United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 30

SEQ ID NO: 142560 - protein, 71 aa, Triticum aestivum
  Clone ID: PAT_TA_36978.pep
DLLPEITESYTPPTSVTPSKAAYTEVSSHRTSPNLPQAQGGHMTPPGSPYPAFEQGHVDESGADWCSAGGV

SEQ ID NO: 142561 - protein, 50 aa, Triticum aestivum
  Clone ID: PAT_TA_36979.pep
SLNLNLAIFMVFVILNRFCSLVSMQIVHPSEPHVVYRTHLDLDDRFFCVA

SEQ ID NO: 142562 - protein, 119 aa, Triticum aestivum
  Clone ID: PAT_TA_36980.pep
GVLPRLGALTSQFSEAALFLPWEEGMSASPSLLSSEEGALVSPDTVCDLPPGWRPPSAPPLFSFSSSTGTWYGAGTSIHASMGLAESSTRGAEHLICSAFFIQPWKKMVFSASYHEMCI

SEQ ID NO: 142563 - protein, 103 aa, Triticum aestivum
  Clone ID: PAT_TA_36981.pep
VASVALFTPVSASPDLNTTAVATHSLSLFSPLVTDPSGSSLPGKVRRCNVHAVVLGDGSYPLLGASRSAFLVVLSQAPLAREGLRPLIPRCRSVGRSGLPSPT

SEQ ID NO: 142564 - protein, 61 aa, Triticum aestivum
  Clone ID: PAT_TA_36982.pep
FVCCQPAELNHLTKPFKMGLELTNHRFNFDKFRVSMRVTVKRSAGHARITWIGVAYLMKAG

SEQ ID NO: 142565 - protein, 83 aa, Triticum aestivum
  Clone ID: PAT_TA_36983.pep
DTAGKKPKAEMRPSKSNEGGADKMNKKAKKIVETYKIYIFKVLMQVHPDIGISSMAMSIMNSFINDIFEKLAGESAKLARYNK

SEQ ID NO: 142566 - protein, 82 aa, Triticum aestivum
  Clone ID: PAT_TA_36984.pep
KVVVFDQITITHNFWQITVCIRPPCINVSTQKTVFDIHTNINVFLGFTMWDVHTNENDWVLMPRKIAHELILPQPVCQDGLS

SEQ ID NO: 142567 - protein, 62 aa, Triticum aestivum
  Clone ID: PAT_TA_36985.pep
LQVIYRWLVEERGGCHPGHLGLLEYYLGVPRASSSLGFSTPYSFIHHDLTQNLKTSAHKTQK

SEQ ID NO: 142568 - protein, 46 aa, Triticum aestivum
  Clone ID: PAT_TA_36986.pep
MTMIYPTARRNVGRRKTPPAMDKSPIIGSSSTSQGMDDVHHYLIDK

SEQ ID NO: 142569 - protein, 120 aa, Triticum aestivum
  Clone ID: PAT_TA_36987.pep
MPSEAQPEEELIISAPNQPEDNAQTEDNPPNDDNDQQEQSLHPVHPRVANEVQIEKIIDSINASGPLTRSRATQLANFYGHFSFVSISEPKKVAEAFMEPEWIQAMQEELQQFKLNNVPE

SEQ ID NO: 142570 - protein, 80 aa, Triticum aestivum
  Clone ID: PAT_TA_36988.pep
CVATCKWCQKARRLCPRVRCSLTSLKWPHFSPWPCMINLRHHALFLFLVIFVFSRVFLIKKADKWLDVSQLAHGVEIVQI

SEQ ID NO: 142571 - protein, 104 aa, Triticum aestivum
  Clone ID: PAT_TA_36989.pep
SLIHTKHRSRYILYSSSLSPTHTLLGMMDRPSTSTNPLFIEQDEDPNNYVTKNHLLARKELYIKAMKHWATTWTYLLPTCDNPSNVQKTTSTHPWHLSRRTSEL

SEQ ID NO: 142572 - protein, 132 aa, Triticum aestivum
  Clone ID: PAT_TA_36990.pep
GRRDYGEKDVSSVYERGTKTQCLRDKPIDRLILDRVVTLLLSLLGLGGGGRERHIESVRGRHRRTTSECVYVGVFERGVDRLRSRSRCHPYAIGVRYCVCVCACVLERIDSIEDYQDRGVTRLVRCPEVCVR

SEQ ID NO: 142573 - protein, 123 aa, Triticum aestivum
  Clone ID: PAT_TA_36991.pep
IHPHEITERAFLLGVTSGADGEGMTNAIHLGGHLLGHRWSCHCILTLAGGARWCIRYSSAALRIGALARVGIKALAGHGLLRPGSFTSKYLALCSCCCFPVDLVGTHNSILLVATDRDDTYWA

SEQ ID NO: 142574 - protein, 76 aa, Triticum aestivum
  Clone ID: PAT_TA_36992.pep
YQLQVQAFVHRRRGACLAREGSPLSCTTVRRTVILLSPLLLQTNTGNRKCHPKERNGFDGSTEMNSDGRRSAARQP

SEQ ID NO: 142575 - protein, 57 aa, Triticum aestivum
  Clone ID: PAT_TA_36993.pep
VEGHEHQQARRGAPWSLWEHAKPKAITSHWIGEQIHSPIRFRYLWVVKVNPLCLRVP

SEQ ID NO: 142576 - protein, 54 aa, Triticum aestivum
  Clone ID: PAT_TA_36994.pep
LLSKAAIYSLTIGIIHVLPVLSHYAPSSTCQPAALQIAISSQTKSSTLSELLAI

SEQ ID NO: 142577 - protein, 129 aa, Triticum aestivum
  Clone ID: PAT_TA_36995.pep
SLSKSQPYQVPITIPISRITLFASCFPLPHFTLAVLFALSFPISSSLSLLPFSRLSFCCLCVGLLVTMAESKGTKGFLPSSSALDNLSILSKLINNDATERPTGITNKNLDDFDDDDSGIFRYLLDESL

SEQ ID NO: 142578 - protein, 85 aa, Triticum aestivum
  Clone ID: PAT_TA_36996.pep
EEYRQHDGVVTILMFYRRRASLKHRYNIIEEYGGRGHRTRLRKRSQGSTCVSRGAPAPVYRGARGGGRPALLACQGGVLLLVGVG

SEQ ID NO: 142579 - protein, 97 aa, Triticum aestivum
  unsure (1)..(97): unsure at all Xaa locations
  Clone ID: PAT_TA_36997.pep
RRIRAPATNDAGGEGNTRGRKNGIKANKGVXDXKIYIFKVLMHVHPDICISSNAMSIMNSIINDIFEKLARDSANLTRNARKPIITSREIQTSVRLV

SEQ ID NO: 142580 - protein, 83 aa, Triticum aestivum
  Clone ID: PAT_TA_36998.pep
GIEAVIYLHEGLPLPKCSYNFQGRARAFTCRVNDKEARAQSDISLTVSSGSPSHVSLVSSSPSLASPSSSPASPSPLSVSPTP

SEQ ID NO: 142581 - protein, 66 aa, Triticum aestivum
  Clone ID: PAT_TA_36999.pep
FLQLWVLMFFVIKWHNISQNYHKMVVYHTGTRITNYRCVVQHNVVLRETSISNDLLDLKAQSRTEP

SEQ ID NO: 142582 - protein, 120 aa, Triticum aestivum
  Clone ID: PAT_TA_37000.pep
IKGPLETPRSYYALSGGAGKAVSTGSKIALESPRTAEKPSAGDIVSMVMKRRRAMPRSDQPSEAGRVKASGGIFGYVRESSGKQEKEKEGLASSGEGEKTQSKGVVVAASRGAADAPVSA

SEQ ID NO: 142583 - protein, 70 aa, Triticum aestivum
  Clone ID: PAT_TA_37001.pep
RFPQQQQHHPLLPGLQKPAHLQHHVKLSAVHTGYVQSPDPTMMQVPRDLCNVNHWMIGSPHKSLQKRLSA

SEQ ID NO: 142584 - protein, 68 aa, Triticum aestivum
  Clone ID: PAT_TA_37002.pep
FWARHSFWREFRISAIIHWKTLEGEGRSDINYREGENREHLCRASCLTVSRRFTSFSRACVHSLFCKY

SEQ ID NO: 142585 - protein, 51 aa, Triticum aestivum
  Clone ID: PAT_TA_37003.pep
ITMFSRYLNFGGPLHLCFAVSERASEIPLLSYYIMVVLTMCCRLRHLIIAR

SEQ ID NO: 142586 - protein, 77 aa, Triticum aestivum
  Clone ID: PAT_TA_37004.pep
DNVIDFLNYSAHSKRCPCISIFMTSAVCCQCPLQHYPTPDALCNRAPVAFLANIQWNIPVGHFCKQHHYQLRLVIAH

SEQ ID NO: 142587 - protein, 80 aa, Triticum aestivum
  Clone ID: PAT_TA_37005.pep
FPCEINRPQHRGTTTGGIKHVAITIRWPFIVIATKQFCERAHDWGMIQHIELSLIHAWACILLRDANTYICNYDHDEQDA

SEQ ID NO: 142588 - protein, 38 aa, Triticum aestivum
  Clone ID: PAT_TA_37006.pep
NPIICVGAKAAATLKTPFRCTRARRYIVINYHLAYRSN

SEQ ID NO: 142589 - protein, 82 aa, Triticum aestivum
  Clone ID: PAT_TA_37007.pep
VCRVFLPKLSSHVYGGTPSLILRPSVMVATPPFPSALQISSTRKRRRSDPHNNSRHSSSLIYGGHSLTHFSTIDDGRNSFFP

SEQ ID NO: 142590 - protein, 110 aa, Triticum aestivum
  unsure (1)..(110): unsure at all Xaa locations
  Clone ID: PAT_TA_37008.pep
KSTAKEGRDKKGKKKAKKSVETFKIYIFKVLKQVXPDIXISSKGMSIMNSFINDIFQKLPREAAKLARYNKKPTITFPGIXNSVRLVLPGELSKHAVSDGTKAVTKFNSS

SEQ ID NO: 142591 - protein, 66 aa, Triticum aestivum
  Clone ID: PAT_TA_37009.pep
ERHDVEWSLVEPSGVVGDEDKRAETDLAAFSQSSTGNYDDGNRKNHNFCNKLLRHLPQGGRQLSWF

SEQ ID NO: 142592 - protein, 107 aa, Triticum aestivum
  Clone ID: PAT_TA_37010.pep
LHRLSGLDMRFIGDHLWPEGPMPNSYFGIVQQFIGVVPHIDAVKRSACIEGARMALARVKTYWAEMEATTIASQSSAVGRVSAEHYFEEVLEGAHVIEAQCSKHIMF

SEQ ID NO: 142593 - protein, 58 aa, Triticum aestivum
  Clone ID: PAT_TA_37011.pep
PWIPHGRSPALMLPAFAHSLRHVRVDLLSTTVPLVRRIRAGIINSDELRRLPSLEKNA

SEQ ID NO: 142594 - protein, 126 aa, Triticum aestivum
  unsure (1)..(126): unsure at all Xaa locations
  Clone ID: PAT_TA_37012.pep
NVKVIYARAKQYSEEYDAQDKELVQLMRKARFNGGFYVIHEANPLYAVIIRRINAMHPKHTKILQLLRLRHIFNGVFLNVTTATINMLHMVDPYVAXGYPNLSNVMELIYRIGYGKLIKHRIPLTN

SEQ ID NO: 142595 - protein, 109 aa, Triticum aestivum
  Clone ID: PAT_TA_37013.pep
LQHTSKSQTVFAVGFITSRSLKLDPILIGLTELFFTKKPKKIQKTKKTKTKKRKPKTRKLVHICAFHSFSEAHLCFFTFREVHMCVTMKHICAFHFSESTVVESITMFF

SEQ ID NO: 142596 - protein, 62 aa, Triticum aestivum
  Clone ID: PAT_TA_37014.pep
GQMEGLGDASSSFLNPNLTGARPLCSSPLESRNFLSRTQLFQGSKSQIHSRCKGIFIPNMFW

SEQ ID NO: 142597 - protein, 141 aa, Triticum aestivum
  Clone ID: PAT_TA_37015.pep
VIDSIFTCPINKNNIQSMWTPRDDTSRGKAPAPSCGESSSCHTKPFVKPFDRLARFIGKSHKAIFDTCRYTATHIATEEVRRISEANALRAHLRARPGSPVEPDEPIPARLPLLEVDFPSATEFPEFFPVPADRSDGDVDD

SEQ ID NO: 142598 - protein, 64 aa, Triticum aestivum
  Clone ID: PAT_TA_37016.pep
DGNDELQHKYFYNPQVPASMTLRSPSLTRKHMGMSAKQTLQLLASSFHPHPDANAACSFSMPST

SEQ ID NO: 142599 - protein, 63 aa, Triticum aestivum
  Clone ID: PAT_TA_37017.pep
ICQIKQTTLRNLNISKTEPSVAILLVGILDSLRYHPKHSHDLGNLTIDLSQRGVNVLLCIRYK

SEQ ID NO: 142600 - protein, 65 aa, Triticum aestivum
  Clone ID: PAT_TA_37018.pep
CVRANSSTYKVTMECPRNRMLPSMHHVDVVRVILVLLYIPLQVGMHAYGFNIFAKLDWHRTKPYA

SEQ ID NO: 142601 - protein, 74 aa, Triticum aestivum
  Clone ID: PAT_TA_37019.pep
MLIKLELIQTLFMLIPITYSHGDLNTYDACFTKLLGHVIALKTSFMQNYLLSAISCIVVPCFKTWVACEYIKIT

SEQ ID NO: 142602 - protein, 65 aa, Triticum aestivum
  Clone ID: PAT_TA_37020.pep
VLNGMLQIPSIAFPLPHICPKPKVKLGPTNSFYLAPPSLDVLATATNPRQISLTDRDLGLTEMGL

SEQ ID NO: 142603 - protein, 85 aa, Triticum aestivum
  Clone ID: PAT_TA_37021.pep
MADPAALPIVPCPDCGRNVVTYVARRGQNAGRCFYKCRNHNPSSGGCNFYRWQEGYAARLANLEGGEAAVGQIGPGQMGGQAVEA

SEQ ID NO: 142604 - protein, 96 aa, Triticum aestivum
  Clone ID: PAT_TA_37022.pep
PNGIMPPVWMNSDITATVSWACILTGILSLYNRYYCCANPDMGKHDLINAYVSRMWTATLKATIGCHTGAKRSRVHLQNHDTLKAKLHPICSHISG

SEQ ID NO: 142605 - protein, 94 aa, Triticum aestivum
  Clone ID: PAT_TA_37023.pep
IYLNVRSSRDTVYTFSHRLFILVCSIMFPQYVVVMIDHDVSESMCQFMSELQLCITSSLRQNETSSVTYIRRATGDVQSSRSVQIDLRIAGAFP

SEQ ID NO: 142606 - protein, 104 aa, Triticum aestivum
  Clone ID: PAT_TA_37024.pep
PKIQTFRIYQGPIRKPTARIPRQQHCGITDNITSLRFTSERSSEMEQIPYRAVQLNLWIKIPFMPGTKYHPLQLNILHQRTIQLAELEASEIVSIYAFSISCKT

SEQ ID NO: 142607 - protein, 115 aa, Triticum aestivum
  Clone ID: PAT_TA_37025.pep
RQRHSWWLHMWIRPGKLMWGGGGSKVEVAAPGGDDRNVLLMGLVVSVSIDSFGLHDRRGADDWRCGALVLCWLGTFSKEASCSLCVIVLPPDLDFGRSSVKDSGRREVLGITLGG

SEQ ID NO: 142608 - protein, 62 aa, Triticum aestivum
  Clone ID: PAT_TA_37026.pep
FYFASKSVQFFQPRNWHVLHHTTAHTNFLSIPHDGFSTPTWPYLNSFCTSITTLNHSTCLPY

SEQ ID NO: 142609 - protein, 53 aa, Triticum aestivum
  Clone ID: PAT_TA_37027.pep
SVQAHFICTMIHVRIWVIIRMVLQCIQRDALEIFDVARKTFSREMSPIYYGIV

SEQ ID NO: 142610 - protein, 51 aa, Triticum aestivum
  Clone ID: PAT_TA_37028.pep
APRGANFKLEGFMDSDWAGDKVDRKSTSGGCQFLGCSLMCWSSKKQSCVSL

SEQ ID NO: 142611 - protein, 70 aa, Triticum aestivum
  Clone ID: PAT_TA_37029.pep
SNHVFHSFFSRYFTFSRSNPYLVQSCYWPYLFTCSIIQYPHNQTHLSHGCKLLRMLYYREGPEISLRHMK

SEQ ID NO: 142612 - protein, 141 aa, Triticum aestivum
  Clone ID: PAT_TA_37030.pep
DGEFQTDGLIRIKVGLSGILMVKGTPYSHMNQVRRNEEMHGTLLSENVIGVIHDHYVTFRLDMDVDGADNSFVRVDMARQDTAPGESPRRSYLKATRHVASTEKDARVRLKLYEPAEFHVINPTKKTRVGNPVGYKVVPAG

SEQ ID NO: 142613 - protein, 61 aa, Triticum aestivum
  unsure (1)..(61): unsure at all Xaa locations
  Clone ID: PAT_TA_37031.pep
SDLWVVNRMKDTPGRKLAXHLNGSLKGRKMYILKIGPSIKRAVNRPKSHRADIEPKYIAGC

SEQ ID NO: 142614 - protein, 63 aa, Triticum aestivum
  Clone ID: PAT_TA_37032.pep
SKLNHAPTSSHNERPYVHASGIINLNTNILTKPQLLTGMTLISPSLYLKTNVRNQTSHIFNTS

SEQ ID NO: 142615 - protein, 58 aa, Triticum aestivum
  Clone ID: PAT_TA_37033.pep
GIDGTYGCALQQKRKLRCLPKHPSVQHDGVGKRMPRNRRNTNHPLLSITTGHGCVATE

SEQ ID NO: 142616 - protein, 56 aa, Triticum aestivum
  Clone ID: PAT_TA_37034.pep
RVDRYSYEKTTEVDGEYATLDAHANRSARVDWLRCNVRLSSTQDHKGCACLEGLSA

SEQ ID NO: 142617 - protein, 122 aa, Triticum aestivum
  Clone ID: PAT_TA_37035.pep
LDMFTKWIESRPIKKLDGPTVVRFIKDIEVRYDMPNNISTDNGTNFAKGALEQYCSVSGIRLDLASVAHPQSNGQVERANRLILSGIKPRLIEPLVRSPGSWLDKLPAVQWSLCTTPNRSAR

SEQ ID NO: 142618 - protein, 80 aa, Triticum aestivum
  Clone ID: PAT_TA_37036.pep
SVRVSSIQIIQVRVQNKGKSIWKSRYDGDVSTPPSLNLCFPSSNLVDKLKVIKKNFTNSVCSCCCKYVKPTFRFSAKIMN

SEQ ID NO: 142619 - protein, 89 aa, Triticum aestivum
  Clone ID: PAT_TA_37037.pep
DESLKDASDRLLRIRASYVPQYQLEIYLKSFYLGLPSSFKQVSDSIFENGFLEGDAVETYEKMKTIFGHPKGENVESTTLMYFYQNEKN

SEQ ID NO: 142620 - protein, 105 aa, Triticum aestivum
  Clone ID: PAT_TA_37038.pep
KGELAMDGVQSSRSRTTRNKGAATKDAEKNERAHRLAETSKDLSREGEGSQERPSRGGKHAELAALESLSLNNMPDQLNKQEEFIDGLVELLKESLDTSHWGLMH

SEQ ID NO: 142621 - protein, 98 aa, Triticum aestivum
  Clone ID: PAT_TA_37039.pep
GRTLILNLEGGILIPVGSGTPIGGALGRAGPSRLLFIDKRGQGAPIGDTRLINVIMFLAVCVAPLAHYSLVNILALLRGTPATIVHQDRHHAVVLTEL

SEQ ID NO: 142622 - protein, 89 aa, Triticum aestivum
  Clone ID: PAT_TA_37040.pep
MPQAAGVYKLILLITNERGDTIYSDNKPTFTAKPRKSPLLPTPAARPSCLRPRLERSSSYATSRPSQQLSPPLCPSLSRLFPSPSSLCH

SEQ ID NO: 142623 - protein, 67 aa, Triticum aestivum
  Clone ID: PAT_TA_37041.pep
TVLLQLDNSFTHYLHLSSRAVSENLGASAKSKFRSRSYEIVMERSFFKLPYAQHTFSKSYMVQIKMN

SEQ ID NO: 142624 - protein, 64 aa, Triticum aestivum
  Clone ID: PAT_TA_37042.pep
DSHVCVGYSALQLIIAQFTDRITNLLYTPIGYEVHCSMCYILHGSVCPCFKFDAGGISNSSCVS

SEQ ID NO: 142625 - protein, 76 aa, Triticum aestivum
  Clone ID: PAT_TA_37043.pep
LVICPCVAARKAHLSPLSFLRSHPPPSEPKLSPPFHEKLPLKHMTKAGDQASSDGQGENIIWTSSSRLQKNDNTDS

SEQ ID NO: 142626 - protein, 87 aa, Triticum aestivum
  Clone ID: PAT_TA_37044.pep
CFSTDLLSGHLHTHGSCASVKDETLKGKTQITDYSREHIPLLRDNTSSKKKNIQVTPVSCNMDESLMVERYGRTKKKKKKKKKKRPL

SEQ ID NO: 142627 - protein, 67 aa, Triticum aestivum
  Clone ID: PAT_TA_37045.pep
ILKLTRKIKICSLIFTPSIRLYRSFQLVSEPRALVYGFTTLEDMVDLGNEGGCAPIAEDGQYLPPRR

SEQ ID NO: 142628 - protein, 70 aa, Triticum aestivum
  Clone ID: PAT_TA_37046.pep
QKQGKNQIKGNGAKNLVSNFLRHRSFLPLISLFTHLQGSVYIRTRTLIGDNLCSHISCNLYNTHNLNRLN

SEQ ID NO: 142629 - protein, 81 aa, Triticum aestivum
  Clone ID: PAT_TA_37047.pep
FATYVEVSELPDTKWKLIAENKPSPRKKNYFPSTQVLFSLQFTSFSRIHHVSPPVKDPGKMYHSISPARSHRYKPSPTPSA

SEQ ID NO: 142630 - protein, 104 aa, Triticum aestivum
  Clone ID: PAT_TA_37048.pep
LTTGTKKRSRHCRESRVDLQLGQKNRAPDANQGWTCNEDTNCWAQLRVEGGLATGKKKGGAKLRVKGGLATGQKKITPQLRVEGELTTNKNMLGSVASRGWTCN

SEQ ID NO: 142631 - protein, 101 aa, Triticum aestivum
  Clone ID: PAT_TA_37049.pep
FSVMHAFLSHFLSHACTHHKSFSVALSLFLRHEIIASIVLVVAGDVQFGPGTCVLLQYGPGTRKYVLNTVSEVETVVLALHVAYVSRISIADGPICLWAEK

SEQ ID NO: 142632 - protein, 65 aa, Triticum aestivum
  Clone ID: PAT_TA_37050.pep
VQMEAICGACQKYTTKPNLILFGLVVLSMCTTCCLHLNLIRQHKLFNHHHSHNINSSYLIIIVIV

SEQ ID NO: 142633 - protein, 65 aa, Triticum aestivum
  Clone ID: PAT_TA_37051.pep
LTTWLFLSNAPITVRYVSDSATYCTYTLVEKELPWHMLHHGREHVPTLRHLRIVSHFENRTVNKF

SEQ ID NO: 142634 - protein, 53 aa, Triticum aestivum
  unsure (1)..(53): unsure at all Xaa locations
  Clone ID: PAT_TA_37052.pep
HHVYPIYLIIDFSPSISIVVQFFQFEPIFACYSISFNNPSIFCCAXLAMQQIM

SEQ ID NO: 142635 - protein, 101 aa, Triticum aestivum
  Clone ID: PAT_TA_37053.pep
LFTVFSASQPSDHLNVRYRSALDRLQVISRAAAPQNERPFLYVIGPPKAQVQSKYFHGHGPQVVQRHSPTAHFPFRPLCHCPSVVRDVPPGFAALSQASVV

SEQ ID NO: 142636 - protein, 48 aa, Triticum aestivum
  Clone ID: PAT_TA_37054.pep
MGQTSRRQEELATMTEGYSGSDLKNLCVTAAYRPVRELLKKKKKKKKK

SEQ ID NO: 142637 - protein, 81 aa, Triticum aestivum
  Clone ID: PAT_TA_37055.pep
PIESLRSTPAINQNTLVSPEVLCRLLGTRSNGIVVNNPRDGHHRYPDPAAPQPHPANLDGETRGEASTSTRHARLDINEVE

SEQ ID NO: 142638 - protein, 60 aa, Triticum aestivum
  Clone ID: PAT_TA_37056.pep
LCGLALNKVMLESSLLFLYHHKFVQSLFFLIIKDHIYLGEICIAFCTDDKLLRGSHSIHR

SEQ ID NO: 142639 - protein, 96 aa, Triticum aestivum
  Clone ID: PAT_TA_37057.pep
TVDVPRCSGQKHMMLLLLPLQHFTYTLRQMCVKFTLEIPCKGEIYKRKVVDARERAVAQRHWSVCPAKEVIQPFGGCNWKVLWSFLGEISQSVRCR

SEQ ID NO: 142640 - protein, 35 aa, Triticum aestivum
  Clone ID: PAT_TA_37058.pep
LRRTYPMCVGTSAATLGLSINSASVLHQYPYRDNV

SEQ ID NO: 142641 - protein, 83 aa, Triticum aestivum
  Clone ID: PAT_TA_37059.pep
TYSTTVGQADTLVEGWDAENRRRTEFRRERLLAPGVPPVLSEEEYGATVRRLALFAQHEWEISARWSMSLGVHWEAWRTVRAV

SEQ ID NO: 142642 - protein, 63 aa, Triticum aestivum
  Clone ID: PAT_TA_37060.pep
SLREGEIITIVITNAPLIGRGQSPSTPAPSHLQTLVHLLYPILVSKSGIGASRLLVVLITPCS

SEQ ID NO: 142643 - protein, 111 aa, Triticum aestivum
  Clone ID: PAT_TA_37061.pep
CFKQNKEKHLKRPCLSLKFESLIQICSNPSGFSCISPTHSYCHVSCMHHIVAHCLVMLVYRCPLRQVLSPRSTVITLTKNHIRASNHQASNQPFDHIDTIPCSRSCSLLLH

SEQ ID NO: 142644 - protein, 139 aa, Triticum aestivum
  Clone ID: PAT_TA_37062.pep
EFSNIEHSSIKRAVTIFLAHEFIFITREAKEIFAHYRVDAGRPPIEAILYDQEEIRRFQSLDYVAFNENLRKKVPINVLVDCINELNNDFFLRNNELGYSLEYKLTRFCQKNAFSDEIVVHYEGPREEPVPSVIDLGDF

SEQ ID NO: 142645 - protein, 72 aa, Triticum aestivum
  Clone ID: PAT_TA_37063.pep
NCAPYRCAGVSIWSALLFIPPGFDGPCWLPTAGSALRRKDFPCKTKHNWFLTNKMSMDGSSEEYWDFDLGHL

SEQ ID NO: 142646 - protein, 65 aa, Triticum aestivum
  Clone ID: PAT_TA_37064.pep
NQIFPKLSRSTFICFFPFLPPCLEQTMPNSPAYRAGKDPPSPFFSPGLYRWIARSSKNPSRVLYS

SEQ ID NO: 142647 - protein, 82 aa, Triticum aestivum
  Clone ID: PAT_TA_37065.pep
NSTIALSIKSSPGAFADLPRSVSDAAEFYHAEEGSSTEKLLWSQYAGAEHLMPLSDQLKQLVELHRVGEVGRHRFHSPDVAW

SEQ ID NO: 142648 - protein, 95 aa, Triticum aestivum
  Clone ID: PAT_TA_37066.pep
YLYSQKLREILTLLCCIIPSSSWKTNASSRRSRKDFWRHCRGVYAKSQHTKYPSQSLSLALHYLPFASRFPLPHFTLAVLFALSLSLSSLSICLF

SEQ ID NO: 142649 - protein, 52 aa, Triticum aestivum
  Clone ID: PAT_TA_37067.pep
PPYMLVLAAAPPYTFTLLISLNSLDREGVRLLSPRDSQIASKPSLQVPMRPP

SEQ ID NO: 142650 - protein, 64 aa, Triticum aestivum
  Clone ID: PAT_TA_37068.pep
YRCFNLVYIVIFELRTMHMGNLFRIRAILDLEKLALTRLLCYCVGHMFESIQSFLTTMVFIMYI

SEQ ID NO: 142651 - protein, 137 aa, Triticum aestivum
  unsure (1)..(137): unsure at all Xaa locations
  Clone ID: PAT_TA_37069.pep
DAARYRGAAHPLCFTDEVMDHEFPEGFKPINIESYDRTTDPAVWIEDFILYIHMSRGDDLHAIKYLPLKLKGPARHXLNNLPENSIGRWEDLEEAFLNNFQGTYVRPPDADDXSHIVQQPGESARKFWTRFLSKLNQ

SEQ ID NO: 142652 - protein, 66 aa, Triticum aestivum
  unsure (1)..(66): unsure at all Xaa locations
  Clone ID: PAT_TA_37070.pep
RXETSRPLRDPRPSTAQRSTTLYPSSRPLTPMSHLSSVKGFNTMSSSLDESTLVKNRAIAPVGKGL

SEQ ID NO: 142653 - protein, 90 aa, Triticum aestivum
  Clone ID: PAT_TA_37071.pep
FFFLSLLFLLGSQLLPIQPLKKTSPLPTRDELQRRRQQLVVSGGSGTVWSAAAAASSSRERRRQDLLTVAAASSRGYVVLQFDSSLAGRR

SEQ ID NO: 142654 - protein, 52 aa, Triticum aestivum
  Clone ID: PAT_TA_37072.pep
TGKITLGVVLGSLDNFQRDDLIFDIVTFRSGYHALLGGNAFARFNTAPHYAY

SEQ ID NO: 142655 - protein, 60 aa, Triticum aestivum
  unsure (1)..(60): unsure at all Xaa locations
  Clone ID: PAT_TA_37073.pep
XERGPHGRSLYIGGIWFSPCCNDPLRREMSPVMHPPPQPQGSPTVITFYYDISLGWIMDP

SEQ ID NO: 142656 - protein, 80 aa, Triticum aestivum
  Clone ID: PAT_TA_37074.pep
GRLPVVGNVLLPPPSSRMHSSFMLLRPGADYVAASSISSWSSPFPGARSPSSLLTETGDEKREKVRRLIIHVVNKEGCWG

SEQ ID NO: 142657 - protein, 77 aa, Triticum aestivum
  Clone ID: PAT_TA_37075.pep
WRNLQYMPLGKIVAEQAVSALYQSNVGCWATRKTLTRSTTAPLLMFPEGHQFYPIRNIVEQQLEFKQFSIPSHQVTL

SEQ ID NO: 142658 - protein, 110 aa, Triticum aestivum
  Clone ID: PAT_TA_37076.pep
PGSTGVPKLRRLSAATTDTSSVLLRRHRFATSGGEEPARTGMRWRPPPTKAASYGTDGVSRRLAATGSITWPAGELAYVFRTTGLLGMNSTGYFLIAKQLRTSGLAGKFF

SEQ ID NO: 142659 - protein, 63 aa, Triticum aestivum
  Clone ID: PAT_TA_37077.pep
HGSTALTNSPLTGLVFSGPQLVRPASFLGPNGHWCLHTLRQAHNLLWPIFDPYFSWAFCGPIT

SEQ ID NO: 142660 - protein, 78 aa, Triticum aestivum
  Clone ID: PAT_TA_37078.pep
SRVDEAHYYQSNHLDATLSHCCIKSFHLSVSAMTGRPFHKNINGHVIWSPPLFHHTTHRFKGLFRHILYHEVSSTIII

SEQ ID NO: 142661 - protein, 126 aa, Triticum aestivum
  Clone ID: PAT_TA_37079.pep
GSMPISILSIEIIAEDFDFRLDLHKIISCHSDNVVLQEFFFPVLRFLNLPGLLKFPFLFLDEGSHHMTLARSQLEIRHRSVWVLVPEINVIEDQLWIQKQRHICALGSSGPDLPISDVFSKFFIIS

SEQ ID NO: 142662 - protein, 83 aa, Triticum aestivum
  Clone ID: PAT_TA_37080.pep
VIASIYLELHSFDRSSKLLLQSQQPELLTNVCLTIANNDVGDKLAMTWNLVFASIKLGLCFQRIWYLHPKKREFPSEELGTSI

SEQ ID NO: 142663 - protein, 135 aa, Triticum aestivum
  Clone ID: PAT_TA_37081.pep
KQIFLNLLGLQNEEQQGKYLGLPRYVGKSRRLCFEYLRDRIWELLQGYKIKLLSKKGKEILIKTVAQAIPAYAMACFDLTKSLCESISHMICRFWWDNQEDEHKHHWVGWDRLTLPKEQGGLGFRDLHAMNIVMV

SEQ ID NO: 142664 - protein, 91 aa, Triticum aestivum
  Clone ID: PAT_TA_37082.pep
IGTNVSFGYCIAMPWYVVYKGKVPGVYDDWEECRRQVHRFSGNSYKGYATRAEAESRYARYLAGEGRERWRNRMKTSFIVMTAALFYVMVV

SEQ ID NO: 142665 - protein, 90 aa, Triticum aestivum
  Clone ID: PAT_TA_37083.pep
MSGAGGKWVASTVKEKHITNLRAARYLAADIAHRLPDYGQVTPTPGPHERVVFLAHFVHGLGFPLHPFVRGVMFYYGIDFHDLAPNFVLN

SEQ ID NO: 142666 - protein, 60 aa, Triticum aestivum
  Clone ID: PAT_TA_37084.pep
ILGQFELVAAGDPVEVREETWLDLLATTGRCSMSPPLVPCALLGCLNFQFGTLSYEYFFD

SEQ ID NO: 142667 - protein, 63 aa, Triticum aestivum
  Clone ID: PAT_TA_37085.pep
MTKRDFPYVHPRKCTQDNPQGLIKPTWLHPTVHVTSTVLQTDLRFKTNVLPADSSLQDLTAQR

SEQ ID NO: 142668 - protein, 86 aa, Triticum aestivum
  Clone ID: PAT_TA_37086.pep
GRPHMVCLFFNITRQVAICLFTRGRRSSLHQVDNQYTVKLPRGLPFRTEMSSTMCPRGCGSERDGSTCAVRAPLLFVHVPHLSGCV

SEQ ID NO: 142669 - protein, 110 aa, Triticum aestivum
  Clone ID: PAT_TA_37087.pep
MLLEITVKMLSGACSTSLNHDIKLHHNLWEKRITDDTSTEFCVCKTIATNTHATLVNMEQCYIYYKHKVPGVKSSCVSNSRFMVGKEYTCKQYNNKWIDLFNSILLFIQQ

SEQ ID NO: 142670 - protein, 80 aa, Triticum aestivum
  Clone ID: PAT_TA_37088.pep
ALKRLKVIMKCLLRPERRVDARCGGLQPCEIVHDSCNTRLQSENIHGNFVVHRRIDGVEVWLQPASFFFKVLTKFCKDDH

SEQ ID NO: 142671 - protein, 75 aa, Triticum aestivum
  Clone ID: PAT_TA_37089.pep
EALVDWSNQWIDDCCWMGEYKFSHYVWEPHLVCVAWKILRYVDCNCDNEIILFKMLFTYDFKNELWHKYQIRASL

SEQ ID NO: 142672 - protein, 43 aa, Triticum aestivum
  Clone ID: PAT_TA_37090.pep
DALYYCCTFYNIFGSFFAKREKLTCKVKKQFSSSLFFKICFCM

SEQ ID NO: 142673 - protein, 65 aa, Triticum aestivum
  Clone ID: PAT_TA_37091.pep
GHMRQTAQGLSGNAKSLKTELTSAPLCKLALVTTHITKIHGLHLWKDDKTLNKTHVEHQGISCTQ

SEQ ID NO: 142674 - protein, 68 aa, Triticum aestivum
  Clone ID: PAT_TA_37092.pep
VTQGMCGEVWWLQVLGRGKSSSLTTSSWCSLPPCIGMDMELGPFGHERWLSSRHSTSASTSWASYLRV

SEQ ID NO: 142675 - protein, 82 aa, Triticum aestivum
  Clone ID: PAT_TA_37093.pep
LLCSPDKIEAMIGAMPATTRKAVKALAMLSLWEIWQERNRCIFRAKEASVADVLLAIRRSLNLWQQGGVKFFQSPFGDPPGE

SEQ ID NO: 142676 - protein, 65 aa, Triticum aestivum
  Clone ID: PAT_TA_37094.pep
KNVYVIKNYSCSFIKMSQRVFEKCLTGILENAQQHVFKKKMCKKCLRCIQKRYNISAKIDIKTYI

SEQ ID NO: 142677 - protein, 109 aa, Triticum aestivum
  Clone ID: PAT_TA_37095.pep
TEAASVTVFPFLRRGRLPDSGTTAGSGAEFGTKPGRLPYGTSGASPSWRVPSWDPTSASSASRGVEAVGMESTSDGAKDPLDEAGRSSSAGLQVVCGIRRTLCGTKEKL

SEQ ID NO: 142678 - protein, 78 aa, Triticum aestivum
  Clone ID: PAT_TA_37096.pep
QQEESNHSTRHTPLTNEIDVPNQHRFKTKCRTKNAVDRKVSASSSFMKEGSKDLSDNLYEKEKPIYRYWYVFVDTTRR

SEQ ID NO: 142679 - protein, 141 aa, Triticum aestivum
  Clone ID: PAT_TA_37097.pep
PHVILQDTVYAVTDAEYEEPMEQILWRSLLHDVGPAAPPKTLLRAVKSDLLSPPRCRVKAEPPSLPCSPPRYHGIQIGCHVKVERLSPSPRRVMEERLSPPPCHVKEERPSPQPSCTGGGMPHAITVKARRGIMRYLGGRQ

SEQ ID NO: 142680 - protein, 61 aa, Triticum aestivum
  Clone ID: PAT_TA_37098.pep
GDHLFHQIICVSLGSSCAYLSPCILLYRQSFLAVHICLGDYYRWNQLFMMSHSNVLHRMIF

SEQ ID NO: 142681 - protein, 96 aa, Triticum aestivum
  Clone ID: PAT_TA_37099.pep
PGWLPSLRLPARHINRLCHGHVGCEAGIRRPHPLLPTTGTPVPVGLILQRTGDGEMEIGRLPRGPQLSSTGGFERPMRHAMDSRQTDHAVGRALSS

SEQ ID NO: 142682 - protein, 53 aa, Triticum aestivum
  Clone ID: PAT_TA_37100.pep
EQGGCVMIIALANYLRLFGRESKLQFELLYVWDVLICKLYAFGQSRKLNLADR

SEQ ID NO: 142683 - protein, 72 aa, Triticum aestivum
  Clone ID: PAT_TA_37101.pep
GLRKYRPSEIYLIPSPSAVIFTESEGPRIINRLFFYRCLVVIMMFLAKKITLPFLVAAWRYVCVLPDLIVQI

SEQ ID NO: 142684 - protein, 113 aa, Triticum aestivum
  Clone ID: PAT_TA_37102.pep
PGPLRVISVPGDRKDADICADKMYREAAAAIDHSTLAVEAPGGKKTTKSGKSYDAYSGKRTSSECCATVEDAPSRYTGKCMMALAASPETQKESAKEDGTGGTFAISATIDPK

SEQ ID NO: 142685 - protein, 76 aa, Triticum aestivum
  Clone ID: PAT_TA_37103.pep
FLGAVPHIDAEKRSACIEGARMALARVKTYWAEMEATAIPSQNPAVGQVSAEHYFEEVLEGARLIEAQCSKSVMFE

SEQ ID NO: 142686 - protein, 137 aa, Triticum aestivum
  unsure (1)..(137): unsure at all Xaa locations
  Clone ID: PAT_TA_37104.pep
NHFQFAIYFDVIKAKKNLYVDVRSIDTDSMEKDPEYFGEALXMCTRLNILSIMQFNKDFDANLVAQFYATVHLGTDAEWTLTWMTNGKLLSVKWKAFMELLGVEDHGLETPVGFRPYRNTSSTHKQALWPYCSVKKN

SEQ ID NO: 142687 - protein, 100 aa, Triticum aestivum
  Clone ID: PAT_TA_37105.pep
RRRYTNRKTLSSVVPLQHPYPSAHTTFSISRLIKISLLAITKLILKPSRLIHSFPFLFVYVLAQFTVEQSARTRPSHSQGCGFSTTSWSPAERSQGFRPR

SEQ ID NO: 142688 - protein, 94 aa, Triticum aestivum
  Clone ID: PAT_TA_37106.pep
MMKMATGDGSPSGRVSEQGPDWFLVATEACGGGTPDLFCSSMFLEYMDIYRRNKSVRGTMRGPRGWGARLPALWLPRCIPDILSKSPGLLQFQN

SEQ ID NO: 142689 - protein, 82 aa, Triticum aestivum
  Clone ID: PAT_TA_37107.pep
TFYHACCNGTLVAIIVDHPGLLPALHVSKDEALTSEEDSFLIPCLMHKYHIFIEATIRMQRRAPGDSSAKGIRARKAQEEGG

SEQ ID NO: 142690 - protein, 59 aa, Triticum aestivum
  Clone ID: PAT_TA_37108.pep
LAGRRGAREPFIMVPRARTLAVAAGSADSRLHQRHNIVLPNHVPQRTIINLCRLITPRS

SEQ ID NO: 142691 - protein, 96 aa, Triticum aestivum
  Clone ID: PAT_TA_37109.pep
TAPGLGSRNRNTQHIVVAKQNRSIRKTPALCQQIDLPLHHASSPESVQGANSGSTRAATHQVHDGASRASPSFLPGRHHLPPPRRLKDHFDGGVED

SEQ ID NO: 142692 - protein, 104 aa, Triticum aestivum
  unsure (1)..(104): unsure at all Xaa locations
  Clone ID: PAT_TA_37110.pep
TGRRREVLGLIGPYGNRGERPKGMRRAPPLWXQLDKGCSPLFLLPLPLFPSLLLQQGKEESYSRWEXDSPLGAPSSLAGRLPPCSFIYGGRGHPIDTTIDLLIS

SEQ ID NO: 142693 - protein, 77 aa, Triticum aestivum
  unsure (1)..(77): unsure at all Xaa locations
  Clone ID: PAT_TA_37111.pep
PFEPFLGYIMPLVNCILCLRACVILLLRFVVYVPKMPXWVEPMPSXIHVNPRVFTSHTLLVSCQITFQHYNFIECEK

SEQ ID NO: 142694 - protein, 59 aa, Triticum aestivum
  Clone ID: PAT_TA_37112.pep
TGQRTRGVYTGSAPCGEGKSLRSRCGGIDGVSMIRERIRFTWLSSCCFLSLNRLRVVPL

SEQ ID NO: 142695 - protein, 141 aa, Triticum aestivum
  Clone ID: PAT_TA_37113.pep
VFYRGENQKIPRSLRLPVDCIAFQPFRPLCFLSPLLLPGAMVAQLITKYEVRLLTQELHAKDAELRAKDVELHELKEERSAMLLRYVREFTELQKRQPSTTKMLEALAALLQKEGDTIGRQGSRLERERADRDEVQDRLSH

SEQ ID NO: 142696 - protein, 80 aa, Triticum aestivum
  Clone ID: PAT_TA_37114.pep
KSLKKEKTYGVHLPVRCSAVRCMMLFIRKCKKFLQKQKSSAVHFLIVLCFIYTRCEVHSTFSSLKKLCLNKRNQAVLLPV

SEQ ID NO: 142697 - protein, 90 aa, Triticum aestivum
  Clone ID: PAT_TA_37115.pep
PFFLFNCSDTWFDFSFLILPGTEAPLITKALHRPFLMSLLDNLTRYTTDGFVTVFLATGYSIRQNRGQHIQQWRRLLRPTSPLQAPLFHN

SEQ ID NO: 142698 - protein, 149 aa, Triticum aestivum
  Clone ID: PAT_TA_37116.pep
LREVMQHPQAIQMRNVVLHIRDVQGLKGTGSMEARLEAMEQEVFRCKGMVEHGLNANHLMIADYTRDLKVDGNSMKDIIFSFKEQINFLQSQIYDLQNQVFEYEARFKGMSLAAGCRNRETHSSSYDGEPLPWKPEDKIASTSTLPTPS

SEQ ID NO: 142699 - protein, 92 aa, Triticum aestivum
  unsure (1)..(92): unsure at all Xaa locations
  Clone ID: PAT_TA_37117.pep
ANATSHAAHVGKNGTHHGANLTYSYTQVRAAQXSKYLRELXCGMYAMRRKAVGIWGCTDGRKDTAGGAHTSNIATLLTVTNTNCSVRHHTES

SEQ ID NO: 142700 - protein, 132 aa, Triticum aestivum
  Clone ID: PAT_TA_37118.pep
SGSTSRPQPAAHFMGMHQSLGIQLAQLGKDASAAGAARRGSTQRKTVEVESVAAAGKQQAREVVKKSFRAEFIEKLHKDLDDDIDVRALENGFISVTPLNVHGHVEPELEAPASDWLSAAVAVSEEKEAPAT

SEQ ID NO: 142701 - protein, 47 aa, Triticum aestivum
  Clone ID: PAT_TA_37119.pep
SVRYGLFSGLDRTGLFGFSFSRMHAFFFLCFRFQNSSNFSLLITSMF

SEQ ID NO: 142702 - protein, 45 aa, Triticum aestivum
  Clone ID: PAT_TA_37120.pep
GRISPTEHWGQKKFQLKVKTVNMIYVTHIPKRERKRALRDVYVVD

SEQ ID NO: 142703 - protein, 42 aa, Triticum aestivum
  Clone ID: PAT_TA_37121.pep
LSQHLTGPLTLTLTPLSYSMAGIALGNKSLIWLYFSNLRYIQ

SEQ ID NO: 142704 - protein, 71 aa, Triticum aestivum
  Clone ID: PAT_TA_37122.pep
YINPAHRTSNNAPRFLPEKQRQEHASTPMHRLPQCHLGNLRVECQNIYQVNQYDTPLSPRVFNCNTYIYQV

SEQ ID NO: 142705 - protein, 88 aa, Triticum aestivum
  unsure (1)..(88): unsure at all Xaa locations
  Clone ID: PAT_TA_37123.pep
IPRSTGANMCNTELHKGRLEVPRLIKDFIDEVSTQLKMVCESDTDELLLEEKLAFVQESRHAFGTTALLLSXGGASLGSFHVGVLKTL

SEQ ID NO: 142706 - protein, 83 aa, Triticum aestivum
  Clone ID: PAT_TA_37124.pep
LSYLICCFFCLSVMFFFVVKERFYFFFISLFLKSNSYIASTTMHCNVNIFIYIVCVSKPGKFSEKMKQKLWNTRKAEQTSLYL

SEQ ID NO: 142707 - protein, 64 aa, Triticum aestivum
  Clone ID: PAT_TA_37125.pep
DQIISHLDEFYILPNNYQMQPILYSQEIEIVQTIHNSTSSDIGKLHSALGWREPISARTPKLEK

SEQ ID NO: 142708 - protein, 87 aa, Triticum aestivum
  Clone ID: PAT_TA_37126.pep
QEDKHVAIVSRTQVAVGVHRCTELLLLPSKFHLCSYGAQLVQFLVVSKSLLSTENMTKFQRTIVRSELVSLPLAAITGVLSVPSTRE

SEQ ID NO: 142709 - protein, 91 aa, Triticum aestivum
  unsure (1)..(91): unsure at all Xaa locations
  Clone ID: PAT_TA_37127.pep
HPSGLRITRIAAEAVRLVGGGGARWVVLVDDDTVLSPDNLVXVLGKYDWREMVYVGASSESHSANSYFSHGPSPLCSRGHSNVLLERLPRL

SEQ ID NO: 142710 - protein, 108 aa, Triticum aestivum
  Clone ID: PAT_TA_37128.pep
SRRQQISAKWEKRQQCSPKPIRSIPGPKATSGLNKAYQGDGGNALPSSPLTDVIQELYSSLNDKDIARLTELIDPDCTVEHASYYKPLNFKVILSSHLLQYLYHQSNE

SEQ ID NO: 142711 - protein, 81 aa, Triticum aestivum
  Clone ID: PAT_TA_37129.pep
MHSPSKRLITSVSKRLAVSNLQGWADLPDDLLHSIVALLGSSIDLLAFAATCRPWRAAFFSHPSKSTLCFSCPPVLTRKNP

SEQ ID NO: 142712 - protein, 46 aa, Triticum aestivum
  Clone ID: PAT_TA_37130.pep
DGATLHRYMTAIFSDFCEKIVEVFMDDFSVYGKSFDDCLSSLDRVL

SEQ ID NO: 142713 - protein, 69 aa, Triticum aestivum
  unsure (1)..(69): unsure at all Xaa locations
  Clone ID: PAT_TA_37131.pep
EDEDEDEEDDSDDEEDEDSEDEGDEDEDSDEXGEDEGQDSDDDDEDEDEDSDEEEDDEDEEEEEEEDDE

SEQ ID NO: 142714 - protein, 118 aa, Triticum aestivum
  unsure (1)..(118): unsure at all Xaa locations
  Clone ID: PAT_TA_37132.pep
PPTGAYSDGGDWFMDIGASSHMAAYPGNLSSVSPIHTSSRIIVGNGVGLPITHIGSTSFRSTSRPLYLNNVLVSXKLIQNLVCVRKLSRDNSVTVEFDEVGFSVKDALIRMVLHPCDS

SEQ ID NO: 142715 - protein, 124 aa, Triticum aestivum
  unsure (1)..(124): unsure at all Xaa locations
  Clone ID: PAT_TA_37133.pep
HKTGTVQNTLIIHFGVAMLLAPRRPXLHQLLGVHLGPVQLRMGKGPACTFDADGPLYDLQPWAGIYKPPHQAEVAIGKGVARPHPDYKAPHGLLSRLVQLDQLLQLVAHRHRVFGPSILRPVQR

SEQ ID NO: 142716 - protein, 50 aa, Triticum aestivum
  Clone ID: PAT_TA_37134.pep
IQLAKLSRNNGSLKRTAEFIKVHSQRVITRKLTTRELVLNQCRHTGTVVV

SEQ ID NO: 142717 - protein, 92 aa, Triticum aestivum
  Clone ID: PAT_TA_37135.pep
LPSDVTQPPYVSAPFIHHGRQPWAAKHPLLARNSYRQILGRCEITVLSPTDETSKFEMGDTSVTFPYFRQERPKNMVPRTSPSIFPFIHHPR

SEQ ID NO: 142718 - protein, 82 aa, Triticum aestivum
  Clone ID: PAT_TA_37136.pep
GTLARMSLIHNHLVCHQYGRRQINTRCNRCKLFAMCILIIYQTVFSIGQRFLVLQALHSGLHCGRRSRVIPYATIVLRVLCP

SEQ ID NO: 142719 - protein, 68 aa, Triticum aestivum
  Clone ID: PAT_TA_37137.pep
FLGHGGCRNYEVSLSRFSGIPELLISFTLCASLYSRSALHYLTIRVGAYFAGGSKLRDQMSSMSDIPP

SEQ ID NO: 142720 - protein, 108 aa, Triticum aestivum
  Clone ID: PAT_TA_37138.pep
KFDDDNDAGDGDDTMEEEHGKEDAEDGGDEGMEQEEGSDGDEDDFPHAFFFVRYLCDREDCYGMLAPLPPLPNGELSHVFECNACGQLKKEEDEVEADADAGDCSMDQ

SEQ ID NO: 142721 - protein, 95 aa, Triticum aestivum
  Clone ID: PAT_TA_37139.pep
CLLVQGEYKLYHSVWEPPIMCVARKISPSLGCYVDNEIMPLKILFISISKSSAGTSTNPYFPLRMAYLFTFMLSHHHLIKKHQLESTAVICIHCY

SEQ ID NO: 142722 - protein, 76 aa, Triticum aestivum
  Clone ID: PAT_TA_37140.pep
RVAAASLYPTPICDMSVKFCIILNRICERRDRRMLVQITVGDIALCVFIAVHYLSQIALLIQCLSRSSSGGSLIQS

SEQ ID NO: 142723 - protein, 109 aa, Triticum aestivum
  Clone ID: PAT_TA_37141.pep
SDMYENLCMVDLPQIRCQLHDHARQYDNDDVCHDDEQNGGKLHGNISRNGYGNAIVGRYGGCFEEDIRRFMCDRAYCIMGFGCTSEVCTNSQGEKGQCTILKRLAMMEG

SEQ ID NO: 142724 - protein, 87 aa, Triticum aestivum
  Clone ID: PAT_TA_37142.pep
WLPLWQGAGTGSRLVLHGYRGLRLWNSRSRLISGGFWIYRNFWHRFQVRGVHESVTRQGARPPPLSLIRDSSGPTLVLRGLLLVHKK

SEQ ID NO: 142725 - protein, 50 aa, Triticum aestivum
  Clone ID: PAT_TA_37143.pep
ALTHFWALGLRKASSSSSLHGLPIFIKLTRLLLAGLRPIVISPTLGPRLV

SEQ ID NO: 142726 - protein, 108 aa, Triticum aestivum
  Clone ID: PAT_TA_37144.pep
IFTTNVIQETWSGRQETIEEATRQGVRLPPWACCPPSWAPRCSTDVLPPIYIHVPPNIQENHENLIPRPQPFLPKRSHLGAFSGAPPEGALITEGLYINSMASPVMCE

SEQ ID NO: 142727 - protein, 61 aa, Triticum aestivum
  Clone ID: PAT_TA_37145.pep
RAVHDVAAVDAAAYQSCVVPKGKRAMRSGHDKVRLVKGMHYFVCTVRGHCKANMKIAVRVI

SEQ ID NO: 142728 - protein, 118 aa, Triticum aestivum
  Clone ID: PAT_TA_37146.pep
STGQLMVFHHNNCVGCHRHLDAGRTLLQELVQTIGWNKPRFCAYTGQLFCASCHTNDTAVLPARVLHHWDFSLYPVSQLAKAFLDSIYDQPMLCVSAVNPFLFAKVPALLNIMSIRKK

SEQ ID NO: 142729 - protein, 81 aa, Triticum aestivum
  unsure (1)..(81): unsure at all Xaa locations
  Clone ID: PAT_TA_37147.pep
XXLYVKQVRKHNLTGHTRFAVHRNNQVSTPAADRKQASWQRRVKPARRTKKLIAQSPDRQAFQDTGTDRLAGLPVVCPIDP

SEQ ID NO: 142730 - protein, 71 aa, Triticum aestivum
  Clone ID: PAT_TA_37148.pep
VATAYLLHLHFHHDNLVCSYLSRMARGDHQNDDDDFMDPPQRNQATGRRKEGDEVNVHTSPIILISVTRRP

SEQ ID NO: 142731 - protein, 58 aa, Triticum aestivum
  Clone ID: PAT_TA_37149.pep
WLNRFTETRHAKRVLSPLINKLERQLQLVRENQEDTPDERDDGGQFGQQWFTPVLLMR

SEQ ID NO: 142732 - protein, 85 aa, Triticum aestivum
  Clone ID: PAT_TA_37150.pep
SRVDGVPEANSGYNLGPTKPPLARSRFPVSVVRIHVFVERPIRVDAGAERGDLSLPAARPTKHASLSHSSSFRLPRVSPLNPRVG

SEQ ID NO: 142733 - protein, 116 aa, Triticum aestivum
  unsure (1)..(116): unsure at all Xaa locations
  Clone ID: PAT_TA_37151.pep
MDFRAVCRSWRSATDDPSNSSDPRFCPRNWIIIDKAFEPNSCLMVNTASGRVLHKDMPVLRKYYVVAVTTDGALFVLADREHPXRCTRTQPFHRQHDPFHCGRALQHEGIFSRRPA

SEQ ID NO: 142734 - protein, 81 aa, Triticum aestivum
  Clone ID: PAT_TA_37152.pep
LELYFYLPHDMCFAWSVLYYLSLYLLVFHNHPCCTHLFERDTDDLEIVRILYVLHLYLLSYIVFALVLHLYLLGQDGGFVL

SEQ ID NO: 142735 - protein, 63 aa, Triticum aestivum
  Clone ID: PAT_TA_37153.pep
RGIIARPGSFVLLFAEGRSCALAISVMDGALTQPTCYLEIPNAPMYQRHCTLNRKHFPTSLPN

SEQ ID NO: 142736 - protein, 112 aa, Triticum aestivum
  Clone ID: PAT_TA_37154.pep
MTHNRAPATKDAGSDGKTRGMKKGSTANKGVETYKIYIFKVLKHVHPDISISSKAMSIMNSFINDIFEKLAGESAKLARYNKKPTITSREIQTSDRLVLPGELSKHAVSEGT

SEQ ID NO: 142737 - protein, 133 aa, Triticum aestivum
  Clone ID: PAT_TA_37155.pep
MHPLNAVGFLGEEKIAAKVAYLKKTFRWSDAEVSIALRKAPSVLRKSKELLQRRSDFLISEVGLEPSYIAERSVIINYKLEGRMKPRYYVVKFLMENGLLKCNPGYYQTAFKVRENVFMEKFICPHNEVAPHL

SEQ ID NO: 142738 - protein, 107 aa, Triticum aestivum
  unsure (1)..(107): unsure at all Xaa locations
  Clone ID: PAT_TA_37156.pep
DDYSFIFENNGCSSYMSNIFYGHGPNVNGLFLLNLDSSDTHVHKTNGKRCKVNNDSTTYLWYYPLGHIGQSDEKTQTEGXLESLDLESFWNMVSHTSWAKYHQTVFS

SEQ ID NO: 142739 - protein, 140 aa, Triticum aestivum
  Clone ID: PAT_TA_37157.pep
CVRIFPAFVLRWLASEHPGWGSVPSELEFLTKLTFHSMPRHAWNNESMNELIKDLGCELVSMFVPPDSWALTVMAWMKKPSTIPKVIGVEIPVQEPGLYYLSPPRPPRTTLGMYLYRVFVHVEEVVNPSIEVLPRLMLAW

SEQ ID NO: 142740 - protein, 113 aa, Triticum aestivum
  unsure (1)..(113): unsure at all Xaa locations
  Clone ID: PAT_TA_37158.pep
PDTCLLRDEYSFKFENNGCSIYTSNIFYGHGPNVNGLPLCVCCCLGAPVKSHVGREGRGGHRVASHVWHERLTYTREEDRDRGPAVVGSASFVWSAHVXGHVSDPCKRSLSLF

SEQ ID NO: 142741 - protein, 110 aa, Triticum aestivum
  Clone ID: PAT_TA_37159.pep
ALTDKVMDHNFQKGLKTVTIESYNGTTDPTIWIKNSLLHINMAQGDDLHAIKYLPLKLKGPARHWLNSLPENSIGSWEDLGDAFGDNFQGTYVRPPDADDLSHIVQKPEE

SEQ ID NO: 142742 - protein, 67 aa, Triticum aestivum
  Clone ID: PAT_TA_37160.pep
ARAEDQPLHPRPMLLFLIFMEMISVLFIRVMLEPRCMCHSFHQVSNELSVLFLVYLGFLLLNMPMIQ

SEQ ID NO: 142743 - protein, 136 aa, Triticum aestivum
  unsure (1)..(136): unsure at all Xaa locations
  Clone ID: PAT_TA_37161.pep
FQREVRAIRRTSHRNLVRLLGFCHXGAHRLLVYEFMSNGSVADLLFRGASTPSWSDCLGIALDVARGRHYLHDELSSRVTHCDVKPQNILIDAAGTAKIADFRLAKLLQPNQTRTFHGVRRTRGYLGPEWYRGTGP

SEQ ID NO: 142744 - protein, 111 aa, Triticum aestivum
  Clone ID: PAT_TA_37162.pep
ERRRRAAFIGGQEGFGGKKHRAVPGPFNPGRAVPCRAGPAHLTRFDCVSASHFLIFTNLLIVAKMPVRGSIGHIVYCMVTYICIMIFIYLTNTSCFSICLQITREIYICIH

SEQ ID NO: 142745 - protein, 117 aa, Triticum aestivum
  unsure (1)..(117): unsure at all Xaa locations
  Clone ID: PAT_TA_37163.pep
ISFGKSNLLGTGNPVVGLPVNKHCGRLEGKGHTNGHRDVNVLRSGQQNDLDXANLVVLQHLDVLEDFMTLHKETIAKKYRDRGVHRTDAXVIREHNSTFLFWFKERVLANPPEEGCP

SEQ ID NO: 142746 - protein, 84 aa, Triticum aestivum
  Clone ID: PAT_TA_37164.pep
LKVLIRSINRSRKKMLLLVINNLLQNYSGVVVLRRRQYVCGKSMLLLVINNLLQNYSGVVVLRRRQYVCGKRMLLLVINNLLQK

SEQ ID NO: 142747 - protein, 36 aa, Triticum aestivum
  Clone ID: PAT_TA_37165.pep
LEPQLFENYHPVILDSKNALSKSSNKTRNYISQHTP

SEQ ID NO: 142748 - protein, 40 aa, Triticum aestivum
  Clone ID: PAT_TA_37166.pep
NNSVISFIPFIQVAIQQCIFTTPNSVASLPYVNLPPASSL

SEQ ID NO: 142749 - protein, 90 aa, Triticum aestivum
  Clone ID: PAT_TA_37167.pep
FLKVLYIKEVPELVSPCCYLTFRVGFPRKLGFRGLPIFPCSIKGNFVKIALCNLGPVVSVIPLSLYRGLDLIKLTLIELSLQLAVISTAI

SEQ ID NO: 142750 - protein, 124 aa, Triticum aestivum
  Clone ID: PAT_TA_37168.pep
MDNSCPIKNFHARDKEFTYRPGVTYYACGEEGHYAKQCPKPRNSTPKPNNGGNNSAPKRSNFNPNNNHRKGHLNHVTHEEAQNALDIVLGTYPVNTIPAMVLFDSGASHSFISKSFALQNNFSM

SEQ ID NO: 142751 - protein, 133 aa, Triticum aestivum
  Clone ID: PAT_TA_37169.pep
IKKLREARYLTAEISHRLPARGEVVPTPEPNESIVFVSHFLRGLGLALDPFVRGLMFYYRLDFHDLAPDSLLHISSFIVVCEAFLRITPHFGLWLKTFDVKPKMVEGQYAACGGALISKIADAPWPKGSFPEV

SEQ ID NO: 142752 - protein, 83 aa, Triticum aestivum
  Clone ID: PAT_TA_37170.pep
THRYWLDTYSSAYLMTSLCGGSASPARNSIPCKLSLVNAELVSPPVTIESSPIWAAPHIVVDEWENIRESDKDAMAAFTKAHR

SEQ ID NO: 142753 - protein, 81 aa, Triticum aestivum
  Clone ID: PAT_TA_37171.pep
ETLTTSTGVAVLALPLCLSVIYSFSASSEREIKSAHFNPLGNDMPKEENYQYFKVARRSRTNTNKRERAYPLFLSIAFCHY

SEQ ID NO: 142754 - protein, 92 aa, Triticum aestivum
  unsure (1)..(92): unsure at all Xaa locations
  Clone ID: PAT_TA_37172.pep
LRHQGLTAHGGEHPWSRWRRGGGQVPPQPGPLHDVQGRRRHKDAVRVTRPNPTNPWGKKDTTATVHCQPSAAVLLGTFSGGAXESAPVTVPI

SEQ ID NO: 142755 - protein, 39 aa, Triticum aestivum
  Clone ID: PAT_TA_37173.pep
SGHQSYWSCFEHPQHTGYPQLVPVDVPLPRADLYVLVTR

SEQ ID NO: 142756 - protein, 51 aa, Triticum aestivum
  Clone ID: PAT_TA_37174.pep
RLHQRVQLLGLMSNSFKVSSSVHNNHATAGSISQPLCNIPYNNFHQVLSTV

SEQ ID NO: 142757 - protein, 104 aa, Triticum aestivum
  Clone ID: PAT_TA_37175.pep
DEGLTRTVWGPIDTNRILEVPMAPSRIEDFVAWNHTKSGMFSVRSAYHAEWSYRFGRHERNLLGVEGSHIIPGVEEAVELIWVVSTIWNIAEGCRCTKHYLYRN

SEQ ID NO: 142758 - protein, 67 aa, Triticum aestivum
  Clone ID: PAT_TA_37176.pep
VFYFTCVCVCERERSIRNTTTISLDLSVPRTIACNTCINMHILTPSPGPCPPQGPHIALYLARTISS

SEQ ID NO: 142759 - protein, 78 aa, Triticum aestivum
  Clone ID: PAT_TA_37177.pep
AHYQLIKGICHHCIKKKKKKKKKKQKKKKKKKKKKKKKKKKKKKKKKKKKKKKKKKKKKKKKKKKKKKKKGPPKSFKL

SEQ ID NO: 142760 - protein, 58 aa, Triticum aestivum
  Clone ID: PAT_TA_37178.pep
ITQYIYHFIHLREATINMGKECTKKDRRMTCNNFNHPLVWRNIIGTLHDMIFIGFFFL

SEQ ID NO: 142761 - protein, 79 aa, Triticum aestivum
  Clone ID: PAT_TA_37179.pep
VVALPQIRCQLHDHAKQYDNDGVCHNKWNGGKLHGNISQNGYGNAIIGRYGGCFGEGIWWVYDTGESCAVLERLAKVEG

SEQ ID NO: 142762 - protein, 130 aa, Triticum aestivum
  unsure (1)..(130): unsure at all Xaa locations
  Clone ID: PAT_TA_37180.pep
LKCAVVGVPKTIDNDIAVIDXSFGFDTAVEEAQRAINAAHVKPESAKNGIGXVKQRGRNSGFIAMYATLASRDVDCCLIPESPFYLEGKGGLLEFVERRLKDSGHMVIVVAEGAGQDLIAQSMNFVDTQD

SEQ ID NO: 142763 - protein, 59 aa, Triticum aestivum
  Clone ID: PAT_TA_37181.pep
NNYGLGLNKCGIELAFNFSSRKPKTTSLTYVHQQLILSKIYNMKHYGYHKVKCISKGVG

SEQ ID NO: 142764 - protein, 85 aa, Triticum aestivum
  unsure (1)..(85): unsure at all Xaa locations
  Clone ID: PAT_TA_37182.pep
VPXAVPKLCLLFLLQPKSFSVRYKFITVLPTFFVLELLLGKAELVLGPLEVLLQSTDLRSQCGRGQQRSLQSDIDIFLELLRISF

SEQ ID NO: 142765 - protein, 89 aa, Triticum aestivum
  Clone ID: PAT_TA_37183.pep
NGGAVSPSTLLPKLGSGKITKLEGCNNCCQQFPPYFKWKKTKFISIAYDGFRFAFHMKHQHKSLTKKKKKKKKKKKKKKKKKKGSSKGI

SEQ ID NO: 142766 - protein, 115 aa, Triticum aestivum
  Clone ID: PAT_TA_37184.pep
SLLLLPGSFILGGLFLRRLLDLLNVGLLQDELSLAHIQLTLGSPQLFPGLAEPDLRLGDALLKIRLHLVHRRRLGLHLVLAGTVERLEVFEVGGHCLKEVVLLGICVAIAPFVAP

SEQ ID NO: 142767 - protein, 115 aa, Triticum aestivum
  unsure (1)..(115): unsure at all Xaa locations
  Clone ID: PAT_TA_37185.pep
SSSSSSSLTSSLDGRRVSPLVLGSHGXEGREPLRDWIYLYFCVLRSFXSPFLLYPEIHNSDWGESFAQIILVKXLSCGKRRASTALRVAQESAXRAPYLLATSGTVSTSWSMVFF

SEQ ID NO: 142768 - protein, 55 aa, Triticum aestivum
  Clone ID: PAT_TA_37186.pep
WKGRSDGGRRLPMDQIGGSIVISHYFTWSERCPQRQLFRNGGSNFLHNLECSSEL

SEQ ID NO: 142769 - protein, 60 aa, Triticum aestivum
  Clone ID: PAT_TA_37187.pep
RCMWILVTWPWIGVSSVAQRLGSRWIGVVGRLYYMRVQTLLRSHHAGSILLLQLIPSACN

SEQ ID NO: 142770 - protein, 61 aa, Triticum aestivum
  Clone ID: PAT_TA_37188.pep
GCRDEEDPRPSTRAPPQRGTQQPGQSTISPLRPMGNPDSKRFICYVPNPPKRLALSSKTGT

SEQ ID NO: 142771 - protein, 141 aa, Triticum aestivum
  unsure (1)..(141): unsure at all Xaa locations
  Clone ID: PAT_TA_37189.pep
MFIKIEGCRLKWIRDHQREIRADLYQGLVDSIAVGEMRASAVGKRIVLPGTHQGSNRDMKRRQMDAMALVQTYGKPDIFLTMTCNPSWEEILNELLPXKTPQDRPDLVARVFRAKLETMKEMLFKKHILGVVVAHVYVVEF

SEQ ID NO: 142772 - protein, 130 aa, Triticum aestivum
  unsure (1)..(130): unsure at all Xaa locations
  Clone ID: PAT_TA_37190.pep
GELYKKSTTGVLQRCISEEEGRNLLAEIHAGLSGHHAAARSLVSKAFPTGFYWPTARAGAXDLVQLCTGCQLFANQSHMPPTALXTIPITWPFTVWGLDMVGPLKGGTYNQKYILVMGDKFTRWIEAKPV

SEQ ID NO: 142773 - protein, 72 aa, Triticum aestivum
  Clone ID: PAT_TA_37191.pep
MINCFCKGLPRIILLNCGSQGCIKLPIEVVGSYPFFCLYKNEFCGSNSELPYLKELQLFLHVKFSVLVWTIR

SEQ ID NO: 142774 - protein, 113 aa, Triticum aestivum
  Clone ID: PAT_TA_37192.pep
AVPHYDYLKLKMPGPRGVITVNGNTERSLRTEEHTAALAAEVESGLLKQNLNLAAEPRTSLRGSELLYSRRARLARSSTSNLASVLVPIKWWHSCRAYITTHSKSHGQRRRDN

SEQ ID NO: 142775 - protein, 109 aa, Triticum aestivum
  unsure (1)..(109): unsure at all Xaa locations
  Clone ID: PAT_TA_37193.pep
MGNFASSDASSSVKEAQRVSTTSFTPKDSRRKHWDSGSIQDWLETAELVGPRLYSCRHCRNHVCLHDDIISKDFQXRNGRAFLSYHAMNVTXGAKEDRQLMTGLHTIAD

SEQ ID NO: 142776 - protein, 75 aa, Triticum aestivum
  Clone ID: PAT_TA_37194.pep
VQMYPARLTSDLTTYASLSTKGMVGFNCSKPALTRWLPELRLQCNSLRWRTRVHIFTISIHHYASAPVSLRERHP

SEQ ID NO: 142777 - protein, 75 aa, Triticum aestivum
  unsure (1)..(75): unsure at all Xaa locations
  Clone ID: PAT_TA_37195.pep
VINARICIVQNFVDRPSASTXSANSRGVFVLLYKAFMRAKIYNKQGNLAIRFYKQRYAERHVILLFNRRNVFQRK

SEQ ID NO: 142778 - protein, 127 aa, Triticum aestivum
  unsure (1)..(127): unsure at all Xaa locations
  Clone ID: PAT_TA_37196.pep
MMSQENTKLCDFSNTNNNDFISTPIALSTSTESYEINAALLNPVMKEQFSGSPNEDVASHLNTFLELCDMQKKKDVDNDIVKLKLFPFSLXNRAKTWFSSLPKNCIDSLNKCKDAFLFKXFPPDKII

SEQ ID NO: 142779 - protein, 44 aa, Triticum aestivum
  Clone ID: PAT_TA_37197.pep
PRSPRTGLDRVYITVLCDYPPVWFVEPVLQVPGSPKALLPPTGW

SEQ ID NO: 142780 - protein, 135 aa, Triticum aestivum
  unsure (1)..(135): unsure at all Xaa locations
  Clone ID: PAT_TA_37198.pep
KQRQGDRPPHGRDKDEDDDDDEDVDDDETDEQEFQKATEVLCVDGGASLHTSHRQLKXWMREVNAAEPSIESRKPLKWSSTPIIFNIEDHPDRVTAVGCLPMLVSPTIRNLKVTKILVDGGAGLNLISSVVLHKL

SEQ ID NO: 142781 - protein, 99 aa, Triticum aestivum
  unsure (1)..(99): unsure at all Xaa locations
  Clone ID: PAT_TA_37199.pep
WYSALSLFLIYPEIRNSDWIETFTPIFFLPKIXLSCGRRRSLTSLXRGPPGSGARPLPRGSLGHRLALIFFPYFTYIPKIISVRFYPIWTPFDMDFLQN

SEQ ID NO: 142782 - protein, 141 aa, Triticum aestivum
  unsure (1)..(141): unsure at all Xaa locations
  Clone ID: PAT_TA_37200.pep
KHKFPLQKPVYYVSTVLTPCKSRYPHYQKIAYAVLMASRKLXHYFQECHYFQECSITVASEVPLNDIINNRDAXGAKFAKWAIELSXFDIIYKPGXAIKSQVLADFVAEWTEAYSNWIMHFDDSKMLAGLGAGVVLKSPTG

SEQ ID NO: 142783 - protein, 130 aa, Triticum aestivum
  Clone ID: PAT_TA_37201.pep
NVTVYKARLVAKGFQQVQGIDYDETFSLVAMLKSVRIMLATAAFYDYEIWQMDVKTAFLNGFLEEELYMMQPEGFVDPKGANKVCKLQRSIYGLVQASRSWNKRFDSVIKEFGFVQTFGEACIYKKVKWE

SEQ ID NO: 142784 - protein, 73 aa, Triticum aestivum
  Clone ID: PAT_TA_37202.pep
FEPQPSAPHYPEGHDIALPPKSALEAAHAPAPILDSEIAASFEDERLDVTLGAAILKAIEPNASPALRMAHDS

SEQ ID NO: 142785 - protein, 126 aa, Triticum aestivum
  Clone ID: PAT_TA_37203.pep
HNLITQYESRVGVTLKNLKEKEPIVNEKIDLDSARIGKLEDIITNLGSAFSPMKNTPKPSTKITKFIYVPKNKGQTSSKGDADLKSISVHPNCLSIIKEPFATNEFLEFFPKGLFIAKKGETPKDY

SEQ ID NO: 142786 - protein, 122 aa, Triticum aestivum
  Clone ID: PAT_TA_37204.pep
YRVGHLDPKHNLPEKLTTAEWAKLGPTIAKVKALLRNGLTGIDLVRCWVSWWIIPLSRRTVLMCTYTGGVKDPLHHSSAPLTNEEINKMVKSLLNEDPEDCIKVGLETFCKLNPPPDVIPRI

SEQ ID NO: 142787 - protein, 71 aa, Triticum aestivum
  Clone ID: PAT_TA_37205.pep
NPTVLARHTAKQVHYDISHYDHLNANDILSGYLSHVHSSRDLEIEMVKKLQLKYEVRSSNLYSASPQVFRL

SEQ ID NO: 142788 - protein, 94 aa, Triticum aestivum
  Clone ID: PAT_TA_37206.pep
RSRPEAMAAGERPVGAMERGRSRCWERCLVFGLGLLSSRTNSFDRCPDSSGTNRSVWGGPRPNVRPLSASYIFLKGNRAISHQIKSNEPFNIGE

SEQ ID NO: 142789 - protein, 97 aa, Triticum aestivum
  Clone ID: PAT_TA_37207.pep
IRVIASSFHVSRLGSSPCTTPSFLKLTKPFAGTSSIFKSDSDCQDAHLNPSFQQGCNYWRGVCQLHPSSKMVLTVQAEWCIEFQLRNTWGKGQVAYS

SEQ ID NO: 142790 - protein, 66 aa, Triticum aestivum
  Clone ID: PAT_TA_37208.pep
NSSYSLLELTAYQGQHINSSYINRKPGITHKFSTRDSSKLNELSCGVGIKTSLTASFPCTWGNWDH

SEQ ID NO: 142791 - protein, 67 aa, Triticum aestivum
  Clone ID: PAT_TA_37209.pep
LITNCTATFKLVTTCSKLDRSSSIHNRTLLKNSINYLSECSEPQGDVNTRMTASLLIAQQQIFSNAY

SEQ ID NO: 142792 - protein, 98 aa, Triticum aestivum
  unsure (1)..(98): unsure at all Xaa locations
  Clone ID: PAT_TA_37210.pep
TFHRLTLCILNFPQVGEHSVELHVDLNQGSCVVDGRGSVDASVLVAVDSVDPSVAQGSHDAIPTSRQEDSDVGIKKPLENVAPAASVVASPVDPDXWT

SEQ ID NO: 142793 - protein, 52 aa, Triticum aestivum
  Clone ID: PAT_TA_37211.pep
SVLEKQSFAYTLCKVEKSPGLTKPLTATIGWLKQDATHRQETLCSLLFNLHQ

SEQ ID NO: 142794 - protein, 78 aa, Triticum aestivum
  Clone ID: PAT_TA_37212.pep
PPMSLTLRQKHYRHLEHHCGGHYTAYEAPWTHAHTRRALYSAHPLAHGSPHRWPRASYPCAGIPVSGASTQGPWSNGP

SEQ ID NO: 142795 - protein, 64 aa, Triticum aestivum
  Clone ID: PAT_TA_37213.pep
TLVTRDSKLRTPEILSSQTIAQISISLMTYQQTEGKHTSTQTKIKENSRKTKSRFPSHQATTKK

SEQ ID NO: 142796 - protein, 82 aa, Triticum aestivum
  Clone ID: PAT_TA_37214.pep
HFHSHFEIYCHATFHRSVYYDTLHHCHIALHDHVVDIVFVAKPPFIIFIHVTHESLHILVHRRRQSYRVISCSKYRVVIHEL

SEQ ID NO: 142797 - protein, 138 aa, Triticum aestivum
  Clone ID: PAT_TA_37215.pep
CTRTLGLTGMRYLKRQHPANLHTIAHRPPTWNHICHDRKHKRSMGELVFGDGARGRRPRSSRHTSSGHAGSRRREHRQPRVLLAAVQRPAPPRSGTPPRMSRAWEAAGHGVPTGRPVSHVLLFLAGDRTFTSRVLNPA

SEQ ID NO: 142798 - protein, 87 aa, Triticum aestivum
  Clone ID: PAT_TA_37216.pep
PVAVILQAILALLKLRITTAGPDATNTSAASIMTIPKTWRSTPDLAALGPVSGRSHSKEIERAHPAWTEYSIDPARFMAPPLTCLSY

SEQ ID NO: 142799 - protein, 102 aa, Triticum aestivum
  Clone ID: PAT_TA_37217.pep
WRWTRAGGRRWRRGGVDGREAWQRAHVVPIESAPDRCVTQFKYCGLDGASGISCEVLVQCLFGIRLGHSSPLHHGSRSSNMYCQDGGFRLTDVLPYNDFMNN

SEQ ID NO: 142800 - protein, 91 aa, Triticum aestivum
  Clone ID: PAT_TA_37218.pep
KAAHGESRDKMAKMAIELKAAADHCRVLEKENQVKASDLEKAATTRKDLRSAMRAKEELREAGDIVAGKSFMLWRMFGDPRYAPLDRLWSS

SEQ ID NO: 142801 - protein, 89 aa, Triticum aestivum
  Clone ID: PAT_TA_37219.pep
PGRSTSILPSTHHKLSYVALHYLPFASRLIENNNESMVVNFVGTNNFGNNAYRGNFNPGPFPCNSSNNYGNSYKNSYGNYNKMPSHLEN

SEQ ID NO: 142802 - protein, 141 aa, Triticum aestivum
  Clone ID: PAT_TA_37220.pep
NVTVYKARLVAKGFRQVQGIDYDETFSPVAMLKSVQIMLAIAAFYDYEIWQMDVKTAFLNGFLEEELYMMQPEGFIDPKGANKVCKLQRSIYGLVQASRSWNKRFDSVIKAFGFIQTFGEACIYKKVSGSSVAFLRLYVDD

SEQ ID NO: 142803 - protein, 82 aa, Triticum aestivum
  Clone ID: PAT_TA_37221.pep
RRWRLRGDEEGGVRWEELGFGWSGCGWGWGLPFFFSFFFFLKIDGWMDVGWRDGWMDGAMSSIRVTANSTNENRARVNMFFL

SEQ ID NO: 142804 - protein, 61 aa, Triticum aestivum
  Clone ID: PAT_TA_37222.pep
RPNRIKCSVPIRKLALEKEVLLSCFNMTHPISRLQAGQPTASTSYPEAGVLLIRPVYQTKL

SEQ ID NO: 142805 - protein, 132 aa, Triticum aestivum
  unsure (1)..(132): unsure at all Xaa locations
  Clone ID: PAT_TA_37223.pep
MLIMLNYIVAKFIPPSFTYQQKKKXFYDLRHYFWDDPHLYKEGVDGFIRCCVPEHEQEQILRKCHSEAYGGHHAGNRTAHKVLQSGFYWPTLFKDAHKFVLSCDECQRIGNISRRQEMPMNYSLVIEPFDVW

SEQ ID NO: 142806 - protein, 81 aa, Triticum aestivum
  Clone ID: PAT_TA_37224.pep
DSKLSHEIGLELSKMSASAGLRPIGAVVFMQRGLLKICLRTTDNTTNTAEIAKAYGGGGKASSSSFALRMDEFNAWIRENT

SEQ ID NO: 142807 - protein, 87 aa, Triticum aestivum
  Clone ID: PAT_TA_37225.pep
GYVFILLPEKFRSSASAPSRITRGCLEKHLITLDPTSWSVKEVLVRQTRQSNYRALTLSLSHMSLTVGLLYSPWYVRGYSNTVRIHT

SEQ ID NO: 142808 - protein, 41 aa, Triticum aestivum
  Clone ID: PAT_TA_37226.pep
TLVYGLLRKGLIWIQKFNAMVRFYLNTFVVVEDACEGVNHK

SEQ ID NO: 142809 - protein, 144 aa, Triticum aestivum
  Clone ID: PAT_TA_37227.pep
GSGGEGGRDHAHPVPMGRSIGSTGSAGSIDARVGIDQRIWVQLMRSSARLDARCARGSTEADNAGEERWGRGRGGGTSMESSAVDSSSFVGDSVIKSQFLHAITGNGCRFLSSLELAYGGFALCWFCLIASIMDYPNANMRNFP

SEQ ID NO: 142810 - protein, 155 aa, Triticum aestivum
  Clone ID: PAT_TA_37228.pep
GTGVFASHGIKLVPPWKANPCLPRKKKTCFFKQIFFLKFFGPKLRGTGQKPKSRINQKKHLEPKDAYRKKIHRERLTRDTGCQPGKKLEKRKRRSRMNWARPVRLGNESYICVLPITPQKKCVLPICLKNRTYCDRSRQRSKANVIAIAGRLCSI

SEQ ID NO: 142811 - protein, 72 aa, Triticum aestivum
  Clone ID: PAT_TA_37229.pep
VGRRRMPRNSCETEQAKRRAEGDRKRESERFKISLFGHAIFRYSPPFSLENAMRCKRKIAFPLPLFDVCSSK

SEQ ID NO: 142812 - protein, 144 aa, Triticum aestivum
  Clone ID: PAT_TA_37230.pep
GMGKEALNVRAAAELFDKANDILGYDLLNLCIDGPKEKLNSTVISQPAIYVTSLAAVEVLRAREEGQSVINSVDVTCGLSLGEYTALAFAGAFSFEDGLKLVKLRGEAMQDASDAVNSAMVSVIGLDSEKVQQLCDAANEDVDE

SEQ ID NO: 142813 - protein, 68 aa, Triticum aestivum
  Clone ID: PAT_TA_37231.pep
TTEGRVADWIYAISMGLATGIFVYVSINHLLAKGYMLQRPVAADTPVGRWLSVVLGVGVIAVVMIWNA

SEQ ID NO: 142814 - protein, 53 aa, Triticum aestivum
  Clone ID: PAT_TA_37232.pep
ITVMQNIFHSMHILSFTPDFQIWFSWQFCTTAYLNIFLKRSPNLCDVSGCMLS

SEQ ID NO: 142815 - protein, 59 aa, Triticum aestivum
  Clone ID: PAT_TA_37233.pep
DSSMTPHALHDTGDCPLKRVESLINDHGPLSLSIVAASDKINYIRLGENAMQDLLGKTV

SEQ ID NO: 142816 - protein, 45 aa, Triticum aestivum
  Clone ID: PAT_TA_37234.pep
GEKDVLLLGDDPWESFVNSVWYIKILSPEDVHKLGKQGNDPRYLS

SEQ ID NO: 142817 - protein, 133 aa, Triticum aestivum
  Clone ID: PAT_TA_37235.pep
TGKEKQKNPADSAGIDGAIEGQSPAENCTDRVSRAKRAAEQAKQKQIAATKQAETTLVLATPSTVPPAARFTRWSTQLAAHSQAPLPPDTTSEALLTQDELARSDELCELQVQEGCCWSQFTVACFFICSLTV

SEQ ID NO: 142818 - protein, 131 aa, Triticum aestivum
  Clone ID: PAT_TA_37236.pep
TTRDCVHVDFSCLFDKGLQLEKPEVVPFRLTQNMIDGLGIAGYEGVFLKVCEITLSVLRGHKEALMTVLETFIHDPLVEWTKAHKSSGGEVRNPQAQRAIANITARLQGVVVGVNAAPSLPLSVERHARRL

SEQ ID NO: 142819 - protein, 46 aa, Triticum aestivum
  Clone ID: PAT_TA_37237.pep
TGKNNWLLLSCRATVHRSLILVTLDSLHNPAHRRLHTYRFISTSKY

SEQ ID NO: 142820 - protein, 112 aa, Triticum aestivum
  unsure (1)..(112): unsure at all Xaa locations
  Clone ID: PAT_TA_37238.pep
LGIGRLVITKMTPGKFEPFEPEQPRKCYGNQVGCILQECTSINDDDLRSQEHLRQLLLTKLYKRFKFPDRDDNIEQPWDDPKMKKINNHAMGMFSNDLASWKERVXKLLRPK

SEQ ID NO: 142821 - protein, 143 aa, Triticum aestivum
  Clone ID: PAT_TA_37239.pep
GSRITLSGLLLGSGELRPKVLHGSCTICIKHTCCKARASSSLTRCLRRNCIPCDSSSRFLTSAMSASATSSCRFSSANLSVWLATGPFATYIGRATHYTWDYDPRRAVIFDNTPSLRGYYLHRAHFICGTVRRYIILRTSKPV

SEQ ID NO: 142822 - protein, 73 aa, Triticum aestivum
  Clone ID: PAT_TA_37240.pep
VHTLVKESPPEKQATTAESINNSVRPSPQMHPGVSNGEGSGASTQLNRHDQAAVIGALLEQMQLDEQIGSLAT

SEQ ID NO: 142823 - protein, 101 aa, Triticum aestivum
  Clone ID: PAT_TA_37241.pep
CLCSSSTCYRQFLFRHLIHLHLCLSSLYPTQIVLVKYEQHFQTHILLTQPLLGIFSGNVVKFMYRCITFVILLVNLRYDAWSIDDWSVDLYMSFGIFLKEL

SEQ ID NO: 142824 - protein, 80 aa, Triticum aestivum
  Clone ID: PAT_TA_37242.pep
IEMDSLAHMSHPIWSQTQTKANEFERGKQLQKEKHTQLTTHRKSVHSLLLWHRDTKRVERTPKHDGGSNTPRHHQSCSSS

SEQ ID NO: 142825 - protein, 76 aa, Triticum aestivum
  Clone ID: PAT_TA_37243.pep
RFHALSNPIGFTFKFVRSVELRTKQSDVAAESESNYKPKGVASPPLGPMRLVRPRVSFRLPWVFLPPPWPPPLAPI

SEQ ID NO: 142826 - protein, 72 aa, Triticum aestivum
  Clone ID: PAT_TA_37244.pep
LPLGLQIFGQGLLPGPDLRKRSLGPSSFSFRSLMESLASESSSTLPRTVACASAKAPLATSLSSVSFRTCFF

SEQ ID NO: 142827 - protein, 118 aa, Triticum aestivum
  Clone ID: PAT_TA_37245.pep
QLCQAFPALFARSTRKNRSVKDALHADRWILDLRRGDPDAIALQVVQLAREIRQAALAIIPGTEDSITWKLSASGCYTTSSAYNAQFSNRQITSFKSIIWKVWAPGKIKMFLWLLHLD

SEQ ID NO: 142828 - protein, 132 aa, Triticum aestivum
  Clone ID: PAT_TA_37246.pep
IEEINVLSGKMDELMKLFASKSASIYPNDIPLFTLIDNNNESMDVNFVGMNNFGNNAYRGHFNPRPFPSNSSNNYGNSYNKSYVNYNKMPTDFQNSVKEFMSSQKNFNALVVENCLRLMIWLRTWIEFLLTL

SEQ ID NO: 142829 - protein, 137 aa, Triticum aestivum
  Clone ID: PAT_TA_37247.pep
DARRRSRGRRASSSSSTCRPAPRHPPRPIPPVSWAGASLTRLPAVAVAMAGRAKPSSSPVSSMSWWPSSSFGATSTSRIAKSSAPSRSSSPASSTSRIEHHIAFTPLATSSPSSTSTSFTVRISTRFRAPSRRLRRV

SEQ ID NO: 142830 - protein, 64 aa, Triticum aestivum
  unsure (1)..(64): unsure at all Xaa locations
  Clone ID: PAT_TA_37248.pep
VGVRGYTLFIAFVIERLHHYLQKLITLRKSVNTSXREELEIFQMEFKREFEKMIPWLSSKNVIL

SEQ ID NO: 142831 - protein, 99 aa, Triticum aestivum
  Clone ID: PAT_TA_37249.pep
YLSAPGRLRLYNPITKTFTDFEMRNSTFVGTYTGSLLSTESTFTSEAERCTICGCYGTLEAIEPYALCEDCMSHQALLLLQRLEGCAELGTLSRITNCQ

SEQ ID NO: 142832 - protein, 135 aa, Triticum aestivum
  Clone ID: PAT_TA_37250.pep
HDGFAALVLDPIIDGFHLTRVLMDGGSSLNLLYQDTMRKMGIDPSRIKPTKTTFKGVIPGVEAHCTCSITLEVVFGSPDNFRSEELIFDIVPFRSGYHTLLGRTAFARFNAVPHYAYLKLKMPGPRGVIIVNGNT

SEQ ID NO: 142833 - protein, 118 aa, Triticum aestivum
  Clone ID: PAT_TA_37251.pep
YSENLRKRVPYSEISQSLYVEDFEEFDWITRGIYVGFSRDWLSKMMKEPARNELRILYDDIYGDDPDYGFMNVKITNQSPFHDLSSSSKREIRERIDFLRRVLEDLIRKELHAEDGNT

SEQ ID NO: 142834 - protein, 63 aa, Triticum aestivum
  Clone ID: PAT_TA_37252.pep
SMSNSVSNFLIWMHCHEKRELVNLNGSIFAGNAVPCNHFGVISRCRGSKSDSRMRGRYEEARS

SEQ ID NO: 142835 - protein, 79 aa, Triticum aestivum
  Clone ID: PAT_TA_37253.pep
VLVLTQFMYTTVLCFISFTVVLTCQNVLVSVVLLCAIMSSWLIYATFRLDRLNTIHSGDQSRQLASQHRQAHASSSIRH

SEQ ID NO: 142836 - protein, 114 aa, Triticum aestivum
  Clone ID: PAT_TA_37254.pep
DEDGDFAEGEEEISEGEEYDNPKASDAKKKQIGEGEENGEDDEEEQEEQDGGGGDDDDDDDDDDDNEDDDDDDDDVAAEDDEDGVEEEDDDQDNDDDEEDDDEDSLQPPKKKKK

SEQ ID NO: 142837 - protein, 69 aa, Triticum aestivum
  unsure (1)..(69): unsure at all Xaa locations
  Clone ID: PAT_TA_37255.pep
MAGPIRVTMEVGADGVALITICNPPVNALHPIIIXGLKEKYAEALDRDDVKAIVLTGAAGKFCGGFDIN

SEQ ID NO: 142838 - protein, 108 aa, Triticum aestivum
  Clone ID: PAT_TA_37256.pep
YKFAAEFENTRLSGNKVNSDALTTMSTALSTWRSAVKRMIDKGDSYEKIKAKNPSISEDDYKEFKIKCESSATSESSQWGKEMRELNLGEHKLGPGGYRVAEPIWDRE

SEQ ID NO: 142839 - protein, 82 aa, Triticum aestivum
  Clone ID: PAT_TA_37257.pep
STSFDLEIVVSIRPSVNLSQNGCQTLEISSKVVNQGECYSPGRIFLFGGLHLRPNSGAIPSRSIRTPLAIRSALRAMNYVVD

SEQ ID NO: 142840 - protein, 78 aa, Triticum aestivum
  Clone ID: PAT_TA_37258.pep
PTVPQDRDLTLLYTLLPKLFLELDFVCSSRATCLVIYSGIRRNTYSHCSEPLSHFVSGNERLPMRLKLLLCTFLLCSR

SEQ ID NO: 142841 - protein, 108 aa, Triticum aestivum
  unsure (1)..(108): unsure at all Xaa locations
  Clone ID: PAT_TA_37259.pep
DESIYMRGIHGILERDGGXSLDVDAHEVFHHDRDLHSKMVRYPREVLAXFDIVLMALEARTGPLFAKHIQSKIDNITSSICWTNLNPXATERMVSIRGMIIRCSSVIP

SEQ ID NO: 142842 - protein, 69 aa, Triticum aestivum
  unsure (1)..(69): unsure at all Xaa locations
  Clone ID: PAT_TA_37260.pep
SSMAEEHFGPRRRRPGAHGHYLHAEALNLSPIPICIQRDGIDVVHICIPGDVSALAPYGFTYLVFRAKX

SEQ ID NO: 142843 - protein, 116 aa, Triticum aestivum
  Clone ID: PAT_TA_37261.pep
PGRLRRLNPGFIRKGFSLVQVYPRRSLLRPGFLPLGSGHFFGIHRRQGRNLGRAKAVLLLGFNPATHLRLQRAAPEIDRLPRRLLPAAAALCVVPARWGKETLDRGVGYFWSPAAR

SEQ ID NO: 142844 - protein, 82 aa, Triticum aestivum
  Clone ID: PAT_TA_37262.pep
CFEESGDELDSGSTSYHLMEKRSLEKSILLELERDHHLKIQEEVRSKLSSLEVCHQNEIQRTISAFARLQKYAESRKEIDRR

SEQ ID NO: 142845 - protein, 137 aa, Triticum aestivum
  unsure (1)..(137): unsure at all Xaa locations
  Clone ID: PAT_TA_37263.pep
RVDRDLLERIKRNSEDWGSDDGKESGMTPKFDCVISFMDTDAFRGFSAKYGLDSEIVASFCESFAAHVDLPKEKWFKYNPPTEVKVVAPITVEEKTITYNDPIVPTTYVEXTPYPVRIKDHARASTMVRKSNTRTYT

SEQ ID NO: 142846 - protein, 94 aa, Triticum aestivum
  Clone ID: PAT_TA_37264.pep
RADGVSNNSDPQILEIIAIREALALAEDLYINKMSIASDCKMAIDAIKEGSSAAFGAIIKEIIARTSIFLHVFLVMSIGPRMYRPIISQSMLYP

SEQ ID NO: 142847 - protein, 42 aa, Triticum aestivum
  unsure (1)..(42): unsure at all Xaa locations
  Clone ID: PAT_TA_37265.pep
XYVYDRFSEGAQLRDVCWLEIRGKINSKILSQDTTYAAYMVF

SEQ ID NO: 142848 - protein, 39 aa, Triticum aestivum
  Clone ID: PAT_TA_37266.pep
NPTITSRDIQTSVGFIPPGDLAKHAVSEGTKAVTKFTSS

SEQ ID NO: 142849 - protein, 91 aa, Triticum aestivum
  Clone ID: PAT_TA_37267.pep
MGISVAVLSIAEREVGQATVTLHSLKSEASMGQTLSIASWLSTTDRSMAGSRTGGVWIEVWVFFFPFFFCFGAQQRGLEPVQAMAGGSCFW

SEQ ID NO: 142850 - protein, 40 aa, Triticum aestivum
  Clone ID: PAT_TA_37268.pep
FSAAEPAAWPATKACKSSLKPNLAGWPMCLNELMLKAVDP

SEQ ID NO: 142851 - protein, 113 aa, Triticum aestivum
  Clone ID: PAT_TA_37269.pep
RSRSRRPSVSRSRDLCWFFSSKMPKRKKAWFRDADSFETRITLEADRGFLNLLDRTQDSLRNARNNAPNMTTKVLGGFVRTFYFDEESNADVIDGEMQIEYDLEQIKVYPITV

SEQ ID NO: 142852 - protein, 96 aa, Triticum aestivum
  Clone ID: PAT_TA_37270.pep
MTDVCVKAAVGHPDTLGDCPFSQRVLLTLEEKNVPYQMKLIDVSNMPDWFLKINPEGKVPVYNGGDGKWIADSDVITQVIDDKYPSPSLVTPPEYA

SEQ ID NO: 142853 - protein, 113 aa, Triticum aestivum
  unsure (1)..(113): unsure at all Xaa locations
  Clone ID: PAT_TA_37271.pep
KKGFLLVLQGVKLSKTQNPTTVEDRERMKVIXYASTIGSIKYAMLCTKPAVYLAMSLAREDNSDPGVDHWIMDKIILSYLRXTKEIFLNYGGNKEFVIKGYVNESFDTKSDDS

SEQ ID NO: 142854 - protein, 40 aa, Triticum aestivum
  Clone ID: PAT_TA_37272.pep
SACFNMQYDLVANQQLLVTINTIISLFLLPTFNCPFRRPG

SEQ ID NO: 142855 - protein, 85 aa, Triticum aestivum
  Clone ID: PAT_TA_37273.pep
GCQLMNLWAMAPPMLMNNHLQIMIKVVVLPRVQTPKNSTATFKKLPKFLRKPRNSRLARTTKKAQKPFRTRPQRLRSTALELRPK

SEQ ID NO: 142856 - protein, 59 aa, Triticum aestivum
  Clone ID: PAT_TA_37274.pep
RTRKHLFGSASTNLVVPPPVGTDDSPYMETATTSAIDILIVGGTGTFIGHFTDCVFAHS

SEQ ID NO: 142857 - protein, 91 aa, Triticum aestivum
  unsure (1)..(91): unsure at all Xaa locations
  Clone ID: PAT_TA_37275.pep
GGSGGTQHTCVXLGTSEFAQEVSGTFSLYGMDSQNILTSLXFVTIVHTYGPSXQSKGTTSTRPVHCNNSIMGFFRLSWIXPNALGVYVHPL

SEQ ID NO: 142858 - protein, 77 aa, Triticum aestivum
  Clone ID: PAT_TA_37276.pep
YVWAPPAFLFFAPEPTCCSVWTQGTNINALGMVSFARTRRACQLTRRPWDASAKTVLWHVVAPFPVVSLLVSMQTLV

SEQ ID NO: 142859 - protein, 46 aa, Triticum aestivum
  Clone ID: PAT_TA_37277.pep
WMQFGRVASMPCIFRSSCVFDHPNILIKELLRKYIMGETQELNVVL

SEQ ID NO: 142860 - protein, 103 aa, Triticum aestivum
  unsure (1)..(103): unsure at all Xaa locations
  Clone ID: PAT_TA_37278.pep
HCLLSNQCIMIDLPHGDPLTYKRRLMATIERIRTLTRPWARSRSLXRQTLPGKRAALTTIFPPHGGPSLGKTARVISVMLLNAPLLFVQCVIPPSNQQGTPGP

SEQ ID NO: 142861 - protein, 83 aa, Triticum aestivum
  Clone ID: PAT_TA_37279.pep
MILAGKYDPHCHLMQANTGNHPSHTWRAIIIGRTVLNMGLIKRVGTGTEINIWEDKWIPSNPSLRPLWKPNNTHLTLVCDLIR

SEQ ID NO: 142862 - protein, 96 aa, Triticum aestivum
  unsure (1)..(96): unsure at all Xaa locations
  Clone ID: PAT_TA_37280.pep
XKKGKKNVENFKIYIFKGAKQVXPTSNPSKHVIMNSFINDIFEKLAGEAAKLARYNKKPXITSREIQTSVRLVLPGELAKHAVSEGTKAVXKFTSS

SEQ ID NO: 142863 - protein, 96 aa, Triticum aestivum
  Clone ID: PAT_TA_37281.pep
AAAEASPDIRTAVRIIQTQPDHPGPPPDHLDNRAEDTRRFLLKPDHPGHLPDHPDDGRIIRTPIRIIRALPACNASGQGPCTHSPPHLPLRPLDYK

SEQ ID NO: 142864 - protein, 72 aa, Triticum aestivum
  Clone ID: PAT_TA_37282.pep
SRMSVVEMLIFYLSGWVLAWNPGKGYFCPPIWCKIICPVWGTPSQQDKIFLLMAMHFSQSQCQCITIQSCTK

SEQ ID NO: 142865 - protein, 81 aa, Triticum aestivum
  Clone ID: PAT_TA_37283.pep
FWSNSNAFYLIICKVHTKRENSGSWKSGPEKATPGHLFCTTTNELKLYQEFLWNISKILEQITTGGGPPGEQKTPGMPVVC

SEQ ID NO: 142866 - protein, 41 aa, Triticum aestivum
  Clone ID: PAT_TA_37284.pep
TNSVACLCLVRSIMGLFLGGMLDRSGVVSPRVRVRSGKASY

SEQ ID NO: 142867 - protein, 42 aa, Triticum aestivum
  Clone ID: PAT_TA_37285.pep
GAPFFFLFIFFYFSFFLCYVFFFFSFFFFFFFFFFFCQLGNA

SEQ ID NO: 142868 - protein, 85 aa, Triticum aestivum
  Clone ID: PAT_TA_37286.pep
QKVYLIIFGVTEVFEIFRFLQTILFLTDSIFFALCACFDDSMVLFDEFLPYKSQNTVDIMQKQNNNRFSIVLIVVGWFLILTDLT

SEQ ID NO: 142869 - protein, 80 aa, Triticum aestivum
  Clone ID: PAT_TA_37287.pep
KNYSNTPNPRHASHMIPYITVGEQITAEQLIEKCIVMIVSMHDHEHMHHVRVKYTETILHLLLLLHTSTAIQHASRVLSS

SEQ ID NO: 142870 - protein, 58 aa, Triticum aestivum
  Clone ID: PAT_TA_37288.pep
YSYFGFFFLRATKFSSRHRQGLPFQPERNYITLSSSYYRHVHHTSRGVQCNTMLHRLD

SEQ ID NO: 142871 - protein, 83 aa, Triticum aestivum
  Clone ID: PAT_TA_37289.pep
KYPSLFHLTILQDCRRITLGESNHNKSSNRYKRHIRLSHFRFSNLERGAMGHITLRPCYGVVFDEGCPLGRQLQLCQMQPRRP

SEQ ID NO: 142872 - protein, 69 aa, Triticum aestivum
  Clone ID: PAT_TA_37290.pep
AGPRLSPTYTLFILWRALLVNRSILLIQIIRTLHLPLVILCNRTCRLSRPHPGNDDHLMLCLSLLMLLY

SEQ ID NO: 142873 - protein, 65 aa, Triticum aestivum
  Clone ID: PAT_TA_37291.pep
WITDTDDNVLQSLLVNHNESKLLYLYNCTCMLLCCTYSVSLNRRYSNVIDVFCMHAQIPLYSARY

SEQ ID NO: 142874 - protein, 43 aa, Triticum aestivum
  Clone ID: PAT_TA_37292.pep
YPMITPPRHTCIEFRIIAHMPGRLSDESVNLANHRHRVYSTWG

SEQ ID NO: 142875 - protein, 67 aa, Triticum aestivum
  Clone ID: PAT_TA_37293.pep
DKTPDFRKQCTGHITSSQDWRPRDPLKDPAFIFLHLGCSIGSLLHFHHMILKSFLTCAGPSIKCASM

SEQ ID NO: 142876 - protein, 51 aa, Triticum aestivum
  Clone ID: PAT_TA_37294.pep
LSEVLLWFFQIYFSFKYFVFSWHWGFSGKLHDHQFKMAFQFKRYNQKFPAT

SEQ ID NO: 142877 - protein, 54 aa, Triticum aestivum
  Clone ID: PAT_TA_37295.pep
LYYWVTSSVNWNQKMNQILKPPSNKKIYARSLQSYMYANIMAGPVHVLEFLIPS

SEQ ID NO: 142878 - protein, 43 aa, Triticum aestivum
  Clone ID: PAT_TA_37296.pep
SAKYDGIPGRLQAVIIIISFNTSEILKLASRSHLLACKNNETS

SEQ ID NO: 142879 - protein, 82 aa, Triticum aestivum
  Clone ID: PAT_TA_37297.pep
CRGRCCTRVSPRSWRGSKAVISQNPTTRSNKWSGKINGQATITSLRLLCISSLCIYLLRFISHTQSLVSLGSTLRSSSPSAR

SEQ ID NO: 142880 - protein, 83 aa, Triticum aestivum
  Clone ID: PAT_TA_37298.pep
TAINLCDNEAVNSHTIPVAISRHHRLYQSVESADETRRDETEHVRADLPDPDRGLDHARGAGPPPPKPAEVPEAARGARFRLP

SEQ ID NO: 142881 - protein, 66 aa, Triticum aestivum
  Clone ID: PAT_TA_37299.pep
CGGVCKKRVFTLDPTCWSIKEVVAQRTRQSHYIGLTLSLSHRSLTVGLLYSPWYLRARPNMVHVCT

SEQ ID NO: 142882 - protein, 59 aa, Triticum aestivum
  Clone ID: PAT_TA_37300.pep
DSSALMIEEFPVMYIGAPCSCQRGCTRGYTMAPLVNSHGNLYVFSHYAVIASRVVLESP

SEQ ID NO: 142883 - protein, 112 aa, Triticum aestivum
  unsure (1)..(112): unsure at all Xaa locations
  Clone ID: PAT_TA_37301.pep
KNPCVATCDKRCPNECIVMCPGCKTYCCKHIYIHHAYHLYIYSHILAMSIQIKKSRCLNXLLNIFVRVCDFYPGMSCGDPRFTGADGNNFYFHGKKDQDFCVLSDADLHINA

SEQ ID NO: 142884 - protein, 79 aa, Triticum aestivum
  Clone ID: PAT_TA_37302.pep
NYVVHARIVHVLIRVVCIVHARRVILKTIGLGSSLMRKWLVTVMPSHMHYAIQIKLIANKTPTGLLLVGGTHCFEQVMD

SEQ ID NO: 142885 - protein, 110 aa, Triticum aestivum
  Clone ID: PAT_TA_37303.pep
GFFACARHHHAGRHRLRLTVHLCHYRCSLGVWCGIVPGPRKAPSRPAPWPMLCARSCGQHRYGSHCCAPTMVCHTHVCILTTILSSQGNTLSQLAREKGDGKSMHDAMSR

SEQ ID NO: 142886 - protein, 48 aa, Triticum aestivum
  Clone ID: PAT_TA_37304.pep
VAFKGKLGLNLLGGPFFFFFFFFFFFFFFFFFFFFFFFFFFFFFFFFF

SEQ ID NO: 142887 - protein, 112 aa, Triticum aestivum
  Clone ID: PAT_TA_37305.pep
ESALIEFIRENQDIFAWKPSDMPGVPRELAEHTLNIDPKFKPVKQFLRRFNKERRKAIGEEVARLLAAGFIVEVFHPEWLANLVLVLKKNGTWHMCVEYTDLNKACPADPFT

SEQ ID NO: 142888 - protein, 58 aa, Triticum aestivum
  Clone ID: PAT_TA_37306.pep
AELLCLLRIQVQDTDEGYDQDPASTGNWKATSAYDVYIVDTSYRNVNEDRQGAQRDPS

SEQ ID NO: 142889 - protein, 90 aa, Triticum aestivum
  Clone ID: PAT_TA_37307.pep
YCSTLTPRTLMVWTPDERYDQESASIGNWIATSSLYVKMVETSIMYFIDDRKGPYRDRTLEKLSKLRYMRHVHPQLHVDPSSQHGDTADA

SEQ ID NO: 142890 - protein, 50 aa, Triticum aestivum
  Clone ID: PAT_TA_37308.pep
TSLHPFWHHFIDPFDHHNYSKFLDRNDVCEASAILVFPFSMIFLQHHHMT

SEQ ID NO: 142891 - protein, 61 aa, Triticum aestivum
  Clone ID: PAT_TA_37309.pep
YNGIVQGVIIFVEKVSVIKIHKVSVSVNKVQGALPLQQCLSLSLSLSFLKSFGFPSLFFGF

SEQ ID NO: 142892 - protein, 111 aa, Triticum aestivum
  unsure (1)..(111): unsure at all Xaa locations
  Clone ID: PAT_TA_37310.pep
IIGKSKRTRIGRSISTLFIKGRGLLFFPPVLNRILPPPQAQMPKVQVRCSEPSVMSGSSLQGRWVPSSVTEEVVKTLREARYLTAEILHRLPPRGHAIXSSEPNESVVFVS

SEQ ID NO: 142893 - protein, 66 aa, Triticum aestivum
  Clone ID: PAT_TA_37311.pep
KTVLSCTHNVSASVYVSLMHDHLHIHTSLCMYHTHTVSTLPFRHNTHMDTYTRSLSVTHTKSVLKN

SEQ ID NO: 142894 - protein, 79 aa, Triticum aestivum
  Clone ID: PAT_TA_37312.pep
RLLKDHALLRPTERLRLWLIQGWSFTGAMVVLGGGLPMLAAAVVHMLLLTTTGGRWLRSSLPSTRRLCKNLLGLHISTD

SEQ ID NO: 142895 - protein, 70 aa, Triticum aestivum
  Clone ID: PAT_TA_37313.pep
TVGRGKSVFLFLDRLYVVNYLLPWTRLQLPPSKLGIEHGVMVFSLLLFMDHCILGFLGANLWFICYLVVS

SEQ ID NO: 142896 - protein, 65 aa, Triticum aestivum
  Clone ID: PAT_TA_37314.pep
SLAFPELLSTQIIFLPNPILLERVECLGGYQFKDQGQGIHLHDSSPAARERMRARGMERPCDPST

SEQ ID NO: 142897 - protein, 47 aa, Triticum aestivum
  Clone ID: PAT_TA_37315.pep
NENNRCHNAMLCTLPMHHITIKITKSTMLPLSHHQLKILLWLRSNLT

SEQ ID NO: 142898 - protein, 55 aa, Triticum aestivum
  Clone ID: PAT_TA_37316.pep
WVGFITRDAVKKKFHLLRLAWLNLLRIFFSKGNSNAVRYNRHKMFEGTSGPVIGR

SEQ ID NO: 142899 - protein, 81 aa, Triticum aestivum
  Clone ID: PAT_TA_37317.pep
CDMMGWYPPLNELSDSTWHMFTHVVESNQCSLHDIYVDGGLYPTHACTWCELILMHDYDCCRSLSWPLPSLLLAFTSRRPG

SEQ ID NO: 142900 - protein, 101 aa, Triticum aestivum
  Clone ID: PAT_TA_37318.pep
VYCHASRRCLQLGKVMGARYPDQVGGHKPCEPEFGYVHMSLFGTVFATMVVVGDFGRHGATHDLAQRGVGRSGRESVMAVGQFCRNAVGPTEWECKAMGFV

SEQ ID NO: 142901 - protein, 54 aa, Triticum aestivum
  Clone ID: PAT_TA_37319.pep
YPLLCGKWFSGATIGCMCSHVEGTVLMEMSWCLVKTDDLDNQNLRTHANKSQTA

SEQ ID NO: 142902 - protein, 71 aa, Triticum aestivum
  Clone ID: PAT_TA_37320.pep
YGCRNFYLIKLPLVMLRLLSSLSSSLHMLVFACLANLFDYNMPMHRKYVRIRCVCPVFHDALFVLQFLSFM

SEQ ID NO: 142903 - protein, 54 aa, Triticum aestivum
  Clone ID: PAT_TA_37321.pep
PTTQRRSANCCENAYLMSVAEKVFQTASVWNDTLRRLLLTSNATQQRSSGPKGS

SEQ ID NO: 142904 - protein, 135 aa, Triticum aestivum
  Clone ID: PAT_TA_37322.pep
VHGFKSGIPTRLTSWKESGRTWGDSEELTGLQAYIQKLVDKKLKLVNIVQVMLIRRILPCQQQGLNMWEFDPAQHQTLSRLFDTTYEDVWKVLFKGAKAPASATEDHGFSSQRPAVEVSDFVLYGTLVFHSLTLC

SEQ ID NO: 142905 - protein, 89 aa, Triticum aestivum
  Clone ID: PAT_TA_37323.pep
YLKDYRLLRSSISFMDMKLCGNDTYKIESWVEHYNHGHLIRSNRRVIESAKNAFYTCNKASIDTCQTYRFPKVSEVSPVTHLARRIWSN

SEQ ID NO: 142906 - protein, 126 aa, Triticum aestivum
  Clone ID: PAT_TA_37324.pep
SSSVSSPLGLMAPLIIDSDAVQGETFLPGQIFVFGGFALRANSLGHLEQIESYAPGHQVRFGSLNYTSDIRGDFIFDGFEPLPSAPHGHDEHDLALPSDSVQETAPTTAPTLNSEPIAPSMDGWID

SEQ ID NO: 142907 - protein, 131 aa, Triticum aestivum
  unsure (1)..(131): unsure at all Xaa locations
  Clone ID: PAT_TA_37325.pep
RVDGEDESSEQGFQKATGAMCVDGGVSLHTSQRQLKQWAREIRGAAPSFDAXKPLKWSSTPLIFDAEDHPHRTAAVGCLRLVVPPTIRNLKVNKMLVDGGASLNLISPVVIRRLQILGGDLDETGTFRRVN

SEQ ID NO: 142908 - protein, 85 aa, Triticum aestivum
  Clone ID: PAT_TA_37326.pep
RGQRQLWSKSSVKPTTIPVLTFQLPQFCLDQISDIIDNMNTHSTIHFSIYKVSRMVYVNQKIFYDHCNAQWRMYKRYSGTQHMYV

SEQ ID NO: 142909 - protein, 117 aa, Triticum aestivum
  Clone ID: PAT_TA_37327.pep
MSTTSMPVPSWARWRAPDPPSHPYQRASCQRLWRAPPPPRAEDNAWPSSLIPTRGNRGSPIAQPTDPRPQCPPRSPHAPPPPPSPPPDQPHQKVALRQSGLRALPGSAQGVAAVLRR

SEQ ID NO: 142910 - protein, 91 aa, Triticum aestivum
  Clone ID: PAT_TA_37328.pep
ADQRRGAAWLVQVGKHSCWLELLRGTLNMFFFWVRGTLNMLGRDHAALIRLWCLKSTTGQANDFFKHQYRHKRSYTRAYTHPYERTHAHPT

SEQ ID NO: 142911 - protein, 132 aa, Triticum aestivum
  Clone ID: PAT_TA_37329.pep
KVQDTSYLMHVYVRVLRNFKSRNMCVCTDGAAVVETLRGELTQAKEQARVSKAVTDKAAADITAEQAARRRFEERVTEVEQKLKDTTRKCESLEEEHKAKGTELAKALQDAKEARSESCTAREEIRQAGQLA

SEQ ID NO: 142912 - protein, 86 aa, Triticum aestivum
  Clone ID: PAT_TA_37330.pep
SRLTKASPTRLNKCRHDDPNIFRPPTRTLILGWIGVMFEIPPVGLNRRPVFGSSEVRHIACDNQTFASSSTPATLTPSQRLATYQH

SEQ ID NO: 142913 - protein, 58 aa, Triticum aestivum
  unsure (1)..(58): unsure at all Xaa locations
  Clone ID: PAT_TA_37331.pep
TIELDRIGDVMYLLVAHATLASCDCPFVQARCHARAAAAASHAGYTXGWIXIFXSFRS

SEQ ID NO: 142914 - protein, 73 aa, Triticum aestivum
  Clone ID: PAT_TA_37332.pep
ADGTSPQASGTPLQGLDVRADPVCRGGWLPFPGALIARYKCAEYMGSCGGMGVVNPTPQRSSFRFRRRRHGYK

SEQ ID NO: 142915 - protein, 128 aa, Triticum aestivum
  Clone ID: PAT_TA_37333.pep
GRQVIGTTERFTSQMPWARSNFPPKIDQIRSRNSSSASVAHLIYSLKLYHTYITTHLRYHGHWRKRNTDKSASTPVTFFSTFLFLSSLPLKNRWRKGETSKTDSIGVQICTLTYGATSFNDSPCRRTA

SEQ ID NO: 142916 - protein, 69 aa, Triticum aestivum
  Clone ID: PAT_TA_37334.pep
FFLCVFHFLILFSFFTDKSVTTAMQWLPVPSRLISSHIISSTTTHTHAPKRWQPQQAGRQQPTSLHSPR

SEQ ID NO: 142917 - protein, 59 aa, Triticum aestivum
  Clone ID: PAT_TA_37335.pep
VSLTSSVHGDIANPSSSVFFRTTNTSSQMVRPHRGCYLWSTRAFRGVTRMRVVCVRQYE

SEQ ID NO: 142918 - protein, 49 aa, Triticum aestivum
  Clone ID: PAT_TA_37336.pep
GLRMFIATDGLADIHSCSWGRTEMQWSLHRVLQLGGELSQPSSYTLPPL

SEQ ID NO: 142919 - protein, 98 aa, Triticum aestivum
  Clone ID: PAT_TA_37337.pep
PGRGCTICKKNLHNYPDSGPYAESASHVGPVTARNREVTHSLIKQTKLTNSPHFETCVTNVLILREFSDKRCVYVFHKTHYNREIEILYFTCFKKLIT

SEQ ID NO: 142920 - protein, 90 aa, Triticum aestivum
  Clone ID: PAT_TA_37338.pep
VLELMVILMTSLSSSKTEFACVFYDVFGVAGFTGLFRGRVLTFFLWDFYILLLIDISFNILLALVASFPTNLVSSNSESVCKSCGSFGVL

SEQ ID NO: 142921 - protein, 97 aa, Triticum aestivum
  Clone ID: PAT_TA_37339.pep
GLAYRRTEEKALCSTDHNRNGIMFIRRGLAYHKTEETNFPWTSYGRNGVLLIGRGVVYRKTEEMDLCWSASVETGVLFIRRGVAYRKTVLHGIPVGP

SEQ ID NO: 142922 - protein, 94 aa, Triticum aestivum
  Clone ID: PAT_TA_37340.pep
GPSNIFHGYDGKENCGKVLEEELHRILGIKYLNDEHDCNVVSMNSLNIHDANDMQSHKLGEAMFDEDDIFSPPSFDENIYYDESMSPIYDDYCE

SEQ ID NO: 142923 - protein, 91 aa, Triticum aestivum
  Clone ID: PAT_TA_37341.pep
GRVISTPWPAPQLGRVALSVDGSFLKEDGSAAVGMVLINDKGDVQMEAYRFIFYCNDPLEAELHAIMQCLALSIQHSDLRVVVQSDSAEAL

SEQ ID NO: 142924 - protein, 99 aa, Triticum aestivum
  Clone ID: PAT_TA_37342.pep
DTTTKLQPSITILFSFLTPLHFLLFRKVDARNKFTQPEEESPFGRHLKEVTRYLNIGMPSFTGTYNATLPKEERWMIQVQVPGRTFTAVTKPIEFSFDA

SEQ ID NO: 142925 - protein, 59 aa, Triticum aestivum
  Clone ID: PAT_TA_37343.pep
RGNLFTLETCGASPFLPHVWQLARPFSFQFLVKLLLPVHAPNRASWHRSRACLRLGVLL

SEQ ID NO: 142926 - protein, 112 aa, Triticum aestivum
  Clone ID: PAT_TA_37344.pep
YGLLVTLDIRSNGSYELLNILQKNHRRILKLRAGTTTPYMPSDLRSNGSDVRIMVAYEDRYPAIQFRSGGRHAAAAAARGRRVPPTGQSQRRGGLPSPSPIFSFTLSASSPS

SEQ ID NO: 142927 - protein, 81 aa, Triticum aestivum
  Clone ID: PAT_TA_37345.pep
STSDLGDFGLLLVFLLQFNAVNALSRLVDQLIAYKSSKHEFLILQIRLTDFLKSSSCLFVGCGSSLPMSMSSRFQFTMFCL

SEQ ID NO: 142928 - protein, 58 aa, Triticum aestivum
  Clone ID: PAT_TA_37346.pep
PLTISRRVHKLWHRFHVLAAPVSVYVQCTLIWNYIKCMRILSRILIACHYVINTIPKT

SEQ ID NO: 142929 - protein, 50 aa, Triticum aestivum
  Clone ID: PAT_TA_37347.pep
PPLYVVSRTSLDQPFAWVPWGGLYRPTPRGYNGNPAGRVVRLSVCTAVGP

SEQ ID NO: 142930 - protein, 91 aa, Triticum aestivum
  Clone ID: PAT_TA_37348.pep
ADGSCKHQEGAAGSTTRCGGCATTATASCGERWRPATHGDGSCRRVRKLCAARPRGWGGWLSAVTRCGQRHDVRKDREEIMQLLLPKSNGC

SEQ ID NO: 142931 - protein, 90 aa, Triticum aestivum
  Clone ID: PAT_TA_37349.pep
ANYQQDLRHYHSRRVRTRTFQEGDLVLRLIQDQTDMHKLSLPWEGPFVVSKNLHNGSYYLIDIQEHKDSRTSEEETNRPWNIAHLRPYYT

SEQ ID NO: 142932 - protein, 40 aa, Triticum aestivum
  Clone ID: PAT_TA_37350.pep
NSRADGGRNSMMCVLVVDLQDNVTDHSCVHHSSKSCPHIF

SEQ ID NO: 142933 - protein, 50 aa, Triticum aestivum
  Clone ID: PAT_TA_37351.pep
KVMANWFPMALKEGARSWLLNLPPGSISSWDEMRIHFIANFQGTPGRPQS

SEQ ID NO: 142934 - protein, 127 aa, Triticum aestivum
  Clone ID: PAT_TA_37352.pep
DISETIMQPVVNEDTANNWAIVVYHPLTVTKEIALPVIPFGPPLPPEMIWRRSFENLLQAPVAFSVPRPVMLQPLSPVVLSKRSWDLAFSDSDLPRLTWREEEPARPVARALFLILLLCNLCSCPVG

SEQ ID NO: 142935 - protein, 52 aa, Triticum aestivum
  Clone ID: PAT_TA_37353.pep
DLVLSQHRVLSNLSNTISFMSKKKNHRKKKKISKNKKKKKRVNKTITKQIKN

SEQ ID NO: 142936 - protein, 117 aa, Triticum aestivum
  Clone ID: PAT_TA_37354.pep
AAVSSLCRSFSVSMALFRVSSRAVTSESVPSKPSSFSFRSLMESLASDSMLALSEIATCEPARVRLAAFFSSVSSNTLFLIFFLIFSWVSHHRGSYSGHGLVDLFLSLLALTSLLWV

SEQ ID NO: 142937 - protein, 67 aa, Triticum aestivum
  Clone ID: PAT_TA_37355.pep
STNDSNIVSRWIYIQRPTSIFNLSSSSSSAAGTTCSCLLLLAALLSMLRCEALLHRWPSHLSTPSAR

SEQ ID NO: 142938 - protein, 60 aa, Triticum aestivum
  Clone ID: PAT_TA_37356.pep
FALFVDFGLCYFRPTCVIDEDNVVASSTLRIAAIEAPKFGLLGRGWQIEYTAGGCRFGDR

SEQ ID NO: 142939 - protein, 43 aa, Triticum aestivum
  Clone ID: PAT_TA_37357.pep
EIAMNYSNKNVNNDSNSRHYIAQMVQLITTPTERQRLLPTRTI

SEQ ID NO: 142940 - protein, 57 aa, Triticum aestivum
  Clone ID: PAT_TA_37358.pep
PAVEDSWMHGLRDKVELMVPSNYSSRAYLYQIMSVLNKFCFCSAIPVIFQSYEPKKA

SEQ ID NO: 142941 - protein, 69 aa, Triticum aestivum
  Clone ID: PAT_TA_37359.pep
ATTRMTTWVLAAKTNSSSVQTVQLGLIEFAIKFLSWKIICCYYFKCYNVWLSFETFMFPISCWHCQCLQ

SEQ ID NO: 142942 - protein, 82 aa, Triticum aestivum
  Clone ID: PAT_TA_37360.pep
AGILLVHPIPLKLFHMSPLYQPIYGIYLPFQVNVYVPKSKPSNKYPVLYARIAHVSTRVVCIFHVKRVILKGSGLRSLFLTR

SEQ ID NO: 142943 - protein, 103 aa, Triticum aestivum
  Clone ID: PAT_TA_37361.pep
DGSHGRSIPRPLILSLAAGEHACRCLRHLCLPSSSRSLCTKEIRLPSPSSPPGDYSMRGRGTSRLPVVGATNHERHPAMRISATPICQFVSLTLPIFSLVRQF

SEQ ID NO: 142944 - protein, 40 aa, Triticum aestivum
  Clone ID: PAT_TA_37362.pep
LKQNQHSLHDIYVHGGLYPTHACTQCSLILMHVHDCCRSL

SEQ ID NO: 142945 - protein, 39 aa, Triticum aestivum
  Clone ID: PAT_TA_37363.pep
KCVTFISMRVLEVRKLTSQSTYDIHTRTLDMRQDMTQAG

SEQ ID NO: 142946 - protein, 68 aa, Triticum aestivum
  Clone ID: PAT_TA_37364.pep
NVSCPVMPNDKLSHRTPMPPHVCHCGDPLDYKRRPKASKRRIQTLGQVTLIVASSRTPRTQIYIPKQD

SEQ ID NO: 142947 - protein, 69 aa, Triticum aestivum
  Clone ID: PAT_TA_37365.pep
VLNITVHSYVHATRITNVNTCISPMHNYSTRTTLISPCPYLKTILKFQTSHSIQHTHKKILHINLECLT

SEQ ID NO: 142948 - protein, 79 aa, Triticum aestivum
  Clone ID: PAT_TA_37366.pep
YRVVNSRVHIGVETLDEYFRTEGVPRNTMSTMEFVTEAKTRRMHFGMQLTNVDCWTLDTEGKTGLLSGKLQADHSRGCV

SEQ ID NO: 142949 - protein, 142 aa, Triticum aestivum
  unsure (1)..(142): unsure at all Xaa locations
  Clone ID: PAT_TA_37367.pep
GGNVXNHISKSKEIISDLAAMEVKYEEEDTALMLLCSLPSSYTNVRDTILYTXRDTLTLNEVYEALNSKEKMKLMVPHDGSSSSQAEGLSVRGRTKEKNSNNGNRGKSKNGYRGRSQSKDKKYCRYCKRDEHDISECFKLHN

SEQ ID NO: 142950 - protein, 82 aa, Triticum aestivum
  Clone ID: PAT_TA_37368.pep
TQESCLALQKQIPHTTVESKIFHKSNMLAAFYSMTSRHGLVIIRNVSHNQLLHVVRGGFLDTSCRSRDRVPLSRDSHQYGHG

SEQ ID NO: 142951 - protein, 81 aa, Triticum aestivum
  Clone ID: PAT_TA_37369.pep
AILLHLEAKVLSEVSTSQHGHEPEIPISSLRTSHMFYGVQNAFGAPTLSRKAWRTKLSCSHQNVSSRWSQHPQTTPEGLAH

SEQ ID NO: 142952 - protein, 51 aa, Triticum aestivum
  Clone ID: PAT_TA_37370.pep
CAQYSISPHAVELIIIYIANIIASSLVSHMALFRQRHYVICQAASGPGICL

SEQ ID NO: 142953 - protein, 98 aa, Triticum aestivum
  Clone ID: PAT_TA_37371.pep
FARSRGLDYQSRSLYSSCPREAEPNLVGPFYNLDGLISHIMVQGTTMDEPADDADSDEAPAPPKPRKLKKPKASKPSPTPKVSRAKPLATAPPKDCAV

SEQ ID NO: 142954 - protein, 68 aa, Triticum aestivum
  Clone ID: PAT_TA_37372.pep
IRRSTGSVYDDTLHHYHIALRDHVVDIVFMAKPPFIILSYMPLLIHCISRHTAGGFHIESYFVLSIEL

SEQ ID NO: 142955 - protein, 51 aa, Triticum aestivum
  Clone ID: PAT_TA_37373.pep
VLFLHKFWMQVEQLNGFVCKRYLFIYFTRMFVSSRDEIISQETYRYPLHMR

SEQ ID NO: 142956 - protein, 128 aa, Triticum aestivum
  unsure (1)..(128): unsure at all Xaa locations
  Clone ID: PAT_TA_37374.pep
MASEGSSGVGVGGRKPSVSHIPRHRGVVKFLTGLPARGNLSSCSNSSNLGSLMVXVSEHDIHPPEGSVIDMDTTKIVIIHLQLNNTDSEAKDTRSMTPQETREGIRCTAEFWVCINHPKSPTWAVSSD

SEQ ID NO: 142957 - protein, 68 aa, Triticum aestivum
  Clone ID: PAT_TA_37375.pep
YRPLAELSSGASKYIPWVECCELTSFQQISEAANLRDTAAVYGAADGLGVSDEAPESVIGEAVWLVSV

SEQ ID NO: 142958 - protein, 140 aa, Triticum aestivum
  Clone ID: PAT_TA_37376.pep
MGNILKCFRGDDEEQEDHYPYYRPGSRPHYPQQQQQADGHGVASLAHDLLNFESASMVPEGLRQHVTASKKAQIKWYQNMLEAYKNARTPPRTPEEAAQLVVSALNWIQSADLEGILEFYNFPIPSLPAASSNHRPSSLP

SEQ ID NO: 142959 - protein, 36 aa, Triticum aestivum
  Clone ID: PAT_TA_37377.pep
RPLEIEFEDTDLFDDAVNGNDVDMHDRERGTGIKVA

SEQ ID NO: 142960 - protein, 74 aa, Triticum aestivum
  Clone ID: PAT_TA_37378.pep
WKFSTINFNPPILEFNLAANCNVNLILPLRFAPSRVNPLNMSALFYPSHRYRVSREPRRRYRVNLGPPVISYHR

SEQ ID NO: 142961 - protein, 39 aa, Triticum aestivum
  Clone ID: PAT_TA_37379.pep
SPVHGSEITIIIRTLSHDQNISGQISPLPPKRYRPKKPT

SEQ ID NO: 142962 - protein, 138 aa, Triticum aestivum
  unsure (1)..(138): unsure at all Xaa locations
  Clone ID: PAT_TA_37380.pep
VHGARVILTSPRGDKFCYVLRLMFPCTNNAAEYEALIYGLXWMNXISLSQVWHLGDSYLVAQQVCRKWDSKDTLIAAYNRDSRXVSGHFNGYQVEHIDRINNESVDASSRFGSQRTPVPSKTFSDVLHNASIKLPTEE

SEQ ID NO: 142963 - protein, 81 aa, Triticum aestivum
  Clone ID: PAT_TA_37381.pep
VPVNGWFSFNFNFRQPWIFRVANTVNSRWIQHVGDWYSHPQFKKPNPAIMTCVSYVSHPTAASSLSLALMEHAFFGPVDRR

SEQ ID NO: 142964 - protein, 37 aa, Triticum aestivum
  Clone ID: PAT_TA_37382.pep
TVVMNDIDTDAHSNHPSGPLFFQSVLASLTFHLHPPR

SEQ ID NO: 142965 - protein, 46 aa, Triticum aestivum
  Clone ID: PAT_TA_37383.pep
SAMRPAIRAMLFLFLHPCIFSIIRLFVVVSRTKGLEHHKLCTRNRN

SEQ ID NO: 142966 - protein, 42 aa, Triticum aestivum
  Clone ID: PAT_TA_37384.pep
LFFFFIFFFSFRSVIVTGTHVTVLVGLDSLQQRTKIKDVSWF

SEQ ID NO: 142967 - protein, 121 aa, Triticum aestivum
  Clone ID: PAT_TA_37385.pep
HKKRNPTTKMNCTKTHKKIKAISRSKSRMNGVTTCGIMHVLRLIVKGGAQRVPALSSLTGHFQPPLRVPPISIPGPSFLHFRTGKTPGFPNFNPLGENPPFPRWVIPKKAPPFSPSQNFAP

SEQ ID NO: 142968 - protein, 147 aa, Triticum aestivum
  Clone ID: PAT_TA_37386.pep
VDGTSESKSLHESIRERHVSHPTPNPTAYNEADHCGWSTEEEIQADLKKLDAMEQDQQVTSLPQPGAMHVELDNSIRTNSVKAHSAKLSSYNNLKNSVPSSTISKMHPWVDNALSITWKLCKEIMDHKQHINKLEQDNRNLRDIIAK

SEQ ID NO: 142969 - protein, 54 aa, Triticum aestivum
  Clone ID: PAT_TA_37387.pep
ELVSHGSFFFEHQYRHKRSYTRAYTHPYERTHEHHIPMSTSERLSRHIILEILK

SEQ ID NO: 142970 - protein, 49 aa, Triticum aestivum
  Clone ID: PAT_TA_37388.pep
QHVQITFLTSFPKKHFLPLYCNLFSQLLNEYQKNIHEPHEILYGKWYTR

SEQ ID NO: 142971 - protein, 63 aa, Triticum aestivum
  Clone ID: PAT_TA_37389.pep
STSDTGGAWIHKSLRRHYIYVPLVMRLDNTVFFVSPVICGDEVINTLQHLHRQNDTKVPTRAP

SEQ ID NO: 142972 - protein, 78 aa, Triticum aestivum
  Clone ID: PAT_TA_37390.pep
TLQGYPNLAHDKLTIHEDNPPSRDPPIRLGIPVHKTFRQWKNKSSKTSRRANSLIVPARISSQATTDELCIQVPKYPN

SEQ ID NO: 142973 - protein, 119 aa, Triticum aestivum
  unsure (1)..(119): unsure at all Xaa locations
  Clone ID: PAT_TA_37391.pep
ATNTKAEKRPPASKDGGXKTGKTRSNKSVETYRIYILMVLNHVHLDIGISSKAMSIMNAFISDIVDKLASESAKLACYHEMPTNTSRGMQSTVGHIIVGELAAHTVXEGSTAVTKFNGA

SEQ ID NO: 142974 - protein, 114 aa, Triticum aestivum
  Clone ID: PAT_TA_37392.pep
KLNLQHFPSIYTIAVQAAGGIYEKVICNYFLLALTPNDKVWLMHLPEDSISSREDLCHEFIGAITGGHHELGKPIDLQLLQHKEGQTLRKYLQRFNTLQTNIPNIYPAAVITAF

SEQ ID NO: 142975 - protein, 120 aa, Triticum aestivum
  unsure (1)..(120): unsure at all Xaa locations
  Clone ID: PAT_TA_37393.pep
EDSSGVPVFAEYTLDELHASTDGFATDHIIFEHCEKEPNAVYHGXLFSSGTTVAIKRFDRSAWPDARQFVEEARAVGLLQSGRLSNLMGXCYEGGERLLVAEFMTHDTLAAVIRSVVRVC

SEQ ID NO: 142976 - protein, 123 aa, Triticum aestivum
  Clone ID: PAT_TA_37394.pep
NRDRCRFCQKVSNGGISRFKFHLSQIPSKGVNPCVRVTDDVREKVIALIEAMESHRELELLKRKRVAELSVLPKRTRELPSQPSSPGLPTSPAINPAFDPSQLLGLEVPAPVLRLSGAATKPR

SEQ ID NO: 142977 - protein, 59 aa, Triticum aestivum
  Clone ID: PAT_TA_37395.pep
DIVWRGRYEQRPFHLRLAPQILPSKPLLLASSSTLVCLYAVLSAFLWDLALFLGDLVSF

SEQ ID NO: 142978 - protein, 129 aa, Triticum aestivum
  Clone ID: PAT_TA_37396.pep
YFKAGDADEARAMFDRVPVRNLVSWNALIAGYAQIGRSEEALHAFHSMLEDRVKPDEFTMASVLSACAQLGSLKEGRKVHDFMDRMRIRKNHFVLNGLVDMYAKCGDLEHARKVFDSIQRRNTECWNSM

SEQ ID NO: 142979 - protein, 68 aa, Triticum aestivum
  Clone ID: PAT_TA_37397.pep
HYTECYNLNVSRCHCTERVSIYVHAEAHRGGGDIHSTTIASPRAAGRTESAICYSARLSRERCNNISM

SEQ ID NO: 142980 - protein, 73 aa, Triticum aestivum
  Clone ID: PAT_TA_37398.pep
EGFFLFARSDGPGWTNQTAARRPADIWRRLSSPILQTPKFLPTSLVHAQIYCDHSLTHTTSFTIKPCNRVFAN

SEQ ID NO: 142981 - protein, 87 aa, Triticum aestivum
  unsure (1)..(87): unsure at all Xaa locations
  Clone ID: PAT_TA_37399.pep
MVWEGREPLRDWICLSVSPFLDLALHRFFYXPEIRNSDWAXFWTRSLSGNXLCCGERMAPTALRGGHHGQWPARTLEVARCSWPPQG

SEQ ID NO: 142982 - protein, 44 aa, Triticum aestivum
  Clone ID: PAT_TA_37400.pep
MMHLPAIKGRMEKDIDEVGKIARSIKVKLEQMDRNVLTGINLSS

SEQ ID NO: 142983 - protein, 76 aa, Triticum aestivum
  Clone ID: PAT_TA_37401.pep
KTYKVGELVLRLPEKKKDKLKPKWEGPFIIDEVLTGKAYRLWDASDNRLEPNPWNAARLRGFYAYRRILCSSPSPL

SEQ ID NO: 142984 - protein, 64 aa, Triticum aestivum
  Clone ID: PAT_TA_37402.pep
MIRDVWVEMLCYAAYRCNENFHAKHLNDGGELMTIVALFMLYYSKDLIINTSAATDAHTTSENV

SEQ ID NO: 142985 - protein, 71 aa, Triticum aestivum
  Clone ID: PAT_TA_37403.pep
LAALSFPFFTGGWRKGVREWEVGVGWSSWSATSLGFSGIGPYMGSKWMDSYMGSKWTDSYMGCEWTALSLS

SEQ ID NO: 142986 - protein, 66 aa, Triticum aestivum
  Clone ID: PAT_TA_37404.pep
YAEIKSFLSLTAGTRQLYYDPFHENIDCIKDVKLFSFYSNSKKKKRKKTRKHLRMQGSATLLREKN

SEQ ID NO: 142987 - protein, 64 aa, Triticum aestivum
  Clone ID: PAT_TA_37405.pep
VFLCENLDIFAWHPSDMPGIPRKLAEHSLNILKGFKPVKQTLRHFSEPKQQAMGEELAELIEAG

SEQ ID NO: 142988 - protein, 136 aa, Triticum aestivum
  unsure (1)..(136): unsure at all Xaa locations
  Clone ID: PAT_TA_37406.pep
EDKENEEDEEEEEEEDDEEEEVEEEEDEEEXEEDEEEDEDEEDEEEEXEEEEEDEAEESEDDEEDVVEYDDELADDQDESVAHNLSTAMLRTSTQVCNWTITLTRTMTFETNLILRTPIGSPTNTSFITPPLTRSG

SEQ ID NO: 142989 - protein, 67 aa, Triticum aestivum
  Clone ID: PAT_TA_37407.pep
SDTQPNPMSSSKDNESKPYPELDESALFVAQAKLSRVFEISPLGTYQFLSDPRSFRTYHVGLPPGYK

SEQ ID NO: 142990 - protein, 123 aa, Triticum aestivum
  Clone ID: PAT_TA_37408.pep
TKYRSRLPPVYEGINLFQTPGAGPSNPTAANRAEAPRIALDQPRATEPPRRTVNLPQYVPTPSGHFSSPLDNMIAAASRLAAIPMEGDSIETVETRRARDLLQTAVVQQQAYSYSRDRIHLTP

SEQ ID NO: 142991 - protein, 65 aa, Triticum aestivum
  Clone ID: PAT_TA_37409.pep
RWSLSSNHATKLQRVTNFYSIAKHMLTCLHALHRCSDAHRINILLVASGHCIIKVSYQQCTLLEM

SEQ ID NO: 142992 - protein, 80 aa, Triticum aestivum
  Clone ID: PAT_TA_37410.pep
PLRLKVKAYVQFEVLLIRVTIARELNSYARLSERLLSPNRRRVVPLYKEADAQQPLESGRLIRVSGLDSKQYLPYTTSLL

SEQ ID NO: 142993 - protein, 41 aa, Triticum aestivum
  Clone ID: PAT_TA_37411.pep
VDKMNPTEMKTNERDLTRRHSALHDADHPARCGVLPPPAVR

SEQ ID NO: 142994 - protein, 73 aa, Triticum aestivum
  Clone ID: PAT_TA_37412.pep
AIWPRKSTRLIEAKELNDMCWFIYKPSAVAKDSFYIGHVVAVGNPTVSANTMRGHSAYIISHVRPKTHGALRP

SEQ ID NO: 142995 - protein, 145 aa, Triticum aestivum
  unsure (1)..(145): unsure at all Xaa locations
  Clone ID: PAT_TA_37413.pep
PGPTGQLINPGKCSILFSDNCMQSVADEVKHILEITQQVFEPKYLGLPVPEGRMHKGQFETTQERLRKRLVDWSEQYVSSGNKEILIKAVAQAIPTYVMSVFRLPASVCDDLTQMMRQYWWGXEKGKRKMAWLSWEKMMLPRVWV

SEQ ID NO: 142996 - protein, 116 aa, Triticum aestivum
  Clone ID: PAT_TA_37414.pep
RLQGVNPGRSQPKGKVTLPVTFGSDLNFRTMWIVFDVARIPWPYNGILGCPALAKFMAASHYAYNTLKMPGPVTIITIPSDKKDALICADQLNQQAVAAAAAARALALAAETPGEK

SEQ ID NO: 142997 - protein, 102 aa, Triticum aestivum
  Clone ID: PAT_TA_37415.pep
GLVQCLLHMDRRLEQHFLLSKLQKLVIFTYGPSIGDALSSRYIRLVGCTTPLCYGHTSLLWHQEYASVWLPNFFCSHQYRHKCSYMHTYTNPINTHTNTLPL

SEQ ID NO: 142998 - protein, 103 aa, Triticum aestivum
  Clone ID: PAT_TA_37416.pep
PNKKARLNKPADDNVAIEPEKTLDLEDTNADAMLNDPPPQDYDFVVEQVEVDPTGQSDKPTSPVRDTDKPSSPVKAADKPSSPVKAADDKADDVMITGFGHTT

SEQ ID NO: 142999 - protein, 74 aa, Triticum aestivum
  Clone ID: PAT_TA_37417.pep
SLQHSDPCVLYKSLCHLVDAATTRYYELFQITTLLYESGLLLRVIRISVKVCIDVTLYDELFYHLHNRENSLVH

SEQ ID NO: 143000 - protein, 68 aa, Triticum aestivum
  Clone ID: PAT_TA_37418.pep
KMFNVSRKIVDNVLKNANRVFHTAKHVLDIYPKYTVCIRRSRLRKYHFSENVNYVCQNVHRVYKKCFR

SEQ ID NO: 143001 - protein, 144 aa, Triticum aestivum
  Clone ID: PAT_TA_37419.pep
VDGESQVSHPAPRSTTNNHVDPFGPATEEEMDADLMRIDAMEEDHEVTSRLQDGLTMGEVQSSSIPNSVIPSNVRFLSYEIMKKSVTGSPAAMQHPWVQGALAVTGKLRKEIMNLKQQVNKLEEENRILKGIIAKNITITSPKR

SEQ ID NO: 143002 - protein, 134 aa, Triticum aestivum
  Clone ID: PAT_TA_37420.pep
EVDSEKSLEDEGENPETATDHSTLENPGADANPPKAEPKIQVDTSTDATPPNQTADPPSHGTKPPSPTAKAPSPAKENINPSSPAKDDDVVVTGTAYTAPGNLVVLSKHTAKDEFAFMNKGKRKTDLSDYANLS

SEQ ID NO: 143003 - protein, 128 aa, Triticum aestivum
  Clone ID: PAT_TA_37421.pep
PVNRASDGSSATGAGQLTYLDFMCQAWLRWGSLDHAWIQTLSYMRLVKGEIAYFTGLTLQAESGIVSRGCESFGAIERHVGGVFVSRIEELAQGMVMCRSTLRQVERPLLARAYPADEHDLDCVNKRD

SEQ ID NO: 143004 - protein, 71 aa, Triticum aestivum
  Clone ID: PAT_TA_37422.pep
LWKFFIQHPCRALAMHFTNEYVSNHLYVQELRKVLIPHPCYNIEVFVKRTSESAGRCLVVDGCERVHLLRI

SEQ ID NO: 143005 - protein, 39 aa, Triticum aestivum
  Clone ID: PAT_TA_37423.pep
GCSCLTVQRKLYLKEDSAFFLVRKLKPAKHVFYMKTSKF

SEQ ID NO: 143006 - protein, 90 aa, Triticum aestivum
  Clone ID: PAT_TA_37424.pep
FVLQLYVESLCSKLEFTFHMIAVYVKFYVISLQSKKSTLQRKQTILRFGKTNVYSYHITRIHMVVCVSLFLIYKLSTESCSVAKTLICKP

SEQ ID NO: 143007 - protein, 96 aa, Triticum aestivum
  unsure (1)..(96): unsure at all Xaa locations
  Clone ID: PAT_TA_37425.pep
DHPEIATSLESAFTVTFAKRXEQDIAELKSAIKELDSQLMPPSVQTRLLSLVPTIHXEFTRLNTLAEEIYRRDXSKLHENVAAVNSTPSSIHRKML

SEQ ID NO: 143008 - protein, 121 aa, Triticum aestivum
  unsure (1)..(121): unsure at all Xaa locations
  Clone ID: PAT_TA_37426.pep
IKKNQTSQTSILEGVVQPSQSAFMPDRNILEGVVVLHETLHEIHSKKLDGVVFKVDFEKAYDKVKWRFLXQALRMKGFDPAWRNQIDSFTQKGGFGIKVNDXVGYYFQTHKGLRSRRRARP

SEQ ID NO: 143009 - protein, 96 aa, Triticum aestivum
  Clone ID: PAT_TA_37427.pep
EQLMMSWLGVSHHAVSRLGGHALGLGLDVRASILARLEARSSSARLGSARQLKRTSRAGNIGPFSDRAEPVFARSSSVARFVAHSNFKIPQPSATR

SEQ ID NO: 143010 - protein, 113 aa, Triticum aestivum
  Clone ID: PAT_TA_37428.pep
KIQLLRWSSNKLVILTKDNLTNRNWTGPIRCSFCDRNETIKHLFLDCPLSKVLWQTVHITFNITPPNSVITLFGTWLNRIQPDLAIHIRVRVCALLLTVSTCIYDLVFNRISH

SEQ ID NO: 143011 - protein, 93 aa, Triticum aestivum
  Clone ID: PAT_TA_37429.pep
VDAEMSCTLASSTETSAKSWLFSLLDTLPHDKFVLLAVTLWAIWTARRKAIHEAIFQTPHAIQMFITRFLADLEAIRTPNPTRAPLARTGTLI

SEQ ID NO: 143012 - protein, 82 aa, Triticum aestivum
  Clone ID: PAT_TA_37430.pep
SFSARNRVFPKISWSLKKCSLCVILSTFATLFLILRVHKIYPQSERCLVLGRAPCQLSQKKIMAHRRTTISLRVRQVNRTVK

SEQ ID NO: 143013 - protein, 76 aa, Triticum aestivum
  Clone ID: PAT_TA_37431.pep
RVDRDIEHGQNTKCAPMQINLPETWHDTQGHYIECTCKLTTDIRTMVDNIMIINQVKLMQEITTNAKLCKATKQRI

SEQ ID NO: 143014 - protein, 75 aa, Triticum aestivum
  Clone ID: PAT_TA_37432.pep
DIKLEYTSQTSVRSQPRRRPSQLQNSLPMALIKIRINGYRRVGTLCGQSCAPKPRCRGRHGQRHLQHHRLHDLHV

SEQ ID NO: 143015 - protein, 59 aa, Triticum aestivum
  Clone ID: PAT_TA_37433.pep
QVTSWRFITNLEDDVMAFYRIYVKVWKEEFFYVLKIDMNKFKSISGLMLEILLLSINRP

SEQ ID NO: 143016 - protein, 36 aa, Triticum aestivum
  Clone ID: PAT_TA_37434.pep
VWLTGPLRHWVVLGSFTPCLYSRTLISLLFGLSEFY

SEQ ID NO: 143017 - protein, 67 aa, Triticum aestivum
  Clone ID: PAT_TA_37435.pep
VCTCWLMRHLVKGRCVANIFVWVTTGRSQWMIFEWILSSIAISQAIQEKMSAYVVHVRWHTWKEIQN

SEQ ID NO: 143018 - protein, 127 aa, Triticum aestivum
  Clone ID: PAT_TA_37436.pep
DMNLQEEEILKLASLGNHGNLENAVDVLKRSLALRNKSYKDLMVQCNHLGRSESRAQQRIEKDKELIKKLRAKVLDLQKELEEKENNVIRDLRSSKKFKADQNQTNPVNANANNGFSSPSAGYGNQT

SEQ ID NO: 143019 - protein, 78 aa, Triticum aestivum
  Clone ID: PAT_TA_37437.pep
VIEWLISLTLYHDSPFSAFSTEVLVWMNQGAERKAAKHRSRANLTFDQRHDLELMHIRPNSRRRTLPKVFGLYGVNWV

SEQ ID NO: 143020 - protein, 69 aa, Triticum aestivum
  Clone ID: PAT_TA_37438.pep
TIAHPTLDHRLIIQPAISQGRVHPRFDLLTFIQPSNITLCPDHQDHFYSAPFIEVLFACIPEYSAYLTP

SEQ ID NO: 143021 - protein, 123 aa, Triticum aestivum
  unsure (1)..(123): unsure at all Xaa locations
  Clone ID: PAT_TA_37439.pep
GPTGLPNHKQFIRVNRMLYIAQTFIWLXVSFVPPHHKQFIPVNRMLCIAHTFIWLPVSFVPPHRKQLIEMNCMPFITHATKTLTVFDASVIANILYIFDGFHTPLFVIIASHTVSRKVSDYSV

SEQ ID NO: 143022 - protein, 121 aa, Triticum aestivum
  unsure (1)..(121): unsure at all Xaa locations
  Clone ID: PAT_TA_37440.pep
HFIDRCTTCQKAESRLNPHGLYIPLPVTNVPWEDLSMDFTFRLPLINKGMDSRFDVFDRFSKMEHFIPRHXSDEPVKVADLYFHEIIRLHSVPNTSVSDHNTKFLSHFPRFRWPTLGTKRL

SEQ ID NO: 143023 - protein, 82 aa, Triticum aestivum
  Clone ID: PAT_TA_37441.pep
GRRNVSLYGQALPYPMYFADVAHFDRSCAIDMLTCQAHLSHTILFAPDLMKLIARPSMPSCRHALEPTESWRETTSSPCTLL

SEQ ID NO: 143024 - protein, 52 aa, Triticum aestivum
  Clone ID: PAT_TA_37442.pep
NRSQRIDSMQGKGSYSKHATHSRSNFVNPHDLIQLHIRNNSDQVVSHGVSID

SEQ ID NO: 143025 - protein, 88 aa, Triticum aestivum
  Clone ID: PAT_TA_37443.pep
TLMELQMQSVFTASYDFDHVDVNVSRKRKDVKSSYVPRKMSDSMICVQETLQELMFDLEGVFLATNDLTTTPTLSGRAYSLTPDMTGT

SEQ ID NO: 143026 - protein, 73 aa, Triticum aestivum
  Clone ID: PAT_TA_37444.pep
PFKSRRCGIPSLSYLGRGPRPLYIGLSHHHRRGPESEQAEHHTSSRTPHLLRLVHPCTSSFIAPRGNPPHHTG

SEQ ID NO: 143027 - protein, 122 aa, Triticum aestivum
  Clone ID: PAT_TA_37445.pep
GSGGSEEGRWRLGYARVEDRAAALVTGDGEERACAGDSGYFSADFLARGDWGPREGPHGKNGGGRDTSQKEIDAWWSSFPSPVTAKLVIPYKPESPYLIRSSTSSFSFRIIHPEEVIGGLTA

SEQ ID NO: 143028 - protein, 38 aa, Triticum aestivum
  Clone ID: PAT_TA_37446.pep
GSTGRQRSRELVLIDGTDLVMTPTSQDMNRATLYKMIL

SEQ ID NO: 143029 - protein, 68 aa, Triticum aestivum
  Clone ID: PAT_TA_37447.pep
KLAIAASCTSFVSTEQSKTAYGCIQSSIIQIYLRHSDCFIIVLLVLRLLGRIYHRGQADRACGIVSNL

SEQ ID NO: 143030 - protein, 80 aa, Triticum aestivum
  Clone ID: PAT_TA_37448.pep
AIRLIASIRIAPDNKRSSRYCSRMLLTHHHYLRLLRWLKLTWMNCHRTYRWNRFLNAAPLVSVFLARSPIILINKLRSRV

SEQ ID NO: 143031 - protein, 127 aa, Triticum aestivum
  Clone ID: PAT_TA_37449.pep
STHSNIQGHMATVATTAPTPVLFNQRPLPRVSPSSSLPPPRHQPGKGSSTSPHHLRPTPWPARAQAFLRRSKLVADPISTHAHRDAAMTPFLCDPRPEMPSPSTSSSPASRNRGRCPDQRVFSPSQA

SEQ ID NO: 143032 - protein, 58 aa, Triticum aestivum
  Clone ID: PAT_TA_37450.pep
THEIIPLWSMFLQLCHQTCCVLSFHVYGIKYITCHDLFDRPNFFLSLCLSLSVCVCVW

SEQ ID NO: 143033 - protein, 81 aa, Triticum aestivum
  unsure (1)..(81): unsure at all Xaa locations
  Clone ID: PAT_TA_37451.pep
VFKQGSISYTTTNSNXYYSYISDFVLNSWSNVWWENQKYYALTIVCLLCNLYHQCPTVYAACNILSAASTCFSCLLCILVS

SEQ ID NO: 143034 - protein, 70 aa, Triticum aestivum
  Clone ID: PAT_TA_37452.pep
LLGAVLELKPTTTWSEPLILSATTSESLVGTLRADPTLFTTCIIYHVCHYVPVIISQLIMVLFHIMADGQ

SEQ ID NO: 143035 - protein, 66 aa, Triticum aestivum
  Clone ID: PAT_TA_37453.pep
SMITTCYMNISWQSKAWHEATQSIQQKSLTYHKPKGIRKYNGNHVNIVTFVNRFRLSRKTGTWLNR

SEQ ID NO: 143036 - protein, 58 aa, Triticum aestivum
  Clone ID: PAT_TA_37454.pep
LPTCNALDTAISPTCRAMTYMHNHIQSIVASKALFRTSHVYRYYKGRYIVGLHSPYHT

SEQ ID NO: 143037 - protein, 60 aa, Triticum aestivum
  Clone ID: PAT_TA_37455.pep
GILCPDGRSSHRMGQEVREVVPRLLEVALRHMDIPLMGEPDYGHEDHALIVKPAVALACN

SEQ ID NO: 143038 - protein, 84 aa, Triticum aestivum
  Clone ID: PAT_TA_37456.pep
LYLELYLYLLHEMCFAWIVVHYTSHCLLVYHNHPCCAHLFGRSLLGSNLLEYVYVRHVRSFELDSFCSIASLISFRARWCHNFE

SEQ ID NO: 143039 - protein, 80 aa, Triticum aestivum
  Clone ID: PAT_TA_37457.pep
VDAGQEHISPKWSQPALSLRDKVTVGGRLELMPTTTWMEPPIISAPTSVSLVGTLQSDPTLVSTCITHYVCNYLPVLNSL

SEQ ID NO: 143040 - protein, 57 aa, Triticum aestivum
  Clone ID: PAT_TA_37458.pep
RFSVFFVVFCFVAVVGAVAVAVAADLVVDVLRRAVSVLAVLGVFAVLGIVVRGLVVV

SEQ ID NO: 143041 - protein, 41 aa, Triticum aestivum
  Clone ID: PAT_TA_37459.pep
VQRLLVCFLIVLFNIIGIPGRIMTNITWEDRLCLIHHEERC

SEQ ID NO: 143042 - protein, 56 aa, Triticum aestivum
  Clone ID: PAT_TA_37460.pep
TIGIFPYDSFALDFIGNIPPRGKIPLWIQDLLMEKIGYLCILTFVDFGSHVSLCVL

SEQ ID NO: 143043 - protein, 62 aa, Triticum aestivum
  Clone ID: PAT_TA_37461.pep
ITRHILLADCDRCLIYDQVLHLCLTTLRSVCSYIISAYILCIGSHNCHTISESTTDDQSVTS

SEQ ID NO: 143044 - protein, 74 aa, Triticum aestivum
  Clone ID: PAT_TA_37462.pep
VWTKPMCRRQTGGWSLPNCGANKAHLQLHTHVLIRVHLPALTRISFAARLSETFSTYFCRLQVDDYSWFCEVTN

SEQ ID NO: 143045 - protein, 106 aa, Triticum aestivum
  unsure (1)..(106): unsure at all Xaa locations
  Clone ID: PAT_TA_37463.pep
MMHDLMPTSVHKSRHMGILDGKRTLGGEHIICIDGYSLTETHYTVLHKSALVAPXLDEHNNLIHSIHPERSDHCIIREQAKSFASWLQTFTMHDTYNEYDIYLQSQ

SEQ ID NO: 143046 - protein, 48 aa, Triticum aestivum
  Clone ID: PAT_TA_37464.pep
RKKDDIFIICFCCFYIHMYVCLVIRHASEIDCAFRSKHYACSKSVHVV

SEQ ID NO: 143047 - protein, 55 aa, Triticum aestivum
  Clone ID: PAT_TA_37465.pep
KILLLLLLCSLPVITSNVADYGMPFILHIRHTCIPRLRERALHMMQACRSLLAKS

SEQ ID NO: 143048 - protein, 103 aa, Triticum aestivum
  Clone ID: PAT_TA_37466.pep
LNRSRSPQSTYQLNQVSTPRPRRPPNTYTASLRALVNSLMHNMQFSRNSESTFNLIQSVGPYPFGVENHSAQEKLHSGCRQSGHCRHTKSILYRVSLTKPLLS

SEQ ID NO: 143049 - protein, 37 aa, Triticum aestivum
  Clone ID: PAT_TA_37467.pep
RVTYHPCGDPGHGWSYVDRQAFEIPSFFLESVLRAII

SEQ ID NO: 143050 - protein, 72 aa, Triticum aestivum
  Clone ID: PAT_TA_37468.pep
WGALNAPYPVMASDKLSHDTPMPPPVCHCGNPLDYKRRPEASRRRIRTLGQVTFMVASSRTQRTLRYTLKQD

SEQ ID NO: 143051 - protein, 54 aa, Triticum aestivum
  Clone ID: PAT_TA_37469.pep
PAMMSSSIKFILFCHISTDLYLNDHPKNRGVRVAGYPCLASSFLAPSLSVLPYK

SEQ ID NO: 143052 - protein, 55 aa, Triticum aestivum
  Clone ID: PAT_TA_37470.pep
SLRHPSGCLGRVLSGARTDVCKMIDVRQSAVNEKMIVLRAIGLALLDMIVSAEFP

SEQ ID NO: 143053 - protein, 56 aa, Triticum aestivum
  Clone ID: PAT_TA_37471.pep
SHVRLTDQFLSLNRERDARCIGTVSVTVFVVTHNVITARFIVSTVAPPTCASTDLT

SEQ ID NO: 143054 - protein, 120 aa, Triticum aestivum
  unsure (1)..(120): unsure at all Xaa locations
  Clone ID: PAT_TA_37472.pep
WWGWLCLFGILGKLGVPLRDAKGPLTLPRILRYIDMRTVLXGKVIESHYHXGYSLLGMPHNTHVQVTGINLDYNQVRRAGPIENLRLKVSGIEDEDIMAGFVLSSVANPIGAFTEFNAQL

SEQ ID NO: 143055 - protein, 56 aa, Triticum aestivum
  Clone ID: PAT_TA_37473.pep
LAHRASGIRFSYLSLPTKLITGKYVLLHAIIPEPTTTIPDLPLCSLEERLESEQFF

SEQ ID NO: 143056 - protein, 72 aa, Triticum aestivum
  Clone ID: PAT_TA_37474.pep
EWRPHAGEIPQHMLQMLPPVNSELRETLCRRTTATTSTSNRCTRSMSCDGCQREIGDDLCHDSIGPRSDGYG

SEQ ID NO: 143057 - protein, 64 aa, Triticum aestivum
  Clone ID: PAT_TA_37475.pep
SSTGNSMMVAISHNIYSTFICVNFKVYMFGLCFCDILGCQCFDWVLPSQCLAFRYVLALLLHSW

SEQ ID NO: 143058 - protein, 91 aa, Triticum aestivum
  Clone ID: PAT_TA_37476.pep
RYVLLDMMILCFRKPWFISTSGQFGYINSSMMSFDHWSSITRAPSRTSSIYRSGLRWSLPPEWTLNCDDGGLHFRAVHLDTGMGQTRIFHT

SEQ ID NO: 143059 - protein, 72 aa, Triticum aestivum
  Clone ID: PAT_TA_37477.pep
LSVSCLVPVPVGFCVVFFSCFGFSCFGLCAFGLARALAWLCASRRSACSASHEPSLGDAPGLRSFSSVHWFL

SEQ ID NO: 143060 - protein, 37 aa, Triticum aestivum
  Clone ID: PAT_TA_37478.pep
TESSRTENSSSPRIASSSKGACNYYPRLLHLPLTHEG

SEQ ID NO: 143061 - protein, 36 aa, Triticum aestivum
  Clone ID: PAT_TA_37479.pep
RETVVRSVWFLACLRLCQSACDFGMLVFRFWFLLRL

SEQ ID NO: 143062 - protein, 64 aa, Triticum aestivum
  Clone ID: PAT_TA_37480.pep
CERIAEELDVGNCADEVSDPTLGYLSRTSRKRPHGHGVYTTSTSAFSNRHTGTPRLETTYRIAQ

SEQ ID NO: 143063 - protein, 102 aa, Triticum aestivum
  Clone ID: PAT_TA_37481.pep
RARTKENRAPLFFQVSEQHQEEELKHDHQEAPPQQQTRRRPYARHLLFGCESVQGSWVRLMPMSVAALDTALSLRAHIIFYNSAIFSQVFIILPSLVLICIA

SEQ ID NO: 143064 - protein, 53 aa, Triticum aestivum
  Clone ID: PAT_TA_37482.pep
SCLFIFILFNFIFAISKSCNEEKEHLPSMIYTLKTFSRDSSSLMSRLPLLHFP

SEQ ID NO: 143065 - protein, 120 aa, Triticum aestivum
  Clone ID: PAT_TA_37483.pep
KEEKRAPATNEAGGEGKTRGRKKGSKANKGVETYKIYIFKVLKQVYPDICISSKAMSIMNSFINYIFYKLAWESANLARYNMRLTITSREILTSVRLVLPGELAKHPVSHGTIAVTIFTS

SEQ ID NO: 143066 - protein, 73 aa, Triticum aestivum
  Clone ID: PAT_TA_37484.pep
LNDQPSFSQGPSTTDHGSSARYCKTLHMYNMYVYLASSFSLFHPSFSAHIYTLEIVFLPHLTLSHAIKVAATQ

SEQ ID NO: 143067 - protein, 83 aa, Triticum aestivum
  Clone ID: PAT_TA_37485.pep
RTWIYLLIPPFTSQSQLSTCRGTGTGIYALRRCIHSYFRSSKYAPRVLKGHLSLIIALMLAIVIYCTCMTRMFVWQAVKVCST

SEQ ID NO: 143068 - protein, 78 aa, Triticum aestivum
  Clone ID: PAT_TA_37486.pep
ATLNVGILLDSSSSFTSMECLHCSLHYHYSLRAPSLIWVVTVVFDSFTSIFYGSSLCHFSSPKIIRNKLLLDNTGFYT

SEQ ID NO: 143069 - protein, 72 aa, Triticum aestivum
  Clone ID: PAT_TA_37487.pep
PTDSYLLQSIELWLDLAYPSATLGLTEPQSVDHRQPVLTKTSMVTHVDIHMPELINEATGNLYPTDLSDDYQ

SEQ ID NO: 143070 - protein, 78 aa, Triticum aestivum
  Clone ID: PAT_TA_37488.pep
LAQDCASVTSATFPLYSVVAFAHLALVTISRLYGTMATARLLACLSWHVLDLYCVRLYACSFHAIFLCVNYLIYVWFQ

SEQ ID NO: 143071 - protein, 72 aa, Triticum aestivum
  Clone ID: PAT_TA_37489.pep
LGSKAWEGASPSCAPELIYRAECNGSLRPSERACGLEPGEGCTHRTSKLQLDTLRRYGLGTAHHTGEGTRKQ

SEQ ID NO: 143072 - protein, 67 aa, Triticum aestivum
  Clone ID: PAT_TA_37490.pep
WCLGLLAMVLRCAGMAWPAFPFSFRLVSSSCPGQFIRDCLVWGLYVILSCQVFLLSYQIGLDMTVSL

SEQ ID NO: 143073 - protein, 38 aa, Triticum aestivum
  Clone ID: PAT_TA_37491.pep
VRTPSLRPISLVSLKGRFPNLYRLRSQGIHNDSWILRT

SEQ ID NO: 143074 - protein, 111 aa, Triticum aestivum
  Clone ID: PAT_TA_37492.pep
GTSIPYACRLLIGFAVVHDYVFICCFNSFMVFTQLHLDIWISSNAMSITKSCISSCDENLARDVVMLVRHRLKGAITSCDIQYSVLLEIPVELNMHALFEVTMAITMFISS

SEQ ID NO: 143075 - protein, 98 aa, Triticum aestivum
  Clone ID: PAT_TA_37493.pep
VSATLGSRLVMSARVLCHMDASDTIIYVSQKAQTVPGHGKATPVGIPCVRPQSDMRCYRLDRCDLELGSVTALVSEPDCLYDYQAKLVEVESRNALVM

SEQ ID NO: 143076 - protein, 130 aa, Triticum aestivum
  Clone ID: PAT_TA_37494.pep
DGDSSQDEEKISAAADGSYGVDTNWYVDSGATNHITNELEKVTMKEKYRGKDQIHTASGEGMGIRHIGHSIFNTPSRKIHLKRILHVPSAHKNLLSVHRIAIDNHVFLEFHPFFFLIKDQATRKVLYRGR

SEQ ID NO: 143077 - protein, 85 aa, Triticum aestivum
  Clone ID: PAT_TA_37495.pep
YKQSGYCSILLILWQMGPGRTVRPPRNAPQSQGQHSGSTSASKSRKVRGINKGNGLERLIKRAGHPLNLTIFEERRPIGENTELL

SEQ ID NO: 143078 - protein, 88 aa, Triticum aestivum
  Clone ID: PAT_TA_37496.pep
SEGGRTRWVPSPMGHGPRAVTSSSRHRSLPFFRSSFPVILGRALGTARADNVLNVHENESNLYLSLIIGWYLYQALRHKTHRETLPCK

SEQ ID NO: 143079 - protein, 129 aa, Triticum aestivum
  Clone ID: PAT_TA_37497.pep
LPEGVLDSLSPEQVLNCNTEEQCVELVSHIPVTHAALLSWVVELMADVVEEEESNKMNARNIAMVFAPNMTQMSDPLTALMHAVQVMNLLKTLVLKTLREREDDEGSYSTFSSSPTLSDGLDEVDREHD

SEQ ID NO: 143080 - protein, 97 aa, Triticum aestivum
  Clone ID: PAT_TA_37498.pep
VSNSYHHELLPVQGKSLPLRLSFGHLLFQVDVVVLRDGNPAHLVLQLMSFLLHSRKQDHVGSGLVLVKNSIELLQSCINQKQTRNELSDSMINYERN

SEQ ID NO: 143081 - protein, 117 aa, Triticum aestivum
  Clone ID: PAT_TA_37499.pep
NRTLAIETDTVQAVEMNDIDDNHVGIDLNRVISTASAPTAHCDDREAKNISLRLASGKPVRVWIEYNATETMLNLTLAPLDRPKPSIPLLSRKMNLSGIFSQEHHVGFSASTGTAAS

SEQ ID NO: 143082 - protein, 53 aa, Triticum aestivum
  Clone ID: PAT_TA_37500.pep
LYLTNGSTERKLLKRKLPLLSMETIKCGRGEQSEQHWTTVVDQHTRQQPVSHK

SEQ ID NO: 143083 - protein, 44 aa, Triticum aestivum
  Clone ID: PAT_TA_37501.pep
LVLSLVSHACSSAYGVLATVPRCCSPPKGRFLSASHLTATGNTT

SEQ ID NO: 143084 - protein, 47 aa, Triticum aestivum
  Clone ID: PAT_TA_37502.pep
EYVASSCITALTQDCLPPVQDVTEEDDRGLTGTRVVRHALVVPISSH

SEQ ID NO: 143085 - protein, 111 aa, Triticum aestivum
  Clone ID: PAT_TA_37503.pep
PSLGHLTSTTHHRKREFVRVQSQIDQICREIAGTTEVGAHVATPHVIADYLIPERPDDFPSHLQELQTRYTNRLAKVPEYVSMVHYLCAVLGMDVLSTVTEVHRTPDDSSC

SEQ ID NO: 143086 - protein, 47 aa, Triticum aestivum
  Clone ID: PAT_TA_37504.pep
ETLGPFDPQLRHANSGLTDTNMAYRQGSRVPVTGALSGVAPRQSRSQ

SEQ ID NO: 143087 - protein, 151 aa, Triticum aestivum
  Clone ID: PAT_TA_37505.pep
LHARGHGTIKRQLAAIAPTLEQLNKKKNERKREFVSVQSQIDQICGEIAGTTEVGEQVATPQVNEDDLTLERLEDFRSQLQELEKEKSNRLEKVLEYVSMVHDLCTVLGMDFLSTVTEVHPSLDDSIADNCKSISDETLSKLDETVPTTHE

SEQ ID NO: 143088 - protein, 61 aa, Triticum aestivum
  Clone ID: PAT_TA_37506.pep
LWYVPSSLLLCPCRWVVLGGVLGLLRLLAWGLFSRARSCFVRFLWGACPVSFLLLLSWRFG

SEQ ID NO: 143089 - protein, 71 aa, Triticum aestivum
  Clone ID: PAT_TA_37507.pep
GPQISKNEFQRSSSKSGTSIAPAPKVTNTRVQRPKLTPELLGSEDGLGGVPHGFPKSAQVAWPTRYTEVFF

SEQ ID NO: 143090 - protein, 72 aa, Triticum aestivum
  Clone ID: PAT_TA_37508.pep
SDRPRGTQRRDTRRPPDPNPHSRRRPRAPTKPTTAPPQTESQNATTGTGRRKTPVWMQNTRRVHGNKAAACP

SEQ ID NO: 143091 - protein, 90 aa, Triticum aestivum
  Clone ID: PAT_TA_37509.pep
SGSSPQARPKWSMAENDLLEKRIKPETMRWPDRCRTWFFGSGGTLDPVTGFCQWTDQHLAIPVMNLVWEPSYFKNFLRSRKLMVMAYPRG

SEQ ID NO: 143092 - protein, 41 aa, Triticum aestivum
  Clone ID: PAT_TA_37510.pep
GDIGNIRILQGQRRHVVVVKRSGGQVGPSRLAHIDVLFPLL

SEQ ID NO: 143093 - protein, 67 aa, Triticum aestivum
  Clone ID: PAT_TA_37511.pep
ELFRIIMIFNILKLLFINFLFKFYNHIPDKANIIWLDTGQLYWTKSPFTHPVLLTCVGAKRFLCHPK

SEQ ID NO: 143094 - protein, 75 aa, Triticum aestivum
  Clone ID: PAT_TA_37512.pep
SNLLYCPRCDDMHKHLDLTYAKMHLRYYCFYLGLFESYLILVILETYIELLPLSIPFIQSELRRRKYEITNMTAG

SEQ ID NO: 143095 - protein, 59 aa, Triticum aestivum
  Clone ID: PAT_TA_37513.pep
SRSLRVATSVRTRSSDDVILLGCLPPSFPRASIFNLVTWYLVPCLSLNTVSRSRFRHDG

SEQ ID NO: 143096 - protein, 115 aa, Triticum aestivum
  Clone ID: PAT_TA_37514.pep
ESEQKVKLIRDRLKVAQSRQKSYTDSKRKETVYKVRDRVYLRVSPLRGVKRFGVKGNLAPRFVGPYKVLERMGEVAYKLELPEGLSGVHDVFHVSQLKKCHAEMADIPLRDTVPL

SEQ ID NO: 143097 - protein, 76 aa, Triticum aestivum
  Clone ID: PAT_TA_37515.pep
YIMPLLSCILCLANHALLSGLCYLLLKLVVYVSKKPLWVEHMPSLNPVNPKVFTSHTLLVLHQIKFQHCNFIEREK

SEQ ID NO: 143098 - protein, 72 aa, Triticum aestivum
  unsure (1)..(72): unsure at all Xaa locations
  Clone ID: PAT_TA_37516.pep
SELHHKLACNYNDLNAKVEALNSKVRYLEGQSASSSGPKVTXLPRKSIQNPKEYANVHAINIRSGSEKSTRV

SEQ ID NO: 143099 - protein, 61 aa, Triticum aestivum
  Clone ID: PAT_TA_37517.pep
PHIVSAQPLYFYHLAHPSFCLLSVALSETMVKENNLIVSLHTAAGFLGFRPVINDELGFKN

SEQ ID NO: 143100 - protein, 48 aa, Triticum aestivum
  Clone ID: PAT_TA_37518.pep
SHREFCNMSFSLLKNEKNWTNKNFCSIWLLFWSWFSLSDFFQVLFKVN

SEQ ID NO: 143101 - protein, 118 aa, Triticum aestivum
  Clone ID: PAT_TA_37519.pep
HEDSTTKMSKPDELQDDAPKFDFTAIPLCGIDDAESSTILFQDGAATSTTTETFKDHALEASDLVTIKDDVSMLGGESDDVPSSAFIHGDDDKMIEHGISPSVMEESDDVPSSAFIHG

SEQ ID NO: 143102 - protein, 55 aa, Triticum aestivum
  Clone ID: PAT_TA_37520.pep
TDGGWISTTNSPSDPYNLLYLSPYTTSYLVKIKSRLPTKTSLLILINQTFLKNKM

SEQ ID NO: 143103 - protein, 58 aa, Triticum aestivum
  Clone ID: PAT_TA_37521.pep
NTTHRQRRHQGSRSTHAQRTNPRTNQPPDSRGRPPLDRHKDVSPSSQPQPKTHTRSPP

SEQ ID NO: 143104 - protein, 90 aa, Triticum aestivum
  Clone ID: PAT_TA_37522.pep
GRVRASAEEETERVPELALTYWPTDRRRSDNGRAVNGRQRAAAVCSPAWRLIRGPNRSESGLARAKRAISRVGSFLPRFSLNLVVFRTKT

SEQ ID NO: 143105 - protein, 127 aa, Triticum aestivum
  Clone ID: PAT_TA_37523.pep
EATIHGRPLSVDVMASATPVHVSAWSKRAARRSRPSLVWLGIGAELRPCCGMRCTSPIPSGLVSAHVEWWRQASDSVSLRTYSGRTRSDLSSPGSRSRDSNVRWHVGASMPSWPRSSLATRHSRFIG

SEQ ID NO: 143106 - protein, 96 aa, Triticum aestivum
  Clone ID: PAT_TA_37524.pep
IIDYATILLLFLISPACTIFRAQVDNPGNAVNAGYPRITSPRVSRGVVITSLTHTRGVWVTLTGCSTISGVGLGFTLCPSTMLCHHFIKSCSLRGH

SEQ ID NO: 143107 - protein, 50 aa, Triticum aestivum
  Clone ID: PAT_TA_37525.pep
ENFPSNHPSDGCSSLSTVNLRVLLDELLVEQPVLADIGCLFASLWRTRMT

SEQ ID NO: 143108 - protein, 84 aa, Triticum aestivum
  Clone ID: PAT_TA_37526.pep
LYYHYIVISTQLSSVKLIIAFNSHTMIVFTSNYHDVYDSHNILSDSCAFIYVLKFTMPPWCQRCKICARANDNILHKTYVIING

SEQ ID NO: 143109 - protein, 69 aa, Triticum aestivum
  Clone ID: PAT_TA_37527.pep
GDPSCVGVSDGTVNCTSSSVSWLSNCAWKELKSVSCRTAKHERTERQIESTLHLCHVYLHCCMKCPVRR

SEQ ID NO: 143110 - protein, 88 aa, Triticum aestivum
  Clone ID: PAT_TA_37528.pep
KPYLACSFPSHTHTFLSIGLISLSIWRARAHTHTHTHKPYLACSFPALSAPSSQALSTRFIHTLECVQNVDFIMDDVELWLVLLHPTK

SEQ ID NO: 143111 - protein, 131 aa, Triticum aestivum
  Clone ID: PAT_TA_37529.pep
SAWTNGRLSFLVSMMKEYSDVGKYRGQNGWTKEGWQAMKDRLNARPPGANFTVQQLKDREQRLKKELNVVKSIVDKSGFGWDPKNKVLTALDEKWEELSSEQRKWRHKPFPYYDVLYEIHEGLFLTMIKFK

SEQ ID NO: 143112 - protein, 78 aa, Triticum aestivum
  Clone ID: PAT_TA_37530.pep
PSILGACMLLGCLCRLIRYLLDCELYVDFVSLCTEYASWRPASEGLGQEAIYSFAFLLSTMLSTFSSTSEALILRSHL

SEQ ID NO: 143113 - protein, 105 aa, Triticum aestivum
  Clone ID: PAT_TA_37531.pep
RIFEAYSGILQGIKGPKAQLMVPYATHLLQFTEAVYKDGSRDESVTKAAVAVLGDLADTLGPISKDLFRNHLFHVEFFRECLDSDEEVREAASWAQGMINQAVVA

SEQ ID NO: 143114 - protein, 124 aa, Triticum aestivum
  Clone ID: PAT_TA_37532.pep
SNYLSKNECLNDFQHLFSLCLKEIREYVYWMAFFYGKCLRSARRPNIEPVAYDLAISHARGGTYLKHAPPPPLLISSLEQAQPLVTFPQALTHHGPSLHLISAPALPWPNQAHARLQPPPFLRC

SEQ ID NO: 143115 - protein, 106 aa, Triticum aestivum
  unsure (1)..(106): unsure at all Xaa locations
  Clone ID: PAT_TA_37533.pep
VEXQGLGYWGAGGHRALECIGGHGVADYEDSQAESRAGTARSQFDILGGNNSNMDNQSENKYYTDSKNPEVHFHRPLKIGRTKWKFIWPENAILKKQIIPKSHKIA

SEQ ID NO: 143116 - protein, 128 aa, Triticum aestivum
  unsure (1)..(128): unsure at all Xaa locations
  Clone ID: PAT_TA_37534.pep
VNIEAYDGTTDPGVWIEDFIVHIHMARGDDLHAIKYLPLKLKGPSRHWLKSLPENSIGSWEELEDAFREKFQGNYVWPPDPDDLSHIIQWPRESARELWNRFLTKKNXIVNCPDAEALAAFKHSIRDE

SEQ ID NO: 143117 - protein, 84 aa, Triticum aestivum
  unsure (1)..(84): unsure at all Xaa locations
  Clone ID: PAT_TA_37535.pep
IEIDGVLLLYGTGSGSRQMLAYVAAESHVLEKEDDPRPLHLSDAYGHFINYSHKTLQSNTTVRLXNKREKRENNQNKKKKKSGR

SEQ ID NO: 143118 - protein, 44 aa, Triticum aestivum
  Clone ID: PAT_TA_37536.pep
GRMGVILLVGVRLVMVRPVIGDTSSSLIIDIRAQGHTIGISIDH

SEQ ID NO: 143119 - protein, 74 aa, Triticum aestivum
  unsure (1)..(74): unsure at all Xaa locations
  Clone ID: PAT_TA_37537.pep
FLGKNIFITXWNIXATEKYFLFWTEMVVSIATTILLAPLCLDFLVHLHLSRSWLTSKAQPPTPSHLTSVTSQSY

SEQ ID NO: 143120 - protein, 84 aa, Triticum aestivum
  Clone ID: PAT_TA_37538.pep
GPRRHFIDRLNCHLVSGSHLTVGRAKKSVKQNFTQARHESNPCARTALAVYVSACTCPPSVFQQRVYIGYKTQSVVHDVHLHFQ

SEQ ID NO: 143121 - protein, 67 aa, Triticum aestivum
  Clone ID: PAT_TA_37539.pep
QFFCTYGMNNIIGRPHCFRNKNCTASDRQVSCIISFVGCFFSHTQVNNITLKSEQHSKTKGIACVDV

SEQ ID NO: 143122 - protein, 62 aa, Triticum aestivum
  Clone ID: PAT_TA_37540.pep
LDSYRARLMLHLGAEYFGLSEAVGLPYGISPSGEILCADTTGSPASCGVEAWGGVSLSIISG

SEQ ID NO: 143123 - protein, 131 aa, Triticum aestivum
  unsure (1)..(131): unsure at all Xaa locations
  Clone ID: PAT_TA_37541.pep
QLDLSSNKIVGQLPDAIGNMTSLQTLRLGDNYLSGVKSELFGNLCNLSWLELWSNEIDQDMSDFMEGFPVCTKSKLRSLDLSATNLTGRIPSSIKQWKNLSDLQLSESXLVGLIPLGIGKMTNLRSLILNN

SEQ ID NO: 143124 - protein, 131 aa, Triticum aestivum
  Clone ID: PAT_TA_37542.pep
NQIRQLPKGVKGMTLPVVKINARVVKDHSSIEPCIKSRAAERSLSRSSRSQSTGTDRNSVHEGLSHLKKHHEHDLQSLQKSKSVPNIPEDHVCTVEELSVKLGDWYYMDGTGHEHGPFSYSELQKLVKRGT

SEQ ID NO: 143125 - protein, 67 aa, Triticum aestivum
  Clone ID: PAT_TA_37543.pep
SEEVSSINSFPSKGNADFIPAFNLFLHLRQKAEFAPSFIFVPSRGMAEFPFFYSFLGAFATIVDASY

SEQ ID NO: 143126 - protein, 95 aa, Triticum aestivum
  Clone ID: PAT_TA_37544.pep
RLALESEKDSCLSGETDFVKAFTPSFDPKAQHINRRVGASTKDTSRNTKPCAGNPVPSSLSSVIVSVVLRRSPAEIVLHQHRHHAVVLPELIYYF

SEQ ID NO: 143127 - protein, 84 aa, Triticum aestivum
  Clone ID: PAT_TA_37545.pep
LCQCLSLLHISGDYLLCMQRAAGILRGQSGESGLRKRSGLQQGPPHIITIYFLESVHGGRAISSPSPISLFSVDTRRAIKFRLS

SEQ ID NO: 143128 - protein, 70 aa, Triticum aestivum
  Clone ID: PAT_TA_37546.pep
SQTSLELIQRHLIFSRSLVTHGAQEHLTSGGCSSPCNVIHSPRGNPPPPHSLQKEDTSVMIRVCHSRSCF

SEQ ID NO: 143129 - protein, 127 aa, Triticum aestivum
  unsure (1)..(127): unsure at all Xaa locations
  Clone ID: PAT_TA_37547.pep
HFRLADLVGFGVAVATGKQYYKSYPERCYKSRLTEIMLDENRTGESSHRGFYLYNDKRQASPDPDIIKYVEKSRNMAXLMKLTDKDIVEMVIFPVVNEACRVLDEGIALKASDLDVASIMGMGFPSF

SEQ ID NO: 143130 - protein, 138 aa, Triticum aestivum
  Clone ID: PAT_TA_37548.pep
NISIEHVKTEDQLDDIFTKPLDEKRFSKLRCELISYNLRMSFEKDTHPNTYAKFMTLMCNTRNVFLQSVKINPLSVKKLTNNLILRALRKLYAVSEIIILIRWVTPPTKVENLQFEFFLIFEIPQLFFFLLLCIIFTC

SEQ ID NO: 143131 - protein, 96 aa, Triticum aestivum
  Clone ID: PAT_TA_37549.pep
GRRAPSSSFFFCNYMCTSVALAFHTVISLRGAALESWTDDEIRMNFFLRVKGVLLQIHRVTVETPHISIQGGTERSQTVVARSVRLKFARQSPTLF

SEQ ID NO: 143132 - protein, 109 aa, Triticum aestivum
  unsure (1)..(109): unsure at all Xaa locations
  Clone ID: PAT_TA_37550.pep
MRAPASNEAGGDGKQRGTKKGINAKXGVETYKIYIFNVLKQVHHDVGISSKAMSIMNSFIIDIVYKLARXSFNSSKYTFTPIITSREIQIIIGLFNVGELTMYPFFQGL

SEQ ID NO: 143133 - protein, 84 aa, Triticum aestivum
  Clone ID: PAT_TA_37551.pep
SNHLDSKKLFFSVMITLDVARGFWRLGNILLVPTLNRPVIIMRFHDWATLRKVILRKPKLREAPHTQDPTTRFAYDGHRTAVFN

SEQ ID NO: 143134 - protein, 132 aa, Triticum aestivum
  Clone ID: PAT_TA_37552.pep
SDSQILFKCDIRMDSISHMPSPRSLSNSFHCLFNLSSFHSPGVSQQFWWCFSSSFEDRRRVSLNLVRSLEDSWFQLLLILSNYSVCQYSFLAHLDYFRTCFLFYFTESHHSRRILHPHIPAIVIQLSRRPAN

SEQ ID NO: 143135 - protein, 89 aa, Triticum aestivum
  Clone ID: PAT_TA_37553.pep
FYFNCKTSNKIRCFAHFLLFYIYFPYPLIKKCMLHFYPNISLLHLTSGPKPKRHPCILPSASSSPFISFTETPIHPRIVPNIVSCPGRP

SEQ ID NO: 143136 - protein, 81 aa, Triticum aestivum
  Clone ID: PAT_TA_37554.pep
TGSLRGFIDKFRHQNIYLPVTSQETADHHTQCTSELKQDVPSEGLHAIVMTDRPVDDAREYTDTLHIARSCVISTSRRLVI

SEQ ID NO: 143137 - protein, 56 aa, Triticum aestivum
  Clone ID: PAT_TA_37555.pep
LLLVFVLSLHCILDYGLLSVVYLSLHVNRFISIVCLQNFHVLNTFIKIAYSPPSSR

SEQ ID NO: 143138 - protein, 59 aa, Triticum aestivum
  Clone ID: PAT_TA_37556.pep
LKGIKEKRLLGDNPIFTLTVFVCLHDYATVLIMFYSFCFNKVPSKTFGNTWEKVNVILL

SEQ ID NO: 143139 - protein, 64 aa, Triticum aestivum
  Clone ID: PAT_TA_37557.pep
RVIALGSVSQCLAHTHVHKRNTQTTLHRSAPTTHRNRELRDIFLALASTTIYSIMDRPKNVMQL

SEQ ID NO: 143140 - protein, 53 aa, Triticum aestivum
  Clone ID: PAT_TA_37558.pep
PGGQRQCGSMRRARPWPSGRRRPGCGRRRFFGSSGSNFPLFYYYLDATRHIST

SEQ ID NO: 143141 - protein, 68 aa, Triticum aestivum
  Clone ID: PAT_TA_37559.pep
INHALTSSHNGSPYVHATGITNFNTSISQIHNYSTSMTLISSCPYLKTIIKHQTSHSIQHTHKNFSFF

SEQ ID NO: 143142 - protein, 85 aa, Triticum aestivum
  Clone ID: PAT_TA_37560.pep
GSTGTLHSGYIHPYVGDGASRHNDTTCLRTHDDHLRYSTTHKSSSSTRATLSTLSLIRIMLGQYARVVTSSSRNVTDKLLKYTAL

SEQ ID NO: 143143 - protein, 135 aa, Triticum aestivum
  Clone ID: PAT_TA_37561.pep
GRPGRSTKADKRAPATNDAGGDGKTMGMKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSSYASLPCP

SEQ ID NO: 143144 - protein, 143 aa, Triticum aestivum
  unsure (1)..(143): unsure at all Xaa locations
  Clone ID: PAT_TA_37562.pep
GSTGWLTAHADAEDLVKRCDDCQKFARRAHVLARELRXIPITWPFATWGLDMVGPFKRSKDKKTHLLVAVDKFTKWVEVEPVSKCGAATTVQFTKKVILRFGFPHSIITDNGTNLSKGEMEXFCQHEHIRLDVASVAHPQSNG

SEQ ID NO: 143145 - protein, 136 aa, Triticum aestivum
  Clone ID: PAT_TA_37563.pep
LVERQDTIVEHEIMTQLSWSFGRGSRCVFICAFIGLWNSQRRPCQSSCRAPHGRRKCLCQRRFQAQEGLDQKLERLNERRGRRLCWIKKKRKKTWSAVEGHRAAVLYKGRSKRPDLFFFFEGWRPDLLGNASAYPF

SEQ ID NO: 143146 - protein, 129 aa, Triticum aestivum
  unsure (1)..(129): unsure at all Xaa locations
  Clone ID: PAT_TA_37564.pep
TKCVSVGQLGRRGIPPGGXGHVQKQEAAISISIDQSTHAFLFLHQDAPSVALHCMHGRPCVHNYHSNRPLRPSASSDPCFFSPVMVLPRGYRALVLFRGGHVTSKTYLMKSYQFKIFAINGLKQMKSID

SEQ ID NO: 143147 - protein, 68 aa, Triticum aestivum
  Clone ID: PAT_TA_37565.pep
TPVWWWWIASWADDEQYKGKNILLRLRCSCALCVDEDHSRSDEMPPNELSPTVVASSTYIGPGPLPKY

SEQ ID NO: 143148 - protein, 87 aa, Triticum aestivum
  Clone ID: PAT_TA_37566.pep
VDAKVAKTHEAIQWSWQHGAASMSCLRVRMTRQERKKAFMVIGINTAFSSKKRRDSVRERWMPQDEKLKKLEEEKGVVIRFMIGHRV

SEQ ID NO: 143149 - protein, 132 aa, Triticum aestivum
  Clone ID: PAT_TA_37567.pep
QETKWRIQKAMEVEDTGFKMWYTGTAANKNGVGILLNKSLKYRVVDVKRRGDRIMLVKLVDEDLGLNVISAYAPQVGHNENTKREFWEGVEDMLRSVPNGEKLFIGGDRTFQLRKRILIGSASFFIVRTRRP

SEQ ID NO: 143150 - protein, 102 aa, Triticum aestivum
  Clone ID: PAT_TA_37568.pep
SIILASSRPPLSRPATLESFSTSIISAPLSHSTTLMLPWREHCISSPLSTVFVQALQLVRRQGRSPMTSCSSCRTRRHDHYPPQSPWSGAQCISSPLSSASS

SEQ ID NO: 143151 - protein, 118 aa, Triticum aestivum
  unsure (1)..(118): unsure at all Xaa locations
  Clone ID: PAT_TA_37569.pep
ETTAXSFQVRHVFCLFCRQPHTPSSPSRPSTHVREPSLSKLQSSQDCSLNWRVVHVGVVVQNSQSEEVDVARRQHQYHALCRIAEHRTIKFSRPKKVGNRQAIMCRGRDGRTATTMRG

SEQ ID NO: 143152 - protein, 73 aa, Triticum aestivum
  Clone ID: PAT_TA_37570.pep
RVDRDGLAGNVHYPNSLYGLVGQELHDRVLCSAGFLCRGRVPAAGIRCTSNNTTRCKLTPGECMDQYPVGCLS

SEQ ID NO: 143153 - protein, 78 aa, Triticum aestivum
  Clone ID: PAT_TA_37571.pep
WVAAMSCSVSSDLNYERGEKEESELDGRGSYGSWWANRAARVRPAEILGRRTGADQSPFFWLMYACFYSLSDGGSLLS

SEQ ID NO: 143154 - protein, 89 aa, Triticum aestivum
  unsure (1)..(89): unsure at all Xaa locations
  Clone ID: PAT_TA_37572.pep
TGVGRGAHISLNVKGQDGNEVFFRIKRSTQLKNLMNAXCDGQSVDLNSSAFLFDGRTLRGKQTPDELEMEEGDEIDAMLHETGGCFPGP

SEQ ID NO: 143155 - protein, 68 aa, Triticum aestivum
  Clone ID: PAT_TA_37573.pep
HWQGYEACAFVNWLDEEWHGMARSVITKLTEDNVKLKKKPADLKCTISTMKQEIINHRQPMKAEIRRN

SEQ ID NO: 143156 - protein, 69 aa, Triticum aestivum
  Clone ID: PAT_TA_37574.pep
VPRSAPFHALPKIRIPQNPLTADQSVRRYLSYDPSLGSSLKFKSSLDRRKEWIKATERKVDANAKKKNR

SEQ ID NO: 143157 - protein, 47 aa, Triticum aestivum
  Clone ID: PAT_TA_37575.pep
IPGRQDKIDGASIRTMMRCTRYGFTVSVETSNLAEFLFTFVSYILTS

SEQ ID NO: 143158 - protein, 88 aa, Triticum aestivum
  Clone ID: PAT_TA_37576.pep
ATRTRRVRVVSVPPFPFELAKRNIFVRSIDRNPEQNDEGGAFPRVRRASLSDMTCYSVIHLLHFYVSKSLHSYVGGVRNTADLILIKG

SEQ ID NO: 143159 - protein, 57 aa, Triticum aestivum
  Clone ID: PAT_TA_37577.pep
HHSKPVAHEVTRVLVVMSLKGPRCTLVRTIASNPGLLVLTLIQPFSTMVTGLIIVLL

SEQ ID NO: 143160 - protein, 74 aa, Triticum aestivum
  Clone ID: PAT_TA_37578.pep
FFNVGITGTMHGRVLKDYMIHATLQALHKYVSTRHDIPRVQISPEVNATRTGSVAVDKSTDDTVSIVVTMAHQP

SEQ ID NO: 143161 - protein, 49 aa, Triticum aestivum
  Clone ID: PAT_TA_37579.pep
HSGTRKGHNTAYIKPTPMRPSDECKHSMSVSLSTYPWDIVFPWQKMGKK

SEQ ID NO: 143162 - protein, 88 aa, Triticum aestivum
  Clone ID: PAT_TA_37580.pep
GSQIFSWRNHYFVRNKEAFPCVRSLTCSKGIHVRVSVDVVNNSNSCNCNMECAHNLRHERIFGPDRSQRVSASSSECEIDRQLRTNAS

SEQ ID NO: 143163 - protein, 91 aa, Triticum aestivum
  unsure (1)..(91): unsure at all Xaa locations
  Clone ID: PAT_TA_37581.pep
MTKVIPYAFVIGSIRYAMPTTAPDVCLATCLARGYMGDPGVGHQIPVKIXPWSNNDMFLDYGGDKKFGVKGYIDASFNTYPTDSKWHTGYV

SEQ ID NO: 143164 - protein, 131 aa, Triticum aestivum
  Clone ID: PAT_TA_37582.pep
WTTTLPGSFSCPSPSRSPSSHAPEPPSCPSPSQRVALRLGDGAESGGGCSGEVEEEKENGTHCAKNTGPDALYRPIRRVTDLWAKAIPSNPATVARSVRGEKGGARIEAPLPNPLRLLRSSPSRALPEISN

SEQ ID NO: 143165 - protein, 63 aa, Triticum aestivum
  Clone ID: PAT_TA_37583.pep
GFPLKSAISFSQKIVEGGTANGEGHIHLDHLVASLVQSLPNYLYVDPRGRNLVQKPPQSRFFP

SEQ ID NO: 143166 - protein, 55 aa, Triticum aestivum
  Clone ID: PAT_TA_37584.pep
KMEWVRQWLFCPLTARPMLTAMVVLKIIAINPKVSGNPVFIPFGFKGGLRHQVTV

SEQ ID NO: 143167 - protein, 35 aa, Triticum aestivum
  Clone ID: PAT_TA_37585.pep
IRWINARLQVHSETDLTRQWQTFYCRRQRSVTDTS

SEQ ID NO: 143168 - protein, 61 aa, Triticum aestivum
  Clone ID: PAT_TA_37586.pep
GSKKDFWHCCRGVYANVSLPSTHHKPVCPAVHCVPSASHILSQITLAVVLSMYRRPPSLSL

SEQ ID NO: 143169 - protein, 80 aa, Triticum aestivum
  Clone ID: PAT_TA_37587.pep
FLVDGDFNDFQRIGLGSGNSFPLPENWKADVLQAQRPGHTPSHEVLQVYLTSWLANVNIKTSRIDEIFELVEEEMQIKLR

SEQ ID NO: 143170 - protein, 39 aa, Triticum aestivum
  Clone ID: PAT_TA_37588.pep
SGDIFSLPDNCSADVLHAQRPGDTPSHERFTSLFNLLAC

SEQ ID NO: 143171 - protein, 70 aa, Triticum aestivum
  Clone ID: PAT_TA_37589.pep
CSHVLSLLEATRCHGSQALSSSSVSGRALVPLLGEYFQICTSSIVVNPCCNEHNNIIGPRLLAFLTKGIY

SEQ ID NO: 143172 - protein, 73 aa, Triticum aestivum
  Clone ID: PAT_TA_37590.pep
RVRRERETPVDVSGKQNTLSRSRLRFRLPLWQPRRPLGNQPGLLQFIQILLSDRRLDPIALDPARRQPRVRRR

SEQ ID NO: 143173 - protein, 130 aa, Triticum aestivum
  Clone ID: PAT_TA_37591.pep
VCSAEQGIRALLSQNFQARVSFVSSALKLPPLQPAPRLVTPKFRRARKLPPHPKLVPQPRHAKFPFDPSARNAGSTSRCQNRWGYAGNLPYISDKRVPKPWLPLPSPSSPPIRTPRPPKSLKPHAPPSTW

SEQ ID NO: 143174 - protein, 85 aa, Triticum aestivum
  Clone ID: PAT_TA_37592.pep
RPFWWVPAVKWRNHYFARKVNGRWMSFVGHVDKAAPIAPWRWTTARPKNGTTRSRGRLGTGCPCGGEYEGLQVQLPSPENNMRCG

SEQ ID NO: 143175 - protein, 99 aa, Triticum aestivum
  Clone ID: PAT_TA_37593.pep
PAGITASKEAGVKGKTRGPKKGTMAKKGLETYKIYIFMVLKQVHPDIGISSKAMSIMNSFINDIFEKLARDSAKLARYNMKPTITSREIQTSFRLVLPG

SEQ ID NO: 143176 - protein, 44 aa, Triticum aestivum
  Clone ID: PAT_TA_37594.pep
MWSKNTMVGKGSPLETNFAKLTTSLIFNPRKLRNSKPSKFRPKL

SEQ ID NO: 143177 - protein, 56 aa, Triticum aestivum
  Clone ID: PAT_TA_37595.pep
KTLPPPLSLSHTHTQLLLPLPFPTTVSLSLTHTHKTLTFAHPTRISLTNIDRLASR

SEQ ID NO: 143178 - protein, 70 aa, Triticum aestivum
  Clone ID: PAT_TA_37596.pep
SLVMYYSYQENEVPGDLLVLIKQEGIGAFKPCSLTRKYGAKQRTSGHAHDHAAGLFRPYPSYAIRRSAAG

SEQ ID NO: 143179 - protein, 36 aa, Triticum aestivum
  Clone ID: PAT_TA_37597.pep
QQAISLVSTPASFPRGQFQFRVLGFLAGRGGCHSIH

SEQ ID NO: 143180 - protein, 41 aa, Triticum aestivum
  Clone ID: PAT_TA_37598.pep
PSPLLTGGFGSKRSVIVPINVYLRISMGLTRISFRSGHLMR

SEQ ID NO: 143181 - protein, 65 aa, Triticum aestivum
  Clone ID: PAT_TA_37599.pep
QQLSRQLIPFRGPFTNGLEGIGCAPLAGHWQESFRLHLQRKVHTSLGLQDRGRFRNNRMINPTPE

SEQ ID NO: 143182 - protein, 135 aa, Triticum aestivum
  unsure (1)..(135): unsure at all Xaa locations
  Clone ID: PAT_TA_37600.pep
ACGTARRIPGRLGTLLNMPKRSKDGPKARADLKSMGIXQELHANDDDNDDDDDDEAKQDTETPRKGKKAKNTGNDYPPASFTLSHEEIEQFFTCYRGNRSTNTYGTSGPSPFRFGGSGDRMKSGSRRSTRAVYPA

SEQ ID NO: 143183 - protein, 95 aa, Triticum aestivum
  Clone ID: PAT_TA_37601.pep
HPNRPRKQPLAPQKFFEGRDKNSALTRVFAGFRLVPAVPHIAVKHLAGGTFQPVPLCPPPSAAARHKFRPSSATDSGQISRWNSVGEAFCTLNHR

SEQ ID NO: 143184 - protein, 127 aa, Triticum aestivum
  unsure (1)..(127): unsure at all Xaa locations
  Clone ID: PAT_TA_37602.pep
RHAQGESGDLPYAVGCPAFSRELRKSXWPSTKNFKRDVPEMYDGKSHPSEFLSIYTIAVQAAGGRDDKMLANDFPLVLKPNVRCWLMHVPDNSISSWVDLCDQFVSAFTSGHKPHGQESDLHLLAQK

SEQ ID NO: 143185 - protein, 77 aa, Triticum aestivum
  Clone ID: PAT_TA_37603.pep
MRKKNAVEVSHGEGLLVKGGQWQKGYEAGKNKIKKKNIQCHKCKQWGHMRKDCPELNGGASANKATHGDDSDSSSDV

SEQ ID NO: 143186 - protein, 44 aa, Triticum aestivum
  Clone ID: PAT_TA_37604.pep
HRKKKIKEINRAKKIINQTIIQITRDSKCIIDNGTTIASKTKID

SEQ ID NO: 143187 - protein, 61 aa, Triticum aestivum
  Clone ID: PAT_TA_37605.pep
WGSNGTSNSVSRVMRLKGSGNGSFCYYPSSTWKLLHLLLWLHLVIVMGNRPETLLNIVYLY

SEQ ID NO: 143188 - protein, 60 aa, Triticum aestivum
  Clone ID: PAT_TA_37606.pep
YNFRLMLIQSRDIYFGTEGVARSSTKQERKADEQSCSLLQPAKLSEVSESPDGRNTTRLL

SEQ ID NO: 143189 - protein, 67 aa, Triticum aestivum
  Clone ID: PAT_TA_37607.pep
LEPRYGETKIRLAISFPAKWLAAVKVWAELARLPLIVMQTNGVQLLPQDRDSVHNQLIGCDGLRRPG

SEQ ID NO: 143190 - protein, 128 aa, Triticum aestivum
  unsure (1)..(128): unsure at all Xaa locations
  Clone ID: PAT_TA_37608.pep
MLTVIINLLPIKFWGETNRPFPAWRPRWLPTHLDLLDTHELCHGYCKSLDAFSQILGSHHGPIRGLGTAXFCSNGNDRAKLEEWFRSPALDQLEDLCFNDGHMRSLPTSALPFAPTLRLANFMNCHPP

SEQ ID NO: 143191 - protein, 48 aa, Triticum aestivum
  Clone ID: PAT_TA_37609.pep
KKSEHFLQYSCPPRIWHYMHWLRIMSLVNSWVARLLCLLPYIPQYRLG

SEQ ID NO: 143192 - protein, 72 aa, Triticum aestivum
  Clone ID: PAT_TA_37610.pep
NLASYIKKPPSLQGIKPRTLLSLGSSPSTPSPRAPRPSPSLPPLRSRRLYLVANVVPCCWLNACLWTLVICK

SEQ ID NO: 143193 - protein, 89 aa, Triticum aestivum
  Clone ID: PAT_TA_37611.pep
GLQCIYMNQTNDYDRINIKAHFSLIRPGMFGHQIGAQRAPQNSTGRTIWAPHIIDSKWENPIHLSAKLSKYEESIVTIFSEGCNRHFLV

SEQ ID NO: 143194 - protein, 147 aa, Triticum aestivum
  Clone ID: PAT_TA_37612.pep
KLTKVAHFLPIKESITAAQLAELYTSRIVSLHGIPQVISSDRGSIFTSKFWDSFQKAMGTNIRFSTAFHPQTSGQVERVNQILEDMLRACVISFGMKWEDCLPYAEFSHNNSFQASSGKAPFKILYGRNCRTPLNWSETGERQLLGN

SEQ ID NO: 143195 - protein, 84 aa, Triticum aestivum
  Clone ID: PAT_TA_37613.pep
DSQGTPSKYARRLKRLSLGMPQKASHISSSTIIGMSRFLLSSHDMRKFLECRVLFIFIFSNALFWHEIVLGLFIEFSLHFTYIF

SEQ ID NO: 143196 - protein, 63 aa, Triticum aestivum
  Clone ID: PAT_TA_37614.pep
PISIHIRCSNSKREITVKKWCSHFLVNRRSSRSPSSCAGPPVWMCEREGNVRAVKARNRSSQN

SEQ ID NO: 143197 - protein, 68 aa, Triticum aestivum
  Clone ID: PAT_TA_37615.pep
KQMKMYGHDLRQVRTSIFRYARCIPYHTNSFFMFTLTDKSFAHKAYRHMLDLTKGMFFFSLVTKIDFF

SEQ ID NO: 143198 - protein, 80 aa, Triticum aestivum
  Clone ID: PAT_TA_37616.pep
CRTRKITSLWAQPEISPTSSLLIFDKVMMQFRLHRRPAFLPTYAERSHRKIAFSALHGFMQMIHLRAMYVLNPQVTYVRH

SEQ ID NO: 143199 - protein, 54 aa, Triticum aestivum
  Clone ID: PAT_TA_37617.pep
TPCGHNFCLKCLEKWVNSGKRTCGKCRGPITSKMASQPMIKAALVADIRMARTA

SEQ ID NO: 143200 - protein, 39 aa, Triticum aestivum
  Clone ID: PAT_TA_37618.pep
GSTGYAITSHIIIFSYQQVVETRINNLSMTTSMHVGNRP

SEQ ID NO: 143201 - protein, 74 aa, Triticum aestivum
  Clone ID: PAT_TA_37619.pep
ETTCILKYTKLWCSIIPSFTDGTIWNLWKMFVSSNDVSAIPAYLFISFLSFQLSQIYYIFIVSLPFFLFTKRTL

SEQ ID NO: 143202 - protein, 148 aa, Triticum aestivum
  unsure (1)..(148): unsure at all Xaa locations
  Clone ID: PAT_TA_37620.pep
GSTGLTKNCSKSLVAPVRCDSFDLDDILSSFPANRTSFPMKYLGLPLSTKRLKTIHFQPLEDKIAAQLTPWMGKHVAQPGRAVLVKSVITAIAIYYLTALDLXAQVMKKIDSLRRAYLWASCDKVTXVKCKINWDQVCKSKVHGGLGI

SEQ ID NO: 143203 - protein, 54 aa, Triticum aestivum
  Clone ID: PAT_TA_37621.pep
SSTIGSLTNLNFNSMLIACPQIWEPMVQPPVPLSGQSCCVFVITIWYQSHSRSR

SEQ ID NO: 143204 - protein, 95 aa, Triticum aestivum
  unsure (1)..(95): unsure at all Xaa locations
  Clone ID: PAT_TA_37622.pep
KELQAHPDELIESFSVMWETMLQCRRRQHAIIKSLSAAXKLETPFDSEPRRQAALFLSIELGKLCSNLRNWIASRRAYLGSLNLGLFGNFSAEIP

SEQ ID NO: 143205 - protein, 97 aa, Triticum aestivum
  unsure (1)..(97): unsure at all Xaa locations
  Clone ID: PAT_TA_37623.pep
IRYSSTLLQHPXHNLSDHMSDHQCPGLSLCPVLTARLAAIAASSLCCPGRVSWIANHTTQTPTAENHRTSPTDAEYHASIRPLGPSPICVFLAIPLK

SEQ ID NO: 143206 - protein, 91 aa, Triticum aestivum
  Clone ID: PAT_TA_37624.pep
GDEEAEDELGAEYLVQPRGRAEDEQHSSDFDPEHSGDGAEDEDIDDDDAEDSEDSVNPDSSATMKTSAAEDKNNSDGDDDGDDDDNPPSDR

SEQ ID NO: 143207 - protein, 130 aa, Triticum aestivum
  unsure (1)..(130): unsure at all Xaa locations
  Clone ID: PAT_TA_37625.pep
QCSETFTSNNARKRTLRNLAEVYQVATINPWSDTAITFNASDEPKFRTARAPAALVLSPIVDGFRLTKVLMDGGSGLNLIYEETLRKMEIDWSRIEXSNTTFRGIIPSREAWCSGKITLDVVFGTPDNYR

SEQ ID NO: 143208 - protein, 57 aa, Triticum aestivum
  Clone ID: PAT_TA_37626.pep
GGSCIWLNFWSKLVMAHRECGVPLLVRHRRCAITNFGKKFKKIVSSGAPRVWCAISS

SEQ ID NO: 143209 - protein, 60 aa, Triticum aestivum
  Clone ID: PAT_TA_37627.pep
IRLEPFGGPPFFFFFFFFFKFFFFFFFFFFFFFFFFFFFFFFFFFFFFFFYDDIHFYFLD

SEQ ID NO: 143210 - protein, 77 aa, Triticum aestivum
  Clone ID: PAT_TA_37628.pep
EESVSTYPRRPKAEAFDNAFDLVELLLVPTDQAPNVRLLRVLHMFSSMTSLKLLIQQSVEEVDEFRQHDGVATVMVQ

SEQ ID NO: 143211 - protein, 69 aa, Triticum aestivum
  Clone ID: PAT_TA_37629.pep
TESYEISFEIIIHVYYYSARAHLMRVFLTLMLCLVHFCYSGAEVVIFDCLLKMFSAWTSRVNMSLRLRL

SEQ ID NO: 143212 - protein, 122 aa, Triticum aestivum
  unsure (1)..(122): unsure at all Xaa locations
  Clone ID: PAT_TA_37630.pep
LLYLAFLIPLPHFQYREDIYAHPYFQAFPNQFTDDYLSNHLYGQEARKVFIQHPWFNIEVFLKRTKDGRSIIHMLSASXERGXPDLPACGPQRGFSSGPVRTIFXSKHSRTSRRAKPREADD

SEQ ID NO: 143213 - protein, 77 aa, Triticum aestivum
  Clone ID: PAT_TA_37631.pep
NAKTGDTVSSDANLGSSPKQELDQTKQKLQTLKDPQKKGQDSSNNLLQIKKMTSEIKQLKDAANASKSETKKLTGQN

SEQ ID NO: 143214 - protein, 68 aa, Triticum aestivum
  Clone ID: PAT_TA_37632.pep
FEGCVVLSPQQNYVMFLLVTLTLQYVHTSISYISSFSWYSTTTRFFTLYTYNIYGQHHIASSLVVKDF

SEQ ID NO: 143215 - protein, 42 aa, Triticum aestivum
  unsure (1)..(42): unsure at all Xaa locations
  Clone ID: PAT_TA_37633.pep
YRSXHSRVDREXLFLFLLIIIFSRLSYSEVTYSRLSHRYRTC

SEQ ID NO: 143216 - protein, 54 aa, Triticum aestivum
  Clone ID: PAT_TA_37634.pep
KLGAKLSGGFELGAELELALFILLDEYARFEKPPWLWTLSRHYILDCAIEIMRL

SEQ ID NO: 143217 - protein, 136 aa, Triticum aestivum
  Clone ID: PAT_TA_37635.pep
QKPDYRQFTPSGFAAHLKPSAFKGVQYKRWRTRAVYWFQTMCCYDATKGKTEGDLNAAQLEAFEKIDTLFKGALLSVFDDSIVDSYMSFDNGKDMWVALEAKFGDSDAGSELYVMEQFYDYKMTDERSVVQQAHEI

SEQ ID NO: 143218 - protein, 46 aa, Triticum aestivum
  Clone ID: PAT_TA_37636.pep
PWDRPWTILWNGGLKACLLNWFPGVCFQESGNFCRSGVILRWGFGG

SEQ ID NO: 143219 - protein, 49 aa, Triticum aestivum
  Clone ID: PAT_TA_37637.pep
YFLSFFDFLCMFILLFYSFSVSFFFFFFFFFFFFFFFFFFFNSTSELYI

SEQ ID NO: 143220 - protein, 87 aa, Triticum aestivum
  Clone ID: PAT_TA_37638.pep
PINAFVSLLGTDWGKLYELVLESFMWFFSSFSRVMYWFIFLFYLIHFPLFFYFSIHVDHIFAYRLNIFHIHLEHFSEIQVEHLSKTH

SEQ ID NO: 143221 - protein, 52 aa, Triticum aestivum
  unsure (1)..(52): unsure at all Xaa locations
  Clone ID: PAT_TA_37639.pep
CDATYLRALSYCHFVANLTHWMLMLXICHYKYLSLFRYPYVIFAQTGMSISI

SEQ ID NO: 143222 - protein, 86 aa, Triticum aestivum
  Clone ID: PAT_TA_37640.pep
NSYYIELEEMVQVALLCTQYLPGHRPKMSEVVRMLEGDGLAERWEASQRTDSHKFKVPDFTFGRCYSDLTDDSSLLVQAVELSGPR

SEQ ID NO: 143223 - protein, 60 aa, Triticum aestivum
  Clone ID: PAT_TA_37641.pep
VSLGSLRQDCGVEPRSLYGQGDRLLRSTLVRQVLHGRWPWWDRQGCFFMDRLWLEPAVDP

SEQ ID NO: 143224 - protein, 67 aa, Triticum aestivum
  Clone ID: PAT_TA_37642.pep
NNTMAILLKTVSVRVSSIQIIQVRVQNKGKSVWKSRYDGDVSTPPSLNPCLSSSNSVDKLKERKKNF

SEQ ID NO: 143225 - protein, 61 aa, Triticum aestivum
  Clone ID: PAT_TA_37643.pep
RHGRCSPSPTCFRSLPSYSVPWWLVHSPQQFIPLCHLIQWIDGRLEPSVFFNLLLPDDTQI

SEQ ID NO: 143226 - protein, 53 aa, Triticum aestivum
  Clone ID: PAT_TA_37644.pep
IPILSRIMSAIFSFMVSISASLRYSLGYLYECSMHLSYIGCVWVYIKHHVFHL

SEQ ID NO: 143227 - protein, 112 aa, Triticum aestivum
  Clone ID: PAT_TA_37645.pep
ECTLLVQTGDFVRARLSQNCVWVFQALSIAQYFHTMAAKSAKCAMSRRLMALGIPLSIPLLQKNEIASSSRQSLTLFITRRNLTPSSSRNSVFRVLFAYFDESMASNRVYEP

SEQ ID NO: 143228 - protein, 102 aa, Triticum aestivum
  Clone ID: PAT_TA_37646.pep
SDRNSRMSHNLLTKHCTAVTIAGDPRSRPPLRITSKKGSRACSQARTTSTPHQNPAKPPGGPRGGLLPQLRPPRSASATSSIHSGEAIPATQTLSVVSQSTQ

SEQ ID NO: 143229 - protein, 118 aa, Triticum aestivum
  Clone ID: PAT_TA_37647.pep
RPMLVSEEDGSVFVLIVPTGEARAGHCVIYVVCVRGDAADADTDTRPMYGCVLTVTTPRRYVGGDTGYVKLTWTLPSWDLPADVEMEDAWYYLTPNNVHGDFKEVHLDICITKLNVDH

SEQ ID NO: 143230 - protein, 44 aa, Triticum aestivum
  Clone ID: PAT_TA_37648.pep
ETTTPPTQIPAPIVLRESDGRCDEGGAIVLADAIGLVEQRFAFE

SEQ ID NO: 143231 - protein, 86 aa, Triticum aestivum
  Clone ID: PAT_TA_37649.pep
SAVSMLVHPPILLLHGSETVLRSGTVVYRKLVLSVDIQGREDAITCVTTPSCTVERCMIRTLLDYRLWFSDDFTNNLNMWQSVIDP

SEQ ID NO: 143232 - protein, 117 aa, Triticum aestivum
  unsure (1)..(117): unsure at all Xaa locations
  Clone ID: PAT_TA_37650.pep
PLRKLSNNNQMKSFSAXFNHIYSYSGLFGILATTSPDFASNAVDLAAGELLEFATPGNVTQGQLDXAKHAAKCKVLMDLESRAVACEDIGRQVMTYSERKPIEKFLNDVEAITLNDI

SEQ ID NO: 143233 - protein, 54 aa, Triticum aestivum
  Clone ID: PAT_TA_37651.pep
DVRCDVQKVGTTWGPERMVTVPHEWDRLRPLPVMGSGRHVLVGTSLVFGVVVDP

SEQ ID NO: 143234 - protein, 74 aa, Triticum aestivum
  Clone ID: PAT_TA_37652.pep
EVPYVDASPWLGPSGHRIPGPVVVPGIKDQGGPNDLILFDNRGQTILIQCVYFKFYIVHLIPSFQNKSLNVILI

SEQ ID NO: 143235 - protein, 90 aa, Triticum aestivum
  Clone ID: PAT_TA_37653.pep
VDGGHTANLHGCGLAHEWGGKRQTQCTRTVPLAGPCSCSLRRAPASASRRVELLTWRRGLLRGVTAAGRPCSEQRLNRCAGERRRSYGSA

SEQ ID NO: 143236 - protein, 132 aa, Triticum aestivum
  unsure (1)..(132): unsure at all Xaa locations
  Clone ID: PAT_TA_37654.pep
VNRALLDLXRLAFRSAFGLAESAAWRELLDCVALHEPLVDGRSDRVQWRLEPSGLFSTKSLYSAIAPSSAPLPLSMVWSVRVPLKIRIFMWQWIHGRVXSGVEVCKRNGPGTGICPLCGVPEDSNHILFSCV

SEQ ID NO: 143237 - protein, 73 aa, Triticum aestivum
  Clone ID: PAT_TA_37655.pep
HKLLQLRKIATPRIRCARCLPFIRSHCHVMCLCVAFFHVIICCASSCFQKLHPVLFPVVCFVIRHSFTSPVDP

SEQ ID NO: 143238 - protein, 131 aa, Triticum aestivum
  Clone ID: PAT_TA_37656.pep
VVLRTTSTTTSHMLARRRRSPSPLCRRPLRSSAYLDLHRPLRSSACVLFFLAAAGLSFLECFLTFPLPLCGFGRLLLYRPFGLGIFKFLPHSCEVASGDELGTSGCHCFPTILCAVVGSEELGAAGCHRCL

SEQ ID NO: 143239 - protein, 58 aa, Triticum aestivum
  Clone ID: PAT_TA_37657.pep
KFTMRMNKIKTLNLLASVENSLCSRLLFYVSNYSFQNSYFRCIFCSLAWCMYRINNRL

SEQ ID NO: 143240 - protein, 76 aa, Triticum aestivum
  Clone ID: PAT_TA_37658.pep
NGLTFWGAPFFFFFFGICFKFFYLFFLFVFFFCFFFFFVFFFFMFFFIFFFFLINVFNQILVLNKQNRASTVGACQ

SEQ ID NO: 143241 - protein, 86 aa, Triticum aestivum
  Clone ID: PAT_TA_37659.pep
YIYRAHVACAVQSEIHILCWVPQSRSCRLVKASVNPLMADEILSITVPIKLQCVIEIAARPSRPISVSGSMPDIPRLFISFSLGAE

SEQ ID NO: 143242 - protein, 65 aa, Triticum aestivum
  Clone ID: PAT_TA_37660.pep
SGSTGALQNLVERPHTHHTDFLQMTSARRTHLERDDGIYNGMGLARLFRRFGKIIKSCNVLVLVH

SEQ ID NO: 143243 - protein, 64 aa, Triticum aestivum
  Clone ID: PAT_TA_37661.pep
MTTHNLFGPLYRLNEFTFLCRCWALGALHGCRSNLEEANRDEGHLLGHGAGQFLARTHTMEQSG

SEQ ID NO: 143244 - protein, 51 aa, Triticum aestivum
  Clone ID: PAT_TA_37662.pep
GHLWIGCDHCQRWFHGRCVGVTADMARGIEDYLCPGCSYKATTKASDSIYR

SEQ ID NO: 143245 - protein, 51 aa, Triticum aestivum
  Clone ID: PAT_TA_37663.pep
FSAEKETCTHYLHLTNDITERKLLKRKLPLLSMETLICRRGEQSGQHWLTL

SEQ ID NO: 143246 - protein, 113 aa, Triticum aestivum
  unsure (1)..(113): unsure at all Xaa locations
  Clone ID: PAT_TA_37664.pep
RASTKCLSAIIVARPLMLSKMYHEACPKLIDGFMEREDIVKMVIFNTFIELLHXTGTMTNRQGDIDESSPTWLLNHEVHHVVNSINRHLPEQSIKTKVEAFPVWTELVFVLLD

SEQ ID NO: 143247 - protein, 152 aa, Triticum aestivum
  unsure (1)..(152): unsure at all Xaa locations
  Clone ID: PAT_TA_37665.pep
SRRSRVPSKSTPLLLSNILVSLHLIKNLVCIHSFTGENPVIVEFDMCVFSVKDARTRMVLHGCDSPXQLYLIHPPASTNTSLVALSIDVDLWHARLGHPNHATLCHILPSFFXCNKTDGHTCHVCHPGKHTRLPFSASSSIASYPFELLHSD

SEQ ID NO: 143248 - protein, 56 aa, Triticum aestivum
  Clone ID: PAT_TA_37666.pep
FYFSVLDGSKRLVYVESYQWQIGLERTLILPLAPCGFDTPYLSLPPLEISMMIPCT

SEQ ID NO: 143249 - protein, 144 aa, Triticum aestivum
  unsure (1)..(144): unsure at all Xaa locations
  Clone ID: PAT_TA_37667.pep
SRGHGVQFRCSSMGMKLDYASVDHPHANGQVELSTGLIMSGIKAGVVRSLSESDTHWVEELDSVQWGLLTMPNHTNGYTPFLXVYGSXAVQPCDIIHDSPKVHXVSKEISRTXRHDSLDALNDDRDVRKARSAFYQHQARLYQI

SEQ ID NO: 143250 - protein, 66 aa, Triticum aestivum
  Clone ID: PAT_TA_37668.pep
TDYGPLALICPHGLLSYSTTDEVNPACPGRFTPRSNIPNIRPQIDLNRFISILSKNLHLQHLLVFC

SEQ ID NO: 143251 - protein, 97 aa, Triticum aestivum
  Clone ID: PAT_TA_37669.pep
FCFTPVRNSCIVSCKKEPLYQFRISTRNDEWLKKVLDIRKLDFLPRNYSRHITHFPFPFTFYYSLFLLVFFFPSMDSLVKNCRSFFYFDLIEIKWMQ

SEQ ID NO: 143252 - protein, 77 aa, Triticum aestivum
  unsure (1)..(77): unsure at all Xaa locations
  Clone ID: PAT_TA_37670.pep
GAWFAGIEVSRGGGHGGNGGHRELRELGLVVKEGKRRVVRLWCARXRQGMAIYSRGERDGLGCCRAHPADTRARPRS

SEQ ID NO: 143253 - protein, 124 aa, Triticum aestivum
  Clone ID: PAT_TA_37671.pep
TWLVTVPTHVYFSCIEMAQNSPTVPSHRLSLVELAKQQKLYEPSSDDQDCPIVKAISIPKGELDYGPRGWRARQSKLAYSYYPLAASPRTDAAFCLGTRMVSKGLTWERYDIEYMPRPSGYNEW

SEQ ID NO: 143254 - protein, 69 aa, Triticum aestivum
  Clone ID: PAT_TA_37672.pep
EHHYNIIMFQSTEFVDHPRCAHTYLQVYAVNTTYFYDVSAIIQRHDLESRRQSYSRCFFICLSYIIILT

SEQ ID NO: 143255 - protein, 101 aa, Triticum aestivum
  Clone ID: PAT_TA_37673.pep
IPAKILGARTLLRIIEGICKINIMMKDYALEVYTSYTSAPCTCSQGNAPLHACDRKMEGGATLACYDAHVHHVGATHLVNRRKHQFRLRRAEVGLHTTCVP

SEQ ID NO: 143256 - protein, 113 aa, Triticum aestivum
  Clone ID: PAT_TA_37674.pep
SLPPPTSSPSSRSSWMTLLYSSRLPGLLIACHPNWPPWSEPLLSIGGPATARRCHEECPPGGRARHEVPRPARIHRPTHQRVRANRVHRYLQGQRGRYDVCPLQLVGCLGCLC

SEQ ID NO: 143257 - protein, 149 aa, Triticum aestivum
  Clone ID: PAT_TA_37675.pep
GSTGTAGSVTDASRTERSPSTQSGTPSWVLDSGASFHMSSHSSILSSLRSPDSPIHVLTADGTPLSVASRGNLITPYSVPDVAHVPRLTMNLFSAGQLTDSGCRVILDVDSCSVQDRHTHTLVGAGPRRRDSQGLWELDWLHVPSAATT

SEQ ID NO: 143258 - protein, 97 aa, Triticum aestivum
  Clone ID: PAT_TA_37676.pep
NCRQNAFSASWPSNWLKCYTTSVTLSRRSAKASAECHSWVSLMHPLQPNTHYNKYGLPAGICSTCWCISQSARATVWSSECASWSFLSSSFACFSLD

SEQ ID NO: 143259 - protein, 61 aa, Triticum aestivum
  Clone ID: PAT_TA_37677.pep
EILVLKFASPVACTYGKRYVKNLKHEVFFDYFPYEWWSWTSATNLPPPPRRMRVVLGFDDL

SEQ ID NO: 143260 - protein, 55 aa, Triticum aestivum
  Clone ID: PAT_TA_37678.pep
DGWCGYILSYSLPITELITLVLFLSIARSGITLVLYDFANCWHGFCVGWCLLCAS

SEQ ID NO: 143261 - protein, 73 aa, Triticum aestivum
  Clone ID: PAT_TA_37679.pep
SPRLSTRVCSSTFVITMLTDTDRAAAEDDAAAASPPPRYTSLIPLMFLSVVAVLAICVDVSTMCVVHALLDRN

SEQ ID NO: 143262 - protein, 92 aa, Triticum aestivum
  unsure (1)..(92): unsure at all Xaa locations
  Clone ID: PAT_TA_37680.pep
LXQYQTPRRLLLLLIKITLAWMRLCPVISTMNLSFIHFEAQGHQSSPSIQPFPGAATLFFPQTEAFYSIPLGDRNTNEVCASTNPTYMGMIR

SEQ ID NO: 143263 - protein, 101 aa, Triticum aestivum
  unsure (1)..(101): unsure at all Xaa locations
  Clone ID: PAT_TA_37681.pep
GWPPVMIPPSGRVPERGRDWISWIQRPCGGGTSDLGLPRRVLEYLEFYRVKKGCGRSPRWAQPTWARLGAQARPGGCCSSPSWVFWXKKIVLXVTRCLVSV

SEQ ID NO: 143264 - protein, 144 aa, Triticum aestivum
  Clone ID: PAT_TA_37682.pep
AADALSRGPATETLTLVSVCQPAWLEDELNSYKSNPRAQKLLTRLAIRADPKGRFSLQQGILCFRGQIWLGGLTSLLQQIMAAFHDSAMGSHSGFPVTYRRINCLFAWPKMKTHVKHYVKCCRVCQQAKPDRAASPGLLKPLPI

SEQ ID NO: 143265 - protein, 103 aa, Triticum aestivum
  Clone ID: PAT_TA_37683.pep
SAFSLSLRPPACQIARVVALLSVRWQLTYKSGSSEHNPYSVFAFSKELNFASSVVSHTHLGTNCQGLDTATNELPTSPNSFIAHFDVTSLALYAPAPNHVFGQ

SEQ ID NO: 143266 - protein, 66 aa, Triticum aestivum
  Clone ID: PAT_TA_37684.pep
WHSSDRYACAIGSLDRALARLGLNSEHFPSSPAGNRLNSSSPMLPSGQWLARSLCVVGPRRAESTF

SEQ ID NO: 143267 - protein, 79 aa, Triticum aestivum
  Clone ID: PAT_TA_37685.pep
CSMRRMERDKMICLCLHLHHCPIMRLERHVQRQMQEPSMTSVQDVAMTIGSGGPDDKWVKWLHTAWNRTELNWLYIDAR

SEQ ID NO: 143268 - protein, 69 aa, Triticum aestivum
  Clone ID: PAT_TA_37686.pep
HVDSRYAVRHTPPPRCDRRALTEIRFVELAVHNTPPDQHGHCFERKTSVATVLQQAIHVPNITKQVSAV

SEQ ID NO: 143269 - protein, 98 aa, Triticum aestivum
  unsure (1)..(98): unsure at all Xaa locations
  Clone ID: PAT_TA_37687.pep
TDFTILLNITHYSLSIDGQYHRXVRERRSGVNSDTTTGIMRSYXVHDVGTLVFDAINFXDSVSXIEFDKLYGCRHALDDCLKTATDVMIDSRVAVVCS

SEQ ID NO: 143270 - protein, 131 aa, Triticum aestivum
  Clone ID: PAT_TA_37688.pep
GEVVIFADHLSRGFAPPGSKFFRDVLNFFDVRPQDIGPNSVSNICNFQVFCEVYLGEEPSLLLFREIFYLNPQNECANGPSLEVGGISIQRRRDCLFPYVEPPSHPKDWNLTWLYYQDTSLADESPLLGFR

SEQ ID NO: 143271 - protein, 52 aa, Triticum aestivum
  Clone ID: PAT_TA_37689.pep
FTTVSLIRSLVIMRHTDEVQYTRERHVIVRNASAELNRWSYRGALRPADVCV

SEQ ID NO: 143272 - protein, 130 aa, Triticum aestivum
  Clone ID: PAT_TA_37690.pep
AADDKTDDVVITGVGYTAPSNPTALSKHSAKEEFSAIDKGKWKVDPESYAHLSAQDIHSGFLNWLYTSCDYEAGLLNMMKERYEVNTADFCITTLPYNRFSATNSSSPQGPVYSIDMNRGFVENTSIFPV

SEQ ID NO: 143273 - protein, 61 aa, Triticum aestivum
  Clone ID: PAT_TA_37691.pep
CFVVYMGMSHARDVSVCQKPCHRLSAPDTGIHGFYNLVNPKRVWKLWNLTWLPWKASTCRC

SEQ ID NO: 143274 - protein, 156 aa, Triticum aestivum
  unsure (1)..(156): unsure at all Xaa locations
  Clone ID: PAT_TA_37692.pep
LGNFRLEHVAQSWERMKLMLRNCPTHGLNLWMIIQKNYAGLNFVSKNLLDSAAGGTFMEITLGEATKLLDNIMANYSQXHTERAPTSKKVNLVEEINSLSEKVDALMKLVANXNSPIDLNDVPLSTLIEQNSDSVDVNFVSRNNFNNNAYRGNPGA

SEQ ID NO: 143275 - protein, 56 aa, Triticum aestivum
  Clone ID: PAT_TA_37693.pep
IKVLLRHILCQIDKQAAIAPASISTGTSEITMSEDGEDQDEQELVCNINQYLQDRR

SEQ ID NO: 143276 - protein, 101 aa, Triticum aestivum
  Clone ID: PAT_TA_37694.pep
PLLLSRRCMFLAGLARAPSGPRREKSASAIPISLGEASRTPPPCLPLPLLLFSATYLFPLNLIGALRLASTPDPSAFDPVSSFPTGSVLRHCARVLRDSPL

SEQ ID NO: 143277 - protein, 100 aa, Triticum aestivum
  unsure (1)..(100): unsure at all Xaa locations
  Clone ID: PAT_TA_37695.pep
NDQADQAFHELKKMLATPPVXAAPTEKEPMLPYIATTSRVVSTVIVVQRPEEGRAQPVXRPMYYLSEVMSASKQNYPXYQKMCYGVYLTAKKLKXYFQEH

SEQ ID NO: 143278 - protein, 64 aa, Triticum aestivum
  unsure (1)..(64): unsure at all Xaa locations
  Clone ID: PAT_TA_37696.pep
RRAGVIIMRSEKVKDEIVLDGIYIXLVSRSVALINQKCXVNNKDIKKFVERIHLSDNGAIREDY

SEQ ID NO: 143279 - protein, 87 aa, Triticum aestivum
  Clone ID: PAT_TA_37697.pep
SLRGAECSSGRYCDQNSSSIELPSSAQKNSAVSATLLGRSANAPEELQTRVSMIYLLLANLLCRRKSLPAAICFACWISWPALWDST

SEQ ID NO: 143280 - protein, 93 aa, Triticum aestivum
  Clone ID: PAT_TA_37698.pep
LESALHEMSSESREAHDIYLINQEEIDHARAHVDDLNNSLHNDKVSYEVMLNEVNYEIVCLKKSVERMDADANNVSDECQSPELGFVNSIMKS

SEQ ID NO: 143281 - protein, 54 aa, Triticum aestivum
  unsure (1)..(54): unsure at all Xaa locations
  Clone ID: PAT_TA_37699.pep
HWALNXLVENRSTFDMFRDSINMVFKQRSDFGYTKDSSGRTYRISLTISSWKNR

SEQ ID NO: 143282 - protein, 76 aa, Triticum aestivum
  Clone ID: PAT_TA_37700.pep
CKFCHKIILQNYPCPPPIVSAVQLVFPSNPGFPIFLFLFLYILNRRLIPFSVFSQFLGPSPPFPFSRSFNSCAVHP

SEQ ID NO: 143283 - protein, 56 aa, Triticum aestivum
  Clone ID: PAT_TA_37701.pep
TAMMSSSLIVVNRSDVTCHNEAIRYASLFNRSAEIEATAPFYGPLIVAPDSCSFAL

SEQ ID NO: 143284 - protein, 101 aa, Triticum aestivum
  unsure (1)..(101): unsure at all Xaa locations
  Clone ID: PAT_TA_37702.pep
CDTQTVHIAPLEMYEETIPSALGHELRDRTTASFTTSCLIGFHCIQYSLNHGTDVENLSICRVXALLILPQHMRIMFLTQTAILNFKCSVAHEWRFRFELI

SEQ ID NO: 143285 - protein, 61 aa, Triticum aestivum
  Clone ID: PAT_TA_37703.pep
SGLYRLLKDLRPDLFKLAPCLVMPPDCQKWGVKPDYDHRVESISPLECDRIPVSLWYLYGL

SEQ ID NO: 143286 - protein, 67 aa, Triticum aestivum
  unsure (1)..(67): unsure at all Xaa locations
  Clone ID: PAT_TA_37704.pep
QGXYHLKYVTSQTITATCSSLNSMCRICGLNISLHRFLNRAGLILTTQILHKEIIDEKCILCLFLHA

SEQ ID NO: 143287 - protein, 55 aa, Triticum aestivum
  Clone ID: PAT_TA_37705.pep
VAPFPTHWPKLSLVIQNSFTNMDVCLMGPCRHWVVLGSFIPRPYSGILISLLFRL

SEQ ID NO: 143288 - protein, 82 aa, Triticum aestivum
  Clone ID: PAT_TA_37706.pep
YHIPVHELTERRYEISMCKLVMAWSRGRRRPGDGFQRCSQGSTSPTRHCQGTTRDHDRTGACNRAHGSPSRIRPGHPEFRTV

SEQ ID NO: 143289 - protein, 74 aa, Triticum aestivum
  Clone ID: PAT_TA_37707.pep
HPVYFVSSLLQGARSRYSGVQKLLFGLLMASRKLRHKFQADQITVVTRHLLQRTLHNLDATGTIVDWALEITSF

SEQ ID NO: 143290 - protein, 44 aa, Triticum aestivum
  unsure (1)..(44): unsure at all Xaa locations
  Clone ID: PAT_TA_37708.pep
LPFPDVVLCCXFESSRCQFSLPHGKSHTIWADLAFKKLSTPIKN

SEQ ID NO: 143291 - protein, 54 aa, Triticum aestivum
  Clone ID: PAT_TA_37709.pep
GWNLFCTLATLATSLVLSGLESQPDFRGNHNPLHPFITEAMLSLCGLSDFYVLT

SEQ ID NO: 143292 - protein, 74 aa, Triticum aestivum
  Clone ID: PAT_TA_37710.pep
FILSLFFIVRVEEKAMHRMRVSSAHPKQSEPCIIISVIAMSKLRLHRRVKLMVLASSLLELRVLYTGCDVAAAI

SEQ ID NO: 143293 - protein, 131 aa, Triticum aestivum
  unsure (1)..(131): unsure at all Xaa locations
  Clone ID: PAT_TA_37711.pep
MGLFLLADGVHSKLDTPRSRFFWEGAGPKQKYHMVKWQAICRPKAQGGLGIINSKLMNIALMCKWIWKMSQGETGLWIDLLRAKYFPQGDFFDTASRGSPFWNSIQXLKPFFARGAKFGVNNGRSTRFWLD

SEQ ID NO: 143294 - protein, 145 aa, Triticum aestivum
  Clone ID: PAT_TA_37712.pep
GPNNEATFDEPPPQDHNADEQAEIDTAVPGDKPASPIRVDDGPSNLVKTTDTPSTPEKAAGDNEDEPIITGIGHTSAGHPVVLPKHSAKEERAAMEKDKWSTDLSSYAHFSAQELHSGFLNRLHTTRDHESSLVNLMKERYEVMT

SEQ ID NO: 143295 - protein, 130 aa, Triticum aestivum
  unsure (1)..(130): unsure at all Xaa locations
  Clone ID: PAT_TA_37713.pep
MPMRHRETWXYRGTRPSGGFSAEIRFRGMRLSLGNFNTSNKAACAYDAAAWRLRWPHRTLNIPNVPTREWAQELAPLPWLSTDEDRRDNRRRDHRLDIARXDEEAMALWRQHFPXDIINEREFYAQRRAE

SEQ ID NO: 143296 - protein, 118 aa, Triticum aestivum
  unsure (1)..(118): unsure at all Xaa locations
  Clone ID: PAT_TA_37714.pep
RQRHLXACQVGERCSSCALDVIVASCLSREGDGLGVRHLLGAVVMGKNEGGWRRWVAGRQVGVRWHRHLHLVLPASCLIFPLFPSLPSTIIAGLLETVPGGGRSLGTLTSSSRFPAEL

SEQ ID NO: 143297 - protein, 58 aa, Triticum aestivum
  Clone ID: PAT_TA_37715.pep
VHGMMLRGHPTTTIRRRRTKLSRLYISLFLLAHINSLSQFPLSISSQTISNTYSTEMF

SEQ ID NO: 143298 - protein, 100 aa, Triticum aestivum
  Clone ID: PAT_TA_37716.pep
EQTHAHTHWVTLHNGLPIGHALVIFLLGHCVLHLANFAKALPNECLQHQHQVLLHAELYLQCASLGYVVLTKLPLAVHTVHPCMTKAILAYMALYAQRAS

SEQ ID NO: 143299 - protein, 85 aa, Triticum aestivum
  Clone ID: PAT_TA_37717.pep
AYICTHVNKIGLVWFYSRYVLMSPREMPNIKQIMWSLFNANGIEANGTGTTDIWPRRDLNQSNHTATIACAHHMALSCAGTMYAL

SEQ ID NO: 143300 - protein, 125 aa, Triticum aestivum
  Clone ID: PAT_TA_37718.pep
HPRPNRAAPLPTSTSLSPRDPSPPPPPTPVIPAASGDSGCCRRCQAHSHDRLRPLRLPFRADSSLASSTGYPRPSPKLGFRPPRRRRGSGGSDRARQCRRRFACAGTAKGRPWTTPLQPFSDAIK

SEQ ID NO: 143301 - protein, 83 aa, Triticum aestivum
  Clone ID: PAT_TA_37719.pep
GPNIRVHGDMFESIVCPANGSVKLPATSEVFACTVGKKPSMAKYYLDDTVDVIKMLQGLASAPSQQRPWPVQLRVTFEEGNGV

SEQ ID NO: 143302 - protein, 59 aa, Triticum aestivum
  Clone ID: PAT_TA_37720.pep
IKLIIHIRLLQLQLLHHHHPIVILGLRTLVRNFILVNILNVSLVIFFIYDVSLEFLVLR

SEQ ID NO: 143303 - protein, 127 aa, Triticum aestivum
  Clone ID: PAT_TA_37721.pep
EQKKEMATIAVGWQVGQQTTVATTQWRTRRRHPPRRCMRTSPSASPVRTTRTCHRRRRRPSSSRRRPTRPTTSASSRSPGVRRSCSPPAHPSCLTWTCPSRRRCSSPTAPHARFVTTAGGTANVRRS

SEQ ID NO: 143304 - protein, 81 aa, Triticum aestivum
  Clone ID: PAT_TA_37722.pep
SFRHSFDTCIITPHFPLEESFRHSFGTSITILQFPLEASFRPSLGIQYLLSLCLIALVNLFICFMFAFVISYVRTALRVLS

SEQ ID NO: 143305 - protein, 49 aa, Triticum aestivum
  Clone ID: PAT_TA_37723.pep
VSTPSKFLLPDKFARLTLPLRHLFPSVCCRWPHAQLRHAAATIQERHHR

SEQ ID NO: 143306 - protein, 138 aa, Triticum aestivum
  unsure (1)..(138): unsure at all Xaa locations
  Clone ID: PAT_TA_37724.pep
MLHTTHGHLAGKNETKRQKISGRWFEVMIAGTTDKVALYWYAESSVLTHRSWCGDYTHMHACTRTASTQHSHKHMHPRTHATLTRIHAATXRTQHSHAHTHACMHTPVHHTTNTHSHAQVLNLHVRAHTSGPDRHIHN

SEQ ID NO: 143307 - protein, 76 aa, Triticum aestivum
  Clone ID: PAT_TA_37725.pep
RVTIIKYLKYMMHDYPNQYELNTIRKHDSGRATQQAPRPRRPLPDSPLSLALRPTWPRHLRSTSRLSMPSSHRGQE

SEQ ID NO: 143308 - protein, 49 aa, Triticum aestivum
  Clone ID: PAT_TA_37726.pep
SSSHHRRDTFASIKWYQISRLLGEILQFFVGDIDSVRYTYSPRTSQPKN

SEQ ID NO: 143309 - protein, 102 aa, Triticum aestivum
  Clone ID: PAT_TA_37727.pep
CYCDCLPHPTDDDQGPSLCITAYLPTWIRRHVPIKFPPRRFIRRPVSEGLVVRSYGIARVDGSVTHRPRYRLPHGVDNRSLDSPSAIWIPVDTAVPATPDNA

SEQ ID NO: 143310 - protein, 39 aa, Triticum aestivum
  unsure (1)..(39): unsure at all Xaa locations
  Clone ID: PAT_TA_37728.pep
SPDYWVAGSVAGVDWGILLAGALLPEVLPLXAVDPVFWT

SEQ ID NO: 143311 - protein, 82 aa, Triticum aestivum
  Clone ID: PAT_TA_37729.pep
HGLQEIIWCQMDVVVVACAVLLDVNACSGPCYPTTPTTYSYQYILYYYRGFDVLVTYNEHINIWLQYKPARRAMHVKLVLQI

SEQ ID NO: 143312 - protein, 74 aa, Triticum aestivum
  Clone ID: PAT_TA_37730.pep
MGVEIVSNMLIERMLRLRVHVVPIENALLLWLDPPLTIGSLDGCLCHFHLGVHVRACLRLLVVLRPFERGKPLG

SEQ ID NO: 143313 - protein, 147 aa, Triticum aestivum
  unsure (1)..(147): unsure at all Xaa locations
  Clone ID: PAT_TA_37731.pep
GPRLAATEHISQFNEEARSPFVKKYKTIIHPGEVNRIRELPQNSTIIATHTDSPDVLIWDVEAQPNRHAVLXATDSRPDLILRGHQENAEFALAMCPAEPYVLSGGKDKSVVWWSIQDHISGLGDSSXSETSPGGSGIKHSKTANEK

SEQ ID NO: 143314 - protein, 138 aa, Triticum aestivum
  Clone ID: PAT_TA_37732.pep
GAAVKKRKASAAANSSVAKKMKPMTSSIENRIDVVPISSMSFKEIVPYEEDYKIPSGSDEENHSVTTSEQFDEEIEVEAFPSMPVISSRMPQFTAEEAGVEEIEKEDEDVDIGCTTPAMNDDFWESQHPNTPLFTRIQ

SEQ ID NO: 143315 - protein, 63 aa, Triticum aestivum
  Clone ID: PAT_TA_37733.pep
QCGKLWKMSLWIGSKKNQGNLTCVGFNRSNCVSAKYLYVCRIKSDYDDRLSCSVDMAQTVSKM

SEQ ID NO: 143316 - protein, 146 aa, Triticum aestivum
  unsure (1)..(146): unsure at all Xaa locations
  Clone ID: PAT_TA_37734.pep
GPRPVEEPQGPSESKHDDSNGAVRPEAADNEGAIKPEATVDEGDGTGLIVXMCTDVQKGYFRLTGPPDATKIRPKPVLVEALKFVQVSSKDYNFKTDQLKSIRQDMTIQNIEDELSVXVYEYHARLALCNRDMAELNLCLTKLHCL

SEQ ID NO: 143317 - protein, 135 aa, Triticum aestivum
  Clone ID: PAT_TA_37735.pep
MLFRKPSMTKDDEDFERFAEMIRRIFLRMRLTDMLKTNPYAKYMKDIITNKRKIHEAEISTMLANYTFKDGIPKKLGDPGVPTIPCSIKRNYVKTALCALGAGVSVMPLSLYRRLELSKLTPTKISLQMDDKSSS

SEQ ID NO: 143318 - protein, 56 aa, Triticum aestivum
  Clone ID: PAT_TA_37736.pep
SYPQLESLTKQTYANNANLTAFCINTTVCKDCSNIHTYLAAKIIKENSQCSKFIID

SEQ ID NO: 143319 - protein, 83 aa, Triticum aestivum
  Clone ID: PAT_TA_37737.pep
LVACLFERARLHDSPATDLQTLGLPVARMVILSDKLLHLEAQQRAQEEGCVVDIKKFRAPVPGRCVPEGISLDAAIESFSFLS

SEQ ID NO: 143320 - protein, 57 aa, Triticum aestivum
  Clone ID: PAT_TA_37738.pep
RNKIHDKSLNGNDGTASIYLINTLWEDVKTKLGDAASSGNDMIDSTMKHALRSNDYS

SEQ ID NO: 143321 - protein, 60 aa, Triticum aestivum
  unsure (1)..(60): unsure at all Xaa locations
  Clone ID: PAT_TA_37739.pep
TQIYPRSEQDMVSLRRTSKHTSYPDLCEPTACPVERPRARELPDFRCLQPSIGXRGPRSN

SEQ ID NO: 143322 - protein, 99 aa, Triticum aestivum
  Clone ID: PAT_TA_37740.pep
PISMQIITTRPLHPCSVLTFIKHIIPFCIKHTIPFMLMGEQFCSRFLFNLEAFDFRSFFCINCVKVKSLLFMTDFSYIHTNYYGRWPWSVNSGVVCRGD

SEQ ID NO: 143323 - protein, 78 aa, Triticum aestivum
  Clone ID: PAT_TA_37741.pep
YCFDVSRQLAERGEACLLRLSLAHARGGSQDEERVLTTAPSPSPSPSPSPSRWTCNSSIGVRLPEAYCTVISSLLDLP

SEQ ID NO: 143324 - protein, 73 aa, Triticum aestivum
  Clone ID: PAT_TA_37742.pep
FPHLLRLLSSFFFCIFLFFFFLLVLILIFVRSFFLIFGYSSPGYVFYVFPKIEVNGNVKLKLKLWLKLKRNRR

SEQ ID NO: 143325 - protein, 60 aa, Triticum aestivum
  Clone ID: PAT_TA_37743.pep
VRSLPLKSNLVSRIWRKKCNCSTQYPSWMPHMTLGSEIATAEWPGKQSWRPIWQTNQTQA

SEQ ID NO: 143326 - protein, 87 aa, Triticum aestivum
  Clone ID: PAT_TA_37744.pep
MKRSELEGSPYLRDDRLTIECVAEIALVNDVKSIAKVPPSDIAEHLGKLLREKDGTDVVLEVEGEAFPAHKIVLAMRSPVFKAELYG

SEQ ID NO: 143327 - protein, 88 aa, Triticum aestivum
  Clone ID: PAT_TA_37745.pep
SWSAREEIAAGKPFLLHCLFWGSNICLAHSTVEFSKCLCGSSEECRRHRIVLPSTGGELNGEALLVTVPGTGTPGAFEQPDEATGGAA

SEQ ID NO: 143328 - protein, 130 aa, Triticum aestivum
  unsure (1)..(130): unsure at all Xaa locations
  Clone ID: PAT_TA_37746.pep
LELILAFPRGDKFCYVLRLMFPCTNNAAKYAAXFHGLRMAKEMNLSWVRCFGDXDLVAQQFSGTWDSKDPLIVAYRWAVDDIVGHFKGYQVEHIXSQEKNDAADALSRLGSQRKPMPPNVFLDVLSNPSV

SEQ ID NO: 143329 - protein, 50 aa, Triticum aestivum
  Clone ID: PAT_TA_37747.pep
YVHCTYMIISEVQGRDLFLEYNRQKKRRGYFQLILFVLRILNGAPGRPGL

SEQ ID NO: 143330 - protein, 145 aa, Triticum aestivum
  unsure (1)..(145): unsure at all Xaa locations
  Clone ID: PAT_TA_37748.pep
YTVGDIIPDWTVPYSAYMNRGELPEDEVLAIQIIRRSKSMAIHNGELHHCSVSGVFQRCVSPEEVCEILHKIHEGDCGHHAGSKSLVAKAFCHGFYWLTAHADAEDLIKWCDACXKFSRRAHVPAQELRMIPITWSFATWGLDMV

SEQ ID NO: 143331 - protein, 58 aa, Triticum aestivum
  Clone ID: PAT_TA_37749.pep
KNNQARHSVILKVAPNYQTRYGIATQPKQTFSTVLNGEPNSVLTCLEIQDSKFEVVNC

SEQ ID NO: 143332 - protein, 37 aa, Triticum aestivum
  Clone ID: PAT_TA_37750.pep
YYMHIWLVESSMITIFASSQFSLLQRNKFLFNYHGSC

SEQ ID NO: 143333 - protein, 64 aa, Triticum aestivum
  Clone ID: PAT_TA_37751.pep
QSHEAQEGSTWPKGCPARCIWQIKNYLYPWRCCSSRKIKRDGSWGVRTSLGTMTEIQVFLESYM

SEQ ID NO: 143334 - protein, 134 aa, Triticum aestivum
  unsure (1)..(134): unsure at all Xaa locations
  Clone ID: PAT_TA_37752.pep
WAATQYLPPVPDSTHWRMHFDSSKMRTSLGAGIVLASLKGDKLKHTPQIHFAASNNVAEYEALIHGLWLAKEIGIRRILCYGDSDLVLHQSSGDXVAKDANMASYRFLVXQISGHFNGCEFLHVPWADNEQADA

SEQ ID NO: 143335 - protein, 121 aa, Triticum aestivum
  unsure (1)..(121): unsure at all Xaa locations
  Clone ID: PAT_TA_37753.pep
GIFPTRFATYIQTLGFLSSKSDSSMFTYHSDNATAYLLLYVDDIILTCSSTAFLTXLITSLRSEFSMTDLGALHHFLGINVTRSSAGMFLSQRQYLSDLIDRAGMTDCHIARTPVDPDRRT

SEQ ID NO: 143336 - protein, 45 aa, Triticum aestivum
  Clone ID: PAT_TA_37754.pep
RCLWLIPPGSAHRFVKLSNQHTKDLNLSNKEHFVAICNFRLALEL

SEQ ID NO: 143337 - protein, 47 aa, Triticum aestivum
  Clone ID: PAT_TA_37755.pep
FTQYPTYLNRSVYLVTVPRIEAPEQLDNQVVGIFIFDSHLLDLVRYI

SEQ ID NO: 143338 - protein, 64 aa, Triticum aestivum
  Clone ID: PAT_TA_37756.pep
GGFFVLCLFFVYFFFFFFFFFFICFFVFFFFFFLASQVTLHQRNILHKIFLVEIVTLPPRQTEV

SEQ ID NO: 143339 - protein, 72 aa, Triticum aestivum
  Clone ID: PAT_TA_37757.pep
LTLHYHHSALSQAPIYSMNESIFHGSFCSNICVSKMITGYTPCFDRPGRTVIYPDEHKVHLTDSQHWHPYVT

SEQ ID NO: 143340 - protein, 77 aa, Triticum aestivum
  unsure (1)..(77): unsure at all Xaa locations
  Clone ID: PAT_TA_37758.pep
RTRKSDSGCESYDQNGETPKAEMPGAGHPGVGAGYPGSVFRTMQIWCSRSRIDEDMTTLDMNKNIAYKHICXGDSSA

SEQ ID NO: 143341 - protein, 57 aa, Triticum aestivum
  Clone ID: PAT_TA_37759.pep
IRFHRLDRTLSSSSPRELQLKLDLNHQEILHEGKYIGARWPHQEYCPYVCSINSAII

SEQ ID NO: 143342 - protein, 105 aa, Triticum aestivum
  Clone ID: PAT_TA_37760.pep
LTYGPSCGRPTCHRSNYLHSEVRYILVVVLVELRFNALSSPSSTLLPPLFFFLLSSPSSASHHLPSLTARPPAPSSLVARAYHIPPLTSRPHEEKLLRSPPESTS

SEQ ID NO: 143343 - protein, 111 aa, Triticum aestivum
  Clone ID: PAT_TA_37761.pep
FGRRALPQTLRKRELHALGLPFNNMLSPSDIISAGSASSACTAGGRGQLYVWGKLKNWGDECMYPKPVRDLSGWNIRCMASGDMHHIVGAEDSCISWGLSEYGELGYGPTH

SEQ ID NO: 143344 - protein, 142 aa, Triticum aestivum
  unsure (1)..(142): unsure at all Xaa locations
  Clone ID: PAT_TA_37762.pep
VWKAQVLPHIKAAXMTGYIDGSLREPPAVIVTKKDVAGKKETTSTPNPEHAVWVTQDQQVLTFLIASLSREVLMQVSTLWAALLXSFSSQSRARVIQLRSQLEHTRKGDLSAVAFFTKMKGITDELAAAGKPLDEDDVVDPE

SEQ ID NO: 143345 - protein, 57 aa, Triticum aestivum
  Clone ID: PAT_TA_37763.pep
EAAVDLRPLTMEDLRQAKNQVAASFAAEGAVMNELKQWNDLYGEGGSRKKEQLTYFL

SEQ ID NO: 143346 - protein, 81 aa, Triticum aestivum
  Clone ID: PAT_TA_37764.pep
RGNFYISDMCDQKLCCCAIARERHARYRSYARVARTYVIFRAPGRTQVRDHAWPVAIISSPPAPGERSQQKQTGIALGSRL

SEQ ID NO: 143347 - protein, 110 aa, Triticum aestivum
  Clone ID: PAT_TA_37765.pep
KKKISVLLPVSSWPSQSARHFPQFGRTAASKSPIRRRLCLRPTPPLLGGSPSPCPVNHCSSPTRRSHSSPPLCHGRHGTRATPAVDFPRCLGCRLYLHFVRSCIGFVRLW

SEQ ID NO: 143348 - protein, 83 aa, Triticum aestivum
  Clone ID: PAT_TA_37766.pep
ENSTRKALPEYFKDISLMKKGGISWLVLLCFDTCGPVVDKIRNELSQCRASPPGHLIYPADQARSLTPHTCPIYVNSFELLTI

SEQ ID NO: 143349 - protein, 56 aa, Triticum aestivum
  Clone ID: PAT_TA_37767.pep
VAGCKISACCCLLVLPLDMLKSYFNLAYYILFLTKCHQSSLHWTAFKIMISDKILF

SEQ ID NO: 143350 - protein, 48 aa, Triticum aestivum
  Clone ID: PAT_TA_37768.pep
PGTTCTSRSLLVHVCMAMTRSCYKSWTAQSMQFSWYSYSSPIPSTRIV

SEQ ID NO: 143351 - protein, 58 aa, Triticum aestivum
  Clone ID: PAT_TA_37769.pep
LSHDRSISSSHVSHSICPMRNENHVSLSRDPTHSVSRICTKLTSCVKKDASCILLRSG

SEQ ID NO: 143352 - protein, 134 aa, Triticum aestivum
  unsure (1)..(134): unsure at all Xaa locations
  Clone ID: PAT_TA_37770.pep
HLRLELEKLGEHXLYAKFSKCEFWLKEVGFLGHVISGEGIAVDPTKVNTVTNWESPTTVGEIRSFFGLAGYYRRFIENFSKIAKPMTELLKKDTKFNWTEECEASFQELKRRLVTSPVLILPDQHKDYEVYCDA

SEQ ID NO: 143353 - protein, 46 aa, Triticum aestivum
  Clone ID: PAT_TA_37771.pep
GLDDMDVASLKKMNKNKQLVKKLANKYHAFLASEGIIKQIPRLLGP

SEQ ID NO: 143354 - protein, 55 aa, Triticum aestivum
  Clone ID: PAT_TA_37772.pep
DLRLRFLGLTKDFLGVLTSLTVCDRKGLDKNEIYKNFRKARAFFTYLIPVDPIAD

SEQ ID NO: 143355 - protein, 72 aa, Triticum aestivum
  Clone ID: PAT_TA_37773.pep
ESALIEFIRENQDIFAWMPSDMLGVPRELVEHTLNIDPMFKPVRQFLRHFNEERHKAIGEEVARLLAARFIV

SEQ ID NO: 143356 - protein, 126 aa, Triticum aestivum
  Clone ID: PAT_TA_37774.pep
TFTSSTARSVALGEDAAARNGFVGEVGEAPDKVLACGHCPRVHNHHVLVVILHKPRRNHLAIALLPTGADPVDRKPLDDPRGHLRPPRCLPRIPGSPPAVFLNPRLAGSATPRPAQDVCRALPCPP

SEQ ID NO: 143357 - protein, 91 aa, Triticum aestivum
  Clone ID: PAT_TA_37775.pep
SNMSSLLFPRLPESRCTRISCLLHVSICLTDLTSSSLFLYCISLSVSLGLSRTLSPTYIQSFPPYLLHLQKLSLHVSFTHWDMSKCCLYNG

SEQ ID NO: 143358 - protein, 125 aa, Triticum aestivum
  Clone ID: PAT_TA_37776.pep
CMHQYELTRTRLQTHRRLRSRSIRSALVSCDSSRYIDFFSFRDYANNDRRGAGRLHRAIEPSASDVHRLHCTRTDAISTRPTPSSSCGINTTRSAWKASNSSLTYPARHDIHTSSSRGTPSSYAS

SEQ ID NO: 143359 - protein, 76 aa, Triticum aestivum
  Clone ID: PAT_TA_37777.pep
WCSKGWFDLLLLWLCRWRLNTETPNLQCTWNSTVYGHINPQGDPAGVSLMALNDVCRVPKPTSTDGSTLGTPCHGA

SEQ ID NO: 143360 - protein, 58 aa, Triticum aestivum
  Clone ID: PAT_TA_37778.pep
MIGVETYMMCIFMVLNQVHPDIGISPTDMSIMKSFINHIFNKLAGESAKLGRLNPIPI

SEQ ID NO: 143361 - protein, 134 aa, Triticum aestivum
  Clone ID: PAT_TA_37779.pep
RPSSWSARAMASSACATTRRGSVALSPCSTRPPARRCHFPRCRTPASSLRALIGGTGTRLTPSRTIRRPGGTSCCASPAFSTGCLSRKPCTCSRWGRRHGGRCSPASTAGRGAASVRASSALTARRTGSRVMLR

SEQ ID NO: 143362 - protein, 60 aa, Triticum aestivum
  Clone ID: PAT_TA_37780.pep
RTRIRAVDGDQGVKPATMEIMTVLWRWRSQAQVDDDHIMSDILIACDVYLLCILFCLVRR

SEQ ID NO: 143363 - protein, 139 aa, Triticum aestivum
  unsure (1)..(139): unsure at all Xaa locations
  Clone ID: PAT_TA_37781.pep
LNKPADDNVVIKPEKTPDPVETNTDALLDDLPPQDYDFVVEQVEVAPSGQSEKTTSPVRDTDKPASPAKAIDKPPTPVKAAGDKEDDIMITGFGHTAPGNPVALSKHSAKDELSAIGEGKWNTDLSSYAHLIVQPVDXR

SEQ ID NO: 143364 - protein, 70 aa, Triticum aestivum
  Clone ID: PAT_TA_37782.pep
RVDREHLDTGSSRWETVSRANFNRFGWLSCNRIGVKFPSGCFACRLWLSYICFLAPCEHYCLSSESLTLM

SEQ ID NO: 143365 - protein, 48 aa, Triticum aestivum
  Clone ID: PAT_TA_37783.pep
LPPLPHPTNDSKRMTTRSDLNLSIGFSLKHCVSVPRSDILDMSFSPYP

SEQ ID NO: 143366 - protein, 74 aa, Triticum aestivum
  unsure (1)..(74): unsure at all Xaa locations
  Clone ID: PAT_TA_37784.pep
VDRSFQVGRVGPLSFSLLSSGQSRGSVHGATLETKATTMSIKTMSTPAQSAKGRLXLPKQQLLQLRVHSRQKYA

SEQ ID NO: 143367 - protein, 123 aa, Triticum aestivum
  Clone ID: PAT_TA_37785.pep
MRPSLKQYVGLLRDDVSQGPKLSKSLSCVASLDSAQPLSSYHIDVLASRLSPDKTTTLLAYANHHDITLYQMDVKSAFLNGKLEEEVYVAQPPGFEDPKHPDRVFRLNKGLYGLKHAPRAWYD

SEQ ID NO: 143368 - protein, 79 aa, Triticum aestivum
  Clone ID: PAT_TA_37786.pep
VASNAKLMAGWQAVAFALAVHVGSSWQSPWHCGCPTASQKSKGNCLKRRKWKRNRALTLTGQADMTTVDLPQVAHLTVH

SEQ ID NO: 143369 - protein, 127 aa, Triticum aestivum
  Clone ID: PAT_TA_37787.pep
IPAMYFVVMFECCSIIILMHLDGYLLIIADRCHICFACLFQTVHPIPVFFISISTEITSPYQWHSWISKLRPGSIIPLQIMHMHRIPHPAYHTMFMCWLFTMLCASFRCLLLRVGSGNVAFVRTGRP

SEQ ID NO: 143370 - protein, 115 aa, Triticum aestivum
  Clone ID: PAT_TA_37788.pep
MISLVPKVMQASDTTAQDIEHSEVYILEHFIVVLEYHRLIIQDFLGMFYKHFDMITALIDMALHVMHTLECTFDITRHILVGAREPLHSRPSCRCCLRRILPIVPDRSVARSPDG

SEQ ID NO: 143371 - protein, 134 aa, Triticum aestivum
  Clone ID: PAT_TA_37789.pep
MQHISKLLQRQTISPWIQIQVIGKRAESLSTDDLEHKKINLLLGEPFYCGSEGMLPWQNLRFWNARTLFDSMLSEDALIMPCKGVLKLCAMSLPDLWKSRRSLKDVEGFDHLVVNETLRACGDLPGEQQGPCLP

SEQ ID NO: 143372 - protein, 104 aa, Triticum aestivum
  Clone ID: PAT_TA_37790.pep
ERSRQNIPTEKQAEDPFRQAQIVEGGVRYQQTVVVRSYEVGPDRTATLETILNLLQETALNHVWMSGLLGDGFGATHGMIKSNLIWVVSRMHVQVDHYPLWGDV

SEQ ID NO: 143373 - protein, 83 aa, Triticum aestivum
  unsure (1)..(83): unsure at all Xaa locations
  Clone ID: PAT_TA_37791.pep
MKSHDCNVMLTQIPLLAIMNLIDKDIRNTVNDLYDFFNHLWQKXLNHEELDHMQDDIARILCNIEMSFPSSFFDVMVHHSMHC

SEQ ID NO: 143374 - protein, 69 aa, Triticum aestivum
  Clone ID: PAT_TA_37792.pep
TTSALVLVVAIHCLRRHRVQDYPCGGRWHGGTLLDLLIPLPRLPVAPKGWIYGDMVMPIWESRCTVCVN

SEQ ID NO: 143375 - protein, 110 aa, Triticum aestivum
  Clone ID: PAT_TA_37793.pep
NVKGTVHKGMPHKFYHGRTGRVWNVTKRAIGVEINTQVGNRIITKRIHVRVEHVQPSTCEPGFLHKELHNCKPKGGGKAPCEGLSTKKQPTRAQPGVKGEGDTIQTGTPI

SEQ ID NO: 143376 - protein, 142 aa, Triticum aestivum
  Clone ID: PAT_TA_37794.pep
GKRNRLCSSLGEKIAELKNEAEGIQRTIVEKNGQKSKLVKDRCDLEQKIADSKRKREPEEYCLEKKILELDDAKRAFAEINRYGAVDNTELEEDIKKEKNIIVERELLLNKINTKLAAASREVNDRREAYKTFMDSVNEETG

SEQ ID NO: 143377 - protein, 90 aa, Triticum aestivum
  Clone ID: PAT_TA_37795.pep
VRGAVHIGMPHKFYHGRTGRVWNVTKRAICFQINTQVRKMIIALKIHVRLDHLHPSRCIEDFFPQDPTFRGRRVVTFDSHLVSILFRHQK

SEQ ID NO: 143378 - protein, 90 aa, Triticum aestivum
  Clone ID: PAT_TA_37796.pep
SALKKHNLLMYQVPRQAMYLYMLKQSRKEAEACGAPEDCACAWTGGVLQQVYHHVKRKGRSASRSDQLPYPNSTKCWYKSNTTNTDRIAA

SEQ ID NO: 143379 - protein, 112 aa, Triticum aestivum
  unsure (1)..(112): unsure at all Xaa locations
  Clone ID: PAT_TA_37797.pep
RGNRRRSRTRRSRGARRSRSTRSARSRRRRSRRSGRRRRTKRKRKKTKKKKKKKKKTKTKKTKTQNDEEEEEEEHAEDEEDEEEAQEEQQSHDEKSRXRRRRRRRRRRTRTR

SEQ ID NO: 143380 - protein, 49 aa, Triticum aestivum
  Clone ID: PAT_TA_37798.pep
SWANLFCHYSSNWIQKSYVSQPSSLGVTTASQIGHQCNRAIQFNAQHKF

SEQ ID NO: 143381 - protein, 60 aa, Triticum aestivum
  Clone ID: PAT_TA_37799.pep
RRAIRVAAGLTRLRLALVMHRNVSMNCSLVEVHFCDCIQFRPLGTLFMHHERLISRYDLI

SEQ ID NO: 143382 - protein, 87 aa, Triticum aestivum
  Clone ID: PAT_TA_37800.pep
NITFCASVYQKIERWPVVGFCPHATSARVFGINLGALFPIVGSFEGVAQHNEPGNLTIMLEHSHLAIELYNFKFRRSPWCSEGRNWG

SEQ ID NO: 143383 - protein, 67 aa, Triticum aestivum
  Clone ID: PAT_TA_37801.pep
YLVNIRYTLSIIRNPVAYHSQFSESAVFGRRAITSISGDRSSGILINCCTRVTWVYVLKNMNDVFEC

SEQ ID NO: 143384 - protein, 65 aa, Triticum aestivum
  Clone ID: PAT_TA_37802.pep
ISNCRSSFELIFLSYRPTPQVCCTFFHIFLGLPKYEMFGLILRSYRGPVSFLGTCHHSPHDRCSA

SEQ ID NO: 143385 - protein, 79 aa, Triticum aestivum
  Clone ID: PAT_TA_37803.pep
NLFAHPMEKVGPIVVTVLMHLQINFTRIKSFCVSARSNLSSPLSIPKVSFWIISKENTNPHRTRDQVKLFMQYCTINAK

SEQ ID NO: 143386 - protein, 107 aa, Triticum aestivum
  unsure (1)..(107): unsure at all Xaa locations
  Clone ID: PAT_TA_37804.pep
IXGIITQHRYVLLDGEVGYIWQRCSVSDECNTGIRWTKQLRWTRHYTSRWGWAALCIAACLDLFQIQKSCPIRVSLRSHPSAGNTQTRTRPHSSSINGQRTVKMTNA

SEQ ID NO: 143387 - protein, 136 aa, Triticum aestivum
  Clone ID: PAT_TA_37805.pep
MEAQARHGVLPTGRQQHLHGHGQAHHQPPAGEDEWWEYFPCPFCYIEVEVPFLCDHLQEEHCFDMRNAVCPICADNLGANTAGHFRERHSQQLKMRKSSSSRAGAADDKEAYEDDDSYYEESSYIMGRPVPDDHSP

SEQ ID NO: 143388 - protein, 50 aa, Triticum aestivum
  unsure (1)..(50): unsure at all Xaa locations
  Clone ID: PAT_TA_37806.pep
ITDKFTVNTMSYSCSMALISEXGVQWVXDLYELTHLLPSLDAIYFIQRAK

SEQ ID NO: 143389 - protein, 50 aa, Triticum aestivum
  Clone ID: PAT_TA_37807.pep
EPFGSINITQLGHCNPRHKHASGIPILSMTSYPTLCTRQRHRTALSDIQE

SEQ ID NO: 143390 - protein, 71 aa, Triticum aestivum
  Clone ID: PAT_TA_37808.pep
PLKQSTTGHALKGLACSEDMPFSWVDNLISKTLFISLKLRRKLITVHHTCMLRETQSSTQVFLLRNNYHMA

SEQ ID NO: 143391 - protein, 50 aa, Triticum aestivum
  Clone ID: PAT_TA_37809.pep
SARFATANSTSIFGNPYNMLIAQGANQVQTYHRFLTQPQNANPSTGQTIS

SEQ ID NO: 143392 - protein, 122 aa, Triticum aestivum
  Clone ID: PAT_TA_37810.pep
TLEKHFESSSFNIGSSGATPEVTDSSVAPSTKVEELSSSQQDVFLLPLRSHDNSAKLEYGTYSSMLGKLRDQVLARPLRPFSKNLTERDWLRSSAKMWDMVRRSPVASDYCKALQSSGLFRK

SEQ ID NO: 143393 - protein, 120 aa, Triticum aestivum
  unsure (1)..(120): unsure at all Xaa locations
  Clone ID: PAT_TA_37811.pep
EFPAGFNSMSIETYAGTTDFGVWIEDYIVHLHMARGADVDAIRYVPLKLKGPAXHWLKSIPENTMGSCDELEDAFRADFHGTYVRPPDAADVTRXTEQPGESARKFWNRFLIKLNQMVDP

SEQ ID NO: 143394 - protein, 49 aa, Triticum aestivum; identical to SEQ ID NO: 139092
  Clone ID: PAT_TA_37812.pep

SEQ ID NO: 143395 - protein, 140 aa, Triticum aestivum
  Clone ID: PAT_TA_37813.pep
STHLDVPDVYITVQQATQVFYLPWACQTNPNLKGWDVVYEVSPRARLSPPKEEDYEPHINPDTYEGEFFQETRLFKKHFKNRYTSPQNIEVDSDSESHITLEEEQEELEQEDVTAADDLSMLDRLRQGGLPHVDATEPYE

SEQ ID NO: 143396 - protein, 70 aa, Triticum aestivum
  Clone ID: PAT_TA_37814.pep
TNKTDQRNLPTGRMIRVHDPRSCWLLISLLAIPPMQQGGAGREREKRTINSGAATKLELSPLPKPAVSLA

SEQ ID NO: 143397 - protein, 53 aa, Triticum aestivum
  Clone ID: PAT_TA_37815.pep
TRRCNSTFCKACTYWIVHGLDYFRCVDLPIFYFLALTWTLVLRTGFNLTSEKL

SEQ ID NO: 143398 - protein, 39 aa, Triticum aestivum
  unsure (1)..(39): unsure at all Xaa locations
  Clone ID: PAT_TA_37816.pep
RWNHTQPGFGCWISGVDTXQQSFEALNPRAFAVLIDPIQ

SEQ ID NO: 143399 - protein, 89 aa, Triticum aestivum
  unsure (1)..(89): unsure at all Xaa locations
  Clone ID: PAT_TA_37817.pep
SKLPYTHSSTCRRHRCACRHQPAPANNFSPITAVSPPSXCLEAEGSPAHVICSPTSPCRSAAKHASSWWSRVYACSVRRIGRACAPARR

SEQ ID NO: 143400 - protein, 90 aa, Triticum aestivum
  Clone ID: PAT_TA_37818.pep
NKQKKTENRKQKGNRREREVFITWRSPGLAQHGPTHHLALPVVVQLPQDGRRAPASAQATSWFHQSCRLAGDATHPPTTLAYPLLLSTRP

SEQ ID NO: 143401 - protein, 92 aa, Triticum aestivum
  Clone ID: PAT_TA_37819.pep
YIAATVQRSIVKLAAAEPSRGASIGPHLHHGAHQLDRKPRVAARGCRLQPQDVACRDGAAPSSFSNWPLAAWHSQGSEGVARCRLGLDHVEP

SEQ ID NO: 143402 - protein, 115 aa, Triticum aestivum
  Clone ID: PAT_TA_37820.pep
RRSTGKTDGMEGGDKKGKMNAKKSVETYKIYIFKVLKQVHPDIGISSKAMSIMNSFINDIFEKLAGEAAKLARYNMKPTITSREIQTSVRLVLPGELAKHAVSEGIKAVTKFTSS

SEQ ID NO: 143403 - protein, 140 aa, Triticum aestivum
  unsure (1)..(140): unsure at all Xaa locations
  Clone ID: PAT_TA_37821.pep
FGRARKLPRHPKSVRRPRHAKSPFYPSAGNAGSTSRCQNRWGYSGNLXYISDTHVPEPWSPTFPFASPFINRGRQNPRNPTLLRWPPDCRPAGDSSPTTSSTAIARRPSSTAPDEDPSSISSSRQISRPVLHLHGAAPST

SEQ ID NO: 143404 - protein, 42 aa, Triticum aestivum
  Clone ID: PAT_TA_37822.pep
SILCASLKSLGLEMFCSNDSRMAIRSWRWSDYEVIIDRPSYT

SEQ ID NO: 143405 - protein, 93 aa, Triticum aestivum
  Clone ID: PAT_TA_37823.pep
TTAEERRRTKVVPYAFIMGSLQYGMLCTAPEVCLAISQSRGTRVIQEWITRQRSKLSLVTSGLRNFLDYGGVKEFIVKGYADANFDTNLDYSE

SEQ ID NO: 143406 - protein, 76 aa, Triticum aestivum
  Clone ID: PAT_TA_37824.pep
KTMSRSSVSQTSCNARIPTEEIESCGEKCANHYKVYKLIMVSRVPGYGQLEYLVLGLSCESHHVTLINFVGVNVET

SEQ ID NO: 143407 - protein, 67 aa, Triticum aestivum
  Clone ID: PAT_TA_37825.pep
VDGRIMRILSMKVTAVLTKIWVRSSTTQMMTRMVSLLPFCGSHLMHHGGRAWNHSSGIRGISILDTS

SEQ ID NO: 143408 - protein, 56 aa, Triticum aestivum
  Clone ID: PAT_TA_37826.pep
IHLGSAMLIAIWWWVCHELMGIHLAPVHLYTGMGPMDTFNTGGMLDDFNQQARIHQ

SEQ ID NO: 143409 - protein, 49 aa, Triticum aestivum
  Clone ID: PAT_TA_37827.pep
RSTFRVEGVVMSPTLVLKITQPQRGNQPQRNLQNNEGGTIPNGPTKSGL

SEQ ID NO: 143410 - protein, 92 aa, Triticum aestivum
  Clone ID: PAT_TA_37828.pep
MFTKYASLRCTLQHFFGSTLHIVGGSQATPNKSRRHHSPKSNTLCVDDELLDLVLQMIISPPINSVSQIWLWWKKDLCGKQLGECYKSMFKW

SEQ ID NO: 143411 - protein, 60 aa, Triticum aestivum
  Clone ID: PAT_TA_37829.pep
VNKGSMLTWVCFVTYHIGCTDDYTDFIIEPIHVEHVTVNPYHTVQDFVVVQEATLIRTHL

SEQ ID NO: 143412 - protein, 44 aa, Triticum aestivum
  Clone ID: PAT_TA_37830.pep
THTRLAPQLWIMDASNVTQMTYDTNLLTNRSSHFIALLHPVINR

SEQ ID NO: 143413 - protein, 93 aa, Triticum aestivum
  Clone ID: PAT_TA_37831.pep
YRTNMKVHRYEATSSDLGAAITRQRSPIARRVARPLGPDRRTDDQEPAHHGVHGALHGGSSIALRVRVHGSEDRGEVEAGVSEIEMAEDACKG

SEQ ID NO: 143414 - protein, 113 aa, Triticum aestivum
  Clone ID: PAT_TA_37832.pep
ADARLAKLLVPAPYVVPEKKAKKKASGTQKSAQRLGVSDSSSGDSKTYSSREDEEEEEETSPPPAGGERKRKAAPPREAEGSKKGKTLPPDGSTNADDGEEDWPHMAKPLARS

SEQ ID NO: 143415 - protein, 144 aa, Triticum aestivum
  unsure (1)..(144): unsure at all Xaa locations
  Clone ID: PAT_TA_37833.pep
VDGQARLDEQAVNDDSEDNNYMPLSEDEVSLGDEEFIVPEDPVXQERFKRRLIATTKSLKKKQQQLQANQDLLTDRWIEVLSAEECRLERPTKSYPKCKLLPQFDDEALEPALQVHNAAHRPPRGRDKMTILPEHQPALRHRTN

SEQ ID NO: 143416 - protein, 123 aa, Triticum aestivum
  unsure (1)..(123): unsure at all Xaa locations
  Clone ID: PAT_TA_37834.pep
APKRAARAPRMRWTSSLHSRFVHAVELLGGHERATPKSVLELMDVKDLTLAHVKSHLQMYRTVKNTERPAASSXDGFENGSAGEICDDNLLDLRGGGKPEAVAPATRNGTLANDDDRSIGAGA

SEQ ID NO: 143417 - protein, 140 aa, Triticum aestivum
  unsure (1)..(140): unsure at all Xaa locations
  Clone ID: PAT_TA_37835.pep
VDGEPRHPNTGGQKKFPPQVKTVNMIYATHIPKRERKRALWDVYAMEPVAPKFNPWSACPITFDCRDHPTSIRHGGSAALVLDPIIDGFHLTRVLMDSSSSLNLLYQDTVCKMGIDPSRIKPTXTTFKGVIPGVAIARAP

SEQ ID NO: 143418 - protein, 129 aa, Triticum aestivum
  unsure (1)..(129): unsure at all Xaa locations
  Clone ID: PAT_TA_37836.pep
QGNILLPEDICLSSSGEVEDLEKLIDHVFPSLDDNMSNSNYMTSRAILSTTKEXVDKINIRMIERFHGDEVIYHSFDNAEDDPYGYYAQEFLNGLNPNGLPPHALKLKLNCPVILLRNIDPANGLCNST

SEQ ID NO: 143419 - protein, 111 aa, Triticum aestivum
  Clone ID: PAT_TA_37837.pep
HIRRQENQMCAGMTDLKKAMTRITELEEELKVARKDYEEESVVLVEKNDDLTRKLGVFMGDPAPRGGDDGSTCPENYIIIDDTDSDPDDGDDDYVDEAGADIMESSTDQFF

SEQ ID NO: 143420 - protein, 72 aa, Triticum aestivum
  Clone ID: PAT_TA_37838.pep
GFYQLLITSTKHDHLIQQLISHHVLTISHHNKPCKNKLDVLYFVVASFTWLLRVEQEPFLPMHQNHNDISSS

SEQ ID NO: 143421 - protein, 60 aa, Triticum aestivum
  Clone ID: PAT_TA_37839.pep
EILVLKFANPVACRYGKRCVTNLKHEVFSDCPPYEWRSGTSDGLFLPIYPPRSMRVVLGF

SEQ ID NO: 143422 - protein, 104 aa, Triticum aestivum
  Clone ID: PAT_TA_37840.pep
KDSHIIYIISCLRGYMTDDIDDIGSKATAASKSGARSINLMGTFSFPVAKRKLCPTNFISMSRASSPLDIHTTRLSRWKWRGWASSGEDDEVAQTPWSYVHVPA

SEQ ID NO: 143423 - protein, 67 aa, Triticum aestivum
  Clone ID: PAT_TA_37841.pep
KNEMNETGVPTIHMGQPKIAHGKRWGALAGFPTHMVPNRSSRLGSLRPSTDLCFVISMKIIDYNMFK

SEQ ID NO: 143424 - protein, 128 aa, Triticum aestivum
  Clone ID: PAT_TA_37842.pep
CVGRLLPSSLDASSSSSSKSLIIISIDSITRLPFLIILQFCIAMRQGKWSPFLGLLLISLEQVLCNIELQTRKQVSTRNTKKKHDERGRIMKEMALTLSLSLVPLGFNLSTALSAAAHLWQSWLIVDP

SEQ ID NO: 143425 - protein, 61 aa, Triticum aestivum
  Clone ID: PAT_TA_37843.pep
RKQCWSDSARSIAMPSSWLDDLIAETALMLKEISRELDDCCLAEQLKQWLNYRCQFPIVPT

SEQ ID NO: 143426 - protein, 74 aa, Triticum aestivum
  Clone ID: PAT_TA_37844.pep
LLFEKFLIPKRPFFWGAPEFAVSLVTLELPKRIRRNFNFNFILVRFGWLLTFLFYQLFPGVLWLLDHSFRMFVR

SEQ ID NO: 143427 - protein, 83 aa, Triticum aestivum
  Clone ID: PAT_TA_37845.pep
NLGINDPTNLEGVESYYNNDKSGFGEVLTLYSDESTTLEEVSIDYDNKVAIYDDYGNDMYAIKSNNNHETCHHDFNVQFGYVN

SEQ ID NO: 143428 - protein, 71 aa, Triticum aestivum
  Clone ID: PAT_TA_37846.pep
HYRVWGSTKDSLVELASAIIDPYYEKMKQDAQRTSPLSWHRAWMWQLDEPTSGSRPSACTHATRCTGRSLT

SEQ ID NO: 143429 - protein, 64 aa, Triticum aestivum
  unsure (1)..(64): unsure at all Xaa locations
  Clone ID: PAT_TA_37847.pep
GFGSKQLPSQLGPLKFSREACNPILKYXFKTPAYIFLDPQSGFSFQTPNQASGATVYAVLFYKY

SEQ ID NO: 143430 - protein, 72 aa, Triticum aestivum
  Clone ID: PAT_TA_37848.pep
EIVCKAHGPTYELCAICARSHTSFLCNPPAMLDSIAHVFQQLPSAIMFYQKWFRSPFAHIQVLQTEKKHRRT

SEQ ID NO: 143431 - protein, 86 aa, Triticum aestivum
  unsure (1)..(86): unsure at all Xaa locations
  Clone ID: PAT_TA_37849.pep
SXXNGAVVSWAPSRKPRQRQGKGQPKGGSPKDELSQPLNFKTYPMYFPFQCVLILTRNSNPFTTTVEPNCGFLILCSVRKTISKIR

SEQ ID NO: 143432 - protein, 72 aa, Triticum aestivum
  Clone ID: PAT_TA_37850.pep
GPLLLSVNSRNSPVVRKIPKSLGTFPMSEYSLPIYQSLCLDHFRTPRHVRDLIWDSEQTSVIKNITHNTNHH

SEQ ID NO: 143433 - protein, 82 aa, Triticum aestivum
  Clone ID: PAT_TA_37851.pep
FDSGWTLYVRVHKQVSTCGVNASHCVESLPFWVRSSCMLKISSKRFSPIGPRSAGVDPARVGWLLSRESEAICGEAGEELLI

SEQ ID NO: 143434 - protein, 103 aa, Triticum aestivum
  Clone ID: PAT_TA_37852.pep
YNEFLDSYTINRFFVRVYNHYSWVLSITSVPAAGIPYIFSTSLSLNLNTLFGPKIMACLTSSTIRKSQTICLTLNLLISGMDRVPPQPIEITMSLFYWSNCNI

SEQ ID NO: 143435 - protein, 87 aa, Triticum aestivum
  Clone ID: PAT_TA_37853.pep
KTACKLQLRFCSQLAENTNTRGKTWPGRIPGGEASPFRGTPVDKGSNVLYGCHAHRLPPPPRTPYPPSMHTTYTSMLLTPPLPSQIA

SEQ ID NO: 143436 - protein, 87 aa, Triticum aestivum
  Clone ID: PAT_TA_37854.pep
IFSELNVYRHVLVSLITHFHPCIVYIEIFKTFYICKQREYVHSPGPNGVRGGHPVFGPSVMCSLGTSLLSLDLLPRGPAKIHPIFIG

SEQ ID NO: 143437 - protein, 74 aa, Triticum aestivum
  Clone ID: PAT_TA_37855.pep
DDFRRCATALSAADAPNPRQPRTKITFPMLVSSKMPIISLAAASMFCAWILISSGAGMMNQINPSNISSSVWNL

SEQ ID NO: 143438 - protein, 50 aa, Triticum aestivum
  Clone ID: PAT_TA_37856.pep
CLLASYSNISLLSQGLLKAIANVFLNCPQRFCLRHIYQNFQTAGFRGEDL

SEQ ID NO: 143439 - protein, 67 aa, Triticum aestivum
  Clone ID: PAT_TA_37857.pep
KPSRCSWTWEKIYSTQHRFYCRSFATGHTDSKSLTLRASPTRATRRALKTTLSRALLLVLHGRQRWL

SEQ ID NO: 143440 - protein, 132 aa, Triticum aestivum
  Clone ID: PAT_TA_37858.pep
MSQVIDDATSYMNDAYDDASTLLDKTMPLGEFLDEQLARAKDIENAEIDEILETGNLVTPIRSSHSRYELPKVLEGYVMDEETTRNFLACNDRDDLKNLLCKLKEKSLNARMKCDPKFATSPMFVDDKDFEF

SEQ ID NO: 143441 - protein, 64 aa, Triticum aestivum
  Clone ID: PAT_TA_37859.pep
LVDTESCNGGIRFLAPVLIVWGYVCISRRKKYAGRATRGPRRRGALNLLGILICYVFNNNTTFL

SEQ ID NO: 143442 - protein, 87 aa, Triticum aestivum
  Clone ID: PAT_TA_37860.pep
IWMVTSPVANPKSPKRAILIIATLLTPLRITDVIGDENGEDNKEYADDQAAASGDNNYNYHHSHYDSGDYYYHYYHLSAVDDRHRVL

SEQ ID NO: 143443 - protein, 130 aa, Triticum aestivum
  Clone ID: PAT_TA_37861.pep
RADGKVYDEKPKSIPDKPLNKKIKFDDSDSSDDEDQGHSVEEANNGNDAEKGEAKSSEQQQEVPGALGIASKEDEEQVETAGGSAPKKQRIEDPLVSEQTEPKAPTDEPAETTDDKPKESTDKPAETTDD

SEQ ID NO: 143444 - protein, 101 aa, Triticum aestivum
  Clone ID: PAT_TA_37862.pep
LLMIVMWDLELSQAPVLRPLVWMIRCLYRADPRSISRRMQGQILKSRCRLSMSCLNFVLSPAVIHAANPPPMIWAEHCPECPLIACAPHHQDVSCLPSARA

SEQ ID NO: 143445 - protein, 87 aa, Triticum aestivum
  Clone ID: PAT_TA_37863.pep
LLPHLSLAQNYLSLYHPHKIINPSTHEILPLSSMRVELCDQTWCVFSVDVNRIPMQTYLKYITCLHLCHRPNFFLSRCLFISLCMCH

SEQ ID NO: 143446 - protein, 84 aa, Triticum aestivum
  Clone ID: PAT_TA_37864.pep
SRNHFDKTLFGLNPSKNHFIRRLTLAPLYGHRHGSVCRGHAQCRELYIAASGASMSMEHRVTAIGVLASATSCGVVPLGRRSIS

SEQ ID NO: 143447 - protein, 77 aa, Triticum aestivum
  Clone ID: PAT_TA_37865.pep
TLSGLGLSDEHFIKRLTLAPLDGHQSGSVRRGHAHWIKLYSSPGGASMSKDYRVNANVVLSDTPRCRVLLLRRRSIS

SEQ ID NO: 143448 - protein, 50 aa, Triticum aestivum
  Clone ID: PAT_TA_37866.pep
KLFLSRAILHAIASDRAGTHHALMDCSLHVNAQSPCLEHVCAPFFSLIAR

SEQ ID NO: 143449 - protein, 140 aa, Triticum aestivum
  unsure (1)..(140): unsure at all Xaa locations
  Clone ID: PAT_TA_37867.pep
VQISGSTGDKAIPLYQMLKKIDNLVXSDATNAAFEDLKRQLVEPPVLAAPVDKEPLLLYMAANDQAVSVAIMVERKEAGKEYPVQQPVYYISEVLIESMQRYQRGVDGVVLTSPRGDKIYYVLRLMFPCTINAAEYEALL

SEQ ID NO: 143450 - protein, 61 aa, Triticum aestivum
  Clone ID: PAT_TA_37868.pep
SKYYVKSFACPTVNLPQSVIINLNAALNTLRDLRQTRRLSTHSLLKHIHISAFDELTFYDH

SEQ ID NO: 143451 - protein, 110 aa, Triticum aestivum
  Clone ID: PAT_TA_37869.pep
VTRLLRAATRWEKSAATRRLRARVGMEFLMQPVNRQQDSNRRGQREQDEHGASSLPCESMTTRPVVELPANTESSANDQICTEGAVPRAGSADNLKLQSTPSNRVRVGAT

SEQ ID NO: 143452 - protein, 93 aa, Triticum aestivum
  Clone ID: PAT_TA_37870.pep
GDLHHALVCLKPTVITRFLFACWNLSLRRHLCHPYLPVQHWTYQPLSSRSHSHTRCTCNLGYTLSVSCCNRRLRFCSFWFCTRTPRYPRRPAN

SEQ ID NO: 143453 - protein, 68 aa, Triticum aestivum
  Clone ID: PAT_TA_37871.pep
CRADLHDDVVCCTHSLVARVQCVLSKWVALVKCATCTSSLGSRFVIPIHPVAAITSDSSATWATSASS

SEQ ID NO: 143454 - protein, 126 aa, Triticum aestivum
  unsure (1)..(126): unsure at all Xaa locations
  Clone ID: PAT_TA_37872.pep
MQQEKMKEKRKARKRSSKDDDDDDDDSNEDGADEDDDFFEDEKSDEDVKPMKKQKVNAKGKEKGKGKDKLPEEHFEPEATKEELELLVADQDAGNGAKGFNIXRKSKKGKKGKDSVEDKHPHIDLS

SEQ ID NO: 143455 - protein, 45 aa, Triticum aestivum
  Clone ID: PAT_TA_37873.pep
GGNQMREDDADDDETYVKRRMKTTLPTKDRNPCRRKSHDHGLNYS

SEQ ID NO: 143456 - protein, 120 aa, Triticum aestivum
  Clone ID: PAT_TA_37874.pep
SPEPIAQTEDRWMDTALGAPTSTTMEPNANLVPCETRDSEVPDSLPDSEPPAPLPIDSDWAPVMEFTAADIFQHSPFGDILNSLKHLSLSGESWPDYGQDGWGTDDEEIQSPPTTHFVAS

SEQ ID NO: 143457 - protein, 93 aa, Triticum aestivum
  Clone ID: PAT_TA_37875.pep
NLGAVHKGSRGSDIGRGEREALTVGLRRNIELCCLALIHILLPETFVNLLTRPLEFAPYLSGCLALQSWTAVMSLIILNGSYVGSYHNGFWSC

SEQ ID NO: 143458 - protein, 65 aa, Triticum aestivum
  Clone ID: PAT_TA_37876.pep
KITVYVPKVHRWVESMPSIICVNPETSTGHTLLVLCQIKSQHYDFVKMRSERMGMHLRCGSRPAN

SEQ ID NO: 143459 - protein, 61 aa, Triticum aestivum
  Clone ID: PAT_TA_37877.pep
NSGTQVCLLPFHLMYMLTFSKIGKICRGYFETAVKPTNLKHTRQLGCGRVSMCKVYISHIA

SEQ ID NO: 143460 - protein, 83 aa, Triticum aestivum
  Clone ID: PAT_TA_37878.pep
MDAQRALLDALMGSSRDLTEEEKKEHREVAWDDPDVCAPYMARFCPHDLFINTKSNLGVCPKIHDPALKQSFESSPRYAAGLP

SEQ ID NO: 143461 - protein, 81 aa, Triticum aestivum
  Clone ID: PAT_TA_37879.pep
YSLDELQVGQAVDEDPTATTKVYKQQCNNSRNLHLNTALFSGIQISRLKSTSPHNLQPSTIMLCFMFYDQVVICWCGAALL

SEQ ID NO: 143462 - protein, 75 aa, Triticum aestivum
  Clone ID: PAT_TA_37880.pep
LKGATTHHQQPILSVNLDDESDTPLYVKPHQYTSPLPTALSFDLRLISVTAEKLPIKLSNSMNRWCWIYPVKTDG

SEQ ID NO: 143463 - protein, 75 aa, Triticum aestivum
  Clone ID: PAT_TA_37881.pep
WMQGDAASDRLAIVGLGHLVAFACAPIVVDAVALVAAPPRVHLPALLMVPMLVPAPRPVASAQPLVVVGALDLAI

SEQ ID NO: 143464 - protein, 40 aa, Triticum aestivum
  Clone ID: PAT_TA_37882.pep
RRGPRADRRESRRIELVWSRERHQPSAKKVTIGSGGELQC

SEQ ID NO: 143465 - protein, 77 aa, Triticum aestivum
  Clone ID: PAT_TA_37883.pep
CPLAFCIMIFGLPSVYLYMMASAYLYDNTKRYIFLTLYRARFFFTTMIATRDNQSSFSSTMPVPFSYPLCFDLVSTV

SEQ ID NO: 143466 - protein, 34 aa, Triticum aestivum
  Clone ID: PAT_TA_37884.pep
RNGMNDGCRWCACIPRCYGDTRCLTRPFASRLDP

SEQ ID NO: 143467 - protein, 83 aa, Triticum aestivum
  Clone ID: PAT_TA_37885.pep
HFERHTFTVNATTMRWRYLPCYIHYRRFPNRMVKVYTPPPPTSINPWLARNNECLQLTTAPGEFCLIILICFDLFYHGTGHTS

SEQ ID NO: 143468 - protein, 82 aa, Triticum aestivum
  Clone ID: PAT_TA_37886.pep
FKFSLIIISAAATVLAGPRAVNSIVWFGLGFLIKVGSGGQPLSFNSVLYFSYGCWPLSFVYIISQWLLVHECFLNMLFLRKC

SEQ ID NO: 143469 - protein, 88 aa, Triticum aestivum
  Clone ID: PAT_TA_37887.pep
PTTWAALHKARHFYHTNLLLKYNFPMHKVPPRIINVCCRCIFLDTPSVIRSVVHFQSASSAQTPYSFWYQGIDSLNYDPRLIFSWVFL

SEQ ID NO: 143470 - protein, 77 aa, Triticum aestivum
  Clone ID: PAT_TA_37888.pep
RQMWLHWENSIQWHHDPINDMFKLSYYQILLKVKITCGIICHENAPQTYASYINRNNWVNHIHTKHRHQYLITPLWL

SEQ ID NO: 143471 - protein, 93 aa, Triticum aestivum
  Clone ID: PAT_TA_37889.pep
KDRSFSMLCIQNRQKRLDDRSHLHEGDVSAAQLAITRPSERRFRITWEGDGGVVWRCVNYAEPIRLAQFTSTSLVGSPRARTVQSLMRSAISL

SEQ ID NO: 143472 - protein, 133 aa, Triticum aestivum
  Clone ID: PAT_TA_37890.pep
KNKDGSEVFDWFEKYVLRSKLDVSIDHLELCSLLSHGGDARDKHITLLMNAGLLTRQLIDPNMYWFSIPSIGPIPGSHKRLVTMASVYKLTLQAFSMSTSFPSMQSKRTICNDSIVSNYQCKGNLLFAAAPTE

SEQ ID NO: 143473 - protein, 34 aa, Triticum aestivum
  Clone ID: PAT_TA_37891.pep
IDLVDQPFVQSFMTETWTLPESSCCEGVWCPRGP

SEQ ID NO: 143474 - protein, 102 aa, Triticum aestivum
  Clone ID: PAT_TA_37892.pep
FSFVPMPALFIWCFSRQVDVIPFIFCKISPQFFLNDVVPSVKLSFFSHAPTLLLGAGVRNRVSTLPVRSLCILSSIISTVFSLQVIRRFPVPSCLCFTRAST

SEQ ID NO: 143475 - protein, 62 aa, Triticum aestivum
  Clone ID: PAT_TA_37893.pep
RNIEDLIKKSNKIFIWFYLLFYLNLGKCAFFKISFRPQINVHHVRLDFRSRGKFISGFLESV

SEQ ID NO: 143476 - protein, 100 aa, Triticum aestivum
  unsure (1)..(100): unsure at all Xaa locations
  Clone ID: PAT_TA_37894.pep
MTVMKTSLTIIPMCPRERFPLYKSLSXLSFATKRIGPSCCTLFTCITCYSLQINLSQNYLLPIISVLVGNTLLKTAYHFLLLLVGFDTLTYRKGYDRSPT

SEQ ID NO: 143477 - protein, 75 aa, Triticum aestivum
  Clone ID: PAT_TA_37895.pep
SWFSKLREILTLLCCITVSSSREKPTQAQQVAAITIFLGLRAIPSSSNPPAHIASRSSSLSKCGGLAFLPSIDVV

SEQ ID NO: 143478 - protein, 131 aa, Triticum aestivum
  Clone ID: PAT_TA_37896.pep
SEPVLTEQVRQIYIEDLRQAITLADSVGLQGANNKLVEARNNLQLERSNSMIDILRAQLDKLIELISSGMGLRALRACLLSMMMLHGRQRVTETGPVMGHKLYVTQFTDMSRKQAGDHEKDPAKVPPPASQ

SEQ ID NO: 143479 - protein, 123 aa, Triticum aestivum
  Clone ID: PAT_TA_37897.pep
TGIYAAHPSFDDSGIPPPPSKWKGSCHGTAAAHCNNKLSGAKFITVNDSGDVIGHGTHTSSTAAGNFVSGTSAQGLGRATAAGTAPHAHLAMYSMCTLRGCDSADIVAGIDEAIKDGVDVLSR

SEQ ID NO: 143480 - protein, 64 aa, Triticum aestivum
  Clone ID: PAT_TA_37898.pep
FMILLFFFFFFFYFFFFFFFFFFFFFLIEKSHYIALSANKTSSLLFELFRNHFYAESCYCYYFS

SEQ ID NO: 143481 - protein, 57 aa, Triticum aestivum
  Clone ID: PAT_TA_37899.pep
DDIHKFLHFIDRLEVLVGCFNGGRLRGICVPLLHTLNKSNCVEKLMVRAVFCYIFCS

SEQ ID NO: 143482 - protein, 104 aa, Triticum aestivum
  Clone ID: PAT_TA_37900.pep
GEDQRFHIFHTKGGINGRSVKVIIDGGSCHNLASEELCSKLQLVKMKHPHPYKVQWLSVSGTIRVEHTVQVSFKIGAYEDTLECDVVPMSVCLLLLGRPGIVDR

SEQ ID NO: 143483 - protein, 100 aa, Triticum aestivum
  Clone ID: PAT_TA_37901.pep
KGVRCPLSLSLLVTNSAASRPPGDREEVHRFSVRRCRGSTSRSAVHVVLSDQAPARQGLRHLLADSARRRSPSYIPTTSRYPLRPCSTARLPTSLHVDLP

SEQ ID NO: 143484 - protein, 57 aa, Triticum aestivum
  Clone ID: PAT_TA_37902.pep
PMLGYLARNKRPIVFFYIYSFYIYIYILYLISVVLVSFFTGHGLSMFCTEATSSMGL

SEQ ID NO: 143485 - protein, 136 aa, Triticum aestivum
  Clone ID: PAT_TA_37903.pep
DIVRTLLIQSSMPLKFWAEALHMATFLLNIRPSKTKPNNTPYYFLFLSHPDYSAVRVFGRLCFPNAYATSANKLSPRSIPCAFLGFSDEHKGYRCLDLHTGHVYVFRHVMFVEHIFPSSQRTPTPSNTPSSATTPS

SEQ ID NO: 143486 - protein, 95 aa, Triticum aestivum
  Clone ID: PAT_TA_37904.pep
GHSSGRPPFFFTTRGLLCGRLAIRPHISFHARRGGWCVGVYHFAHTPVSSPHPKLSVDMCFCRVHGNCPSFACKQMATLFYPNCHVFLHGTWQLP

SEQ ID NO: 143487 - protein, 78 aa, Triticum aestivum
  Clone ID: PAT_TA_37905.pep
NNPNPPTSNIAKLMYLPKNKGESSSKENADLKSISVHPNFFNIIREPFATNEFLDFLPRSLIINKKKETPKGYKCSIE

SEQ ID NO: 143488 - protein, 117 aa, Triticum aestivum
  Clone ID: PAT_TA_37906.pep
VGRLPSFIAFGVRSIAQPLNYSGNISRSFRRTFSVSGNRAGLLLSPLLLHQPTLHSPLPFTARPNLTSLSSPRLSTRASESCPGPDSDSHHHWVQNIPKHLQNIIGLFIGLLSIFIL

SEQ ID NO: 143489 - protein, 61 aa, Triticum aestivum
  Clone ID: PAT_TA_37907.pep
EIIFDKEAIREEIRSQKLKVAKLEEKNLMIQEIHQGLKDSSTMAHAKDVETLKFGTQLQKY

SEQ ID NO: 143490 - protein, 67 aa, Triticum aestivum
  Clone ID: PAT_TA_37908.pep
LSCLINYYLIKLNSILVIKALKQAQGTDLCAFCICENIRMMASERSRSQRQEWVRLSEHYSQFLHHY

SEQ ID NO: 143491 - protein, 109 aa, Triticum aestivum
  Clone ID: PAT_TA_37909.pep
RGGEVEEGFLDGRGHVFIKKCAAQCNYAGTPGCSHLRGMWQARNILRVVPRSHARQVCRMVVPASPDFNNKDESFKTNLMFVSVSSADKDAEKTFDSFNSMHMIWTDRV

SEQ ID NO: 143492 - protein, 134 aa, Triticum aestivum
  Clone ID: PAT_TA_37910.pep
GISSEEEINLFNWHIPNLEYANAGLSSRLSLAFWDQDDPYDMGGDHCFLPGGNGRLVQALAENVPIVYERTVHTIRYGGDGVQVVVNGGQVYEGDMALCTVPLGVLKNGGIKFVTELPQRKLDSIKKLGFGLLN

SEQ ID NO: 143493 - protein, 113 aa, Triticum aestivum
  Clone ID: PAT_TA_37911.pep
GASYWIDTLVLKTEGNTYATIAASPSPLRGKPTQAQEVARRISGAVAGEVFAQVKTYQVPITNPSPLHLHYLPFASHFPLPHFTLAVLFALSLTIFFSFFRLPSRCHGRIKKN

SEQ ID NO: 143494 - protein, 130 aa, Triticum aestivum
  unsure (1)..(130): unsure at all Xaa locations
  Clone ID: PAT_TA_37912.pep
ETMLLQRTLDAMVDVVYCPRCQTACLEDAGDEAVCPSCLFSFCALCRGRRHVGVECLSAEEKLQILEERQKSARTKGDIQKLMDEVCSIKEILKDAKQCPHCKMAISKIEGCNKMTCWNCGGFXCYQCNA

SEQ ID NO: 143495 - protein, 86 aa, Triticum aestivum
  Clone ID: PAT_TA_37913.pep
GHHQGQNVFLPHTSRCARTSNGRLAGSPKFNYLDNLNSFKSSPYVGEKCDCLDYLACYLSHTIPTQKPHPRTHPFPFPGALGFKIE

SEQ ID NO: 143496 - protein, 107 aa, Triticum aestivum
  Clone ID: PAT_TA_37914.pep
VVRNHSGLTCPISYLTLSMWWFTHSVKVGALNVTYGGVTHLTQVVGLWLSLHGNHGNTSNMGLVVKSLSLSIWWHKSLKSSYVAVVEGNVIIAVDEGRRWHIITLTS

SEQ ID NO: 143497 - protein, 97 aa, Triticum aestivum
  Clone ID: PAT_TA_37915.pep
SEALVLGVTWVWNSCSIDLPTSACSSSAIFHIIISSLAAVLRPLSDPRSTFSGENQFQGSQLTELYHSIFPGSQQNSSSHGSHDALSLSLSCVGGSP

SEQ ID NO: 143498 - protein, 118 aa, Triticum aestivum
  unsure (1)..(118): unsure at all Xaa locations
  Clone ID: PAT_TA_37916.pep
LLATKPXVTATEPRKPKIMHTSTASFSMLPLLLFLLDELSSVRITLDCLHRCIKTGSYKCAKGLKNRVALAIWSIVKHLVSLKYLAVGYFVHQFCWDGANAMGLHGHGAPAENCSSRA

SEQ ID NO: 143499 - protein, 134 aa, Triticum aestivum
  unsure (1)..(134): unsure at all Xaa locations
  Clone ID: PAT_TA_37917.pep
RYLIGIVTXMTFHLRDGFFVSLDHVIGFTKLFQERNEVLLGFALELTHEGLKFIYLLIRPLTIIKANRQRRIRNNGGFDVGAYLVSGFSHEALGGDVLVGESKRDTRGVVEMATDTIATASLYSSSSSSSRYSF

SEQ ID NO: 143500 - protein, 74 aa, Triticum aestivum
  Clone ID: PAT_TA_37918.pep
PRCISQTKMSSRNWYQTASVWMNTMARMRSRSTSTLLNISSAAEARFQCDNLFCGSRNSLRLGAHEINTRNLPD

SEQ ID NO: 143501 - protein, 123 aa, Triticum aestivum
  Clone ID: PAT_TA_37919.pep
SQQESRSSVTGEERRGEGAPSRHVVRWPPLLCSWPLAPGETPKQRRAFHFGTPLRLLRLRQRGDRMEVATVFLETSLGTRLAVSFPASATTVADLKRACASFLSFFRPFFLSFLMLKMNLKQI

SEQ ID NO: 143502 - protein, 76 aa, Triticum aestivum
  Clone ID: PAT_TA_37920.pep
SLFQTPRLVLLSLSVSSDRSWTINIFSVSFRLIFLWIDLILQPSAMPWPDQTAAGLPPLHRPELPLQYRTESGLSR

SEQ ID NO: 143503 - protein, 110 aa, Triticum aestivum
  Clone ID: PAT_TA_37921.pep
KTTSKEGGEKKGKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 143504 - protein, 87 aa, Triticum aestivum
  Clone ID: PAT_TA_37922.pep
GDDQAPSIAAPPRRGMVLYMSLSVRTAQHGARRAFQCRRSSTSSGFNISFAVLLGSCVRPSMHCILWGLRTCDLYGYPALLIVLFVH

SEQ ID NO: 143505 - protein, 82 aa, Triticum aestivum
  unsure (1)..(82): unsure at all Xaa locations
  Clone ID: PAT_TA_37923.pep
VPLIAFVDSGAQSTIISKDCAERCGLLKHLDQRYKRVANGVGQTEIHGTIHVSATNICHAFXPCTFRVLDDPNMEILFGLEM

SEQ ID NO: 143506 - protein, 91 aa, Triticum aestivum
  unsure (1)..(91): unsure at all Xaa locations
  Clone ID: PAT_TA_37924.pep
GSTGKKHKAEKPAPXGQRRPSAKGKTRGRKKGTMAKKTFETYMIYIFKVLRQVHPDVGISSNAMSIMNSFINDTTSIRIRIPSHIPSPHTL

SEQ ID NO: 143507 - protein, 112 aa, Triticum aestivum
  Clone ID: PAT_TA_37925.pep
RAPASWRPAAGEERGTTKAACQEELGTYRIDIFKVLRQVHPDVGISSNAMSIMSCLINDTRRIRIRISPHIPSRHTLEPPAAAAPMAPKAADKNPAEKTTAGKKPTAGEAGR

SEQ ID NO: 143508 - protein, 41 aa, Triticum aestivum
  unsure (1)..(41): unsure at all Xaa locations
  Clone ID: PAT_TA_37926.pep
GRFFFFFFFFFFNFFFXFFFFFFFXFFFFCPEQTPDHPMGG

SEQ ID NO: 143509 - protein, 78 aa, Triticum aestivum
  unsure (1)..(78): unsure at all Xaa locations
  Clone ID: PAT_TA_37927.pep
KSYLSTHPSIKNHSDPLPQPKVLKKAIHLYRKPCAGNGIKGSPKGCIFKLPCLRRNSFGGGGCLXRKHALCCLHIDGH

SEQ ID NO: 143510 - protein, 54 aa, Triticum aestivum
  Clone ID: PAT_TA_37928.pep
LAIIYICEIVSCYPVWLDNINMNYFMPSFIPHYPLTCLSYNIYTFNYFSCLSAI

SEQ ID NO: 143511 - protein, 35 aa, Triticum aestivum
  Clone ID: PAT_TA_37929.pep
SSNTANSSSPRLASSSEGACNYHPPLLHLPLSQEG

SEQ ID NO: 143512 - protein, 138 aa, Triticum aestivum
  unsure (1)..(138): unsure at all Xaa locations
  Clone ID: PAT_TA_37930.pep
QINKNSVHHGKNNHYTLVQMDKKITLLPRTPDSILKDDINRANKAKQEKNKTENHIVAKEFEQQMRPNNKQSSVASEIKLKSACLLATKSDINDLDFRKSICYAFECKEALFSFEDVPSSLPPAVTNILXEFADVFPQ

SEQ ID NO: 143513 - protein, 75 aa, Triticum aestivum
  Clone ID: PAT_TA_37931.pep
MECLTGLSPDYSALRMFGCLCYVLLAPRERTKLTTQSVECVFLGYSDRHKDYRCWDPVGRRLRISRDVTFDESRS

SEQ ID NO: 143514 - protein, 74 aa, Triticum aestivum
  Clone ID: PAT_TA_37932.pep
APFFYFFNFFFSYFFFFFKFFFFFFFFFFFFFFFFFFFFFFFFFFFFFFFFRKPQYDSTLLLKGFEFLVKIRTH

SEQ ID NO: 143515 - protein, 41 aa, Triticum aestivum
  Clone ID: PAT_TA_37933.pep
ASSKSSKEEKEPSPTKTNTLKTCSRDSSSVISSWPPCLCPS

SEQ ID NO: 143516 - protein, 59 aa, Triticum aestivum
  Clone ID: PAT_TA_37934.pep
YHCGKFLKGSYRSKIFMVVYSWTLKGWSPSLIGASDTRTRFISKAKWPYCCKDLSKSCQ

SEQ ID NO: 143517 - protein, 59 aa, Triticum aestivum
  Clone ID: PAT_TA_37935.pep
IFFILFFYLFFFFFLFLFFLSFLIFFFFFFFFFFFFLFYSMKQLRILHLKLWQVPSDKN

SEQ ID NO: 143518 - protein, 55 aa, Triticum aestivum
  Clone ID: PAT_TA_37936.pep
IIFVEPPCLLNSSSQTCFTIYIVHSNQIQSKRRIFNFSEDDAVKSNRSHNTQKDL

SEQ ID NO: 143519 - protein, 141 aa, Triticum aestivum
  unsure (1)..(141): unsure at all Xaa locations
  Clone ID: PAT_TA_37937.pep
WTSNIIVYEARLVAKSFSQVQGVDYDEIFSSVAMLKSVGIMLALAAXYEIWQMDVKTSFLTSLRKERLYVIQXKGFVNPKVAKRYAXLQRSFHGLEXASRSWNIHFDKMIKDFGFIQSLXETCISKEVSGSTIELLMSICC

SEQ ID NO: 143520 - protein, 107 aa, Triticum aestivum
  Clone ID: PAT_TA_37938.pep
QIQAENYRLMLDQNASNDVMRRRHQSRLPTVYEARNLFSTPGAGTSNLAAVNWGETPGTGVPDQPHAADPPRQNHDPPQYVPTPPGHFPTPLDNMIAAASRLAANPM

SEQ ID NO: 143521 - protein, 135 aa, Triticum aestivum
  Clone ID: PAT_TA_37939.pep
AASAGGGGKDKDRDRDRARGSAVSFTEGEKVLAYHGPLLYEAKVQKTENREDEWRYFVHYLGWNKNWDEWVASDRLLKLTEENVRKQLELKNQSGDKTVRTGGRSAQHNPKGSNVDAKADKDDTKGLVKGKKRKN

SEQ ID NO: 143522 - protein, 87 aa, Triticum aestivum
  Clone ID: PAT_TA_37940.pep
LIIGLEPYLLSYRCMDWTKHESPQGADRAMDLSRMVTRTKRRCYTQVRALLMEVKPYILLSFILMECIEYRVDLPPDREMWSNSRAR

SEQ ID NO: 143523 - protein, 108 aa, Triticum aestivum
  Clone ID: PAT_TA_37941.pep
MQSCCWRRSPLLLTGQQIAFKKLEEVYGTFDAPSQRNGFFLPRPKMTNADLGRIINSDEVQSVVKPTNKEIKLRKKRRNPLKNVAAVLKLNPYFGTARKMATLVEAAR

SEQ ID NO: 143524 - protein, 79 aa, Triticum aestivum
  unsure (1)..(79): unsure at all Xaa locations
  Clone ID: PAT_TA_37942.pep
LLFQRKHRXLTTLCAVCSFRSAIPLPWLTLYPSCLCFPNFMMTTISLRGSCRNSTTPPIELNKLSCTNSYLILVKLRDV

SEQ ID NO: 143525 - protein, 100 aa, Triticum aestivum
  Clone ID: PAT_TA_37943.pep
IPLRLILAFIEYPLIPQLFMCYTKVFEIPPDIPKILSNLLLWNFLFSFIMNNPISIEILLTFLVIIILSLLTQYVANASNHQMILLNYLSSSDVLHTLAG

SEQ ID NO: 143526 - protein, 54 aa, Triticum aestivum
  Clone ID: PAT_TA_37944.pep
TTEDPPIRDHVKIRLETRMLPHIREVTIFVYPFVYNFIILLFFFFFFFFFFFFF

SEQ ID NO: 143527 - protein, 91 aa, Triticum aestivum
  Clone ID: PAT_TA_37945.pep
PRPASLPLLHINGVPKRPHPPSSAHTHTQSSLSACILNAALSPRSRQCMRMPPKRPIGGSGDAGAAEAPEHGADMETELAVTSGDVSLHPD

SEQ ID NO: 143528 - protein, 96 aa, Triticum aestivum
  unsure (1)..(96): unsure at all Xaa locations
  Clone ID: PAT_TA_37946.pep
YIFGVLKQVHAAMGISSTDMSXMISFINDIFGNLAGDAVTVARXGMKSSITSSEIXSSLRLVLRGDLAKHAVSDGITAVTMFITNYGYVAVSLGFR

SEQ ID NO: 143529 - protein, 142 aa, Triticum aestivum
  unsure (1)..(142): unsure at all Xaa locations
  Clone ID: PAT_TA_37947.pep
LQEFDLHIIDRKGAENPVADNLSRLENVPDDPLPIDDSFPDEQLAAINVAHSTPWYANYANYIVAKHLPPSFTYQQKKKFFYNLRHYFWDDPHLYKEGIDGIIXRCVLEHEQGQILRKFHSEAYGGHHAGDRTVHKVLQSGF

SEQ ID NO: 143530 - protein, 115 aa, Triticum aestivum
  Clone ID: PAT_TA_37948.pep
GSTGNSKGRTVRCGVKSWVVYAHMRQSMGWAYMGIPTKDMSRMSALTIDIFRKLAGAASVRFAELELVNINSGEVYSCVFSDSHGELAKHAVSDGSTAVSKFTSSYVSSHIPSMM

SEQ ID NO: 143531 - protein, 114 aa, Triticum aestivum
  Clone ID: PAT_TA_37949.pep
SVAICGHSQFTIIFSSPLSPPRLLLSPNRLPSPWPIVLTMFHPRMYAPALSTSSSASPEHGEITGGSRACCAHDSCHQHSPTPPRRPPRATASHQPLCRRPRPRNRRPAQRRPL

SEQ ID NO: 143532 - protein, 92 aa, Triticum aestivum
  unsure (1)..(92): unsure at all Xaa locations
  Clone ID: PAT_TA_37950.pep
SEHFIFFCRHPSPESLRNHHCIFQADDKFWKVKYDHEVAKKARKAKKAAKRAAPRKKGSXPTASELLQLSDSSDSEVTPQKKKRTTKKKTGR

SEQ ID NO: 143533 - protein, 67 aa, Triticum aestivum
  unsure (1)..(67): unsure at all Xaa locations
  Clone ID: PAT_TA_37951.pep
GSTGERMEXGRAGRAGRQMGTRLRFHKGVTKEAFGDLILKGEMIRITPWGKKFTRRWPKDISPRWMH

SEQ ID NO: 143534 - protein, 125 aa, Triticum aestivum
  Clone ID: PAT_TA_37952.pep
SAAKSKDKAAQTSASMRAPCPSQEARDQQRHSVRSAIRPLTQDQAGGSRGVQDQHARQHAGSSEVRSPGWDAAPSNLVRSPSTPLSSHRSPLPRTTPAEALARAQLLLDYPPTVDKTDEWRATIQ

SEQ ID NO: 143535 - protein, 53 aa, Triticum aestivum
  Clone ID: PAT_TA_37953.pep
TTLHQLNFLCLRPMNVVGLDLHYHDIPSLPEHAARPAIRPITDSLCFPVDRTN

SEQ ID NO: 143536 - protein, 79 aa, Triticum aestivum
  Clone ID: PAT_TA_37954.pep
IDTFRATNTTYQPVRRRPAVPTTALRWGKVAHHCGTSSSTITLYPRVDEQHDSPPFLPPGRDMIISITSHGVKWLLSSS

SEQ ID NO: 143537 - protein, 123 aa, Triticum aestivum
  Clone ID: PAT_TA_37955.pep
MEQSRWMKNRKTADYINGVTEFMNLTESTKWIIGDADYIMCPCTNCANIESHQVADVQWNLVSRGFMDGYTRWTKHGEEEVMDEDTQGREMANPNQCHMDVESNIRAKASSYQWNGGTPKRPL

SEQ ID NO: 143538 - protein, 69 aa, Triticum aestivum
  Clone ID: PAT_TA_37956.pep
SYPSTQCLYYQFVTIHMNPNTLSLDDRSFWLFFWLLVHILARRAWECSLSVISPYGIVDLGYGSNTCNI

SEQ ID NO: 143539 - protein, 78 aa, Triticum aestivum
  Clone ID: PAT_TA_37957.pep
TCSRAPCNRFLFRLSPCVNLIYCLLLFNHPMGSIPTEDTAVFGIWPRQTKLHVPRNKVLKIGSCQPILFYNRPNTRST

SEQ ID NO: 143540 - protein, 78 aa, Triticum aestivum
  Clone ID: PAT_TA_37958.pep
TSSFKNNVFCTLALYNAGSLQDIIKILLGRAVLLARGRSFGRELDSVHLRPLNFDTSEGQLRTFAADRALDGIKLRAG

SEQ ID NO: 143541 - protein, 61 aa, Triticum aestivum
  Clone ID: PAT_TA_37959.pep
EDRITYCIAGAEPMWLMLSLMSLMRRLPRSGKKAFVEEVVAGSSHRSVLPKNLYLPSPVDP

SEQ ID NO: 143542 - protein, 107 aa, Triticum aestivum
  Clone ID: PAT_TA_37960.pep
MQQAANAAVNGAIGATALSSPSTSRKRKHIDSSLDLSTKEHLAIRNGQLSQVIYQKNAMASDGSLPIGQSAHPHMMGPFKVTYRPLLADIIQPGDVKELCKLLVTVS

SEQ ID NO: 143543 - protein, 106 aa, Triticum aestivum
  unsure (1)..(106): unsure at all Xaa locations
  Clone ID: PAT_TA_37961.pep
MVNLSNLLVVHFGVLLVLNGCLATQSLGVPPHLQNKCQLDNLYVLXTTEHFTSETGHIHXGDYNHTQIRSVGVSVARQSASSSXCLYLFTFFTSPLFSDIIHRTDI

SEQ ID NO: 143544 - protein, 96 aa, Triticum aestivum
  Clone ID: PAT_TA_37962.pep
WPSGSPSCASRSCPPIGHPAMNSSRCLPSSTASSHLHHRSSRKFLQNIFHRARRRRMELDRTPAGHTVPPFQLLELNSVCPDGNQQCRGRTTSVAK

SEQ ID NO: 143545 - protein, 112 aa, Triticum aestivum
  unsure (1)..(112): unsure at all Xaa locations
  Clone ID: PAT_TA_37963.pep
NGWQFTTYHIVDTHMSXKALLVVYTNEPVSVESSIQTMEQLLAEDKYQVVGFDLEYTIGRAGHDEKVSLTSCACDMTSLSTNTTWPEGLASVSPGLSTALTTISLRWTPSTI

SEQ ID NO: 143546 - protein, 82 aa, Triticum aestivum
  Clone ID: PAT_TA_37964.pep
VLQDEEFVLEAHNYEMEPLLVPEGYVFVLGDNRNNSLDSHNWGPLPVRNILGRSVFRYWPPSKITDTRYYQPDAALYAVGMS

SEQ ID NO: 143547 - protein, 35 aa, Triticum aestivum
  Clone ID: PAT_TA_37965.pep
LITCIINVWLINYINCLISKLIGCLVSKLFCINDW

SEQ ID NO: 143548 - protein, 131 aa, Triticum aestivum
  unsure (1)..(131): unsure at all Xaa locations
  Clone ID: PAT_TA_37966.pep
IRRSTGWIRRVRVGANPIERPPCPGRVGALEKTIRGLVDREWDEVVKPELGTNFDSLTEANDFXNLYSWEHGFGIRYGKNRLNPDRRKTMQEIVCRCSGKPLRENTRSCRCECPAMIRLLRASDNGYPDLH

SEQ ID NO: 143549 - protein, 50 aa, Triticum aestivum
  Clone ID: PAT_TA_37967.pep
KMDRWGALRIMGEAAPWPRRVELHNVLECYFFILFSDLGRASKLMESVGL

SEQ ID NO: 143550 - protein, 103 aa, Triticum aestivum
  Clone ID: PAT_TA_37968.pep
GADGAARHRRVLAGGPGDGGGGHRGRALRGGGARVDPPLGRLIRPTPRTHRRARINKPSPRLIRMLELWIAVRVVFSALFMGLIGDLGFYAKTALSQKRKTWL

SEQ ID NO: 143551 - protein, 96 aa, Triticum aestivum
  unsure (1)..(96): unsure at all Xaa locations
  Clone ID: PAT_TA_37969.pep
HCSIPKSSLASSSPSPSFYTFGHRHGQAGMVVRPRSHPSTHFHPPLHHHPTPPAPPPSFRAIHPPSPATDASGATDQTARLVXRVSAPSTTPLLSA

SEQ ID NO: 143552 - protein, 80 aa, Triticum aestivum
  Clone ID: PAT_TA_37970.pep
IQMAFKNVHHFWKMLETVTRGDAHFFMTYLGSKLNHTPFAFGHLNVIKYFKCPNNHKLKCLLLEIFQTVTSVSCMIFESA

SEQ ID NO: 143553 - protein, 126 aa, Triticum aestivum
  Clone ID: PAT_TA_37971.pep
VDRIGGSSENDKAYGGWESVAGLSDVIQSMKEVVILPLLYPEFFSSLGLTPPRGVLLHGHPGTGKTLVVRALIGACSQGNRRIAYFARKGADCLGKYVGDAERQLRLLFQVAEKCQPSIIFFDEMD

SEQ ID NO: 143554 - protein, 57 aa, Triticum aestivum
  Clone ID: PAT_TA_37972.pep
LITEDQGDTCIRYSIFGSSILALVIYPFVLINKTGGPFHSPLASSSLLLPCDPEDPK

SEQ ID NO: 143555 - protein, 91 aa, Triticum aestivum
  unsure (1)..(91): unsure at all Xaa locations
  Clone ID: PAT_TA_37973.pep
PDSLQAXRMTRNTSYNIYNALQALQYFTSSPSNVTSSTSVLFFSMELLQQQSNVGLTDRHSQDWADRNTTCLPQSPCCCGGASWWSCLSSS

SEQ ID NO: 143556 - protein, 88 aa, Triticum aestivum
  Clone ID: PAT_TA_37974.pep
YGFNHIPMMPTEMVSPNSVHSDTASSHQQAILHQMPSPHGMAQYQVRQTNPNNPLEGEGSLSGNSRHRGDGQVLRDKVASIATGGVAN

SEQ ID NO: 143557 - protein, 57 aa, Triticum aestivum
  Clone ID: PAT_TA_37975.pep
THSLFILVLNLLYSNFSMVHTPHRFIKISKQHTKNRTVCSNLICSNTYGIPKILKNF

SEQ ID NO: 143558 - protein, 53 aa, Triticum aestivum
  Clone ID: PAT_TA_37976.pep
ACVGFSLEEEMVVQQSTNKYFPQFENQGINLVGENAQITEYLYKQSNNLHPTQ

SEQ ID NO: 143559 - protein, 133 aa, Triticum aestivum
  Clone ID: PAT_TA_37977.pep
GSTGIGKITLTDFSLGELPPYLRTMRVVPRDLNELWAFEFDFEYCSKIILNAEARLEVQEPGLQKDIMRTTVEADSNGNQFGPSQLLASVMEDEDEADVLRRSKKTGKTSRWKNILHSITDHVSQVPFSLAIK

SEQ ID NO: 143560 - protein, 61 aa, Triticum aestivum
  Clone ID: PAT_TA_37978.pep
TPQKKCHSYTRRKELAGDIYIRGPTRTSMSLLLDLSIMNRQVFYHENTPPPPNPGDPPRIP

SEQ ID NO: 143561 - protein, 99 aa, Triticum aestivum
  Clone ID: PAT_TA_37979.pep
NRKVRAALREAERKVLEARKKKDAAPETNAAYLGGFAMPNDPAEQLKHRGYHMVAGAVDIGLFRKAALEDVKRFKEASMEIGEAEGEEEDEKEDGYWSE

SEQ ID NO: 143562 - protein, 60 aa, Triticum aestivum
  Clone ID: PAT_TA_37980.pep
LRKSGIIFKNIQTMLNLFVIMIFLFNPKSQWGCLFHRTFYTTTKKLKFSSKTIHNFLLFL

SEQ ID NO: 143563 - protein, 51 aa, Triticum aestivum
  Clone ID: PAT_TA_37981.pep
EGPNLGKHRVPIVHCDHRSLDTHLGTPYPRSAGFDTDIGAFIESSVVLSTR

SEQ ID NO: 143564 - protein, 105 aa, Triticum aestivum
  unsure (1)..(105): unsure at all Xaa locations
  Clone ID: PAT_TA_37982.pep
LNLGQPVAERFRHVHGFDYKETFAILMMLKSVGIMLAIAAFXDYKILQMEVKTAFLNXFRVQDLYMMQPDTFIYTKDANRVCRLHRSIYEPXTSSRCWCTRSDNV

SEQ ID NO: 143565 - protein, 45 aa, Triticum aestivum
  Clone ID: PAT_TA_37983.pep
GLPPQESIKRAFLFGVKIGADGEGTTSAILLSGHLLCHRWICHRL

SEQ ID NO: 143566 - protein, 135 aa, Triticum aestivum
  Clone ID: PAT_TA_37984.pep
SAHKGFSPIEKKFIRLLHDCNVGPSRMVQILSLIHDRDGSLSSMPYIPADVKNLKAKYRRESRLADIEDTIAYFEEKAKADNDFFYRIRLDDEDRVRNMYWVDGAARRAYKHFCDCISFNATYLTNMYKMPRAPF

SEQ ID NO: 143567 - protein, 106 aa, Triticum aestivum
  Clone ID: PAT_TA_37985.pep
TSPPHRTPIADLAIPLLIHTCCYSPGTADEPVNPRTPPRGKQLLSLPWLHVVPFLGLAVVHRPGALGVAWSTWSMNDIHRKWTVRGEADSWVHSRTQGNASLLRAK

SEQ ID NO: 143568 - protein, 94 aa, Triticum aestivum
  Clone ID: PAT_TA_37986.pep
SPVDGTTLLPRRTTGYAAVYTSMRHRTPIADLSISLLIHTCCYSPGTVVQPLSPRTPPHGKQLLGLHWIHVVRFLSLASSISLVISVWSVQHVQ

SEQ ID NO: 143569 - protein, 76 aa, Triticum aestivum
  Clone ID: PAT_TA_37987.pep
LQQRQQAPVDHHGHVGQVSRAQAALEREGAVDGDRVRARGENGGQRPTRPGYGFLRCCGGVWRACVERNELGRLYL

SEQ ID NO: 143570 - protein, 80 aa, Triticum aestivum
  Clone ID: PAT_TA_37988.pep
PRWGINGSQGLTFYSIPMHLRSLHSFCSVPSHLLKSVERQILRIWEQREAFTPYYLGTEGVSPYGGNRGSLKYEHVNGRD

SEQ ID NO: 143571 - protein, 118 aa, Triticum aestivum
  Clone ID: PAT_TA_37989.pep
VAHLRLALARPSLSTSSASSSPCALARFPFVCFLVEPSPSPSTVHARAPSSSSLLSPSPSRPRAALVSVSSRASPASPSLPSRHSRDPWPRVHIAGAIHVAVPRVTSSPPLELIPAAI

SEQ ID NO: 143572 - protein, 49 aa, Triticum aestivum
  Clone ID: PAT_TA_37990.pep
DFERCVEEDQGAHGPARMGKWAIMELLLPKIMTCYNIDMNECSRTHLTP

SEQ ID NO: 143573 - protein, 130 aa, Triticum aestivum
  unsure (1)..(130): unsure at all Xaa locations
  Clone ID: PAT_TA_37991.pep
GGPDRGGRRRRDRDRADERCARGSSRARARRSKRRGGAAYGRDGIEGKSGIEGEGGCGAGGKREGEIDRRSPLALGLEGRSAAGLPGVCWAGLDQGRFGPDWAADGPASSSLSLSLSLSLSLNFSFQXKR

SEQ ID NO: 143574 - protein, 91 aa, Triticum aestivum
  unsure (1)..(91): unsure at all Xaa locations
  Clone ID: PAT_TA_37992.pep
SRQQRRGSYGARLVNEKGERNGEAHRAAHTVALGGLVAAXASXELVKNGGDQRSGRRGTGAARPPSSSCGHRSTRKMMAEMTDTLARRGDG

SEQ ID NO: 143575 - protein, 141 aa, Triticum aestivum
  Clone ID: PAT_TA_37993.pep
QAMSSSAPKQLVAGPTTAEDAPPVQMPAAEAAGGDPAAAHAQQTNLVEQTAKQSDASEPPTKQSVGPEPTAHQSVGPQACDQHTNASALPAQQTNALARPPQHTDKLAPPSQKPDIASTHGQQSDAWLLQPSSLSQQHRQL

SEQ ID NO: 143576 - protein, 96 aa, Triticum aestivum
  Clone ID: PAT_TA_37994.pep
PTDSTWTIHKTILLVCLSHFEKIMQALNIDVRSPCIRCRFICMHYVLKYIKNHYRTSPILFSGFSNRGDANPAKKKKKNRGDAKKENRSRGKQKKE

SEQ ID NO: 143577 - protein, 142 aa, Triticum aestivum
  Clone ID: PAT_TA_37995.pep
DKELVVNGYVDASFDTDPDDSKSQTGYVFILNGGAVSWCGSKKSIMEGSTCEAEYLATSKAANEGVWMMEFISDLGVIPSASGPMKIFCDNTSAIALAKESRFHKRTKHIKRRFNSIRDQVKEGDKEICKIHTDLNVADPST

SEQ ID NO: 143578 - protein, 42 aa, Triticum aestivum
  Clone ID: PAT_TA_37996.pep
ASVTPTGSLYIKFWKFLRTPSPARNLLYLLWSPDHPLVACDL

SEQ ID NO: 143579 - protein, 46 aa, Triticum aestivum
  Clone ID: PAT_TA_37997.pep
KFITQATYRLHGKLSPAGRETGVDKVKYTHRCSLLLYSDFFSPVDP

SEQ ID NO: 143580 - protein, 131 aa, Triticum aestivum
  Clone ID: PAT_TA_37998.pep
LDGYRLTRVLMDGGSSPNLIYEDTVRKMGIDPSRISQSNTTFEGVISGVEAYSRGSFVLEVTFGSPGNSRSDELLFIIAPFQSDHHALLGRTAFARFNALPHYGYLTLKMPGPRGVITVSGITERSSRTEE

SEQ ID NO: 143581 - protein, 49 aa, Triticum aestivum
  Clone ID: PAT_TA_37999.pep
MMSKAGKKSSSSNSMYEAPLGYKIEDVRPAGGIKKFQSAAYSNCARKPS

SEQ ID NO: 143582 - protein, 63 aa, Triticum aestivum
  Clone ID: PAT_TA_38000.pep
TGWRYQPVLREILFIYLHNVYILILLNSRQLKNLNGNPKFNGKLILKPKPLNLLVPVGVTNRY

SEQ ID NO: 143583 - protein, 68 aa, Triticum aestivum
  Clone ID: PAT_TA_38001.pep
SLFLLFLLKKLYMWPITNCRPGAHHSTNGRPIFFSYMGQAQPTFLFFYAKFCLKKNCSCAAGRTALRV

SEQ ID NO: 143584 - protein, 91 aa, Triticum aestivum
  Clone ID: PAT_TA_38002.pep
ATATCRPCHRLIKWSIPNPSASTAIDLFKGPAANLPRHAVKDLQSLYAIDPILSFPKDAFYNGGLESSIIKSYLIDHDHEEGTHKASSKVK

SEQ ID NO: 143585 - protein, 80 aa, Triticum aestivum
  Clone ID: PAT_TA_38003.pep
ISTATTAALLQITDATSARSHQHINRRSRLEVTICRCTGPQIANEGSRTSPRMFKGPGDRGHDVYPSSGLHDGSKTLLPA

SEQ ID NO: 143586 - protein, 67 aa, Triticum aestivum
  Clone ID: PAT_TA_38004.pep
AYLVMLLAHLTHRTRSMRLHLSLPLAATALSSTPFAAFPSTRHHEMAATTAHETAAFNADHYSALHY

SEQ ID NO: 143587 - protein, 37 aa, Triticum aestivum
  Clone ID: PAT_TA_38005.pep
PPARRRRAWCIPRQKPVASAYSPQTECGPRIYLRDHE

SEQ ID NO: 143588 - protein, 86 aa, Triticum aestivum
  Clone ID: PAT_TA_38006.pep
GRPGFTGQSLGWCATFLCCWYSSCDVSDEIFERAIILHEITGSNEMDRYVFSCSFIRLDERIQNASTWLDSFIGTSYSRVPIFEHF

SEQ ID NO: 143589 - protein, 63 aa, Triticum aestivum
  Clone ID: PAT_TA_38007.pep
STGKERVMLPSLLPPVCRVVDRPPPSCTFSSTETNQSTPGSGVNPRPSLYWMWIGSRESSSLS

SEQ ID NO: 143590 - protein, 134 aa, Triticum aestivum
  Clone ID: PAT_TA_38008.pep
FDKLFIFELDKDLGISSMECIIDSMGELGGIPQSLSEEKAYMIRGYLVECGDRLLMVKRWIHPIARSTSDDFFEHNRTVALGVFEADLGTDPAGWRTVNDLDGHALFLGQHSSKSLRAGECSWIQEDCIYFMCD

SEQ ID NO: 143591 - protein, 130 aa, Triticum aestivum
  Clone ID: PAT_TA_38009.pep
LDKVVKPNVVFLKECGLDDCHIAKLCIPVPRMLATNPERVRAMVACAERLGVPRGTGMFRQALRAVAFLNEEKIAAKVNYLKSTFRWSDAEVSIAVRKYPILLEKSKESLKRRSEFLFYKVGVEPVYIAH

SEQ ID NO: 143592 - protein, 50 aa, Triticum aestivum
  Clone ID: PAT_TA_38010.pep
AYESHICHEMKLKPNTNQLSIQLVLYPPVLTGVFFRVLKKGVTSPGRILP

SEQ ID NO: 143593 - protein, 62 aa, Triticum aestivum
  Clone ID: PAT_TA_38011.pep
CYKATPGFVTLLGASMFLPLALVNPFSERVVVIRIEIVHCTCKFGRDVHCTCTFTSKIKLSY

SEQ ID NO: 143594 - protein, 69 aa, Triticum aestivum
  Clone ID: PAT_TA_38012.pep
PDHSFDVSGVYCIHRVIRRRRNSKSVQPQVILKWHCEPCGIVGFYAVALSWDNRSECLFHDIRVSFSVI

SEQ ID NO: 143595 - protein, 77 aa, Triticum aestivum
  Clone ID: PAT_TA_38013.pep
ALRRGKHRLSCAFWVDAQNLNAKERQFILPLVCGPLLCSPSLLLLPQQDHTKLIFSALISHTYLDSNFCCLQHDNLL

SEQ ID NO: 143596 - protein, 97 aa, Triticum aestivum
  Clone ID: PAT_TA_38014.pep
FSPFQPRCGFDAYTLGQYSLPSFPYSTQTWISLHEVGFPLIAQIKVFICVTSRAEDSKLGRWWSGKRSTCSDMADGAIEQGYGSKRGSIPESRREVA

SEQ ID NO: 143597 - protein, 70 aa, Triticum aestivum
  Clone ID: PAT_TA_38015.pep
LIIVHTLCRAHKIYLISLFYEYFYLFYPKKNKKLEQKRQSIKGRKKNLTFREKQRVNQILENSKIKNCFP

SEQ ID NO: 143598 - protein, 45 aa, Triticum aestivum
  Clone ID: PAT_TA_38016.pep
TVTRAMSSRACLLMLSRRMLLEAYHRPAWPGALSVRFSIFFAAFC

SEQ ID NO: 143599 - protein, 69 aa, Triticum aestivum
  Clone ID: PAT_TA_38017.pep
TCNMQHSHVHMHACTQYSCIHAAHSTRRNTHAHAQVLNLLPPSMKDYTYRDLHIDQEELKLHGIIITQK

SEQ ID NO: 143600 - protein, 36 aa, Triticum aestivum
  unsure (1)..(36): unsure at all Xaa locations
  Clone ID: PAT_TA_38018.pep
FWSGRFFFFFXFFFXFVYEAIQDCFNRGRKRLHLLT

SEQ ID NO: 143601 - protein, 94 aa, Triticum aestivum
  Clone ID: PAT_TA_38019.pep
RGHGDGTNWEVARELLQGAVAPPQQRVFAATEPSDVVASSYLAILQAANYMSFPLDYALELEEKLLARDAEIAALRKQLEETKGELATAKVPRR

SEQ ID NO: 143602 - protein, 116 aa, Triticum aestivum
  unsure (1)..(116): unsure at all Xaa locations
  Clone ID: PAT_TA_38020.pep
FFSQPQIMCCLCVPSLHDVNLSSATAASTCALLNLVEGGGGDWWCEADPPQGLLHAATLSRRSLLAFAQAGADGADTPLNQRRTAWRRRCVRSLRPLQATASGDEAXTYWESSCVQ

SEQ ID NO: 143603 - protein, 111 aa, Triticum aestivum
  unsure (1)..(111): unsure at all Xaa locations
  Clone ID: PAT_TA_38021.pep
AAKDGGDKNGNKNAKTSVETYKIYIFKVLTQVHPXDIGISSKAMSIMNSFINDIFEKLAGHAAKLVRYNKIPTITSPEIHTPSASFSPGELAKHAVSSGHSAVTNFTSSLK

SEQ ID NO: 143604 - protein, 66 aa, Triticum aestivum
  Clone ID: PAT_TA_38022.pep
VRCSYEQVMIPRNVRSKEELHHRLHCHHDQCLQQRWVQLLEYLQLHEPLWKQAHGLSFFVLDVLTL

SEQ ID NO: 143605 - protein, 131 aa, Triticum aestivum
  unsure (1)..(131): unsure at all Xaa locations
  Clone ID: PAT_TA_38023.pep
PSPIPTPSLRPPTSAAXEARSPSPFARSPPHHSFEPPPLAPVSKPPAPSSLSLAAPSPSIPSFPASPGRGARHHASAVLAPLLPSPHAPGDTPFSMCLSWPRSQTSMSRAQAPPPXPAAPPPGPSGRAPSH

SEQ ID NO: 143606 - protein, 155 aa, Triticum aestivum
  Clone ID: PAT_TA_38024.pep
IEFMFLLCILLDSIYSSTILVHMISLISIIAVMIYFVLIWIKSCSNVLIYSTGATSPTVTPVSWTTWSMPPRSPSSTSMSARCRLGARQQTSCITSGCMQRSLLALGRKHQVRDVLPVHHARVARGSLPPASLGGGRQRLPLDRGHRQGPRWPLP

SEQ ID NO: 143607 - protein, 143 aa, Triticum aestivum
  Clone ID: PAT_TA_38025.pep
SELISIGRPLTPIAQDASWADHPQEEEDSKAQPTQTPHASPALRRLHKGPRPQVSTSEAKTAEDIPATSADEEELPQAATPLSHQEAVLEENVIVSNPPARQVEVENLAAATTNTTEATGAVMAEANVEPSPTKAPKVSDATD

SEQ ID NO: 143608 - protein, 72 aa, Triticum aestivum
  Clone ID: PAT_TA_38026.pep
ALKLLPWPGTPFGFNGFPAESFMADIAVARVLQVKLSLITSEPIVMFWVVLAVQMEPAMLCRNSSNNELEQE

SEQ ID NO: 143609 - protein, 151 aa, Triticum aestivum
  Clone ID: PAT_TA_38027.pep
FRPAPGVPDNHDEHGLDLLSDSARDIAPAGTPNLNPDQIASPEDVWMDPAPQAAHSSAVEPNIGLTSKEAYDSSPPDSYPAIGSSPRAPEPAEPGWAPVTEFIAADIFQHSPLGDVLNSLKSLSLSGDSWPNYVRLEWEACDEGNSLPNPQ

SEQ ID NO: 143610 - protein, 61 aa, Triticum aestivum
  Clone ID: PAT_TA_38028.pep
IPPHLDVDMQITSPKLKLLQAQTGGITVAVGHKPIHGSSWRSLNSCRRTCLEGTRQGCSYH

SEQ ID NO: 143611 - protein, 93 aa, Triticum aestivum
  Clone ID: PAT_TA_38029.pep
VPITNSSPSHLHYLPFDSRFPLAHFTLAVLFALSFPIFFSLFRLLSSSSLLFAVMSKIGEIIVEMDNNDNMENSDAPAEEAPILHTINSNRSW

SEQ ID NO: 143612 - protein, 129 aa, Triticum aestivum
  Clone ID: PAT_TA_38030.pep
VSQDRELSHPGILGHSFEDWDGFSSMVDQMAFKVWKCHNCFSMAHITSSCTNQTRCRRCFRQSHRSKSCIGSTLAGGFRWVSRVIEGSATNHPDTPQPILPLDASSSLQPDVPACPLLRLVGELHVASS

SEQ ID NO: 143613 - protein, 92 aa, Triticum aestivum
  Clone ID: PAT_TA_38031.pep
RVATDGTWASPLPHAASVTARLDESLVHAEKTSLPPIVGVVSWPSPAIKGEGRGPRRPSLLLFCLLLLPYFNASSIGPVTEVFRRREGESPP

SEQ ID NO: 143614 - protein, 100 aa, Triticum aestivum
  Clone ID: PAT_TA_38032.pep
YYTAMFYFSHDSSCNIVSGVHPKGDPHHKHMMQLQYRFCVTRIIRCRCKHKASGTHKLQQPPSPVHNKQSNTKPHSLRGQGHRPCRGRSQSCPRQPRSGS

SEQ ID NO: 143615 - protein, 71 aa, Triticum aestivum
  unsure (1)..(71): unsure at all Xaa locations
  Clone ID: PAT_TA_38033.pep
PPKEIQWWFKDDFLNLMWIYTYIWIILFPIXSHLSYSYTECRSMIKQMQQRIELCLARSRAQYVGPFPIPN

SEQ ID NO: 143616 - protein, 90 aa, Triticum aestivum
  unsure (1)..(90): unsure at all Xaa locations
  Clone ID: PAT_TA_38034.pep
HNPQEVLNFLKKARFSANTTIYLTYTLWHKGLTNLKNALPNTYTIDDIMPAEKKCEFLNSGDSXYQGPFYLQICSHTNFFVPAIPGMFYR

SEQ ID NO: 143617 - protein, 50 aa, Triticum aestivum
  Clone ID: PAT_TA_38035.pep
WAIGWLRDRIPVVVSSFFVNVRHLPWCWGMKYFWESLRASDLVSYALGWQ

SEQ ID NO: 143618 - protein, 80 aa, Triticum aestivum
  Clone ID: PAT_TA_38036.pep
APRNQPKVAICLERGPGPPERQDRCHRRSHHEVTLKGFVGEDRLSSRLYVLLVPFQIWPLWDPFPPKFRRKRTKAIINIV

SEQ ID NO: 143619 - protein, 85 aa, Triticum aestivum
  Clone ID: PAT_TA_38037.pep
AAIRCSGYKLLPCCVGRIRTCLKFPDLISVVVDILSTCTWYICPGKYFWYKMIRMRQYVSGYKLWLSCAKARHCLLKARICCSWL

SEQ ID NO: 143620 - protein, 65 aa, Triticum aestivum
  Clone ID: PAT_TA_38038.pep
SLTDIAMSMLLFLLPSFLITRQKGRYVVTREETAEHKERAEAAHQHSKSILKIWLRIISTNANPS

SEQ ID NO: 143621 - protein, 44 aa, Triticum aestivum
  Clone ID: PAT_TA_38039.pep
THMVLTTQHRLKQTLLSKYAYRPITNKSTRVNYTTLSVCKINAS

SEQ ID NO: 143622 - protein, 72 aa, Triticum aestivum
  Clone ID: PAT_TA_38040.pep
GGTFGLGLKLDWKGSGFFGGKIGNGGNPRFGLVEWPLGANPRFDPGFWCWCLTFFLGWPQNVGWACNSRQMG

SEQ ID NO: 143623 - protein, 84 aa, Triticum aestivum
  Clone ID: PAT_TA_38041.pep
PHDIYLGLGKGVPQKPLTRRSWWVFPTSREPCHELSSQRARNTTTSFKFHQSSYGHFLKHLMSHLIKEINPDGHKIITYMQLTE

SEQ ID NO: 143624 - protein, 87 aa, Triticum aestivum
  Clone ID: PAT_TA_38042.pep
RSPPIQNPNWPWNSGAPSRCPSPLGASRPFQKNPTIQLIESINNHTVIASSTHLLKVPTNRIWTYDRLLFTFDLSGNQSGLCSTSNY

SEQ ID NO: 143625 - protein, 154 aa, Triticum aestivum
  Clone ID: PAT_TA_38043.pep
SRGHGEERRMQYQSHIRGLNAYDRHKKFMKDYVQFYGHEKNVDNSLPIKTDKDTLREGYRFILTEEDDMDSTWEKRLVKRYYDKLFKEYCIADMTQYKKSKIGLRWRTEKEVISGKGQFICGNRHCDEKHGLGSYEVNFSYVEAGEQKQALVKL

SEQ ID NO: 143626 - protein, 49 aa, Triticum aestivum
  Clone ID: PAT_TA_38044.pep
QTCRSLDHVCIICFYGEPMAYVNKCFDWHCNIFCLALFVNNDGKQKKTF

SEQ ID NO: 143627 - protein, 74 aa, Triticum aestivum
  Clone ID: PAT_TA_38045.pep
AIRACTTECLFEGLEFGTYTFTWNCTYLGHICRYSGVIRNIFGVHGVLKQFLFSRLALVTANASLGNYVSRHSI

SEQ ID NO: 143628 - protein, 109 aa, Triticum aestivum
  unsure (1)..(109): unsure at all Xaa locations
  Clone ID: PAT_TA_38046.pep
WMTMRKANXNNNQKAMGNQLLILHLYCWQNQRKELATKHRGLPSKKQTKRRRQRRRPKSRQSKSGDTGTGDNSTPDSAEDDNNPLQQDLEXEDGEASPPERAADGEAEA

SEQ ID NO: 143629 - protein, 59 aa, Triticum aestivum
  Clone ID: PAT_TA_38047.pep
LMSALGLFLGGVILRCLVAMTNSVISYIPFIQVGVQQCISTTPNSVASLPYVNIPWPLE

SEQ ID NO: 143630 - protein, 107 aa, Triticum aestivum
  Clone ID: PAT_TA_38048.pep
AVCMQSCLKLGRLSLKRVVLAMWEMLMLLIILMKNLLFYTLKSFGLVVAILLEKELFKISLLAPMLCPLWAGLFFIKLVVLQMLYLCSWLNLKDNLSTCILAYRGFF

SEQ ID NO: 143631 - protein, 76 aa, Triticum aestivum
  Clone ID: PAT_TA_38049.pep
IILLLDMLTDNLLILAWYEMSMPLNIYIKNLTHYTQKIYSLAIYLVLDKELFIISSHTTIMYPILADLIFIHEVLC

SEQ ID NO: 143632 - protein, 41 aa, Triticum aestivum
  Clone ID: PAT_TA_38050.pep
RLEGTIEPRVSVLRTIEDQNQTVDTQSAKPIVQLLIFCNSL

SEQ ID NO: 143633 - protein, 120 aa, Triticum aestivum
  Clone ID: PAT_TA_38051.pep
GACVSFQPDKQLEGPSSQIQPAEGGSAEAEDEYDFLKDGKKQAEGRLQRSLARVKSMTQYPEAREQYSRLQACVTELQESKAIQDKMLSDAAGGDGGDFMVDLEDLCADELLDTPMSTIL

SEQ ID NO: 143634 - protein, 61 aa, Triticum aestivum
  Clone ID: PAT_TA_38052.pep
ISLKGKLSLNPLGGPLFFFFFFFFFCFFFFFFFFFFFFFFFFFFFFFFFFFFFFFFFKDKP

SEQ ID NO: 143635 - protein, 121 aa, Triticum aestivum
  unsure (1)..(121): unsure at all Xaa locations
  Clone ID: PAT_TA_38053.pep
NEASVEGTVENGGEATLRHLASSCGGRTNTPVALAGSTPSRMAHHTRLICYPLGARPSTCMPTTSPDCCLGRICLLHRPEEILNELGGPRRDSRRGVHVHCHPHRRLLPLXHTMPHGPHRP

SEQ ID NO: 143636 - protein, 63 aa, Triticum aestivum
  Clone ID: PAT_TA_38054.pep
DSLPASKTRSANSYMAIAKQFTDKIYRLLLTTSRTRSTRLGSTKESKQNERTNPLTSHRACGS

SEQ ID NO: 143637 - protein, 90 aa, Triticum aestivum
  Clone ID: PAT_TA_38055.pep
SRGHGEISKLLAYLESLVGVQHVRAIHLHLSSCSAVRLPTLPPLPCTSFSSPNFQFDFLPNLLSNPVFTRISEITIASYLSKHMYHILSN

SEQ ID NO: 143638 - protein, 67 aa, Triticum aestivum
  Clone ID: PAT_TA_38056.pep
FHKYIKSFNFLMPTFAGARYIIPELFYNWHNFWTIFHIYINIFPMQIFIELIQMAKINVHELLKILF

SEQ ID NO: 143639 - protein, 60 aa, Triticum aestivum
  Clone ID: PAT_TA_38057.pep
FFHEMKLKPYTKSHSHQLVVVHSSHGQSYRQGCKKKRYIHRKDPSLNWKKSWLHGRLLRV

SEQ ID NO: 143640 - protein, 61 aa, Triticum aestivum
  Clone ID: PAT_TA_38058.pep
GPIVIAETNNLESLDQALVRSGRFDRHIQIHYPNVDGRQEILDAHMSKVLNTNDVDLLPRP

SEQ ID NO: 143641 - protein, 114 aa, Triticum aestivum
  unsure (1)..(114): unsure at all Xaa locations
  Clone ID: PAT_TA_38059.pep
MEILVKMAEVLVKIAVMMMAPDGVPAPPEVRVREPPFFFLFFLDLLPGWREPLQDWICLSVCLCFYALXDSALAPFLLYPEMCNSDWAETFAVIFLPKNXLSCGRRRASTALWV

SEQ ID NO: 143642 - protein, 101 aa, Triticum aestivum
  Clone ID: PAT_TA_38060.pep
GGGLSKSCKHTPCLLSLTFSTVLFNYLSHSGYLARTSSVHRYTVIGYTLSYRTLIICSALHQVDLPMIAFRKRVLEILPCTFQRVIQTIHTHHWHTTDIII

SEQ ID NO: 143643 - protein, 57 aa, Triticum aestivum
  Clone ID: PAT_TA_38061.pep
ILKNVQYLGWDQNPYHKLSNIYEEHFGAMNEIFRVFSLLLIKFFLGFQNSSVQVSTI

SEQ ID NO: 143644 - protein, 57 aa, Triticum aestivum
  Clone ID: PAT_TA_38062.pep
KCNHALNHILMLMTTCMLGLIMFIKYISRLCLKGRVWIMTTDIKHIYTYITREQRPR

SEQ ID NO: 143645 - protein, 64 aa, Triticum aestivum
  Clone ID: PAT_TA_38063.pep
MAGQVQNVLNRFEEAMEKIDGMEKTFETQLNNKFNELLVRLPPPPPAGPNAPLLLQQQQQRQQR

SEQ ID NO: 143646 - protein, 117 aa, Triticum aestivum
  Clone ID: PAT_TA_38064.pep
GVATHSSSLGSSSWSSADAAGISSASLVSDSEMFAVGEASGKTSRETDWRSSPCRTLDKSDLWPWSFAKPAKRWRRLWRWSWLGLKVFIVNHRSGDLGRGSNWCFFIMRGFLRVISP

SEQ ID NO: 143647 - protein, 127 aa, Triticum aestivum
  unsure (1)..(127): unsure at all Xaa locations
  Clone ID: PAT_TA_38065.pep
DIGMNMSHRQLLDCVAKGNFIEIDPSIVHEVIEGIXGTLPQXKGPHHTQEQTQVFEKICEVTKILQKSLEPLKGVSGNLHRMNMLITLCNKRLDALDLKISEYEGKRKEPPGFEHDSAKKLKTEDGN

SEQ ID NO: 143648 - protein, 79 aa, Triticum aestivum
  Clone ID: PAT_TA_38066.pep
SRPCRMMGSLIDLALWSSNESLHDVMLSMHLIDMASVGQVCYIPIDDVYDMGSCEDCLNCDLCIQYADVYMSCVNTWEL

SEQ ID NO: 143649 - protein, 129 aa, Triticum aestivum
  unsure (1)..(129): unsure at all Xaa locations
  Clone ID: PAT_TA_38067.pep
KADNRLPAGKSAAKEVGDTMGNINAKKSVETYIIYSIKVLKQVHPDIGISSSAMSIMNSFINDIFHNLAGXAAKLARYNKNPTITSREIQTSVRLVLTGELAKHAVSDGTNAVTKFTSSYSAPAPVSPS

SEQ ID NO: 143650 - protein, 115 aa, Triticum aestivum
  Clone ID: PAT_TA_38068.pep
PLAASLAEHASLLHSNASMKPAHVEADKPTLDTRPFVIGPALNATSAELLPYVIYLISYLNDAKCRPRITHLHRSPISSFTIFFHSYNGLLRVVIPHPSWLGGPPSPPDMRYATH

SEQ ID NO: 143651 - protein, 65 aa, Triticum aestivum
  Clone ID: PAT_TA_38069.pep
LTHILHEHSQQLTSIVAIATFHNIHRRHHFITQASIPNQSNLTTISCPTSPSSPVQIESSGRLRL

SEQ ID NO: 143652 - protein, 51 aa, Triticum aestivum
  Clone ID: PAT_TA_38070.pep
YPLVSNWTPLPREGRTKHVMQVLSISTYDYLRNRCLHYICELELVPYRPRL

SEQ ID NO: 143653 - protein, 90 aa, Triticum aestivum
  Clone ID: PAT_TA_38071.pep
GIRASSPYARGIQQPEEGRHRCRRPGYYHAIIPGDSLVCAPRPPSADDLHSGTCRHHVDDESSSTSAQLQVHAIEAVTHHVTDLQTQEVS

SEQ ID NO: 143654 - protein, 61 aa, Triticum aestivum
  Clone ID: PAT_TA_38072.pep
TSAVESYVSVNIKYCCIKEHYHLLVIVKKYDSSVYGLQAYGIDLQYRPRAFSYIHPLSMLS

SEQ ID NO: 143655 - protein, 103 aa, Triticum aestivum
  Clone ID: PAT_TA_38073.pep
SIVINFESCVSLSKGVYNKYDCGKQKAKTQIIQDAPSIPKLKILVVLEFYLGVPWASPSLGSCHSLFHNPSNLYPKLENFTTQNSIENLMSSVNEIKPTTNLR

SEQ ID NO: 143656 - protein, 89 aa, Triticum aestivum
  Clone ID: PAT_TA_38074.pep
GASPSTETQALTMAEPSSARRKSGWNSLPTEVIKLIVSRVDNLSTMPLAVCSSGLYRLLKAIRPELFKPAPCLLMPRDLQKRHVTHQPP

SEQ ID NO: 143657 - protein, 103 aa, Triticum aestivum
  Clone ID: PAT_TA_38075.pep
AVLSTCLHLCPWYFECVVVYAWHKCHLNGAGEEAGLLIELLSSLTIMLQGAPDSLDGVRGYHCQIGCLSKKSALYFCHEGCSVLFHTEGAVCVSIDCYNAVDP

SEQ ID NO: 143658 - protein, 74 aa, Triticum aestivum
  Clone ID: PAT_TA_38076.pep
GNLIIRPDFETPRMMISTLERGCLTWFASTVRLLSMGSSEDRVMRSSSYSNCDSTGSDNWVLLVRHWCHVGRCW

SEQ ID NO: 143659 - protein, 105 aa, Triticum aestivum
  Clone ID: PAT_TA_38077.pep
LVIYASMCFLPPRFWIHAEQNSNMSDRLNDTTLHPTILTESFENGESVSRLVDGIEGKCSEHMHYRRCFLYAWFFIVFLFFNLPLSCCLIGTVFAQVSLACCSFF

SEQ ID NO: 143660 - protein, 88 aa, Triticum aestivum
  Clone ID: PAT_TA_38078.pep
ARIIAVSLRMIIVVIVLAILTREVLSRIGMIIISITSFIILIIIIVIIVIRPCISVLRNSLGFDSGKMLDNFLVVFSDDICCTVYRVN

SEQ ID NO: 143661 - protein, 143 aa, Triticum aestivum
  Clone ID: PAT_TA_38079.pep
GVERTLNSRLQEAEAKAAASEEKERSISERLSQNLSRITVLETQITILRTEQTQLSRSLEKERQRASESRQEYLAIKEEAALQEGRAKQLEEEIKELRARHKKELQDAAEHRGLLETDLEREKAARAELEKTSSRDLPKIPFP

SEQ ID NO: 143662 - protein, 100 aa, Triticum aestivum
  Clone ID: PAT_TA_38080.pep
SNGSSTSQLRAASRRPTLYSVPSSLSSGFSGAKYHCSSPIPLSLPLLRAYNERSSEIMKLGAEIRTLLARMRSQLENRVIAVVYFSSLVRRMLACQILHA

SEQ ID NO: 143663 - protein, 46 aa, Triticum aestivum
  Clone ID: PAT_TA_38081.pep
KTHEDGCNSRRGRSSKRHRRKHTTSLVVGFFFIFISLLYYFVLVPC

SEQ ID NO: 143664 - protein, 96 aa, Triticum aestivum
  Clone ID: PAT_TA_38082.pep
GGEGIEDTGNRASPRACQSGRKDSRGPMVSTCTPSTAAGARCHEEGDVRRGAHQRVVWKIHDDIWISGTVIWRQGISDDGESKMAADGQIRRRWLW

SEQ ID NO: 143665 - protein, 135 aa, Triticum aestivum
  unsure (1)..(135): unsure at all Xaa locations
  Clone ID: PAT_TA_38083.pep
MFFHIVLARYMQLNPRHFGPHLGDXIFSKLTCDIXGSCIGRDGFIVAIIGVDDIINGLIREXTGFITFLVMXNTSSSSSSHSDIIDAILTMDNNMGFFAYAGPVQIFVSDHLIPDDMEFQSDDVPHYRTSDASVI

SEQ ID NO: 143666 - protein, 92 aa, Triticum aestivum
  Clone ID: PAT_TA_38084.pep
NPMAKRKCYSYIVRLPSSTCDHLLNGPRRWIKCDYAYFFANTPALYAWGLKPTTPNFWITHIHRNSRAGDTIILSRKKYKYSPVIKITLFLQ

SEQ ID NO: 143667 - protein, 77 aa, Triticum aestivum
  unsure (1)..(77): unsure at all Xaa locations
  Clone ID: PAT_TA_38085.pep
GTTETAAXQSQRPNQWRPKFAGHQRAPPVRNENASSVLKFAGRVVRRFIPQRSCCRSPISGSGRNTQLNKYVISSSG

SEQ ID NO: 143668 - protein, 49 aa, Triticum aestivum
  Clone ID: PAT_TA_38086.pep
SILFIHQFEFFKFLFQFTYDMSQLSALVLNKVVLVRLIHLTHFVDLWLS

SEQ ID NO: 143669 - protein, 45 aa, Triticum aestivum
  Clone ID: PAT_TA_38087.pep
DIITVHLFPCWWYIAYCDFLETEAVLPGTNSLKRGFPKFSENPFL

SEQ ID NO: 143670 - protein, 89 aa, Triticum aestivum
  Clone ID: PAT_TA_38088.pep
VAGKCSRIGMRVGVWSGYGVGRPPAKFHRNRSSFDAPTINYSDIIVGLTSGVFGLRKQMPGPLSLFSPSQSRHSPPSPSSFPSSFPELS

SEQ ID NO: 143671 - protein, 75 aa, Triticum aestivum
  Clone ID: PAT_TA_38089.pep
VDNMCKIVHIYLQIQQLEGCPTKSPDNTREHKVQRSRVDLPFIKRKPCQTLITFIDVTCLLFFKKKSEHVFEESN

SEQ ID NO: 143672 - protein, 141 aa, Triticum aestivum
  Clone ID: PAT_TA_38090.pep
GTRKNPSRSLEPSAAAATSALSFLLRSKMMFIAAYLLAYLSGNASPSAEDLTSILESVGCEIDNENMELMLSQVKGKDITELLAAGREKFAAVPSGGGGVAVSADAPAAGGAAAPAADSKKEENVVEKDQSDDDMGFSPFD

SEQ ID NO: 143673 - protein, 110 aa, Triticum aestivum
  Clone ID: PAT_TA_38091.pep
STRTSTVCVQAKGAYCRAPGVMLSSHCQRKRRRRRTCGVLELELEIFTSCNLNYLLILSLPLSRVNLGLLSCCILAIGKYLYSKAGFLPQSINTHTAPLRRSRNASIDPI

SEQ ID NO: 143674 - protein, 91 aa, Triticum aestivum
  unsure (1)..(91): unsure at all Xaa locations
  Clone ID: PAT_TA_38092.pep
SINHEHLGTKPSNWIVLLTRFSIFNFTQYMSVSHRYSTMGGTKYGRKDQXEKEESLALIGRINGLWRCQSININERSTDFHATNALRAISV

SEQ ID NO: 143675 - protein, 54 aa, Triticum aestivum
  Clone ID: PAT_TA_38093.pep
VFHAKSIKQEQLGYKPSIWIILLTLMSIFKFNQYISVIHRYFTMGITNYGLKDH

SEQ ID NO: 143676 - protein, 34 aa, Triticum aestivum
  Clone ID: PAT_TA_38094.pep
LAVALPEHYLLSKSSDKSLFGIRKSYFLTRSYFV

SEQ ID NO: 143677 - protein, 74 aa, Triticum aestivum
  Clone ID: PAT_TA_38095.pep
VSRLLILINTIFFCEWQVVTSLFEMYSIRPYQAYSFRCWFSNNSVIVFVVSVLSQDRVPLRSFHSILTLLAAVP

SEQ ID NO: 143678 - protein, 83 aa, Triticum aestivum
  Clone ID: PAT_TA_38096.pep
QHNGVVVMEERGNPAGLRQAPRERRRTWERGRAVPELWCGCPPTPPLIIGGREGDRPLRSHLGLGRRPKGGGVPPKSSGGPPL

SEQ ID NO: 143679 - protein, 99 aa, Triticum aestivum
  Clone ID: PAT_TA_38097.pep
FEPPLWCNTLLHCVGGGLPLGLMMNITRAERPPEVKAFLCLVSLCVRWSLSSSDQSSHSLFLSPFSLWWLVLFIEALVLFRNIEREGSQQWRANLKGGS

SEQ ID NO: 143680 - protein, 141 aa, Triticum aestivum
  unsure (1)..(141): unsure at all Xaa locations
  Clone ID: PAT_TA_38098.pep
GTRRDPSRSLEPSAAAATSALSFLLDSKINFIAAYLLAYLSGNASPSAEDLTSILESVGCEIDNEKMELMLXQVKGKDITELLAAGREKFAAVPSGGGGVAVSAAAPAAGGAAAPAAESKKEEKVVEKEESDDDMGFSLFD

SEQ ID NO: 143681 - protein, 61 aa, Triticum aestivum
  Clone ID: PAT_TA_38099.pep
RGDCQHHRSLQQQGVPRLGRPAAWAPVAQDVEQQQEMRPSLSRMLRLPPVLSTLEERTLSF

SEQ ID NO: 143682 - protein, 148 aa, Triticum aestivum
  unsure (1)..(148): unsure at all Xaa locations
  Clone ID: PAT_TA_38100.pep
CSAKLGVPMELVXGFRNQISTPRCPMEPLPGGNRCYLQSSPTGSKLQCIVQRSNGALTGGSRCCVAALDEPRSCDARLNVSATVKLSTAVLEAVMQRPVVAQVLRGSACRRQPLQGASMEPSLVAPGAALQRLTSLGAANASSMLVLQ

SEQ ID NO: 143683 - protein, 62 aa, Triticum aestivum
  Clone ID: PAT_TA_38101.pep
CWFLPPVLKLYPDQISDSFPCPVLYFSLSDFDVGSSTVYVREKNWCFVSETMYVTHVKQAGT

SEQ ID NO: 143684 - protein, 96 aa, Triticum aestivum
  Clone ID: PAT_TA_38102.pep
HFLWNMYLKCTSFCISTYSQKLKEKKSEQKKQMSCTAKLLKNHLVGKHVVAASSAPLHQRSSRVLPPGVSCPPVSATSGCAVKKVVILKSPDVPHH

SEQ ID NO: 143685 - protein, 75 aa, Triticum aestivum
  Clone ID: PAT_TA_38103.pep
IGGTGNTNNLSLMEHGQIMRDSMHQYGLQTGLGRSFGPLINVPANAGRILPRPGPRLAARFGGTGSPHAAATPVA

SEQ ID NO: 143686 - protein, 65 aa, Triticum aestivum
  Clone ID: PAT_TA_38104.pep
IQSELPNWNSLVIWAMLCSSCYFRQTSFSQVQTVTCESANIHEQGTGMSGRRLHVVDVDAAHLPT

SEQ ID NO: 143687 - protein, 57 aa, Triticum aestivum
  Clone ID: PAT_TA_38105.pep
PEAQPILLFYCLFQYFEEEEYQTESKRNETFGIVIFWENIILETWSSRQKTLEEAKR

SEQ ID NO: 143688 - protein, 63 aa, Triticum aestivum
  unsure (1)..(63): unsure at all Xaa locations
  Clone ID: PAT_TA_38106.pep
LIVKRQPVLPLLLKKRDSXGRYLFTKWTWVATCMAPHPMITXWKMVAPPVLMPLTRSPHVXHA

SEQ ID NO: 143689 - protein, 144 aa, Triticum aestivum
  unsure (1)..(144): unsure at all Xaa locations
  Clone ID: PAT_TA_38107.pep
NEYEKDGFILDDADKNKEEEEKEAKPIDDKRPRKKKKRKKKKKTEDFNLDKDDYMLLKDNNITGITRPKPPENKFKRLKKARRESEMDGRSGFSDHDGARKSRTAEETVRSSLFGNEEPFEEDFVEEDQXVDEDEVGEDDMDDE

SEQ ID NO: 143690 - protein, 103 aa, Triticum aestivum
  unsure (1)..(103): unsure at all Xaa locations
  Clone ID: PAT_TA_38108.pep
IIGLINYSYFTVKMFKGVIASSYNESHNFFIDPINPLLLSCFLPQXNGLYSXGGYLGGRCAGHGGFGGRGRFHRRRAPKGRGPPKGERRCFRRRDRFNDVHLS

SEQ ID NO: 143691 - protein, 78 aa, Triticum aestivum
  Clone ID: PAT_TA_38109.pep
SGRLEQGGATAWRLMSYGICTLAPAGCRGRMSRSGHTRRWLLLLAESRLPLQMTTSLFCALCLHSCATVSNFPFGHTS

SEQ ID NO: 143692 - protein, 67 aa, Triticum aestivum
  Clone ID: PAT_TA_38110.pep
LLFDLAEKNRKYALTRINFVFLPESDKLPIPTEVDQYTNYLSPPKFLEILELHKYSKPADCYKLFCF

SEQ ID NO: 143693 - protein, 81 aa, Triticum aestivum
  Clone ID: PAT_TA_38111.pep
CGRTDQHYKSIPPISAIYRTTDVSHRNIGQRGERNVKHEMMRIQHSVIQVARYSQTRWILFGASEVCSCNSLYINACRFIS

SEQ ID NO: 143694 - protein, 55 aa, Triticum aestivum
  Clone ID: PAT_TA_38112.pep
GKMQLGGPSMRMIELLEELRKQSSMEIHMHELRGALGTLMTEGAVVIHGDNVRRV

SEQ ID NO: 143695 - protein, 49 aa, Triticum aestivum
  Clone ID: PAT_TA_38113.pep
TWASIVKSELGTSKRSGTADRGHTSHLRKAWNRMLNNHPNDREPAVTTL

SEQ ID NO: 143696 - protein, 63 aa, Triticum aestivum
  Clone ID: PAT_TA_38114.pep
VRAPLLNRLWTQSNTNNIVNLKQYIGHAPITDVLSHAFYHETLSDLGYEKLATDHISNSKGII

SEQ ID NO: 143697 - protein, 44 aa, Triticum aestivum
  Clone ID: PAT_TA_38115.pep
SSERMRYTVGFTAGGMPSGTNGFGRLVWSSDHHVVASPIAATST

SEQ ID NO: 143698 - protein, 55 aa, Triticum aestivum
  Clone ID: PAT_TA_38116.pep
VAMVVTGAGKAAAVQKALSDKQTSSDLLPVEMAVLQDGEFTWFTDKAAVSLLQNK

SEQ ID NO: 143699 - protein, 51 aa, Triticum aestivum
  Clone ID: PAT_TA_38117.pep
TCRLLLPPAGVAYRLHRNDASRSKREIAATPRRIHNVTSGRHTLRNSSYWA

SEQ ID NO: 143700 - protein, 44 aa, Triticum aestivum
  Clone ID: PAT_TA_38118.pep
LKVHDVGHMVPMDQPKAALEMLKRWSSGNLSEPSSSSQRLDFTM

SEQ ID NO: 143701 - protein, 72 aa, Triticum aestivum
  Clone ID: PAT_TA_38119.pep
RRIHRSSGFPSIYRSTDQANLLSPASVRRAHSRAERATPAHRAIALSLAIASRCAREPARMDPAMRERFSTR

SEQ ID NO: 143702 - protein, 62 aa, Triticum aestivum
  Clone ID: PAT_TA_38120.pep
MLGVSTDCRLNIPIQQRSSADEAKKLQTKLPHSRDGTTLARKLLREDGTNLLHLESPSRKPG

SEQ ID NO: 143703 - protein, 124 aa, Triticum aestivum
  Clone ID: PAT_TA_38121.pep
PHEYFFLSFGKDSDLSLYIGSIEQGAKPIVVTPNHPSTTGGRKLHAPLMRSLDQRVSGQGQTEEKMASGPRQRRTPPPENKCSTARARRRFERCGFISTSCLAACFTERSTNPGRPAASERSSS

SEQ ID NO: 143704 - protein, 65 aa, Triticum aestivum
  Clone ID: PAT_TA_38122.pep
LFGYQQPVSLELTEAAMVLCAERLSGLVNDAYTDVHRRSVQALKVRLAELAQSLGMLAGLGDALK

SEQ ID NO: 143705 - protein, 93 aa, Triticum aestivum
  Clone ID: PAT_TA_38123.pep
HIADLQSGKGLQHLCKLNCRYFLKFQPTTKELMELCLAVCTSLQIETIKTGFQRQNSFPSLPTSYICSLEKELPYRPVTHLSQEVATKDTFLF

SEQ ID NO: 143706 - protein, 65 aa, Triticum aestivum
  Clone ID: PAT_TA_38124.pep
ACIIFIRGFFLFFSLLSLRRDHQRTEPTFWVFLLLFILFLFPGSDVTFWVVCKCSDEPAVCLCSQ

SEQ ID NO: 143707 - protein, 72 aa, Triticum aestivum
  Clone ID: PAT_TA_38125.pep
VGACRIPNVAGVASTWNNQNYFSIFSIFLALHVRQALGFVVRFEGLSMCAVLLFTFVHPCLVYPQDCFLLVL

SEQ ID NO: 143708 - protein, 49 aa, Triticum aestivum
  Clone ID: PAT_TA_38126.pep
AVEETVMPVYASLIAKLKSSPETGRDLYIKYTPEDVVAHIQHLFEGAAK

SEQ ID NO: 143709 - protein, 128 aa, Triticum aestivum
  Clone ID: PAT_TA_38127.pep
SSTFFCSVFFLFLFFFLAHLNNKVHVEEPGNMKTTCCFQFVCAINSQKSRLAVGILMIIGKAKKHSNPIQQLASTYAKQHNNFTGLTSPQTNTKLVAKASYLLLIPEQALTPKKIRIYATKMLSPRVG

SEQ ID NO: 143710 - protein, 141 aa, Triticum aestivum
  Clone ID: PAT_TA_38128.pep
YCPASSILFCLFFFFFFFFFLAHRNKNVHVEEATKTTTSCCFQFVCAINSQESRLAVGNLISIGKAKKHSNPIHQLASNYAKQQNNFTGLSPSQTNTKLVAKASYFVLMPEQAISPNKIGMYATKMLSPLVGELGSKRIAP

SEQ ID NO: 143711 - protein, 65 aa, Triticum aestivum
  Clone ID: PAT_TA_38129.pep
VVKQKNLVMALRLSDFVFGSDACKKDSQCFCCSCDPVRTHMREIFSLLMANLVLCSCLCLSDQAL

SEQ ID NO: 143712 - protein, 70 aa, Triticum aestivum
  Clone ID: PAT_TA_38130.pep
PNPNLRYISTITGGAHKRSCSPNCQVSCRHRGKPDLALTVRDYCWHILGTCMLACDSLDPDLGFCASCTM

SEQ ID NO: 143713 - protein, 60 aa, Triticum aestivum
  Clone ID: PAT_TA_38131.pep
VANIRIRMGLNACCGPKPKYTSFSHMSSRSSRINMPVKLYSRQNYGISQTKEGQNVTAQD

SEQ ID NO: 143714 - protein, 68 aa, Triticum aestivum
  Clone ID: PAT_TA_38132.pep
CRLSVAASTLEYYFCLAPELVIKNFMYTSSIPLLTFVLALSYYQLSPSYQYLVLTIHGDLHLSSYMMQ

SEQ ID NO: 143715 - protein, 93 aa, Triticum aestivum
  Clone ID: PAT_TA_38133.pep
HPPVVHILRLVGQSVDLCWDSSPVIRSDETLHGDTVLGISQPDPSRRMNWKAFVWLGHEGHLFHYSHFSKSMLFAKMTFTSVDTITDKKTIKT

SEQ ID NO: 143716 - protein, 63 aa, Triticum aestivum
  unsure (1)..(63): unsure at all Xaa locations
  Clone ID: PAT_TA_38134.pep
RGKLHAYDQHLNMILGDVEXVVTTVEIDDETYEEIVRTTKRTIPFLFVRGDGVILVSPPLRTA

SEQ ID NO: 143717 - protein, 85 aa, Triticum aestivum
  Clone ID: PAT_TA_38135.pep
DEVVAKSLDLLVGPITFSIPVAFEAVHAIEKFINTGAIEQDLMNCNAVKSNRHFIYMGYPSCASHMICVISRVLKFESIVSSGWC

SEQ ID NO: 143718 - protein, 60 aa, Triticum aestivum
  Clone ID: PAT_TA_38136.pep
SSILFCLVELSKTNLCFSFCILNDKQRSVFFLVFIDRCYSSFHAQVRFVVVVVRNGHFTY

SEQ ID NO: 143719 - protein, 78 aa, Triticum aestivum
  Clone ID: PAT_TA_38137.pep
SHTYGTTTGPHYYSQRTHSRPDTLLLGLSFLFNLGCSSTPSSLPVSGAGSLVLASLCVLTESDNVILIPNKTTIEMLN

SEQ ID NO: 143720 - protein, 96 aa, Triticum aestivum
  Clone ID: PAT_TA_38138.pep
PTSIFSCLFFLSIEQQNNQLEIQTVDFHRSLNIVLIILTNSLRNTVQKSHAYHTSNVLNIDEAAGQPTTISEFNVTTGKGKIICAMKPSCAHQHWL

SEQ ID NO: 143721 - protein, 62 aa, Triticum aestivum
  Clone ID: PAT_TA_38139.pep
QPQASGPPPPPPPSSSSYHDPVILQFGKVGRDMFTMDYRYPLSAFQAFAICLTSFDTKLACE

SEQ ID NO: 143722 - protein, 59 aa, Triticum aestivum
  Clone ID: PAT_TA_38140.pep
FKPLWAKNCPRFGLAHALCLGLAPWLAAEVPILVDSGMVKHKDDEAAPAEASASAAPPS

SEQ ID NO: 143723 - protein, 141 aa, Triticum aestivum
  Clone ID: PAT_TA_38141.pep
PHEYFFLSFFFFIFFFFRLDVYVHLHRKKKVCTISRDVAKFINHSAKNWFVQTSLMMDTSLKESVLTQDPRPIHRQPFQRQQPLCQQGHLRHHQVRPPLHPYDWEQLARQCLCLGQQHYSILDHLEIWLWLLLCHQSFHKC

SEQ ID NO: 143724 - protein, 81 aa, Triticum aestivum
  Clone ID: PAT_TA_38142.pep
QDHQVLNSVGDQGKGIGEPAVSNHMDEEAGEPVDEEDVPDDKEVVDAEMVDDVVAGDPDLEQSPSEYDPASETFSQIQFPG

SEQ ID NO: 143725 - protein, 72 aa, Triticum aestivum
  Clone ID: PAT_TA_38143.pep
ASSREHQCHFHAMTTSQKRNLAVAHPRGLHNAITDQEMMMSCWMIFMGSMSTMSCRCGLAVNPQWAACEGLV

SEQ ID NO: 143726 - protein, 93 aa, Triticum aestivum
  Clone ID: PAT_TA_38144.pep
YHLTLFVRADNQFGNSPFSIQWGCLGVVVFGLPTFTFVFFFTYCTRESWNWDFADISGSIFAGGVCGNRYIVVVYSLLILFALQKKKKKKRQN

SEQ ID NO: 143727 - protein, 125 aa, Triticum aestivum
  Clone ID: PAT_TA_38145.pep
GDDIPEHELPYPFTQAKSSVAQSTPRVVTEVVFAAPSPSLAEQPAVALSHMSQSFKRRFSQRSSTYSATASTTGLPPKAESTAPSPLGRELMLSSTSGGIDHESQVQEKSSKDVALRFGVTEGTP

SEQ ID NO: 143728 - protein, 50 aa, Triticum aestivum
  Clone ID: PAT_TA_38146.pep
HVNLNFNAFLEKTKLKDDGSNYTDWVRNLRIILIGFMQAYIRPTGHYPST

SEQ ID NO: 143729 - protein, 133 aa, Triticum aestivum
  Clone ID: PAT_TA_38147.pep
SQSRVDSDHKKYALQKSLRPPDGILEDLFTEPDLEFSRFSFVFSSMTPDDPQSMGLLRITLENPHLEGDQKDQEPAAEKEAHQKAFHLYAAISREQANQLQLAGDDDRGRLELLCKDLTVKLMGYDSTCDTGN

SEQ ID NO: 143730 - protein, 75 aa, Triticum aestivum
  Clone ID: PAT_TA_38148.pep
RCKGEGADEEDEDEDEDDEEDDSDDEEDEDSEDEGDEDEDEDSDEEGYDDDDEDEDEDSDEDHDHEEDEDDEDDD

SEQ ID NO: 143731 - protein, 92 aa, Triticum aestivum
  Clone ID: PAT_TA_38149.pep
MIKDLDEEEEQDASPAKSQKLMGDAIRPWAAPSKPKSAPKVAVQAPKRSTRNIAPAEKNKAPVPEVEEEEEGQVLRKLKPKIPDHDDTHPVA

SEQ ID NO: 143732 - protein, 71 aa, Triticum aestivum
  Clone ID: PAT_TA_38150.pep
NPTTTLSRKKLTDLNINNFFIDQLTKYFYNLFTEIKLQNTSTNYLQRKRARGVGSGSRWRERRRHGAPPWT

SEQ ID NO: 143733 - protein, 60 aa, Triticum aestivum
  Clone ID: PAT_TA_38151.pep
RSTGTTKSRMGWKWSLRRSHLVEDEMNMQRIMCRLGRHDMIRLHKLLYTKNLIPRLRDKT

SEQ ID NO: 143734 - protein, 80 aa, Triticum aestivum
  Clone ID: PAT_TA_38152.pep
ARSKIRAIKEELNQVADIVSGKPFLLRTKFGDPKYAHLDRLWSSANAYVDLAASAADAAEYFKDRKDHEVEKWRLVISRT

SEQ ID NO: 143735 - protein, 76 aa, Triticum aestivum
  Clone ID: PAT_TA_38153.pep
TRSLQKYAISNTLAAPTPLHTWLLTYDTNVIIHPSTLIQICYLFCGCYFLLRFRDLLRNSVQLGFVSSIWGWIIID

SEQ ID NO: 143736 - protein, 87 aa, Triticum aestivum
  Clone ID: PAT_TA_38154.pep
ISKLSCVNAEAILVTGGMKKVACIKVGLHPRKRNMMAHRPVMVDRPKFSEIRCLSHKSIQVFQPCEDAQHHRILTREIDTNVHALLT

SEQ ID NO: 143737 - protein, 79 aa, Triticum aestivum
  Clone ID: PAT_TA_38155.pep
IYGVGKPDNMHIDQGAKQVHTTQQVVNQTPHSKHSIQTDRKQIKPLGQIIGLQQHALGKHQEAGSSTHRPRHLPHPRGP

SEQ ID NO: 143738 - protein, 65 aa, Triticum aestivum
  Clone ID: PAT_TA_38156.pep
TLIDGSGDTYVWMVDDMLMQCVILTQIYDWVTDHDVPPSPFSSWLLPPPPAPVPPCSSPSFFDRA

SEQ ID NO: 143739 - protein, 65 aa, Triticum aestivum
  Clone ID: PAT_TA_38157.pep
LGHLGNPVMPVPVEILEYCVILIWTATQAQTDHKIVHARNFREHPQAIMGSSIVEYILRPLLEVG

SEQ ID NO: 143740 - protein, 98 aa, Triticum aestivum
  Clone ID: PAT_TA_38158.pep
HFPAASVLGNNQANLCPVSFTMGRSKGTMEESDIQDLLAMRSEVLDNQKETESLRSDMTVLQTEVRTIGQKQDLMSVAVEDVQKSDVVRRCLCRGYPH

SEQ ID NO: 143741 - protein, 109 aa, Triticum aestivum
  Clone ID: PAT_TA_38159.pep
LFHMSPPYLPIYGIYLPFQVNLYVPNSKPSNKHSVSYARTAHVSTRVVCIFHARRVILKRSGLRSSLTRKWLVTGMPSPMLKSNQNNCKKTPLGLLLVGGTRCFGQAMD

SEQ ID NO: 143742 - protein, 86 aa, Triticum aestivum
  unsure (1)..(86): unsure at all Xaa locations
  Clone ID: PAT_TA_38160.pep
MMQIICFRMIGRLVARVALQSDDVELVAVNDPFITTXXMTYMFTYDTVHSHWKQTDIFLTEDMILHFGERQITVFSIMNPEEITSR

SEQ ID NO: 143743 - protein, 77 aa, Triticum aestivum
  unsure (1)..(77): unsure at all Xaa locations
  Clone ID: PAT_TA_38161.pep
FETGASHSFMSEDFAIMHGIKSDDMYAYILVHTRVGQCRTSLSXHDVSVESGGLDFRVSPIVVKSWSIYLMMGMDCI

SEQ ID NO: 143744 - protein, 115 aa, Triticum aestivum
  Clone ID: PAT_TA_38162.pep
FTPVMSKLATPKPASAIRSDMSHVIDDATSAMHDTYDETTSMLDTTVPISEFFDEQIARAREKEIIETHHVDEIDDENMPDIPEGYIIDKEAFTAILACKDNDECRCQYRPSTDE

SEQ ID NO: 143745 - protein, 94 aa, Triticum aestivum
  Clone ID: PAT_TA_38163.pep
MQSYEEKLDLKASIPRKLYDEWEPTIKIKIKDQEFYALCDLGASVSTIPKTLCDLRDFRNFVDCSLNLHLADSTIKKPTGRINDVLIVANRYYV

SEQ ID NO: 143746 - protein, 133 aa, Triticum aestivum
  Clone ID: PAT_TA_38164.pep
SRPGGRVRALSRPSPPVLVSTHALASAACGALLAGRQLRWRSGGASMKVACCHAGACPAVWGGSCMRTAAKTWLARAWQWPCRCAWRGSCRVARQGSFHGVRASPARILPGVLWVPSVRIVAALSSFDLEHAR

SEQ ID NO: 143747 - protein, 100 aa, Triticum aestivum
  unsure (1)..(100): unsure at all Xaa locations
  Clone ID: PAT_TA_38165.pep
PERVPGVRCYQTHRPMTLXRTPAAKTRKRKKRLLPQRGERRKERPPQLGRPEGPRREGPFLRTTPPTPTTVKRSGHRGLSPWRHRKCPDTRIIHGVLFVA

SEQ ID NO: 143748 - protein, 89 aa, Triticum aestivum
  Clone ID: PAT_TA_38166.pep
GPKGVITVPGDRKKAEECYQKGPKIADSQVTAVEFEEYKQNADPSDLLRSKKPATESAFQSSGETKPVHIHPTDPDAAPTRISTTLDLK

SEQ ID NO: 143749 - protein, 73 aa, Triticum aestivum
  Clone ID: PAT_TA_38167.pep
FGGPPFFFFFFFFFFFFFFFINFFFFFFFFFFFFFFFFFFFFFFFFFFRLQQQQHKYYVYVLLRLMCTLTSYK

SEQ ID NO: 143750 - protein, 127 aa, Triticum aestivum
  Clone ID: PAT_TA_38168.pep
NHIELFNDAAVKDWRFKRYATCSTLRLYRRRRRLECGLTSSRLGCTGANSNISGFLNFFQFILVIGFFHRRGASGAARVSDTLPRTSALLRIIGPTTTRWTRAPSGDLLASRAPLSMALLPREGEDS

SEQ ID NO: 143751 - protein, 102 aa, Triticum aestivum
  unsure (1)..(102): unsure at all Xaa locations
  Clone ID: PAT_TA_38169.pep
GSPVQTAVVTHEENANVQDLVLLDVIPMSLGLKTAGGVMTVLIIRNTTIPTTKEQVFSTYSDNQPGVLSQVFEGERTTTRDISLLGKLYLXSGIAPAPKGFP

SEQ ID NO: 143752 - protein, 127 aa, Triticum aestivum
  unsure (1)..(127): unsure at all Xaa locations
  Clone ID: PAT_TA_38170.pep
VQTATIVQRVGALGMVMQLPGEDAEFELSRKQMLATLDVMMGGLVAEELIAGEGGVTTGPSTDLSEATQLATDMVTKYGMGKRVGFVTYSNGGDASSGKATNMSERMSELVDXEVKDLLDNAYXNAK

SEQ ID NO: 143753 - protein, 70 aa, Triticum aestivum
  Clone ID: PAT_TA_38171.pep
RIVLQAFYDTLCSMARVQSMDTKLVYCILFESRRRGFSCAVGGRAVPPSRFYIDTRRPVSTLFQTHGCVI

SEQ ID NO: 143754 - protein, 127 aa, Triticum aestivum
  Clone ID: PAT_TA_38172.pep
FAGRRDSRKPHNNILFSCSLFALENGCSKNFADISKIQLWLQQRSSSPPSRGHSSALMEVAQYFAGSTTTHLRLQQNLLSPVPHVHPLCIKNEAGCSKQRSWLQLFGVVHGFCSLWLKLFLPPVESF

SEQ ID NO: 143755 - protein, 61 aa, Triticum aestivum
  Clone ID: PAT_TA_38173.pep
VTIKCTGISVLHTHSSDLTSTPSVREKLSMGQCICFFAKKPHSFKHVTKKSISFLPPPPWT

SEQ ID NO: 143756 - protein, 115 aa, Triticum aestivum
  Clone ID: PAT_TA_38174.pep
AVVEEAVPAGQQAEEEAILHPWRFRLASDTSGWCGWTASRHYGTCREHQGFSHRRRRAAKQACHPSDAWGRVDPLAADLPLTPLASWWKPAAGPCACCPSVAGTDCYHQPASGEP

SEQ ID NO: 143757 - protein, 46 aa, Triticum aestivum
  Clone ID: PAT_TA_38175.pep
IAPENLKRTIHNVRKLGNPDITHIYTKGFISGYMLYHICKTHFPGK

SEQ ID NO: 143758 - protein, 100 aa, Triticum aestivum
  Clone ID: PAT_TA_38176.pep
RGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 143759 - protein, 126 aa, Triticum aestivum
  unsure (1)..(126): unsure at all Xaa locations
  Clone ID: PAT_TA_38177.pep
PFLPSPSVGKGHSRSHCSYCNRDGHVNLVASRRSATCATWSTXHTSLTSSIVSSTEGDIVRLKTYNRRFRFFFDVCCLMALSYHHYTIRYIPVGSGFYGFLSCLLVLPPCPPLDLLIFLFMLPSTR

SEQ ID NO: 143760 - protein, 108 aa, Triticum aestivum
  unsure (1)..(108): unsure at all Xaa locations
  Clone ID: PAT_TA_38178.pep
PVPAGRGSDQLAXLSFKSTIAPPRGLLASWNTSTHHCSWPGVACGRRXRHPDRVVSLRMASFNLSGRISPFLGNLSFLRELHLRDNHLAGRIPPELGHLARLRLLSLR

SEQ ID NO: 143761 - protein, 99 aa, Triticum aestivum
  Clone ID: PAT_TA_38179.pep
PYHQLTEVCFAASLLVQCIYSACITSGERVRFGGADHLHSCYVNACDSVHFRKKMKLGCTLCVIVMWRHKKGLFVWITQFVKSFLCKSSALGEPKKYIF

SEQ ID NO: 143762 - protein, 79 aa, Triticum aestivum
  Clone ID: PAT_TA_38180.pep
RDWDLQIHSTPSEESSELSRRNHSNMASAPSSSSRPHGPGKGDGEKLFRIPQSASEATDIGISSPCGSSPRSSKIDFLQ

SEQ ID NO: 143763 - protein, 90 aa, Triticum aestivum
  Clone ID: PAT_TA_38181.pep
THQSYLVRTLSKKGLIMSWLPSCAPSLSTCTIHVPLRRKNIVYYVPSKYMTHLHTAYLIISIFLHDTSSLMLNVTRVGKRMNTAHVQDKS

SEQ ID NO: 143764 - protein, 58 aa, Triticum aestivum
  Clone ID: PAT_TA_38182.pep
YTSRWIACLGTWRIQCCPRISRSTRVTILRSATQAQRDLRYFMLETSVCSHKLLWALT

SEQ ID NO: 143765 - protein, 50 aa, Triticum aestivum
  Clone ID: PAT_TA_38183.pep
FRGGRKNDLVMEGPFGNLSQFLNKCDFYHNLQMTPFFFYMVTYMCQTWLS

SEQ ID NO: 143766 - protein, 123 aa, Triticum aestivum
  Clone ID: PAT_TA_38184.pep
LDLRVFPFSYDEDGVSLTVDKVIPLDDPTRIGLHAGEKNEMVRRVVHQRTATTAIRPWKGPLPKVRLTALTLGDFVGSWKVVEDRRKKKRLTAAPAPALGLDEIWATRKLRLNYLLGQVGPDS

SEQ ID NO: 143767 - protein, 143 aa, Triticum aestivum
  Clone ID: PAT_TA_38185.pep
GGMTTRGGCVVTQSYQSKFLLLRSRSGSLSPRGKSKCHFIIISLFCLSHAHSGCYLFCLSHANSSFFCSNWIYSKGVRIPNGLITVLLKLHWPGLYCPDPVRHPNHRVLATSWEHWEAALHADHGTHAKAVITTLWVNSLQKH

SEQ ID NO: 143768 - protein, 53 aa, Triticum aestivum
  Clone ID: PAT_TA_38186.pep
SKLYLFCLPMLVDSCSLKLCAHKIPRHRKWIKFKFASHILHDALFMFQFLSFM

SEQ ID NO: 143769 - protein, 37 aa, Triticum aestivum
  Clone ID: PAT_TA_38187.pep
PKKISLKYIDMRSSFEDLVARDLMVKTDLQLDFSFKR

SEQ ID NO: 143770 - protein, 66 aa, Triticum aestivum
  Clone ID: PAT_TA_38188.pep
CPKCAVLYSYTFLCVFCRRYALEAIINDIIYLRVHNYVYVPCYNCYGSRVCNNHEARRKDSYAHVE

SEQ ID NO: 143771 - protein, 133 aa, Triticum aestivum
  Clone ID: PAT_TA_38189.pep
NRRMIAIMIAMMIVMIPLILLKYPFLMMLAAYGQDANMNDAYGDELAIVPYVKHEIVAIAPTHDSPIIFLNSPNYTISEKFALIKDYIDGLPFTIAHDDFYECDMHVLAAPTCNYYERGTISPPLYVSHTLRL

SEQ ID NO: 143772 - protein, 46 aa, Triticum aestivum
  Clone ID: PAT_TA_38190.pep
MDYLFLNRSKNKETKNKIGLPPNKRYHLTPLGRHKSKDRSRYCHLW

SEQ ID NO: 143773 - protein, 45 aa, Triticum aestivum
  Clone ID: PAT_TA_38191.pep
TRKKTNSGDREVVVFPCKWILRCMLFVALTTKITLSACLFHSYVA

SEQ ID NO: 143774 - protein, 36 aa, Triticum aestivum
  Clone ID: PAT_TA_38192.pep
DSRRRAHLLARSLTVSLSPTPLPHTSVRVLNVTYVY

SEQ ID NO: 143775 - protein, 139 aa, Triticum aestivum
  unsure (1)..(139): unsure at all Xaa locations
  Clone ID: PAT_TA_38193.pep
TVENTGPSPTGNGRGADITLNPKVPHFANRNPDLLFLQFNXKKHNSMCYSLNVNVLPFFRFYRGAQGRVSSFSCTNATIKKFKDALAKHSPDRCSLGPARGLEEAELLALAANRDLEFTYNEKPTLVPIAEAIQMEAAS

SEQ ID NO: 143776 - protein, 78 aa, Triticum aestivum
  Clone ID: PAT_TA_38194.pep
DKFFLSKFVHILFPVCIVCRTCQLMIYLWTFGRFTNVDDSMTLYARNMSSFAVHRAKHMVMHYTSPVRGRPEVTIICP

SEQ ID NO: 143777 - protein, 83 aa, Triticum aestivum
  Clone ID: PAT_TA_38195.pep
FDPQALEAKHTAPKLVIGKAKLVQTSIRSGTVPCADQARIGGDHELLSSGRGIPPPEWVGGRQVCQLDWLRPAASPLRHLPLC

SEQ ID NO: 143778 - protein, 74 aa, Triticum aestivum
  unsure (1)..(74): unsure at all Xaa locations
  Clone ID: PAT_TA_38196.pep
LMRTWPHLSSSWSGMTRSIRRVPLSPCYSARTGRRWWLLCPHLMGASWCHWHPLWSGSNGAGGRVFGRLPQXRR

SEQ ID NO: 143779 - protein, 64 aa, Triticum aestivum
  Clone ID: PAT_TA_38197.pep
MQRQNTTKCSPSCMSLADDEQLHDWEISGVTQVNALVSHRHLDIWRTSENALIDGISQDVRIRK

SEQ ID NO: 143780 - protein, 63 aa, Triticum aestivum
  Clone ID: PAT_TA_38198.pep
MVYIQFLVGPALSTYHYMVKLSIALGGYHRVEIKILTQNHSLVVDYFIFIMEAAEKLMERSEM

SEQ ID NO: 143781 - protein, 47 aa, Triticum aestivum
  Clone ID: PAT_TA_38199.pep
GSTRHAQLILLHSKSLVLDDLRFYYEVKYVIFINEYNGYAIFEMEAM

SEQ ID NO: 143782 - protein, 141 aa, Triticum aestivum
  Clone ID: PAT_TA_38200.pep
SRYPGRRGDKIDNSDKKEGASDSVEESGKASEEKAPENTDAKEEKSDDAEELKGSDAQSVKKDDKSPSENDKEPVSREDFKEYFAKFGTVRYVDFSKGDDSGYLKFEESTAAEKARAFAALADEGGLVMKGHLVTLEPVSG

SEQ ID NO: 143783 - protein, 62 aa, Triticum aestivum
  Clone ID: PAT_TA_38201.pep
PHCGGSGQMGGVGHGAKGPRSGGGSRYGDHSVNPLNTAPSDQPDPNPAHYHAHKHCTVTVPL

SEQ ID NO: 143784 - protein, 80 aa, Triticum aestivum
  Clone ID: PAT_TA_38202.pep
SQGGSLSAPPQAAPARLPRPEEFPGEDPEAPPRNSLCPRSPSRRALPRTPALLGGHGRALAASVAAAPPQARRCLPGAST

SEQ ID NO: 143785 - protein, 100 aa, Triticum aestivum
  Clone ID: PAT_TA_38203.pep
ELTRAKEQARRSDAATMKAAEELKAEQAAHHRSEDKIANMALELQNTASRYELLERENQMKTADLEKALQAAKETRSKIRMAREKLQQAGDIVAGKPFLL

SEQ ID NO: 143786 - protein, 63 aa, Triticum aestivum
  Clone ID: PAT_TA_38204.pep
QMIFNPARDYIGPFKLHSHLDWLYSSSIPYNRLSSLQSCWEYFAANATWSYTRLTGISCPSAP

SEQ ID NO: 143787 - protein, 48 aa, Triticum aestivum
  Clone ID: PAT_TA_38205.pep
MLKSGKVAQYSLLQYSALYSMLYSNSLRASPPIRKFNRLHWDCSLAST

SEQ ID NO: 143788 - protein, 76 aa, Triticum aestivum
  Clone ID: PAT_TA_38206.pep
CTYEWKHFPWSDCVGCTYERKCLAGTDCVGCTCDRNQFRLYNCIFSSTARISIFERSPVAHDPILPSVCASRAYPR

SEQ ID NO: 143789 - protein, 51 aa, Triticum aestivum
  Clone ID: PAT_TA_38207.pep
NLWGAPFFILIFFFFFGFFFFFFFFFFFFFFFFFFFFFFFFFFFFFINQGA

SEQ ID NO: 143790 - protein, 58 aa, Triticum aestivum
  Clone ID: PAT_TA_38208.pep
ASQPGANQHPLSIMGQISNSLLARVSRHLIFGLTSMIVSASCLFALMSASTWCIFRLA

SEQ ID NO: 143791 - protein, 102 aa, Triticum aestivum
  Clone ID: PAT_TA_38209.pep
SRIDDVAGRITTQLATMGMSNMKYVPEPNVSPNARLTLFFEGVLGAPGGDPIQQGGLSGPRGPAALPACEDHGPHGTGVPQILRLGHILVGWWRVGGNPRGA

SEQ ID NO: 143792 - protein, 138 aa, Triticum aestivum
  Clone ID: PAT_TA_38210.pep
ATDGYLEDDNYMPTSEDEASLGDDKFGVPEDPIEQDRFKRRLIATTRSLKKKQQQLQADQDLLADRWTEVLAAEEYGLEAPSRGYPKHKPLEEEAEELELPAQDEADRPPRGRDETACQAGHQPAPPRRFTMACGNTQ

SEQ ID NO: 143793 - protein, 70 aa, Triticum aestivum
  Clone ID: PAT_TA_38211.pep
NYSNRLYLVCPIRCEIINKVLSYSTLKLVHRVLVHVHTILLSFLIYFMTHHQNPMWTNNYLIAIEDALRA

SEQ ID NO: 143794 - protein, 71 aa, Triticum aestivum
  Clone ID: PAT_TA_38212.pep
WSRGLRVPSVVSEYSWVARAAPCEPTDLPCIKASDEQIYRDNCSRHVKLEVFGAPTGAHGVERSPRFDSPR

SEQ ID NO: 143795 - protein, 61 aa, Triticum aestivum
  Clone ID: PAT_TA_38213.pep
DGWSEPAEAHSCDKAGLFDLVPRWRAGPWNACDRPVRISPICSPRPLGLLDPLRVRPCIVL

SEQ ID NO: 143796 - protein, 71 aa, Triticum aestivum
  Clone ID: PAT_TA_38214.pep
TVQGTQVLIHYIEGPIAQFVKHKALNLLDVGSSPMVDITSYDIIINELYTKSQLSNILLNRPLGATLVEVL

SEQ ID NO: 143797 - protein, 116 aa, Triticum aestivum
  Clone ID: PAT_TA_38215.pep
VAAKSLNVFCPARRLWIISQHQLTRVRRKGSLASTIVVQVHRPHGYRGAHIPVIGATTGLIRQIHRKPPCQEVRPPHSKSAVQIYGLDLKGTRIHLSSPKSLNSSALPPPRKGIRV

SEQ ID NO: 143798 - protein, 118 aa, Triticum aestivum
  Clone ID: PAT_TA_38216.pep
PELPCSTHSCSFPGLRRSSPAPRLGRVDSPSFVALFPRVRRRLNFFSICSSMAAPFHHVGEPELALSVVNLIYLAVNLVHLAINLVHEAGPRRSTNGSQRLMELYEPDPSEPLTYHNS

SEQ ID NO: 143799 - protein, 87 aa, Triticum aestivum
  Clone ID: PAT_TA_38217.pep
TSLPRNLWYVQPICYYFYNVYSFSNSYGIYCSPFSILRIAGHFLVSTRVKKLTKYVGNCENSQIFAGERNILNPKINSHTKTNLKIN

SEQ ID NO: 143800 - protein, 79 aa, Triticum aestivum
  unsure (1)..(79): unsure at all Xaa locations
  Clone ID: PAT_TA_38218.pep
LQKNQKPTTGRGTVLEGWLNGPCXIHTIWDTIPTHSLRGCWILRQVAKTARISSLTIPRSIIPQKRQYSVDSLRDFHLK

SEQ ID NO: 143801 - protein, 100 aa, Triticum aestivum
  Clone ID: PAT_TA_38219.pep
KKGSKAKKGVETYKIYIFKVLKQVHPDVGISSKAMSIMNSFINDIFEKLVGESAKLARYNKKPTITSREIQTSVRLVLPGELAKHAVSEGTKAVTKFTSS

SEQ ID NO: 143802 - protein, 94 aa, Triticum aestivum
  Clone ID: PAT_TA_38220.pep
VAWRFSRCGSSLGRGRCTRVVRIFSTELYVFGSFNVEVIVNVVGNLIVLGVMAWAANIESWEIQIFVFRLLFRELARPPFCFWTTVVSNFNAAF

SEQ ID NO: 143803 - protein, 138 aa, Triticum aestivum
  unsure (1)..(138): unsure at all Xaa locations
  Clone ID: PAT_TA_38221.pep
MELLDVSNAACAKYFTMMLDGTTRTWLKGLPANSIGSWAKLKARFIQNLKXTCKHPMSIVDLDSCVQEEGESTTHWVRRVSTILHSPDRINVGSVVLMLEKNCHFLPLKQKLGRLNRHFSDMGEPMEALVKYADNCFY

SEQ ID NO: 143804 - protein, 50 aa, Triticum aestivum
  Clone ID: PAT_TA_38222.pep
SRFEIQTGTKGITPFSPGSCLKPGLKGSFEPGPMPLAARTRTNAHINPGS

SEQ ID NO: 143805 - protein, 100 aa, Triticum aestivum
  unsure (1)..(100): unsure at all Xaa locations
  Clone ID: PAT_TA_38223.pep
MLGGVVLAGCEGSRDAIVACRLSSRQEFVXEGHTDMISLDGLLDGSRGNRSDEKLLSLMKIVMQLRKVWNHPELFERIEGSYYFYFAEVPCSPLLLPFGE

SEQ ID NO: 143806 - protein, 90 aa, Triticum aestivum
  Clone ID: PAT_TA_38224.pep
TVKTSRADRVVKYLDGKHGLALALYVAAPALLLRGGGVFVCGVGFRTSVLTGVLPPLLSSSAPIGQNIKLGHIFDLVHRRLSRILRLHTF

SEQ ID NO: 143807 - protein, 130 aa, Triticum aestivum
  unsure (1)..(130): unsure at all Xaa locations
  Clone ID: PAT_TA_38225.pep
IGLIKRMGDGDTINVWENPXIPSNNSYKAMLKPMYATANHASELLVENYEEWDVQKVKANFIGIDAEAIVRIPISVGEDFWAWQPNNRGLFSVHSAYKLLTEATGLGNGYLNAWNKLWQLEVPPKVWCFP

SEQ ID NO: 143808 - protein, 126 aa, Triticum aestivum
  Clone ID: PAT_TA_38226.pep
NTRAVADEGEAPPTYHSCINVHCRCFTPCFGVDLLSPGFIGLILACLLHSTIVHCSLQVCWSSRRLSTIIYKFSHFMLEPLQFRSDHVGHCVYYTNTATPHYFFSVVCSINVLCHRLGVTDFLRCT

SEQ ID NO: 143809 - protein, 58 aa, Triticum aestivum
  Clone ID: PAT_TA_38227.pep
RHGGLSGVRRMTSHRVMAFTRTVSRRFFLSAELKIDTSRLKSIWPKKKKKKKKKKRPL

SEQ ID NO: 143810 - protein, 63 aa, Triticum aestivum
  Clone ID: PAT_TA_38228.pep
GLGLQNTHRYNPAPPGRVIPYSYIPNIRPQIDLNWFMSIFDTLRKIFCSLLMKLFVTCHDIIP

SEQ ID NO: 143811 - protein, 88 aa, Triticum aestivum
  Clone ID: PAT_TA_38229.pep
LNLLGGPFFFFFFFFFFQFFFFFFFFFFFFFFFFFFFFFFFFFFFLIECQPLQQLNFYTRDIIHDQMMLQAYKIRKPTQVSFKLRLPD

SEQ ID NO: 143812 - protein, 67 aa, Triticum aestivum
  Clone ID: PAT_TA_38230.pep
LNQNLDMMLLSGIANFCGSLKSFSEHLQLLCCPIFPRNPNVFALWLCFQMANCAQNQVVRLTQCLDV

SEQ ID NO: 143813 - protein, 35 aa, Triticum aestivum
  Clone ID: PAT_TA_38231.pep
AHVYVMHVCKLYMVCVSCLSARGSQSVVIIMYINL

SEQ ID NO: 143814 - protein, 78 aa, Triticum aestivum
  Clone ID: PAT_TA_38232.pep
SPPWPPLSTVVRSVVSRPLISLRCMNATTLAPCFNTPERGVPLAYEGSCCILTVLSPMPPLHIQCHMARDRPYDAHTL

SEQ ID NO: 143815 - protein, 47 aa, Triticum aestivum
  Clone ID: PAT_TA_38233.pep
CITIPVELIDPVHDQTAIWVPPFGHLPHVIALFKVGANFAGAFKPRA

SEQ ID NO: 143816 - protein, 95 aa, Triticum aestivum
  Clone ID: PAT_TA_38234.pep
AVLPLVLFLISPRVNPHTTHWSRVLHHNGGLNQYKSRVPCVVHLVSLESRRGCGRGSVGRRSSRAPQSLNLKGFAGTRYPTFGAPGRGAPESFLR

SEQ ID NO: 143817 - protein, 89 aa, Triticum aestivum
  Clone ID: PAT_TA_38235.pep
ARLRPSEFGRERRRGCGGRGDVCLAPTASTWCGEFDGRMSGTKWSPEHHRRRTPAVAHSVAGEATAMEHEGKTEMGSRSRGSRWVRRAA

SEQ ID NO: 143818 - protein, 137 aa, Triticum aestivum
  Clone ID: PAT_TA_38236.pep
QFMYIWVFRVICFTFHQNHYEVPLILLPTGGTNCNDPKTQMLGLHAVSGSGKRDLRKHETDSAGVGNHHRLRRRSPHTESIPRPHDGRTGWTEPADGWETELSSLLGCAGAHGAGRLAAEHGLPAECSSSSDMIDDS

SEQ ID NO: 143819 - protein, 139 aa, Triticum aestivum
  unsure (1)..(139): unsure at all Xaa locations
  Clone ID: PAT_TA_38237.pep
SKSDISGHYPHLSRINQSSTTFKGVIPGVEARCTVSLTLEVVFGSPDNFXKRXLIFNIALFQSVYHALLGRMAFARFNAVPHXAYLKLKMPGPRGVITISGNTERSLRTEEYMGALAAEPLNGLSNPSNPLVFRDTDAD

SEQ ID NO: 143820 - protein, 61 aa, Triticum aestivum
  Clone ID: PAT_TA_38238.pep
VADVSQTCTHRTPELKCAKPDAYCTEIRYSSRSNLSLIYLPDLFGHAGLGVLSERRALNLG

SEQ ID NO: 143821 - protein, 112 aa, Triticum aestivum
  Clone ID: PAT_TA_38239.pep
LVRWTLPLNWYLNQELWQVNHYYISIWCCIAQTLTIARSLALIFKILHGFLSQKNLPLTKKRRETSKPSILEVCIARCRGWGLGVILLFEKQDKFLQFFAVTCPDLISSTYL

SEQ ID NO: 143822 - protein, 82 aa, Triticum aestivum
  Clone ID: PAT_TA_38240.pep
RRRPARGETETRCGGGCQRRMRVWMWALVGSSGVGECEECASCWAQISILTTLVGWATNFLARIFFRLQTWKNIPSEGKKQI

SEQ ID NO: 143823 - protein, 58 aa, Triticum aestivum
  Clone ID: PAT_TA_38241.pep
IHHAPTSLHNGSPYVHAAGITNLNTSISNNPQLPTSMTTISPSLYRKTIARNQTYHIQ

SEQ ID NO: 143824 - protein, 71 aa, Triticum aestivum
  Clone ID: PAT_TA_38242.pep
QTGFVKQIIQASPMLERAHLLVGHVVEDEHRELVGLKIVRRRRDWHECERSEVLKDLSYGISSPHLEIVLE

SEQ ID NO: 143825 - protein, 47 aa, Triticum aestivum
  Clone ID: PAT_TA_38243.pep
DESHTGLKWAHVYIRPLTSRKSLGYNWPQIFNEQLMGQIWLWAVNGP

SEQ ID NO: 143826 - protein, 55 aa, Triticum aestivum
  Clone ID: PAT_TA_38244.pep
PRCITGSKIQGSYNTTGCKTNTKSKDSNRQITDKATRADHGIAAARLGKAPGGRL

SEQ ID NO: 143827 - protein, 78 aa, Triticum aestivum
  Clone ID: PAT_TA_38245.pep
KTINILIVKRQAARGSRIGPTAGRVAGMAGITLGRLIGQNQKRGSRTMAASSGPLSCFVVYAVASPRVSEPTYLPDAL

SEQ ID NO: 143828 - protein, 79 aa, Triticum aestivum
  Clone ID: PAT_TA_38246.pep
GVPLPRGPPVASPTPTPLPYIEFQGEKIREKKSSRFTMRNRRQALKPLGRANLESVRGSGEGNRSPSSSPTILHHQFHD

SEQ ID NO: 143829 - protein, 107 aa, Triticum aestivum
  Clone ID: PAT_TA_38247.pep
VGITGRPWMDLTDAGDSDDISHTVSYSDIYRCSTPPPPRLSLIMVLYKFSPPCHCSSIDLLGVAVQLAHHPFRIRECCHAYVHSDSLPNVSIAMHLRTNSAVGTLDL

SEQ ID NO: 143830 - protein, 108 aa, Triticum aestivum
  unsure (1)..(108): unsure at all Xaa locations
  Clone ID: PAT_TA_38248.pep
KRAPASNEAGGQGITRGRKKGTTAKTGVQTYKIYIFNVYDHVHPDLGISSNAMSIMNSFINDIFEKLAGESAKLAPYSXKPTITSREIQTSVRLVLPVELAKHAVSDG

SEQ ID NO: 143831 - protein, 135 aa, Triticum aestivum
  Clone ID: PAT_TA_38249.pep
VWPADCTAMEYIEQFDRDGDCMIENDGFPDQTYDAWTVLGVSAYCGCLWLAALQAAAAMARSLGHDDYADRCMVKFAKAKHVFEAKLWNGSYFNYDSGTSYSSHSIQADQLGGQWDTASSGFAPLFDEDRIKCTL

SEQ ID NO: 143832 - protein, 69 aa, Triticum aestivum
  Clone ID: PAT_TA_38250.pep
YSIVIPMFYRITAYRHVLVHHAQSTNRYLLLHQHVFPFDLLATSQKTKSILWFARTLALGIGKHVFSFG

SEQ ID NO: 143833 - protein, 84 aa, Triticum aestivum
  Clone ID: PAT_TA_38251.pep
RGRRETEEKPKESEFNKKLREVRNNKDLKGITRSHNLLKPLNWNLGSQDQPGKETPGRRLNGGNKTPFLTTLSQGQDNLCLTLS

SEQ ID NO: 143834 - protein, 77 aa, Triticum aestivum
  Clone ID: PAT_TA_38252.pep
SWLAVHRVITQVLRDPLGKSTGFSRVPGQVHWFLQGAPYQSTQMCVNVATLRLPLIIISLATFMYLTYQARSTRDSD

SEQ ID NO: 143835 - protein, 122 aa, Triticum aestivum
  Clone ID: PAT_TA_38253.pep
HVVPRVYCYNLADFSEARSALLCLLFEAKVSKTVSTVWLLSSMGCCSAVFLMRRSLLLLATRRSIQHALRLWVRMVSGIVCILHGLSSHPCRTVPCPVMGFDFLVTGSGEKQGCNLFVRTRG

SEQ ID NO: 143836 - protein, 44 aa, Triticum aestivum
  Clone ID: PAT_TA_38254.pep
TAHQVFLVQISFRPSSRSYLNFSWIQVPISSMVSAKCCSMPRRF

SEQ ID NO: 143837 - protein, 129 aa, Triticum aestivum
  unsure (1)..(129): unsure at all Xaa locations
  Clone ID: PAT_TA_38255.pep
RSKGYTPFFMVYRPKAVLPIDIRHDSPXVANNVEADNKQARQXALDLLDEKGDMALAHLAVYQQDPXRYHNRRVKTITFQEGDLMPRLIQDQTDMHKLSPPWEGPFVVSKNLHNGSYYLIDIPRRLTHF

SEQ ID NO: 143838 - protein, 81 aa, Triticum aestivum
  Clone ID: PAT_TA_38256.pep
VDRAYIKENEDHYPGVHDSYRACGVDEFVAQKLTKWNDNLITYFNPKVNFNQIGRMAGISKGIRYNPTVPNWKNLLMAQKK

SEQ ID NO: 143839 - protein, 112 aa, Triticum aestivum
  Clone ID: PAT_TA_38257.pep
RSGTRRPARSPKRRSRPPASKEAGGKGNHRGRKKGSKAKKGLETSKINTSKVLNQVHPNLAISSKAISTMNPFINNIFKNLAGNSPNLARYNRNPTITSRKIKTSFGLFFPG

SEQ ID NO: 143840 - protein, 81 aa, Triticum aestivum
  Clone ID: PAT_TA_38258.pep
LVARWLLLSLSSSIQCSLRYSWSSIPCNFLLQCACWDPMNCVFMIRLFIDTSILHHVFIMLFIMFLSFITLYGVILMPFLS

SEQ ID NO: 143841 - protein, 53 aa, Triticum aestivum
  Clone ID: PAT_TA_38259.pep
GRVAQLKVEPPIHLLTLPSIKYKYTTATKPLLQTNKVTDKSVTTALLWLPVGP

SEQ ID NO: 143842 - protein, 128 aa, Triticum aestivum
  unsure (1)..(128): unsure at all Xaa locations
  Clone ID: PAT_TA_38260.pep
MAEEGKPRVVVVGGGIGGALLAKTMEPDADVVLLDPKDYLEITWAELRSTVEPSFAERSIIYHTDYLXQATMVTSSAFSITDTXVLTADGQSLAYDYLVVAIGHVFASAGSRTERLTEFQRDNEKIKS

SEQ ID NO: 143843 - protein, 67 aa, Triticum aestivum
  Clone ID: PAT_TA_38261.pep
MCRAGIWILILIRSSGTKKKKKKKKKKKKKKKKKKKKKKKKKKKKKKKKKKKKKKKKILLKKKKKNK

SEQ ID NO: 143844 - protein, 90 aa, Triticum aestivum
  Clone ID: PAT_TA_38262.pep
STVFVHSSTLPVHQPFESVMENSRVKIVSLDQSVVPVEADMLLVTDSFSKEYSEINDQSYPPRGVRSNLVGLYCSYQSYGVLHCCAIFLV

SEQ ID NO: 143845 - protein, 52 aa, Triticum aestivum
  Clone ID: PAT_TA_38263.pep
DAFMKFKESELAQERSRINKINASKKIWHHKLGSGGYEVAQPKWDLAEQQMR

SEQ ID NO: 143846 - protein, 108 aa, Triticum aestivum
  Clone ID: PAT_TA_38264.pep
GPTGAATASWAASPRPSARWAGAKPTAASCRCRSTTSHSHGMNAEPLSIHSFTHRVITKHHNTSSPMMELAATIFVDYFSYNFGEIGNCSICVDSIPSYRLDPVSPNK

SEQ ID NO: 143847 - protein, 70 aa, Triticum aestivum
  Clone ID: PAT_TA_38265.pep
KARHQTPLFISYSTPLRTLFIPNGHHHNICITNLWIDFHDTTSSKLLDNFVVAKPCFHKDGILIIFIPST

SEQ ID NO: 143848 - protein, 87 aa, Triticum aestivum
  unsure (1)..(87): unsure at all Xaa locations
  Clone ID: PAT_TA_38266.pep
VDRLFKLTEGAKXKEKIDKMFKGEKINTTEKQXLLKVALKPPENASITIDGVNLAPEFGAVKDKIRQFPKTFRIGPWVGATGKPLTN

SEQ ID NO: 143849 - protein, 72 aa, Triticum aestivum
  Clone ID: PAT_TA_38267.pep
SQFVFVGPIRLILFANQSSSVERSVWIFSFEFYPCILCLSAYVCHCLFTIEFPKCEACYYYSLGFSNRQQGK

SEQ ID NO: 143850 - protein, 88 aa, Triticum aestivum
  Clone ID: PAT_TA_38268.pep
ICYKFHPGGARACWHRYDDEHEEKKKANLVTNSYGIDTNWYADSGATEHITGELDKLTMRERYHGGDQKAIQFPTSPLAPSGESPHLS

SEQ ID NO: 143851 - protein, 117 aa, Triticum aestivum
  unsure (1)..(117): unsure at all Xaa locations
  Clone ID: PAT_TA_38269.pep
NFSPITPVSPPSLCHEAEGSPAHAVCSPSXRCRCDAKHVSSWWSRVYAHNIRRGGRAHALARRRGGTSVSLPSPPVRRRCAWWLSRWNPVVHMSSPQTRCGHGIYLPDLECHVDPSI

SEQ ID NO: 143852 - protein, 93 aa, Triticum aestivum
  Clone ID: PAT_TA_38270.pep
VINNLCDSPQGVWYLFLPNTMSFLWQKFLVEPKDHSQSVLDEFSPLCCDSASSTFLHGLSRRNMLNLVRHTNLCICNSDSYMFPELSLFSCIL

SEQ ID NO: 143853 - protein, 68 aa, Triticum aestivum
  Clone ID: PAT_TA_38271.pep
EDINAENSRMADLQAHINIKAERLKTRAWRLNLEQNASNAVHERRYLMRLETTSVFPQRGRDDAVQLW

SEQ ID NO: 143854 - protein, 44 aa, Triticum aestivum
  Clone ID: PAT_TA_38272.pep
VAPNNWMAKRFAPIGSNSSIKMVPGAFFFCRIKGIFDKLCPVDP

SEQ ID NO: 143855 - protein, 131 aa, Triticum aestivum
  Clone ID: PAT_TA_38273.pep
PVSTPGRRAVNSHHVTKGKNRAVPIEVRAIRPIPEESRHWLLKPITFDHQDYSRSIRYAGWTALILDLIIDGLQFTQVLMDGGSDLNLLYQDTSRKMGIDPTKIHHSNTSFQGVMPGPHAHCTGSLLLEVV

SEQ ID NO: 143856 - protein, 94 aa, Triticum aestivum
  Clone ID: PAT_TA_38274.pep
MGMKFLNKKGWHTGSLRNVEKVWVAEQKEKEEQHEIEEYKKQLKEEREKAEFRAIQEQAGFKPRQERLEFLYESGLGVGKGSSDGFQALQQPGP

SEQ ID NO: 143857 - protein, 131 aa, Triticum aestivum
  Clone ID: PAT_TA_38275.pep
GSHTGRRKRANCQQQWPKKLGNAPPDEIGPPPPAEPGNAASTGFKKPLGRPKKEKQPASISAETGDATPAGTGDAETGDATPAGTGDAETGDVTPTETGAATPAEGGNAASTGIKRPLGRPRKVKKFGRPR

SEQ ID NO: 143858 - protein, 64 aa, Triticum aestivum
  Clone ID: PAT_TA_38276.pep
ETPEEREEGPDFTFGLGKVPPSWLLEFPLNNCLGCRLACLAPWALRCSRVLMLVVAPWAGTGRP

SEQ ID NO: 143859 - protein, 68 aa, Triticum aestivum
  Clone ID: PAT_TA_38277.pep
DPTSFKGTQAQEVLPPQDHRLKARDKLQEEIDAFEEAPKALVNLVPKTTSSSTSSCTTTTPGISIKRG

SEQ ID NO: 143860 - protein, 47 aa, Triticum aestivum
  Clone ID: PAT_TA_38278.pep
SPYLIGRREMMTVNISSGRLLMKSKPAGVACGSCSSCLLLLAAPSTR

SEQ ID NO: 143861 - protein, 37 aa, Triticum aestivum
  Clone ID: PAT_TA_38279.pep
TAPGNPVVLSKHTTKDEFAFMNKGKSKTDLSDYSDLS

SEQ ID NO: 143862 - protein, 122 aa, Triticum aestivum
  Clone ID: PAT_TA_38280.pep
ARDVSASPCPCIGNGLADGHGAMHQRGWRRGGGWRRIIDHRILHWDVGVLWMPAGQPVGSNGCHLLLVRRPAIRKSAGARGNHRGSGVDRRKGTEANDYGYGRRSSLYSNGGRQRDGRVAPE

SEQ ID NO: 143863 - protein, 71 aa, Triticum aestivum
  Clone ID: PAT_TA_38281.pep
RKDYIRIGSSWSVIELYSSMVRDLPASSASELDGLAVMQTEKWSVILQLYDYIPLSSRLTEIMTSMKGHIL

SEQ ID NO: 143864 - protein, 86 aa, Triticum aestivum
  Clone ID: PAT_TA_38282.pep
GLRLRSRGRGSIYSRRMRGYVAPSEFSRSRRATTKGASEGGRAQRSCGSCCSSRTSTGSKGGRRHGHGRTMAFGRDVPVIAMASPA

SEQ ID NO: 143865 - protein, 78 aa, Triticum aestivum
  Clone ID: PAT_TA_38283.pep
TIDTPKSLSIFIRFWRFTLRFFLIYMSLFAWYRRLAGIKGSQHWLQRFKLLSKLSSRAIYHSTCSTVFFHWDAQFVFD

SEQ ID NO: 143866 - protein, 86 aa, Triticum aestivum
  Clone ID: PAT_TA_38284.pep
GRRRRRPAVGQAHEREGDERERGPSKKTPWTRPTLAERAHCMSKLVFTVCTGAHSGTRRAKQCLGACPSWGGCNCGGSLVKSDMVK

SEQ ID NO: 143867 - protein, 119 aa, Triticum aestivum
  Clone ID: PAT_TA_38285.pep
EKRAPASKEAGGEGKTRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 143868 - protein, 77 aa, Triticum aestivum
  Clone ID: PAT_TA_38286.pep
DKLTAAVDDYIRWCMASTDRAQGWWFGAATTYRVCMLVLWALYAAHTYIWTTPFVCCVCRSITSLGRSLSIRPVKFL

SEQ ID NO: 143869 - protein, 103 aa, Triticum aestivum
  Clone ID: PAT_TA_38287.pep
SKVVYGKYDCGKLTSKDSNNTRHSKQKTYHVANKNIAPSKVTDRSRRKRGCLPGLPQALAFRCPWIILGVPWASPSLGSCHSLFHNPSNLYPKLENFMTQNLK

SEQ ID NO: 143870 - protein, 45 aa, Triticum aestivum
  Clone ID: PAT_TA_38288.pep
FVFFFFFFFFFLIFFFFFFFLKHQLCNRSQHRTRRLAYCLILYLG

SEQ ID NO: 143871 - protein, 47 aa, Triticum aestivum
  Clone ID: PAT_TA_38289.pep
RPVDELQSILLHGAKTIVDKKKINAVSIHYDDKAIDILPNLNPSMGK

SEQ ID NO: 143872 - protein, 68 aa, Triticum aestivum
  Clone ID: PAT_TA_38290.pep
CICAKLVWTHAPSIHSTKHPKGGREGNSWAAFVSYYVLPLNVVGAMHGDVMEYVPKYSTTTVLVGGTY

SEQ ID NO: 143873 - protein, 147 aa, Triticum aestivum
  Clone ID: PAT_TA_38291.pep
FIFHHFLVDGSRFCFMFLLYLFACLFSISVLRACSCIMWFILLAYATKSTTCFLWVWSLLLFHNFGLLFLRFGLLDLLIIVSFQECWTCQLVVSRNLVAQTRFPVSKWHSILIEHDDSSCRWCLYLSSLVTFLCCSNFLPTILFRIP

SEQ ID NO: 143874 - protein, 123 aa, Triticum aestivum
  unsure (1)..(123): unsure at all Xaa locations
  Clone ID: PAT_TA_38292.pep
TQRTVGITELTQTEQGFNERAADFINRWRNLSLHCPQPINEPEAVRMCMNNLXSEVAVQLQGVRPLTFEELASKSMDIENFMQLVAHRTKTTFNKPTNKGGQCEKLPMKPKSAQAMETTTVKL

SEQ ID NO: 143875 - protein, 116 aa, Triticum aestivum
  Clone ID: PAT_TA_38293.pep
VLGSATWQLSGTIGKAKIEVISRGGYLACKVLRVVESLILVSVLNRFLVHELVSWLYPRQEHKQRTTINHEKCTSNMMQNMYDMRDMICDAYAWSGREKMNKAVTWQTKHATGKMR

SEQ ID NO: 143876 - protein, 55 aa, Triticum aestivum
  Clone ID: PAT_TA_38294.pep
QKKKKKKKKKKKKKKKKKKKKKKKKKKKKKKNKRKNKKKKKKKRGRPKGSNLTYP

SEQ ID NO: 143877 - protein, 61 aa, Triticum aestivum
  Clone ID: PAT_TA_38295.pep
ERQTEWTPEILGAHRLRAPAGYRPAWHKLVKPPMSKRMLQQQPQARDQGHMTLSQHTEAHS

SEQ ID NO: 143878 - protein, 95 aa, Triticum aestivum
  unsure (1)..(95): unsure at all Xaa locations
  Clone ID: PAT_TA_38296.pep
SVSRVDRANIEMKSRHQRKILERARKMSEKIGRLEVEMQKVQXALVKYEEEQTTSKTVVQRSKVQLVDYLYGRMRESRKPRFSPCRCMKAKTIDD

SEQ ID NO: 143879 - protein, 132 aa, Triticum aestivum
  unsure (1)..(132): unsure at all Xaa locations
  Clone ID: PAT_TA_38297.pep
TELAKALAEQLFDNENMLVRFDMSEYGTKGSVLRLIGAPPSYFGYDDGGQLTEKVKSHPYSVTLFDEVEKAHREVXNVFLQLLDDGLLTDGKGRTVDFXNTIIIMTSNLGSKHLAAGMVGKNTXQETHKLVM

SEQ ID NO: 143880 - protein, 67 aa, Triticum aestivum
  Clone ID: PAT_TA_38298.pep
NIYKATHKLPELLESYLIYIKYKSKANSYWINSNGQNNYLCDSKNIGLNFTSHQYFHGITGTFSWTH

SEQ ID NO: 143881 - protein, 91 aa, Triticum aestivum
  Clone ID: PAT_TA_38299.pep
CQSSTQSMQVPGEAKRTLWRANSSNVYKYHGFSWPRVVGLKVHKAKRIIRKGKPELHFEVLPENAMRSCVSRNFHVTLIVDKHNRVLESPP

SEQ ID NO: 143882 - protein, 48 aa, Triticum aestivum
  Clone ID: PAT_TA_38300.pep
GSRSCAAGPREEGEGLSFFILYSFFFLVVFCFLFLFKINSFIKYKTCT

SEQ ID NO: 143883 - protein, 122 aa, Triticum aestivum
  unsure (1)..(122): unsure at all Xaa locations
  Clone ID: PAT_TA_38301.pep
DQKGELYKXSTTGVLQRCISEEEGRKLLAEIHAGLGGHHAAARAIVSKAFXTGFYLLTARVDAHDMVQXCVGCQLFSNQSHMPPTALQTIPIIWPFTVWGLDMVGPLKGGTHKKKILTGHGG

SEQ ID NO: 143884 - protein, 118 aa, Triticum aestivum
  Clone ID: PAT_TA_38302.pep
MLLSRRSNLSHFHNARSLSISGAVDDLLFPLDKFIYLVVLDLEGWQCFKDEDMLLICSSRMLLLRYLSVKNTRVRKLPAKIKELRSLETLDMSHTEVSELPSEACELSRLETLDLRST

SEQ ID NO: 143885 - protein, 135 aa, Triticum aestivum
  unsure (1)..(135): unsure at all Xaa locations
  Clone ID: PAT_TA_38303.pep
EVKEDGANGGNGGACTEEDRDLSTTVLRRHAFAYLTKGGGTISEGLVAASSPVDLQNKLQELIESEHPGAGWNYAIFWQLSRTKSGDLVLGWGDGSCREPNDAELAAAASARNDDAKHRMLKRVLXQLHKAFGGA

SEQ ID NO: 143886 - protein, 58 aa, Triticum aestivum
  Clone ID: PAT_TA_38304.pep
YPWSSPSKERRFERYSSSERGSKRKRRSSPSSPSFHSGRGRDWRGATCCTMNSWSIMA

SEQ ID NO: 143887 - protein, 38 aa, Triticum aestivum
  Clone ID: PAT_TA_38305.pep
SLALSPTPCYGPMLPAPRCWNASSPDLLCLVYRPRRPG

SEQ ID NO: 143888 - protein, 46 aa, Triticum aestivum
  Clone ID: PAT_TA_38306.pep
INGRSQVIFSPGFCVEKNLNSRGSESHYESLGKSFYSLSFTFQKVL

SEQ ID NO: 143889 - protein, 58 aa, Triticum aestivum
  Clone ID: PAT_TA_38307.pep
SAHEVLLYFTYLITATSSIPQSENDFIYKGSIHGTWIYQASETKIKGSNPSKKKKQKE

SEQ ID NO: 143890 - protein, 136 aa, Triticum aestivum
  unsure (1)..(136): unsure at all Xaa locations
  Clone ID: PAT_TA_38308.pep
IQPCRYAEWISNIVPVXNKGSGKLRVCIDFRDLNRATPKDEYPMPIADMLINDASGHKVISFLDGNAGYTQIFMAEQDMYKTAFXCPDFLGLFEWTMMTFRLKNAGATYHSAMNLIFHDLLGVILEVYIDDTDVKS

SEQ ID NO: 143891 - protein, 39 aa, Triticum aestivum
  Clone ID: PAT_TA_38309.pep
VAPSPPSSCCSTAERFFRNRKIMTLRARPRYLLSGHVMS

SEQ ID NO: 143892 - protein, 89 aa, Triticum aestivum
  Clone ID: PAT_TA_38310.pep
ADGEVEKSQAEGVHTSTQMGSGHFPEEGFGKASYFKNIQVVDSTNNLKAPHGMGTFTEQSNCYDVQNGNNADWGSYFYYGGPGRSANYQ

SEQ ID NO: 143893 - protein, 104 aa, Triticum aestivum
  unsure (1)..(104): unsure at all Xaa locations
  Clone ID: PAT_TA_38311.pep
MAICIPGNSPEKKEDDGPEGERRXESILDGYAEAAVYLIHGVXSAGQHGGAAPWEGAGLEIRVTIRALVHLRMEASGALRVPRHAMAVPCTKPMHITFFMTMKR

SEQ ID NO: 143894 - protein, 38 aa, Triticum aestivum
  Clone ID: PAT_TA_38312.pep
LAILLFNCPRQKASFCYTTSTNSISLLRARNTWLDNVL

SEQ ID NO: 143895 - protein, 146 aa, Triticum aestivum
  Clone ID: PAT_TA_38313.pep
DFCYIHHDGASTDDDGDGVFAATAVKFCYDWARNLLHPFFFYGKDRWPSFMAKPVRRASMARDGRRCTGTIARPPRGLEQIGGVGLKPAMSELQPKLMVTGEEVFGKHRGRAAQQGGEMRAAGGRSPRRSRGHGRNHADKEGRASF

SEQ ID NO: 143896 - protein, 161 aa, Triticum aestivum
  Clone ID: PAT_TA_38314.pep
GSTYIISLDINPITIARNFLAGMYWVGMNSHWMAAFREDGKKLVLMNFQTSHEIILPPLDYIEYYHRGPSHLDYYVSWTDLVLQKIVICQVPTRYANYIDFKLIALFNRGLAYLYTGAFFSRRQLGSQWIIVKADTHFCDAIEHNGIIYAIDKADGTMYCW

SEQ ID NO: 143897 - protein, 92 aa, Triticum aestivum
  Clone ID: PAT_TA_38315.pep
QCQNKRTKQIHRDKASSEYAYRYTPCSGIARHTLSHCHSTMNQTQPNTQEKGRQPVPSAMIRMGSMSFRISGSTTNSIHTTRTAATDKPETD

SEQ ID NO: 143898 - protein, 91 aa, Triticum aestivum
  Clone ID: PAT_TA_38316.pep
HKAIFSVRSILEFVLRYHERKFIFIILNPTQRTLKSSPRFLPDKQRQERASTPMHRLPQCHLGNPRVECQNIYQVNPYDAPLSTRVFNCKT

SEQ ID NO: 143899 - protein, 57 aa, Triticum aestivum
  Clone ID: PAT_TA_38317.pep
VMFKSCQIKMMVQMIITIIVVVVINLPFCNRSILLCTGCLGGESRKGSLRCTGEVDD

SEQ ID NO: 143900 - protein, 57 aa, Triticum aestivum
  Clone ID: PAT_TA_38318.pep
LVDLTDAQRLLRSNSADEVHRMMAEIDIDGDGISNVTEIISFCNAKAGRMKDVAKVV

SEQ ID NO: 143901 - protein, 133 aa, Triticum aestivum
  Clone ID: PAT_TA_38319.pep
SARFEGLEFHHIARDNNQAADVLARIGAKRDAVPPNIFLERLFKPSVLWEEEPGSDKPEKTAPTGDSADDITSSAHVIIAVIAALTEPFLAYLLRQELPEDQNEARCIVWRSKAYKVHEGGLYKKSTNGVFQR

SEQ ID NO: 143902 - protein, 143 aa, Triticum aestivum
  Clone ID: PAT_TA_38320.pep
LVSEPFAVWGLASLGPFPSSTGYTHILVVVDYVTKWVQAIPTSTVGHNTSIKMLKEVIFPMFGVPRYLMTDGGSHFIHGAFRKMLAKYDVNHIIASPYHPQSSRQVKLFIIEIKLILHQTVNRSIQNWSTKLDDALWAFITAY

SEQ ID NO: 143903 - protein, 121 aa, Triticum aestivum
  Clone ID: PAT_TA_38321.pep
LSFALWLHIYLLEHGGGSIFIDVSNLSYFTSSNLLVFGLIGYIYFACIGLKHVASLRHFFLCCNSLVDLYQVCTLSTFPYFLSIVFSLGSRLSLAVDHLCVGPSILGVLHLCFDYSCSPLA

SEQ ID NO: 143904 - protein, 123 aa, Triticum aestivum
  Clone ID: PAT_TA_38322.pep
KIGHAPKLHSLGYLDSENHVQEFGNTVINVGTKVSPRTMAPSVTILALDVRCGIRSYAKMIPTVIRCFPNVETLHIMSGETGQPSGKHNLDFRNESGTIACICSCIILLVFHDFRRDRHELAF

SEQ ID NO: 143905 - protein, 132 aa, Triticum aestivum
  unsure (1)..(132): unsure at all Xaa locations
  Clone ID: PAT_TA_38323.pep
KPEQDAQTGHGGAENVEEYLSLESHSNKARRMESTQSAKFKRSFTLPARMSSSNSPSPSVSXLDGAGAVAAAAAXKGWSTERSTRAASTQTSWRRSWSSNACMRRRSIDHPYDDKRTDSMFSCSHFLFCSNQ

SEQ ID NO: 143906 - protein, 54 aa, Triticum aestivum
  Clone ID: PAT_TA_38324.pep
NEGWICVAESLEQPGRVIRMNSVSFFIQACCMTDRHRERVPQCLNALVNGDIVV

SEQ ID NO: 143907 - protein, 66 aa, Triticum aestivum
  Clone ID: PAT_TA_38325.pep
FGCGRAGSQCNLILIIPLPIGKGNPGYLAWVDQWRFRPWLSLKMGQVIFPPCTRKFLPNRPLNGED

SEQ ID NO: 143908 - protein, 112 aa, Triticum aestivum
  Clone ID: PAT_TA_38326.pep
SETRVDRVLTDSPPTASGAIVCMAHTKGNAFVFPIAKAGAPPGGGENTRPLIITHNGAIGVFSDSTDLAYQQAVKDGADIINCWVRMSKDGVAFCLGSTDLNSSTTSSHNFL

SEQ ID NO: 143909 - protein, 60 aa, Triticum aestivum
  Clone ID: PAT_TA_38327.pep
VPIYHWPTGIWKQLNWGNLKQTGILVWVTVRTDWNKEVAQAKKRLNKWERNKMPPITRQE

SEQ ID NO: 143910 - protein, 55 aa, Triticum aestivum
  Clone ID: PAT_TA_38328.pep
CRLEIIPSTFRKKEICTYLCFKKERKKYIFKFQERKTEERKKTEELKLWFTVRSL

SEQ ID NO: 143911 - protein, 76 aa, Triticum aestivum
  Clone ID: PAT_TA_38329.pep
KRKIYIYTTDLVVIVVLYIIVTRRCADYFACVLEAVPAIRLESDGATCFALLFSSVGVIGYIFASVVIVGIVMKQI

SEQ ID NO: 143912 - protein, 132 aa, Triticum aestivum
  unsure (1)..(132): unsure at all Xaa locations
  Clone ID: PAT_TA_38330.pep
VLCVETQLPRDRVENLASTLGYDNSXAVSSSGRSGGLGIFWNNEIKIENFGYSAYHIDAHVTLPGASPWRLTVMYGEAQVSDRGKTWDVLRSLAEDDGLPWVCFGDFNEVLSLNEHDGIGHRCMTPVNGFRD

SEQ ID NO: 143913 - protein, 86 aa, Triticum aestivum
  Clone ID: PAT_TA_38331.pep
HTLFTNKVSIQLTQDEALHSSWEQQVACDVETHKAGVYIGSNRTFLNRIAIEWTDLDAILTTDQSLTNGNVGKIVGYAVNDHLKEK

SEQ ID NO: 143914 - protein, 117 aa, Triticum aestivum
  Clone ID: PAT_TA_38332.pep
VRSRRQHGGERSSMSESATTCVIVGNMEASQRQGAAPVTNMEASHRRVAAPVANRRQRACHGSALMVKAHEVRLSLKLAATAAIDVTRWHWRPSPCCTDDIDDHGLQERNKLTRLWR

SEQ ID NO: 143915 - protein, 138 aa, Triticum aestivum
  Clone ID: PAT_TA_38333.pep
RFFITPNFFIFKKLYANMNIFRKFGSKKNSKGVIGESSDSDLHPRGLAEVRPCGWPHTPFLQEAGIHEEFMQYISNAGLTNFIADECGQHQILTNISVQSFTFLPTNNPPKVSFDLYAENHQIPLTEFCDICIILSVP

SEQ ID NO: 143916 - protein, 37 aa, Triticum aestivum
  Clone ID: PAT_TA_38334.pep
QSSCYPFVMNAEPFFAKKKMLSHLNRSFVSRDRDTIY

SEQ ID NO: 143917 - protein, 128 aa, Triticum aestivum
  unsure (1)..(128): unsure at all Xaa locations
  Clone ID: PAT_TA_38335.pep
MGLLSSAVRKCNSKMLLGGGSSSPCGVRGKEQPLTPSKHKRSRKKRFWRKKKSSKKFGCVPCVSLTELTRRAECEAIADLVNNISAKSDVTSHMYAAEEILRITNHNIPSRVLTFRELSAAXNNFSCD

SEQ ID NO: 143918 - protein, 116 aa, Triticum aestivum
  Clone ID: PAT_TA_38336.pep
VTVQVTKDMFPCQAPPPSDLPRSHRQESSKLQPTGSLRSRGRRKLPCIVASPPPLPWLETRAPIVFTRGLVESWLFGIDCLPGIVLGFCGLWDFCLVGTRRSLKPEPDVNRLYLHP

SEQ ID NO: 143919 - protein, 48 aa, Triticum aestivum
  Clone ID: PAT_TA_38337.pep
SSAKRINLIAISRKKRQQILWAVKFLFFTAKLQRISPSPPKGFNWHQP

SEQ ID NO: 143920 - protein, 133 aa, Triticum aestivum
  Clone ID: PAT_TA_38338.pep
WRTDKEASSVAHIEHLFAELSSVGQKVLQFNMLSTSGGQDALKESVDKHGGCPGNKTVYLYSAQCSADCNEACSNHCDMDCPYIAARFGYIMATPANKKAIDQDMECFKRCSKEKDATNDKCRVACKLAASLP

SEQ ID NO: 143921 - protein, 127 aa, Triticum aestivum
  Clone ID: PAT_TA_38339.pep
PGRRVDDSDGVYLVHLKELELRIWLHKGDDWLLVHNICLRGKFAGLSMLDGNAFLQIKQVGDNAEYVLLEMMCQCALYLDIKCRTLHTVYEVTNEDRYLGDIHPFMMIWPPKFPALKDDPATARNAM

SEQ ID NO: 143922 - protein, 133 aa, Triticum aestivum
  Clone ID: PAT_TA_38340.pep
QTSSAFRPLGELVVIRDELACLSLSTVFNDGKGYSANNPEIREHQTDDICRGKIVGQPRVGCCIRQALFFLTGRGSALIFFFPFLLLAISTGACDACGTLSLRPPPTSSRSGKCLRREKEGPYTPHFTYLYFQ

SEQ ID NO: 143923 - protein, 78 aa, Triticum aestivum
  Clone ID: PAT_TA_38341.pep
AGPLMGCSVFGFGNLLEFPSRFFWYWEPSRRFQPVFLFLFFSFLVFLFILLFLFYLFFLMLFLHFLFSFIFAFFPFSC

SEQ ID NO: 143924 - protein, 119 aa, Triticum aestivum
  Clone ID: PAT_TA_38342.pep
LHMRNNKSGRRRKERQQLKKKKDRVLDAAVESEGAAGHAIAEGSKKIVLVKQKKKIKHAKVTSCCTKAHNLVTLNEDEATPKLKKKKSKKQLKESKSPVEVQSPLDSNDAGTLKLKKKK

SEQ ID NO: 143925 - protein, 79 aa, Triticum aestivum
  Clone ID: PAT_TA_38343.pep
SGSFSFLKLKPFGQITFPSKKFLYTVPAGPEDHTSSPLLWGIIKGFTKGYLHRKEPFFNCKNHGSTGGFSLISLRARST

SEQ ID NO: 143926 - protein, 140 aa, Triticum aestivum
  Clone ID: PAT_TA_38344.pep
EIEAGKSFMLRRKFGDPRYASLDRLWSLEDVYMDLAASAADAAKYFQGQTDHEVDHLFWTQFHSPERPLSLIDQLSEWAELNRLSGLAMRSVVDQLWPERPKLNSYFSLVHQLLDVVPRINAMKRLACIEGSRMAFARVK

SEQ ID NO: 143927 - protein, 66 aa, Triticum aestivum
  unsure (1)..(66): unsure at all Xaa locations
  Clone ID: PAT_TA_38345.pep
PCRILRKCLDSIYLFTVDDVVCGYCSDRKVPLLDSLSVCQPHRICNLHGNHPSREITQIDXFYDEC

SEQ ID NO: 143928 - protein, 62 aa, Triticum aestivum
  Clone ID: PAT_TA_38346.pep
PARCRFLPRQVAVSFRHIHKSGLTPDNQPPVYTGHHLRYLGLRSSTCRTSLRHTESQGLLST

SEQ ID NO: 143929 - protein, 101 aa, Triticum aestivum
  unsure (1)..(101): unsure at all Xaa locations
  Clone ID: PAT_TA_38347.pep
PKAEKRAPASKEAGGKAKQRGTKXGSRAKKTLKTYRFKTSTVLKQVHPDLGISSKAMSIMNPFINNIFKNLAGDSANLARYKMKPTITSREIKTSVRLVLP

SEQ ID NO: 143930 - protein, 66 aa, Triticum aestivum
  Clone ID: PAT_TA_38348.pep
ELEPIIYRAHSRSRCIYEVDPNMCRANTRTRNCGKTSNRKNKNTYWTAAGAEALDLGSVSSILSRR

SEQ ID NO: 143931 - protein, 57 aa, Triticum aestivum
  Clone ID: PAT_TA_38349.pep
GASINLWVLFRLNVRYSCIFAYFGWVHRVYSRVTEPDPDHCCFHLMFAISRLHSYIL

SEQ ID NO: 143932 - protein, 94 aa, Triticum aestivum
  Clone ID: PAT_TA_38350.pep
YTTVSDDDNATDMDCACSNKIWVLGLHLSFTRVRLTLYDAGVLSSKISCLLQCFWDGWEHPGPVVLPHRVWLLPTLGYLHDPVSRMGMYLVRSH

SEQ ID NO: 143933 - protein, 41 aa, Triticum aestivum
  Clone ID: PAT_TA_38351.pep
NFQSPGFFFSRLNNSVSSFIPFIQVGIQQCIFTILNPVGRR

SEQ ID NO: 143934 - protein, 127 aa, Triticum aestivum
  Clone ID: PAT_TA_38352.pep
MHKLLQLRQTATVAEYRAAFDEQMYHLLALDPSINTKFFVTQFIMGLKDELRAPVRLQAPSSITRASVLARIQEEELGTMRARPRITPAGRPPLATPPPQPRAAADTSKCIYNFLLFHAILNSVLDV

SEQ ID NO: 143935 - protein, 113 aa, Triticum aestivum
  Clone ID: PAT_TA_38353.pep
GRPVELYKQDEAEQARQDAVDLLEEEREMAMIRSTIYQQDLRQFNAKNVKSRAFKKGNLALRVVQQKPHKLAPTWEGPFIVTRVLHNGAYHLYKVDRQIDEPRAWNAELFRPF

SEQ ID NO: 143936 - protein, 51 aa, Triticum aestivum
  Clone ID: PAT_TA_38354.pep
LSHGLLVRGNIINICLDYCWWPCIDAKCIFYSCLVYKNGGSTSVLVYSSLL

SEQ ID NO: 143937 - protein, 63 aa, Triticum aestivum
  Clone ID: PAT_TA_38355.pep
RPAPRIKTASPMPARRSPRLKTLNQLKKVKISKKKEKVLKVERPSPMKKGAKEKFKPKNNKNL

SEQ ID NO: 143938 - protein, 125 aa, Triticum aestivum
  Clone ID: PAT_TA_38356.pep
PGRRDCLNRAKDNGYVWRVKQPKQNPEKSPLLIPTPTTSQHPTPSPRDSSGIETTHASVQTSPITSSPLPVQHQPAPPPPEQDMANFPLDPLEFLPPGFEIIDGGPTRLPRTFYSPAIAPERRHE

SEQ ID NO: 143939 - protein, 84 aa, Triticum aestivum
  Clone ID: PAT_TA_38357.pep
EEERILGVGDLDAVLLVPIRSRRRRCSFPYGKVVHRISHLIHGCHRGRARTATLARNSYRQIFGRCEITVVSPTDAMSEILNGG

SEQ ID NO: 143940 - protein, 92 aa, Triticum aestivum
  Clone ID: PAT_TA_38358.pep
ADGSKNHPPSIYIICHLPLVFLSPTSPLSFYFPSPSQSPLFSICLPVAMAESKRTKGSLPSFSALDSPSVLSNLLNNDAMGRPTGVINEIFN

SEQ ID NO: 143941 - protein, 100 aa, Triticum aestivum
  Clone ID: PAT_TA_38359.pep
MRMNVKHPATVTRPQTLRYLVLNSSRSKARLKFMKLGMLSWSTINRGKFFVPFEAGLGYASHKPELLTKSPMVSVGKVSPFWTKRYPLPLLDFNFFLMST

SEQ ID NO: 143942 - protein, 93 aa, Triticum aestivum
  unsure (1)..(93): unsure at all Xaa locations
  Clone ID: PAT_TA_38360.pep
GPLISLPVHILGLLPFGLVRYNIWSIFHGFSCNNSFGAFLQKIKRSFGAFWLVGHLTTTSVFLCYLFSVLLNCHVLMYAIFLSTLXASSWPVD

SEQ ID NO: 143943 - protein, 130 aa, Triticum aestivum
  Clone ID: PAT_TA_38361.pep
DGDREQASLQQAVDRGWPASLHLIGKDILRFHAIYWPTMLMSAGISVPDAVFGHGILTEDGMILGNSLSNILVTYDLVGKFDPDAIQDYFLQASYHVNDGDDSKQFCIHTVNAHLCSTIGNLLNRLLGLL

SEQ ID NO: 143944 - protein, 56 aa, Triticum aestivum
  Clone ID: PAT_TA_38362.pep
NWIRDPLRFRQGFRVKAGLGALGGFIPFAPGVREVALRCLQGPPPPGLESVGTAGR

SEQ ID NO: 143945 - protein, 100 aa, Triticum aestivum
  Clone ID: PAT_TA_38363.pep
VDRAKYWTLLGHTGIEERGQKEGGAHPPSGPNWTRGAAPFSFSLSPSFLLSYSNKERRSPTPGGIRTPPLACPPPWSAASPLAPLYTGAREHPIDTTIDH

SEQ ID NO: 143946 - protein, 99 aa, Triticum aestivum
  Clone ID: PAT_TA_38364.pep
ARQETAPPLPRHLSGSVLRKIRLSLLKAHFSCSSGTNVFSSLKSIFLMYYGRKYVFLRRKRIIPECVFSFLSQGLVCRKHFTDRSLAEKLSQLLARNSV

SEQ ID NO: 143947 - protein, 88 aa, Triticum aestivum
  Clone ID: PAT_TA_38365.pep
NCNISFLPHLCHCLGLAQRCFDNVYGAPVSVQNMGILYPHLCTDSGSVPTGQGLLEIAKIKMVFGQIRSHLEKAYFLYTSAQNMISQF

SEQ ID NO: 143948 - protein, 71 aa, Triticum aestivum
  Clone ID: PAT_TA_38366.pep
LEQRKSTANCDRCRACVCWGNTIYSPCRHTVFHHRVFLSMDLEFLQPLLCINILIFGVAGRKRLFVHDLLL

SEQ ID NO: 143949 - protein, 62 aa, Triticum aestivum
  Clone ID: PAT_TA_38367.pep
KIASDTKVRDLRSLQTSTRSTSSFDCTHSLSHSSELSCSSLISLRSTISSKTTPELFSTETE

SEQ ID NO: 143950 - protein, 161 aa, Triticum aestivum
  Clone ID: PAT_TA_38368.pep
GRRALTIYNEMQATEVNPNDVTMVSVLSACAVLGALEMGKWVHSYIRRKALPLTVVLGTALVDFYAKCGCIEDAVKAFESMPVRNSWTWTALIKGMASNGRGREALELFSSMREANIEPTDVTFIGVLLACSHNCLVEEGRRHFDSMTQDYGIHPRIEHYG

SEQ ID NO: 143951 - protein, 85 aa, Triticum aestivum
  Clone ID: PAT_TA_38369.pep
KYQIDITSIAYKFLLTTSCTKRHHQHEWSLAPAPLSGTVLVSLRAGFVRLLRATTRNRFLKRGWAQNILVWMRYPLSLAWLRLLR

SEQ ID NO: 143952 - protein, 61 aa, Triticum aestivum
  Clone ID: PAT_TA_38370.pep
RLALNYVFDVTMIAYLQAFKYASGLCNPNNEMKISIPVYQHQEYLLCVYQRCDSKLSRPAN

SEQ ID NO: 143953 - protein, 91 aa, Triticum aestivum
  Clone ID: PAT_TA_38371.pep
APFGFSPTPSFFVSAHGVVLNATSPRSQLRGANNPCSAKTRGRSNATSKIERGGVGRNYLICHCQVTLGHRTRSINVFISPIHSLPYEKPL

SEQ ID NO: 143954 - protein, 63 aa, Triticum aestivum
  Clone ID: PAT_TA_38372.pep
VDRTADDNRCWFTCGGSAWKSGCSTFVIDVNILKRELLGCIWNSCHVFLGLFFCLIRDLSEFS

SEQ ID NO: 143955 - protein, 163 aa, Triticum aestivum
  unsure (1)..(163): unsure at all Xaa locations
  Clone ID: PAT_TA_38373.pep
AFLELEWIQAMQEELHQFELNNVWELVKRPDLLKHNIIGTKXFYRNKQYENGLVVRNKAWLVAQGYTQVEGIDFDETFAPVARLEAIRILLAYTNHHDITLYQMDVKSAFLNGKLEEEVYVAQPPGFEDPKNPDKVFRLNKALYGLKQAPRAWYVTLKDPSTR

SEQ ID NO: 143956 - protein, 63 aa, Triticum aestivum
  Clone ID: PAT_TA_38374.pep
CCVKKKKKKKKKKKKKKKKKKKKKKKKKKKKKKKKKKKKKKKKKGRPKGSKLKKNGGAPKGSP

SEQ ID NO: 143957 - protein, 72 aa, Triticum aestivum
  unsure (1)..(72): unsure at all Xaa locations
  Clone ID: PAT_TA_38375.pep
SHHHHHGSPLQHHHSXRQGHHPRHRHRSVHPRSPLQHRHHHHEHHQFHHPHLHHRHDRHQTLRLCYQEQYRI

SEQ ID NO: 143958 - protein, 108 aa, Triticum aestivum
  Clone ID: PAT_TA_38376.pep
LPSTVTISQWITPQILSSEMSRAYVADSAKTAIDHFLDVSRAMWYITKELFGKPLAPPNPRIRGVPVSSLHDIELRLRLLREQSHRAGGTPNRPQVSVMPVNPIGGST

SEQ ID NO: 143959 - protein, 47 aa, Triticum aestivum
  Clone ID: PAT_TA_38377.pep
ERGTYPMDRCQLPNTAQHGTLQIPLQKSLKPTASGWLMWPLHDISHV

SEQ ID NO: 143960 - protein, 35 aa, Triticum aestivum
  Clone ID: PAT_TA_38378.pep
HGAYITRKILQIHELASYEWYTTHGERTKDRGGTQ

SEQ ID NO: 143961 - protein, 96 aa, Triticum aestivum
  Clone ID: PAT_TA_38379.pep
CGVPILHRWCHEDIHLKTFKAYFGNPDFLHRRTVPAISSNISGKYLTMIIFEQFLVRVDDSSDEYEDSHVKPDKVDGSTGGPFAVTHEVLGYYSGL

SEQ ID NO: 143962 - protein, 50 aa, Triticum aestivum
  Clone ID: PAT_TA_38380.pep
IFTTFRNSHTRWYTDRCVSSGSILKRKVNICAIIDVEVQCTWRLGPQTTD

SEQ ID NO: 143963 - protein, 41 aa, Triticum aestivum
  Clone ID: PAT_TA_38381.pep
FQLPNTAQHSTIQFPLQKSLKTTSCVSVNWPLHDIIRLNLA

SEQ ID NO: 143964 - protein, 39 aa, Triticum aestivum
  Clone ID: PAT_TA_38382.pep
TSLVDLNAAVAIGFDICRIALNLSCGLRPPFRVSVCQLS

SEQ ID NO: 143965 - protein, 54 aa, Triticum aestivum
  Clone ID: PAT_TA_38383.pep
GRTFRVHGVSALEFFIYHSDVITLWFSFISIFGFIDVIVYLTFLFVLCKFVTVL

SEQ ID NO: 143966 - protein, 40 aa, Triticum aestivum
  Clone ID: PAT_TA_38384.pep
RPSFQNIEIIVLIMEMSSEPPCNNVVMIKDNFYCRNPVDP

SEQ ID NO: 143967 - protein, 66 aa, Triticum aestivum
  Clone ID: PAT_TA_38385.pep
CVLTLPTMQDSREHGTRTKFRPSQSRFRSTGVRSHMTYTLSMSDNCVIKRHGGTRLIQDCPLIRLT

SEQ ID NO: 143968 - protein, 90 aa, Triticum aestivum
  unsure (1)..(90): unsure at all Xaa locations
  Clone ID: PAT_TA_38386.pep
RVDRKRQRTINRVSYSPPETPLMLADLHNLTGVYKTDFPTMPTNARPRKASSVLNASYKGFLXMVLHNTETDVQTXHLDGXSFFVVGMGP

SEQ ID NO: 143969 - protein, 24 aa, Triticum aestivum
  unsure (1)..(24): unsure at all Xaa locations
  Clone ID: PAT_TA_38387.pep
STGRYQCCCCCRWCCCWWXCCCCC

SEQ ID NO: 143970 - protein, 34 aa, Triticum aestivum
  Clone ID: PAT_TA_38388.pep
LDSEVARMIDCTGNCDFISWKVLHARHTRKVGFT

SEQ ID NO: 143971 - protein, 110 aa, Triticum aestivum
  Clone ID: PAT_TA_38389.pep
MVIGEDNTGEAKWMMDNVKFSVEEPIEAVAKREELEHLAMICRSEADAMGRITAGILRLLKLDKSLGQGTIEQLRNLGSGSLDNIFSPSRFSRHNSFGIVSTPRTPRSPM

SEQ ID NO: 143972 - protein, 81 aa, Triticum aestivum
  Clone ID: PAT_TA_38390.pep
LVLTLSPVDDPNDRTLYGLLQPRQVSHAELSQRSRRRCQVQLEVIDFVLLLVLFFLKVILILVFIISALVLLPASLIFFFT

SEQ ID NO: 143973 - protein, 110 aa, Triticum aestivum
  unsure (1)..(110): unsure at all Xaa locations
  Clone ID: PAT_TA_38391.pep
APFFFFFNFNFRIFFILIYFIXFNLFFIFFFFIFFFFFFFFXXFFLEKQKRLISRRYNSILAVTLILTPNNGSSFWLQLYWGKFAIFSDKTLPLTFYLLGIIVLVLPGKN

SEQ ID NO: 143974 - protein, 93 aa, Triticum aestivum
  Clone ID: PAT_TA_38392.pep
HSFSIQLPHSFLLVYKNIHSVHQCRKVKQNLQVNHEMQVNTNVSHFKVQYGKRYIPESTANVIATEPRANDTIALVHSIYPFVHEPEALGLCG

SEQ ID NO: 143975 - protein, 115 aa, Triticum aestivum
  Clone ID: PAT_TA_38393.pep
RFLLPLCSKSLGSTSPPSGPFPLHNDIFFFTAPPSHLIFPQDLVCRVARSSNVSPPKELSMEEARTCSSPAPARFSSALGFPRHHEVPLCRQAPQHSRSIILILQSQGVEKLKRR

SEQ ID NO: 143976 - protein, 116 aa, Triticum aestivum
  Clone ID: PAT_TA_38394.pep
IMRKHGMHATVSSIHVNGWFGKHDKLSASVSLARRAFGLDLHAERERWVFVGDSANDAAMFEFFPLSVGVANVLDVIDTLPVPPAYLTEAEGGGGFAEVAERILEARSLALPAPRD

SEQ ID NO: 143977 - protein, 82 aa, Triticum aestivum
  Clone ID: PAT_TA_38395.pep
PGLKPKQGGSEDGPNVNGTEEDKPPEIGLDGHQRYKGQHNPNRTFAWRLQPTRGPRNKGAGILTGYPVAKPGGYPKRGGRAQ

SEQ ID NO: 143978 - protein, 70 aa, Triticum aestivum
  Clone ID: PAT_TA_38396.pep
SYVLVENIILGIMGQFKGYWILVVLDLIIHWVIWNQGVELLVQILALELEGFICACMLALQDPEVELACW

SEQ ID NO: 143979 - protein, 84 aa, Triticum aestivum
  Clone ID: PAT_TA_38397.pep
GRPEQLRKRMKLRLHGQAYGGVSMHAHVPDLEHASGLVGFSLCLDLKGVRLSVSCSGRCTNAGCGSSDFLCLFLGMYISESCEP

SEQ ID NO: 143980 - protein, 79 aa, Triticum aestivum
  Clone ID: PAT_TA_38398.pep
GLKGQPPDEGELFQGNLKIEKNGLLGWIKKVGTSGKIATAIWQLWGLRLTYTAVCVSDFFCSEFNTKNMGASSAHWTRS

SEQ ID NO: 143981 - protein, 48 aa, Triticum aestivum
  Clone ID: PAT_TA_38399.pep
IGHQRDRHPVITALTVLIYGSLLMVIPVAAVVLSFVVVRTVIVFPVGR

SEQ ID NO: 143982 - protein, 43 aa, Triticum aestivum
  Clone ID: PAT_TA_38400.pep
FYMLTPSSSGFFVKGGNGRSFSSRAFFYRAVMVSHSISNPKTS

SEQ ID NO: 143983 - protein, 65 aa, Triticum aestivum
  unsure (1)..(65): unsure at all Xaa locations
  Clone ID: PAT_TA_38401.pep
KDIICSCLSRDQFXLIMHLCNAKLIWDRISDVYEGYPNSHDPWFEDFXESLKTMTFEPESSSSAS

SEQ ID NO: 143984 - protein, 57 aa, Triticum aestivum
  Clone ID: PAT_TA_38402.pep
TYSYHRKACRSEKKNIKKYVTLRRKKLRYCNTCEWVLVLFLAASSRRAGRRRRLGAP

SEQ ID NO: 143985 - protein, 66 aa, Triticum aestivum
  Clone ID: PAT_TA_38403.pep
MKVWHHFVWALTFDARESLVLIFLYRLFFFFFFFFFFFFFFFLFFFFFFFFFFFFFFFFFFFWLES

SEQ ID NO: 143986 - protein, 86 aa, Triticum aestivum
  Clone ID: PAT_TA_38404.pep
HCLKSVTNRFKLFLNSVIVLVFGKCLNCLKFVSEFENFPGFQFRPGVKKLSWILKTCPHFPVIVHLARPGYYRLPNSIWDFPFLRC

SEQ ID NO: 143987 - protein, 58 aa, Triticum aestivum
  Clone ID: PAT_TA_38405.pep
PIDIHAVQLLGRQMAKKLPHTLSQLLKDGHATSRLFPLQDKLFRQMHLDVPCNAWASC

SEQ ID NO: 143988 - protein, 80 aa, Triticum aestivum
  Clone ID: PAT_TA_38406.pep
GEGRDGVTTQGGDCHRSSVAHRGCSLCFVAAAGREIRSGRRRALTSEPIFGLDHNNVFRSPTSRSSGKVLNLYGKNHLRR

SEQ ID NO: 143989 - protein, 66 aa, Triticum aestivum
  Clone ID: PAT_TA_38407.pep
PWFIGVYRRTIVHVPAPRGFKIQSWRDGREEAETSHIWQVGPLSHVEIWGYEVIYGASFINYGARP

SEQ ID NO: 143990 - protein, 53 aa, Triticum aestivum
  Clone ID: PAT_TA_38408.pep
RPCEDSLTLNNFGSRYFIQTSSKTKLSKVTDSPQNQIFMSRMDISHLVIPRRP

SEQ ID NO: 143991 - protein, 45 aa, Triticum aestivum
  Clone ID: PAT_TA_38409.pep
SRSYTIFHISKYQQKISSNRINGAKLSSISIKCTVSLDDSLHDNP

SEQ ID NO: 143992 - protein, 120 aa, Triticum aestivum
  Clone ID: PAT_TA_38410.pep
VDGDGKKDGDGKKDGEKKEGGDAKKEGGDGGDGKKDGDGKKDGDGKKDGEKKEEGDGKKDGGGKKDGDKKEEGDGKKDDQKKPAAVAPLPFPHHMPLPHHMPPPYMFNADYMMNQYRPAP

SEQ ID NO: 143993 - protein, 120 aa, Triticum aestivum
  unsure (1)..(120): unsure at all Xaa locations
  Clone ID: PAT_TA_38411.pep
VIKHFLYTRSTLSEHIFNNFYILVQHFNAYSTFFKYLFNIFNIYSTFSNTSSTYIILIQHFQMDNYKQIWKSKMPLKXKIFMWYLXRGVMLTKDNLARRNLKGSNKCRFCTHIQYNHPST

SEQ ID NO: 143994 - protein, 48 aa, Triticum aestivum
  unsure (1)..(48): unsure at all Xaa locations
  Clone ID: PAT_TA_38412.pep
SCYQSCTVRVVGTLKRAWKRSAIIXIVVLVFSVIVDAVGCCAFRNKRR

SEQ ID NO: 143995 - protein, 137 aa, Triticum aestivum
  Clone ID: PAT_TA_38413.pep
GRRAMIDTLPHTTFVKLSVTLWAIWWFRRKAIHEEIFQSPASTHQLICSFIRELEYMPGNQHGFMKIHVDASIARNQNKGAAAAVCRDGDGNFMGNSSLVIYGINDAATTEAIACREALSLVDDLMLQSFVIASDSK

SEQ ID NO: 143996 - protein, 44 aa, Triticum aestivum
  Clone ID: PAT_TA_38414.pep
KTNSTLSQQHCIFLFPNTSPFIQGSDKLQVKATTISSLLNYTDA

SEQ ID NO: 143997 - protein, 49 aa, Triticum aestivum
  Clone ID: PAT_TA_38415.pep
YPRIYRLIMGSKVYYMDLCGILARPHLVMYSVVQFRFIDSNVGSQGRFS

SEQ ID NO: 143998 - protein, 84 aa, Triticum aestivum
  Clone ID: PAT_TA_38416.pep
DPDHQRHESWGDPPSASAAPARSSPAYTAVAFSSHGGLRRRLHLPWFRSTTTTCIARSPHGLPSGDHLSAPAHGLTVPHVCAPC

SEQ ID NO: 143999 - protein, 123 aa, Triticum aestivum
  Clone ID: PAT_TA_38417.pep
RGQRSPFLVWALAFAVSGAVVHLLCVGVRGGRILIVIFRAGAADVRRRGDVAGEALDGAVPLLRVVLCPGLSNLILPRKALRHLDPEPKRHHILVLESPSVRLRRGKRTTHDLVEELLLRLDP

SEQ ID NO: 144000 - protein, 51 aa, Triticum aestivum
  Clone ID: PAT_TA_38418.pep
SAKLVSEAASVVTCQARILPSWFYYRDEKHTSQFNTFLDDLTVTTVIPHTL

SEQ ID NO: 144001 - protein, 94 aa, Triticum aestivum
  Clone ID: PAT_TA_38419.pep
IGLYGKESIACHSLPRPSPKWTRGNGCAPLSFSSRFPFLLTYSYEVERLLVLRGKGESDSRLDLHSPVAHHRSGPALLTTTPLYTWSMGIPYTH

SEQ ID NO: 144002 - protein, 94 aa, Triticum aestivum
  Clone ID: PAT_TA_38420.pep
IHGTHAPSGAVLYGALGGKSLPWRSREARLSLAQQRLVDRGAVLLRSLGQWLIGQPLAIWTSVKNESEKLYKNMKFEKNMDLKKVHIFAKKMQI

SEQ ID NO: 144003 - protein, 52 aa, Triticum aestivum
  Clone ID: PAT_TA_38421.pep
SDVVDSRAPRPFSFVVVCTQTCNSSACCLYGPNDGSCDPCLYLMLCGSFGPP

SEQ ID NO: 144004 - protein, 83 aa, Triticum aestivum
  Clone ID: PAT_TA_38422.pep
MCHALKCQSSALILLKKKKKKKKKKKKKKKKKKKKKKKKKKKKKKKKEEEKNSKNKLKKIKKKKRNRDKKKKGGPQKVYSLFF

SEQ ID NO: 144005 - protein, 70 aa, Triticum aestivum
  Clone ID: PAT_TA_38423.pep
PIVVEEERWDAYWGIPKLRFLRLLEILSWGALGIHKLELLCLLNSSHIMVSLFLKKASFTTNSTRTREIG

SEQ ID NO: 144006 - protein, 83 aa, Triticum aestivum
  Clone ID: PAT_TA_38424.pep
RRRKENDPSVLFMKQKTSVRRANPGATNFGSGVVASIIADLLNKEGIINVSFMMMSCRFTVTRKDDDTTVQRLQEDFEDKDFC

SEQ ID NO: 144007 - protein, 85 aa, Triticum aestivum
  Clone ID: PAT_TA_38425.pep
VGTSHCKNPKANTRMTKTRPDRLLESTTSSRTSTILTGTITISSHRLFLCLIFSSGQHHNYTINANARRHNHTLRCQTSSTGSSQ

SEQ ID NO: 144008 - protein, 125 aa, Triticum aestivum
  Clone ID: PAT_TA_38426.pep
GTGLQTNKGRASKLRRRMMILSKRRWRRRILMPIANVLLMRCRVCKTTKEIRGWKWCSPARTDLLPQSALLQNKTRRGQKLRSQKNQAVEWGRRSLVRERARTRERRPPRRRTAGRNESFKLELP

SEQ ID NO: 144009 - protein, 106 aa, Triticum aestivum
  Clone ID: PAT_TA_38427.pep
GEQKEEMDWKGSCRPVHIAEGGQPSASMITGNHDPFCMQGLVNSCSCRGIVGSQDAHVQSTATRLPRPQAIGPVALRTCPFASLLSQVWARLGPGGYCQHSGNGVT

SEQ ID NO: 144010 - protein, 93 aa, Triticum aestivum
  Clone ID: PAT_TA_38428.pep
SLDVNLTTVLLLQYLIFLLQPPKPALVGLPAPASRGRLCCRTGRTALPYFIAGQAIPLLTHTSYYFPATAAGPVNPRTPHRVGNHCRVFRVDP

SEQ ID NO: 144011 - protein, 48 aa, Triticum aestivum
  Clone ID: PAT_TA_38429.pep
EVFPWGMFARIHGLPKAITSAICRSTTTLGICMCNVILVLYNLPLPAV

SEQ ID NO: 144012 - protein, 89 aa, Triticum aestivum
  Clone ID: PAT_TA_38430.pep
LLALPELVFAGVHPSWLFHRRSPARECDGHVPPLGPVDTWAKEAVEPIGPRTRRMAWRASDASTTRQASGAIKALRAYSHSWIGMGVLT

SEQ ID NO: 144013 - protein, 65 aa, Triticum aestivum
  Clone ID: PAT_TA_38431.pep
QRISIYVILQYYSTDPSALSKLRINHVCITYVLLMLQVESMCDGAAVTQHVIHNIHMPHHVRNMP

SEQ ID NO: 144014 - protein, 67 aa, Triticum aestivum
  Clone ID: PAT_TA_38432.pep
LDKKSLPFLKTMAEVSGWPLNRYETLALLIFSSVLAVDLWFWEFLVESSLNWASLAGSWIDQFSAPF

SEQ ID NO: 144015 - protein, 43 aa, Triticum aestivum
  Clone ID: PAT_TA_38433.pep
LDFKGKLSLNLLGRPFFFYFFLFFFNFFFFFFIFFFFFFYFFC

SEQ ID NO: 144016 - protein, 35 aa, Triticum aestivum
  Clone ID: PAT_TA_38434.pep
PQSLILTCGGIIVSIILFSLGQCSNNDDFHTPVDP

SEQ ID NO: 144017 - protein, 71 aa, Triticum aestivum
  Clone ID: PAT_TA_38435.pep
LFLLRIHRKCLKEVSEEFSFHLFVLNSWDKGNFIHLLALCFPKENFKVFYHTKLEDSREVVVLWLHRTGRP

SEQ ID NO: 144018 - protein, 126 aa, Triticum aestivum
  unsure (1)..(126): unsure at all Xaa locations
  Clone ID: PAT_TA_38436.pep
GSTGTLKKXREHWPAFVRIQGTKLPKERPKKKKAIAEKITNFKRLVQGGNPVAMPNWNKSEQEMEDAGVTPVTKSWPPRCRTWFYAHGGTLDPKTSLVSKXASLKXAEQKLLDAIEDARKGVFTPN

SEQ ID NO: 144019 - protein, 126 aa, Triticum aestivum
  Clone ID: PAT_TA_38437.pep
KAHKRKTKKGASQPAPSTIRAQDGPPSPQDISRRSLHDSVLSLEKRRLREKDVAYPVFVAKVPEGKGFVDGDIGGTIVLRFDDIFAMFNLHPLHYTFVRLFSLSMEMRIIRDKTPVIVIVGPVILD

SEQ ID NO: 144020 - protein, 66 aa, Triticum aestivum
  Clone ID: PAT_TA_38438.pep
YISNVSIIYEVFMLLYYLFWMFMGFIKHFYIIFGTNLLTGGPAQIVVFLPFSVFQRKGISNRVQTE

SEQ ID NO: 144021 - protein, 72 aa, Triticum aestivum
  unsure (1)..(72): unsure at all Xaa locations
  Clone ID: PAT_TA_38439.pep
ISSNPSPSSKPTMELLTHGGEHHEIVDGGRLMMTMATDSPLWSPERTPDQPSQERFGLGGGSVSXNMMNPSL

SEQ ID NO: 144022 - protein, 64 aa, Triticum aestivum
  Clone ID: PAT_TA_38440.pep
CFYLFVFFFFFFFFFFFFFFFFFFFFKQKIFDMFHYLYARRYKFNNTRNAIISSFLMPVYNNSA

SEQ ID NO: 144023 - protein, 57 aa, Triticum aestivum
  Clone ID: PAT_TA_38441.pep
IVRTCHEVRRRSSVTGKAEAEQLFQLSAAVPWCGVAHQCDEEVVVHRRLADGHCPCQ

SEQ ID NO: 144024 - protein, 43 aa, Triticum aestivum
  Clone ID: PAT_TA_38442.pep
MVGRIRYAAAQFFCTLLVFLQFFRLQIFCSKSPAPLRAASVIW

SEQ ID NO: 144025 - protein, 52 aa, Triticum aestivum
  Clone ID: PAT_TA_38443.pep
SDRDDQFTHRRKPSGDASGSNDWQTARQNRYVYIVHNFTRTHEMDCTNSTFQ

SEQ ID NO: 144026 - protein, 69 aa, Triticum aestivum
  Clone ID: PAT_TA_38444.pep
IACKGEKESSKCVHMPVRLQQGAAVNKQLLTRVNHGNCSAQIKSFTFSHANNVSTHYSIDYVFNKYFFV

SEQ ID NO: 144027 - protein, 63 aa, Triticum aestivum
  unsure (1)..(63): unsure at all Xaa locations
  Clone ID: PAT_TA_38445.pep
GERHRCDQRAGQKKPLPTVHAKSSDLIDVPTITQIEMEHTHTNRCETCVTXKSATEMKKRALK

SEQ ID NO: 144028 - protein, 40 aa, Triticum aestivum
  Clone ID: PAT_TA_38446.pep
LESHAVLHPHHHTRTQLLTTVTRTFYIHDLYAVYLELLHL

SEQ ID NO: 144029 - protein, 74 aa, Triticum aestivum
  Clone ID: PAT_TA_38447.pep
QYNLSSQPTKNHKARLGLQSRVSKLNPCNSLKFSCQSVRIQSMHDSILPKINEAVCRYIINLAHLNPSFQQGCN

SEQ ID NO: 144030 - protein, 90 aa, Triticum aestivum
  unsure (1)..(90): unsure at all Xaa locations
  Clone ID: PAT_TA_38448.pep
GRARSSNGGSPASKNHKVTLSGLLNMVDGLWSSSGHERILIFTTNHRDRLDPALLRPGRMDMHVHMGYCGFVAFRELAANYHGIXXHPLF

SEQ ID NO: 144031 - protein, 126 aa, Triticum aestivum
  Clone ID: PAT_TA_38449.pep
KSKNKDDDDDDDDEKKANKSKCKDDDDDNDDDDEKKEKKLKNKDDDDDDEKNEKKLENKDDDDDEKKSKEKSDSSEDDDAEKKSKSKSESYEDDDDNKKSKSKNKASEEDFDAVPMEVKADESMPA

SEQ ID NO: 144032 - protein, 47 aa, Triticum aestivum
  Clone ID: PAT_TA_38450.pep
DVMSHVKISVWIIEEVISCSDTYSAYFHTDAIHLLPRSLILTHPSGS

SEQ ID NO: 144033 - protein, 84 aa, Triticum aestivum
  Clone ID: PAT_TA_38451.pep
PGRRGPTAEHPHDNSTYPCPFGKGRFPTHGHLAECLNLNLVFLLLLLLLLLGNSLLIPSGHAILLGATTNYCPCFDFLPVKFIL

SEQ ID NO: 144034 - protein, 51 aa, Triticum aestivum
  unsure (1)..(51): unsure at all Xaa locations
  Clone ID: PAT_TA_38452.pep
PPSKLRHLGTPPRCWSCRRPPASHPSESQKSTSAGPSTPLXRGLIRRTIGS

SEQ ID NO: 144035 - protein, 54 aa, Triticum aestivum
  unsure (1)..(54): unsure at all Xaa locations
  Clone ID: PAT_TA_38453.pep
FWVNSFDRSWYKEWQEPIASDXHGAPKIIQGHQKFLYYLGMXRNYXLFFVNFHR

SEQ ID NO: 144036 - protein, 76 aa, Triticum aestivum
  Clone ID: PAT_TA_38454.pep
KKHYQTREECKNRRRPVLKKIEKTFSTLPFFYATPPNVRGTRRHMRLSHRVSFTSNFKRSENRSLSTPLYLHGSWS

SEQ ID NO: 144037 - protein, 45 aa, Triticum aestivum
  Clone ID: PAT_TA_38455.pep
CISKMFNMFLENVSHVLKNYNVFLKNVCLAQKNFTPGILKQVQRV

SEQ ID NO: 144038 - protein, 80 aa, Triticum aestivum
  Clone ID: PAT_TA_38456.pep
RTQSFASFYRSITNYSCSNLVSVSIRFRKTAGYQIPHSQRVSWSHLTFISPKPSSLHPLLTITAGQRGSNSFDVVRRSSS

SEQ ID NO: 144039 - protein, 59 aa, Triticum aestivum
  Clone ID: PAT_TA_38457.pep
MQNRFGLLVVDTMPIYKIMPRYSHNYALLYQLLNSNLFTHHNTYAILREVTSETYGPGV

SEQ ID NO: 144040 - protein, 41 aa, Triticum aestivum
  Clone ID: PAT_TA_38458.pep
LYYIQYFNNSSKVKVTRTVPVHFSINTYAVYVESNVIPMQA

SEQ ID NO: 144041 - protein, 89 aa, Triticum aestivum
  Clone ID: PAT_TA_38459.pep
RADGVRQEWRRHDRDQQMNSSRSMPYIVRDRNSEEDSVAELLLITIQKRTLLLAVGITEPQACLHCISSSARNRMAGKISGDTGAKMLP

SEQ ID NO: 144042 - protein, 55 aa, Triticum aestivum
  Clone ID: PAT_TA_38460.pep
STGMNTNIEKKFCNNVGTMKVFNDCLPYEWWTETNDGLFLKIYPPRGYARTTLFQ

SEQ ID NO: 144043 - protein, 43 aa, Triticum aestivum
  Clone ID: PAT_TA_38461.pep
TGWVLFSYVTTFGYSGSGVRETMKMPSVLDQCEPLEFIKHIHI

SEQ ID NO: 144044 - protein, 129 aa, Triticum aestivum
  Clone ID: PAT_TA_38462.pep
PALNARRGGLSMMWGSCVGRFSHACVMSQLMGKEAARAFPVKRNNRGHAAHLPSVPSPISEPPSHSPSFVSLRLCSPPLCLRCLLSLAARSRHGTQDQQRQGSGQGRRDERAAGERVGGVADAARLPPL

SEQ ID NO: 144045 - protein, 117 aa, Triticum aestivum
  unsure (1)..(117): unsure at all Xaa locations
  Clone ID: PAT_TA_38463.pep
MSTTYCNDHDXSDHVSYDLEKLFMPHDEYAIDNNVCINIESGVGRASTLGKSNPTYLESVQSYETFYESGFDVNPTILEDYKTFMHVDHEEKILYDGYIVEFYYGPTCNYYERLKYG

SEQ ID NO: 144046 - protein, 137 aa, Triticum aestivum
  unsure (1)..(137): unsure at all Xaa locations
  Clone ID: PAT_TA_38464.pep
AAVSAQPRRQVPRAIXYLVLALPLGTNRGKSLTLVCEHAHELLRPRVDPAASPSTGRRAGDQLPQAGLASLLFLSPSSLGSSFLSHSSISRPLYSSQEYAMEAARSSSLPATISSQIRLVPAIFIDRRPSLLRLARR

SEQ ID NO: 144047 - protein, 57 aa, Triticum aestivum
  Clone ID: PAT_TA_38465.pep
MPTDAFYSFQEHPITVVCNAPLAEIIGSRDASGRVAKWAIYLAPYTIYYQPRTVIKS

SEQ ID NO: 144048 - protein, 82 aa, Triticum aestivum
  Clone ID: PAT_TA_38466.pep
SFCPCLKKKKKKKKKKKKKKKKKKKKKKKKKKKKKKKKKKKKKKKKKKKKKKKKKKKKKKKKKKKKKGAPQKDQNFIAAKQK

SEQ ID NO: 144049 - protein, 97 aa, Triticum aestivum
  Clone ID: PAT_TA_38467.pep
LEDTWHIGLGALHSSTSSRRPFLPTSKPIEFSFEAPTWSLGKTMAAHITMGRIGEVYNRELKDIIYQVCGRRDEQWEVISTRKDRSIVAFIQELNQH

SEQ ID NO: 144050 - protein, 97 aa, Triticum aestivum
  unsure (1)..(97): unsure at all Xaa locations
  Clone ID: PAT_TA_38468.pep
KNSRVIYAPIPCLFKWFVVITCSISNVCMFIDRQLSGLYXGHRLFNLYMCWNHFAYIKEIFRILNYVNTIKQIVKVNIKNVDGIQKMFVTFKMFNTY

SEQ ID NO: 144051 - protein, 67 aa, Triticum aestivum
  unsure (1)..(67): unsure at all Xaa locations
  Clone ID: PAT_TA_38469.pep
EKWVKLTMQCVPSLKYRNHFNTEETESFKLNXGLRQGDPIXPYIFVIXTEGLADLLPNPDENGNITG

SEQ ID NO: 144052 - protein, 133 aa, Triticum aestivum
  unsure (1)..(133): unsure at all Xaa locations
  Clone ID: PAT_TA_38470.pep
VDASFDTNPDDSKSQSGYVFILNGGAVSWCSSKQSVVVGLTCEAEYIASLEAANEGVWMKEFISDLGVIPSASGPMKIFCDNIGALALAKESRFHKRTKHIKRRFNSICHQVXEGDIEICKIHTDLNVADPST

SEQ ID NO: 144053 - protein, 74 aa, Triticum aestivum
  Clone ID: PAT_TA_38471.pep
VVFTFMLRFYLFVRPFFFFFFFFFFFRPKLWNPCYLPISIVLFHFFERSNITTNASVLSLLFPMPAGSVGNPLI

SEQ ID NO: 144054 - protein, 90 aa, Triticum aestivum
  Clone ID: PAT_TA_38472.pep
VSINKIVTAHVLPTESIQTLPGYDDNDGRRSLCEPWTATRVSSLSTTVVLLRLASTSGKRIRDRGILCPGRGSVYDYYCGPAPLHHTRSS

SEQ ID NO: 144055 - protein, 69 aa, Triticum aestivum
  Clone ID: PAT_TA_38473.pep
LSIKPNTSKTSLVVEMHENEAHPVNYDGGRSSMNVQNQVRVWLVGQRTSSWHITDMWDRSVSKPVTVDG

SEQ ID NO: 144056 - protein, 135 aa, Triticum aestivum
  Clone ID: PAT_TA_38474.pep
VPGRRIRRYDVTVKNVYWADSGDLVAIASDTSFYILKYNRDVVAAYLEGGKPADEEGAEDAFELLHEVNERVRTGIWVGDCFIYNNSSWRLNYCVGGEVTTMYHLDRPMYLMGYLANQSRVCLIDKEFNVIGYTL

SEQ ID NO: 144057 - protein, 68 aa, Triticum aestivum
  Clone ID: PAT_TA_38475.pep
PKTQVMKSHVILKIESLKVMKYQTQNESGKDTHKNKKVNMMSLLSRYQGSIIVFGNSCMYRKPSRYSS

SEQ ID NO: 144058 - protein, 71 aa, Triticum aestivum
  unsure (1)..(71): unsure at all Xaa locations
  Clone ID: PAT_TA_38476.pep
FSPHTPRRQESARNNEAVEARARSSSLRASCHVXTTVEPQRRRAPIGDRHGRHRWPRDRSQSAAQSPRLNY

SEQ ID NO: 144059 - protein, 120 aa, Triticum aestivum
  Clone ID: PAT_TA_38477.pep
CKYLMYVVTVDGASAVETLREELARAKEQARRSDAAALKAAEDLRAEQATHGKSKDKIAKMAAELKDVAGRYELLEKESQVRAADLKRAMEADKETRSKIRAGGGAPSSQIYHGWEALFV

SEQ ID NO: 144060 - protein, 131 aa, Triticum aestivum
  Clone ID: PAT_TA_38478.pep
RADGKNKSEAASEKKSKKKSEPSQPSTTEKKPKGKNDHGTEKKSKGKKDASGYTGAEKKRKAKVDSPKKAGAKKKPEMLKKEEPKKNDKPKSSAPATTDAYVAPKEETKKPEAATPDTYTAPKVEPKKEEP

SEQ ID NO: 144061 - protein, 55 aa, Triticum aestivum
  Clone ID: PAT_TA_38479.pep
TAGRKNLRNRSTNMYMATTNPKEWNDPPPDTRYVSVRRDIRSTHKKETNAASVKY

SEQ ID NO: 144062 - protein, 86 aa, Triticum aestivum
  Clone ID: PAT_TA_38480.pep
STGNPRLSLISRLLTMRTSSSCESWPLHLTQDLRHEATDSLRHIHHFVHTELSSWDSSCLQQLHQHLHVLLGLLTFNVYAACNFWG

SEQ ID NO: 144063 - protein, 127 aa, Triticum aestivum
  Clone ID: PAT_TA_38481.pep
WARPRTGAHFHQHAHSPRRSIPHIPRASDEPDEPDYTSATHTSRAHPTRPSGPTTINAVAYSNTRPLSHGLAIAGVAHVDVVATTVTQLADLTWRTKGRSPPPQTRPCMLTPITAVPAARPWPPGRP

SEQ ID NO: 144064 - protein, 65 aa, Triticum aestivum
  Clone ID: PAT_TA_38482.pep
PHRQPKKVLLFPYSCKSYVSACMVFIPQMTLLDRFFLILDVRSNSRCTRFLLIYYFTLARGPSPP

SEQ ID NO: 144065 - protein, 59 aa, Triticum aestivum
  Clone ID: PAT_TA_38483.pep
PGRRESKTDHFVVYIWMHIRMCSLLNDDIASVMLRTSLQTSHNITRKSMISPMEYYNLL

SEQ ID NO: 144066 - protein, 77 aa, Triticum aestivum
  Clone ID: PAT_TA_38484.pep
IYCHRYRSRINCWLSRDKRKKRVKFCNYIRKNHLFRQKFHALALLMYIPRISFGRCHCSLRVAVCVADLQPYHRLPP

SEQ ID NO: 144067 - protein, 93 aa, Triticum aestivum
  unsure (1)..(93): unsure at all Xaa locations
  Clone ID: PAT_TA_38485.pep
MVHVNFDRTYGNTFRIPRFPYYKDRLDAELKLGSEYGLRCTRELCKVQYAVSMTRSAAXHLLILDQKNPRRIFEGAGLLRXRMNRYGPLAEGQ

SEQ ID NO: 144068 - protein, 66 aa, Triticum aestivum
  Clone ID: PAT_TA_38486.pep
NHAPTSSHNDSPYVHATGITNFNTSISQIHNYTTSMTLISPSSYLKTIIKNQTSHSIQCTLYESSY

SEQ ID NO: 144069 - protein, 53 aa, Triticum aestivum
  Clone ID: PAT_TA_38487.pep
TPRYETMNFTVLITCDCFLVYLYSLILAVHPLTGIEQVIYPIESCCKHATFPC

SEQ ID NO: 144070 - protein, 60 aa, Triticum aestivum
  Clone ID: PAT_TA_38488.pep
DCGFNSSFSCRNQFLRRLACLMAHKWAGTNASLKQFHGPRRKISTPGKPSHVETSGPADL

SEQ ID NO: 144071 - protein, 58 aa, Triticum aestivum
  Clone ID: PAT_TA_38489.pep
HNTLHVNSYRNLHRCSFPTLMMLVYSAAGVHRYSHLRDEHSGCNTSYLFGSRNRSFYI

SEQ ID NO: 144072 - protein, 42 aa, Triticum aestivum
  Clone ID: PAT_TA_38490.pep
VICNVCWQAQSLRVHKRASCSTACEHIYDLDKRNVCHVSQPR

SEQ ID NO: 144073 - protein, 102 aa, Triticum aestivum
  Clone ID: PAT_TA_38491.pep
GQQRAARVENWIWGKWPWGRTNPVVKSEVAVARYRKRATATLATARSGIHATATTFSFPPLSFSFLHILFFSFHLNIFLSFSITFLFAFHLILYPLAVASLD

SEQ ID NO: 144074 - protein, 115 aa, Triticum aestivum
  unsure (1)..(115): unsure at all Xaa locations
  Clone ID: PAT_TA_38492.pep
LXWSSFPFPGSLSLAVPHLTRPRRRYRRAPPRLSPPPRPLERSRSSAMTCPSSLLRQTTPERPAVPSSLLPSSSAPTAVVVDSQQPDRRRPRRRRHRTRCEHPHRFPLFPLLGPV

SEQ ID NO: 144075 - protein, 68 aa, Triticum aestivum
  Clone ID: PAT_TA_38493.pep
IMSLHTFCLYLIIIRISLLPTGRFMFFPHLSAHCFRIIHIDNNYNKAATLDDSSIRYLESKFIALLYS

SEQ ID NO: 144076 - protein, 73 aa, Triticum aestivum
  Clone ID: PAT_TA_38494.pep
VVLKKNCKTSGPIILGKPFLKTIGAIIEMKEGNIRFQFPPRKGMEHFPRNKIKLPYESIMRATYGLNTKDDNT

SEQ ID NO: 144077 - protein, 103 aa, Triticum aestivum
  Clone ID: PAT_TA_38495.pep
GRRSYLPRVHLQSCTVASTVSGLSAIDATTTPDSVVLLHESILPHRTPNLHYATPSRSVAINVWMKHHSTKEAVRWSREAECTSKNAAPKGVTTYDCRQHPIS

SEQ ID NO: 144078 - protein, 103 aa, Triticum aestivum
  unsure (1)..(103): unsure at all Xaa locations
  Clone ID: PAT_TA_38496.pep
RSTNAMFRHHPANLRFIADLNPFSFPVSARESCKYHQDRTVHLWHVFQDWHVHYGMFMTSHNDFVXTSTAVINLNVSLIHNDHTFRSSHPVNTTHTSNRLLNT

SEQ ID NO: 144079 - protein, 78 aa, Triticum aestivum
  Clone ID: PAT_TA_38497.pep
TTKIIWENATGNLGIGHRRSVLMPDNVHLKEMIIRCAQVQLCNDSVNSLFVQSDMKTNILQLSWIFTPTQHLFLWKKW

SEQ ID NO: 144080 - protein, 108 aa, Triticum aestivum
  Clone ID: PAT_TA_38498.pep
MSSSYDSSEKEFDMEEEEDLAMILAMHINKKPKHGGSVIGRQKNWRDRIDAHNRLMRYYFVENPTYPESYFRRRFRMSTELFRRIAEKLASHDRFFSAKEERLQRARA

SEQ ID NO: 144081 - protein, 96 aa, Triticum aestivum
  Clone ID: PAT_TA_38499.pep
QPHPSTHHRTRPTALMDGPIAAAARPCRGRKRCDRPGPCQNEPPLSFFLAFPLPAVQPSEKGNAHTLAPCLALPNRAVVGPSLIFLPRGPAAGQQV

SEQ ID NO: 144082 - protein, 64 aa, Triticum aestivum
  Clone ID: PAT_TA_38500.pep
SYMIHMRGSGDPPPPMTEVAGEGEPSSWRLARSPLLRKGIYMSSILFHMVLAPWRLYRVFLLRC

SEQ ID NO: 144083 - protein, 69 aa, Triticum aestivum
  Clone ID: PAT_TA_38501.pep
DLSGQGYWVSGLSTQCKLRIMSKLTMHTKCSTECHGHLGNSWGGQTLQIIFSLDDKEGGKVTWSRPETR

SEQ ID NO: 144084 - protein, 44 aa, Triticum aestivum
  Clone ID: PAT_TA_38502.pep
RQWNIRYIYNVWLLHTTASAGTYSATLDVKVPALGTKVLTPDGK

SEQ ID NO: 144085 - protein, 65 aa, Triticum aestivum
  Clone ID: PAT_TA_38503.pep
TPITIETKQCGSTSYSHMRENIGCYRILDATVIQALRSFDVRSNGIGALFVLVNSGRTLLGLFCK

SEQ ID NO: 144086 - protein, 58 aa, Triticum aestivum
  Clone ID: PAT_TA_38504.pep
VEYSGSTGHRMNMLLTLCNKRLDSLDLMISEYEGKCKESPPGFEHDSAKKFKTKDGNT

SEQ ID NO: 144087 - protein, 71 aa, Triticum aestivum
  Clone ID: PAT_TA_38505.pep
YCPMNISKLFPAAPQKGKYAFLHFISMLVYFFLKNILSPIQNIVLPLFPCFNFDHKFNQRDRLRREQKLYQ

SEQ ID NO: 144088 - protein, 58 aa, Triticum aestivum
  Clone ID: PAT_TA_38506.pep
WKGPGVVYSFPYLALYITHPSYSFICVFGSLCYPNTASTMPHKLSPRSSACIFLGPVG

SEQ ID NO: 144089 - protein, 120 aa, Triticum aestivum
  unsure (1)..(120): unsure at all Xaa locations
  Clone ID: PAT_TA_38507.pep
TLLPRKIEKEKIEKGKSEPKIGIQELPLANFKKMLNIRTSRGKLGGHPQWISFVSQTSFSVSLVIYLNETETENCEDRTSMSLELLCFNLGLPSLLLSLYALFFAVKDAIGPTLLVLXQD

SEQ ID NO: 144090 - protein, 51 aa, Triticum aestivum
  Clone ID: PAT_TA_38508.pep
KHKRQTLAALPLQVKSIHCDMLGGRLTHSRCMMSSPVSLFVGLRSTVSAEV

SEQ ID NO: 144091 - protein, 101 aa, Triticum aestivum
  Clone ID: PAT_TA_38509.pep
PSNIKNVSGSAKQVPHISAESIIFLESNLLTTFVASHHVAARSLFRTIFKPLAPCFKMQFYLHVLSKQRSCPLIGVFIKTDMVIQPARLIALWGLGGGVCY

SEQ ID NO: 144092 - protein, 51 aa, Triticum aestivum
  Clone ID: PAT_TA_38510.pep
LHAWPGDLSCAHASWLVGFVAGALCVHARCYASLLVTDRLPGGEPDVSGRV

SEQ ID NO: 144093 - protein, 102 aa, Triticum aestivum
  unsure (1)..(102): unsure at all Xaa locations
  Clone ID: PAT_TA_38511.pep
PSTLVRDTFQLAKEKAPCIIFIDEIDAIGTKRFDRYKSFSDSSSCISALSQLFAQITFFGXEYSEVSGDREVQRTMLELLNQLDGFSSDERIKVSVFIHSKD

SEQ ID NO: 144094 - protein, 83 aa, Triticum aestivum
  unsure (1)..(83): unsure at all Xaa locations
  Clone ID: PAT_TA_38512.pep
GAPRCIYHPSRSLYGLKXPPRAWYQRFADFHTTIGFIXHMFDSSLFALCHDTDMSYLFFYLLRHHVSPHDQLFPLGATLHPRC

SEQ ID NO: 144095 - protein, 49 aa, Triticum aestivum
  Clone ID: PAT_TA_38513.pep
NLRRLSLHGTIHTPSSVYSLASSRMLLSSADAIMNKPMCFGVTPTCGGS

SEQ ID NO: 144096 - protein, 97 aa, Triticum aestivum
  Clone ID: PAT_TA_38514.pep
QISDYVSTISSIACTLKACTTTNTKIRPPTAVRPWILIGHLIKNDSTTTNIISKHQIHIITCNMKPNLSEARPAPPCPCTAAGCGPQTIAPVAGEVE

SEQ ID NO: 144097 - protein, 90 aa, Triticum aestivum
  unsure (1)..(90): unsure at all Xaa locations
  Clone ID: PAT_TA_38515.pep
TVDRDGYLTYGGYSSMVVVHERFVVQFPDAKPLDKGAPLLCTGXPVYNPIKYHGRNAPGMHXGVLSLGWLSHITVKFGKAFGINVTVISS

SEQ ID NO: 144098 - protein, 75 aa, Triticum aestivum
  Clone ID: PAT_TA_38516.pep
SSTSTSGIMCSLLANNDRCTEENGAISISSSPDLDHQSVRGRHLSQQQIDVVYGNDLHSLPRLRAAPKPAHEHQL

SEQ ID NO: 144099 - protein, 80 aa, Triticum aestivum
  Clone ID: PAT_TA_38517.pep
VTRYKIIMLFLYNLLYFSKIYAPCFTLAEIDVNRCLSRSECECYSLIRIQNSRVHVSYIYVPQTYGLALEVYACHIKIAV

SEQ ID NO: 144100 - protein, 75 aa, Triticum aestivum
  Clone ID: PAT_TA_38518.pep
RSKGGGRSALGAPKERRNPPPSRSRIQPFLVLLGRGKGERKRGRGRGKEGPRPPPLVQFRLPLGGTSWDAALSLP

SEQ ID NO: 144101 - protein, 50 aa, Triticum aestivum
  Clone ID: PAT_TA_38519.pep
TGSIYVILHDYSIDQSLLIHCVLNQVRTTVFLTEVKRLVPVLRVQMYYNT

SEQ ID NO: 144102 - protein, 120 aa, Triticum aestivum
  Clone ID: PAT_TA_38520.pep
GIAPQLLLASHQLSMMTMASHHHRRHRTDSSCGSFTPPSSHSGTAWPPSFFLHSRAPSRMESVVPQPTPAQRRSPWTILSWMTSSRRRPPHHHHLAASHRNRPPAASRRPPPHADVLCIT

SEQ ID NO: 144103 - protein, 112 aa, Triticum aestivum
  Clone ID: PAT_TA_38521.pep
SPSLLISRHNITLNPSMCSCWQHLSFSEEVVAVVSAKKLKILMYCKFLETNIIALKISYTNPGLMAFQTAYVDEASATYLVKERYISFTKVLLKTSQLKIHISLWFHLPGRP

SEQ ID NO: 144104 - protein, 87 aa, Triticum aestivum
  Clone ID: PAT_TA_38522.pep
RASRYGAPVAINAHYHGLLPPSVSCSGKIPYAGDVRWQSLHVLKVLPPLSRLCHDDPFLKHHAVREHQLTRSSLVRNSAHTSAACIH

SEQ ID NO: 144105 - protein, 107 aa, Triticum aestivum
  Clone ID: PAT_TA_38523.pep
DNAPLRWSHHHPKTHTLPKIILNALNLVHKTRVHDQSQDCGEPPNDAHSHFLTHENLRYKMQAQDQYEAQDGAHYFQINPRPSTYQDDLSRLTTKIAFKLKTKVDSV

SEQ ID NO: 144106 - protein, 136 aa, Triticum aestivum
  Clone ID: PAT_TA_38524.pep
TGQCTTHLEPSPPQDPHASEEQSEGSQPREQDQGQDQSQDGGEPPNDAQGQVLPLEQVQDHEQAQDQEQAQDGAQDNQVNPPPSTSEEELERRAAKIASKLTTKGHLMENVVGSLRKGVITRRQLTNYCEHHAFVP

SEQ ID NO: 144107 - protein, 101 aa, Triticum aestivum
  Clone ID: PAT_TA_38525.pep
RIGLVVGQPFDLQKASLVSSSQPSMLTLAATMIDPLYAKLKKPPHEFHHAWESKILDEHHILYAATDAYLCLNIYKGWMKKRSPVSSSSKEVSAKRKRKRD

SEQ ID NO: 144108 - protein, 74 aa, Triticum aestivum
  Clone ID: PAT_TA_38526.pep
RRRRGQQVGHCGCHAALLPRVHDHVLGCAGEEGVQDHSLILPSFPCFCLSASLDWIIYTSRVICLLLSCSLLFV

SEQ ID NO: 144109 - protein, 105 aa, Triticum aestivum
  Clone ID: PAT_TA_38527.pep
RMRSILATTSSESRLKWPLRAMMKPQAAFVLTESRRSSAHSLRGIRLSMSTVMAALQVGHRSCRRAALGLLHGGWKTAHHTSAANMSIVLQRTVMRIWLRMAIGA

SEQ ID NO: 144110 - protein, 76 aa, Triticum aestivum
  Clone ID: PAT_TA_38528.pep
EEELGREERREEKPGGSFGDRNVRQLNRQQCRYVKRLGYQTNSECDETWQAVCLHYNKTTRQVATHSENIFMPLIK

SEQ ID NO: 144111 - protein, 61 aa, Triticum aestivum
  unsure (1)..(61): unsure at all Xaa locations
  Clone ID: PAT_TA_38529.pep
DANYNDTSVISLHPDTIXRLQLFLGETFLLNGNTTNDSICIVLADYICDEPKVIIMRSVKS

SEQ ID NO: 144112 - protein, 49 aa, Triticum aestivum
  Clone ID: PAT_TA_38530.pep
LQSQPLLQLCSYAAITSLDEDNSFIITDFLLMVLFGLVNYGITVHTGSR

SEQ ID NO: 144113 - protein, 69 aa, Triticum aestivum
  Clone ID: PAT_TA_38531.pep
DGRSKTSDAAARLAHHKIQDVNMTVLQFQHVTSHCHCQGFPKSHISLIGQMQTKYILIYMCTGSCTSRS

SEQ ID NO: 144114 - protein, 37 aa, Triticum aestivum
  Clone ID: PAT_TA_38532.pep
FCVKSTLTHSFEHEHYFVYFIQVAIRQCILTTSNSVA

SEQ ID NO: 144115 - protein, 50 aa, Triticum aestivum
  Clone ID: PAT_TA_38533.pep
SLSNLLKSIQVRNILYRDCYLTVPLSHSVLCKYISSSDTVYRLHIANIRF

SEQ ID NO: 144116 - protein, 69 aa, Triticum aestivum
  Clone ID: PAT_TA_38534.pep
NPREYQSKDVTVSSSHPNQSEPCINFSVIALLILRLHLRVQLLVITSSPLKLLLLFTSCHTVTAPTSSH

SEQ ID NO: 144117 - protein, 60 aa, Triticum aestivum
  Clone ID: PAT_TA_38535.pep
CNYAGAPSGSHLDDMWKACNLLKIEPISPRPPVWLEGLSGFIGFQEKGIIPLKLVLMVYP

SEQ ID NO: 144118 - protein, 109 aa, Triticum aestivum
  unsure (1)..(109): unsure at all Xaa locations
  Clone ID: PAT_TA_38536.pep
SGRILTCVVRGGHIFIRVSCLGESGDPEMKLEMRRYREPRFYTKVYTGCQSXGHDGNSFELSLVSSRCIGAYVNCMTSHCHICWLWDKVICTVDTGFXRFLNIVHYRST

SEQ ID NO: 144119 - protein, 77 aa, Triticum aestivum
  Clone ID: PAT_TA_38537.pep
IHPTVANVVEVRRPSRHRGRHKRPREARKKRKIWVHIGGPESNKEGRRVAGQGIGLCYDGIGEGLPGQEYHCPSTAN

SEQ ID NO: 144120 - protein, 67 aa, Triticum aestivum
  unsure (1)..(67): unsure at all Xaa locations
  Clone ID: PAT_TA_38538.pep
GXPRYGTSHPSIYQVQCGSIGDTCVSFGVVRHFLSPTGEASGGCYARRLMRRHQVMPAXSACCMVFV

SEQ ID NO: 144121 - protein, 89 aa, Triticum aestivum
  Clone ID: PAT_TA_38539.pep
NIGFVEVLAKKSSMQTRRRRRPRVCLKNKKWEKEKTIFSTKCKQMILSQSNLQENFCRNQNQIYIYIVSRNVLPRAACETNCHLGEENI

SEQ ID NO: 144122 - protein, 48 aa, Triticum aestivum
  Clone ID: PAT_TA_38540.pep
SPIAIPPFALVAANISLAGSIIRSMRVTHDILHFCSGHVVTADIHVID

SEQ ID NO: 144123 - protein, 33 aa, Triticum aestivum
  unsure (1)..(33): unsure at all Xaa locations
  Clone ID: PAT_TA_38541.pep
KHSRQIQKELHKLSIHLISSMNKXLNSNGCPKV

SEQ ID NO: 144124 - protein, 39 aa, Triticum aestivum
  Clone ID: PAT_TA_38542.pep
ADGVHKWRSVKDNVSICVQGVQSSLASCYEAHKLRNSTE

SEQ ID NO: 144125 - protein, 85 aa, Triticum aestivum
  Clone ID: PAT_TA_38543.pep
FGGPFFFFFFFFFFGFFFFFFFFFFFFFFFFFFFFFFFFFFFFFLEIKSFQPLPVSQSEINRWGVYYLHLRSRHVSSEHALVHGP

SEQ ID NO: 144126 - protein, 54 aa, Triticum aestivum
  Clone ID: PAT_TA_38544.pep
MAGIMHKIEEKLHMGGGSDEHKKDEEHNKAEEHKKKDGEHKKDGEHNEGMMVKI

SEQ ID NO: 144127 - protein, 80 aa, Triticum aestivum
  Clone ID: PAT_TA_38545.pep
VLFFSLYIFLSLLSSSFWFLFVPFMGFNPFFLFSIPFFFSLVSFSFFQYEFNIFFFINGQQFLYTYLNIFHILDIHFSNT

SEQ ID NO: 144128 - protein, 37 aa, Triticum aestivum
  Clone ID: PAT_TA_38546.pep
ADRMLIEELLNLSRGLYRSDLTQSDLCASVSSLNQSR

SEQ ID NO: 144129 - protein, 85 aa, Triticum aestivum
  unsure (1)..(85): unsure at all Xaa locations
  Clone ID: PAT_TA_38547.pep
FLQCKGGHLACVDCHVERLENQRQCQKCEHDGGFDMRNTTVDAIISSLKVECPHEGCGLCITYHKLADHQSMCLLAPCXCPVPVC

SEQ ID NO: 144130 - protein, 76 aa, Triticum aestivum
  Clone ID: PAT_TA_38548.pep
VQELDMPLKTAEVPSLAGQKSCEEHINQETCAVAILYRLRRWYEAYSTGAISAMSSWGECSMASSIATLLRIPVDP

SEQ ID NO: 144131 - protein, 120 aa, Triticum aestivum
  Clone ID: PAT_TA_38549.pep
DCCLHVMTCFDTARNLLHLHSSWTAFVCARPERKRFDCRTFSGLYSVVVYNDGGSDDNGVDRGAVGAVRRTRRRVPEPLGTTMFDGTACSQPCRCRADSYHDIDLARSRWSFCRTFAASP

SEQ ID NO: 144132 - protein, 63 aa, Triticum aestivum
  Clone ID: PAT_TA_38550.pep
VPCYQVLKYKSSDQALIKNVCAVNQIPAILPGKIRTYLTFLCCTYLQGHDILDIFMLHLSPRS

SEQ ID NO: 144133 - protein, 144 aa, Triticum aestivum
  unsure (1)..(144): unsure at all Xaa locations
  Clone ID: PAT_TA_38551.pep
GLLETFHPSRGLRQGDPLSPYLFLFVAKALPLLLNDASEMGVILDFRLNRHAPGISHLIFADXDDSYFSKGNLQHALNVKGILSAYDDGIGQLLCPDKCTILIGKKCSKEDQLSILIILKITIDGFDDKYLSLPAPSLLKALSS

SEQ ID NO: 144134 - protein, 88 aa, Triticum aestivum
  Clone ID: PAT_TA_38552.pep
QSRAPNAGCSSRGSERLHEGRRPEEEKDCVWGFGSRSFETGEEVSHRGSYPGGRGCRTKSLGGSILPRVVSDPKYLNSTDMSSFLLRR

SEQ ID NO: 144135 - protein, 123 aa, Triticum aestivum
  Clone ID: PAT_TA_38553.pep
PGHGGNGKRKAEGGLNFVANTNTQNNSQCQKEKPPRLGGPKFNLEAMMNQPCPKHGMQEKPVSHLWKDCFILRAYRNSNFFQNNHGPNGGPGSSSHGPGFGGGGSSSGFQGHGNQGGLSQQYG

SEQ ID NO: 144136 - protein, 133 aa, Triticum aestivum
  Clone ID: PAT_TA_38554.pep
ATLCLCHPSSICPSCSSTPSPSSAYPSAMQYTGPTYCFPPTVPERLYPTGVYVDRILCVWAISRLRTARNFAEFFLASGYHHLPRGSPTMFRVEEVIQNRVVVALLAHFTNTFDAFYLLGRVFWCGSEFIAFT

SEQ ID NO: 144137 - protein, 81 aa, Triticum aestivum
  Clone ID: PAT_TA_38555.pep
GCYLIQAIYFNRRNFAFKLFNGVSFELTLTYRSFPGSYLTLLIFPELLKFFLKFDVRMNYHQSYVFSPRPVKFFSPLPGAP

SEQ ID NO: 144138 - protein, 75 aa, Triticum aestivum
  Clone ID: PAT_TA_38556.pep
LYGTRPATIPCDRNYYALYLDHINVEQIVASVQYQCHIDMFHLISTTGSIFVQKSVTMLRTCRFAPGQSATCSRR

SEQ ID NO: 144139 - protein, 39 aa, Triticum aestivum
  Clone ID: PAT_TA_38557.pep
KRRRSLKITTLDMHPGADKASLDAPSSQVKSEFLRKSSS

SEQ ID NO: 144140 - protein, 83 aa, Triticum aestivum
  Clone ID: PAT_TA_38558.pep
SEWTGTQSIDQSMSFALQASRAHMPISEGMLNVRTSSRCPTCLSTVRLLCSESHGSLACLRQVNHFDPSPVWTMSSQTLHIAC

SEQ ID NO: 144141 - protein, 79 aa, Triticum aestivum
  Clone ID: PAT_TA_38559.pep
LQYKLYIDTGLRLQALNRLWVLSPHLPSWALTCLTTDEVNPAQIGRFTPSSNIPNIRPQIDLNRFMSILSKNFIFNIFL

SEQ ID NO: 144142 - protein, 69 aa, Triticum aestivum
  Clone ID: PAT_TA_38560.pep
FRGDGENDETPHTVIQCQVPGSSYFHQGTAHLLIWGFARSCELSYTPGIPQFNSIVLNEFHPYDHNEKS

SEQ ID NO: 144143 - protein, 87 aa, Triticum aestivum
  Clone ID: PAT_TA_38561.pep
PLGAGTKSVGSSSVRLDVPSGLFGPLVARSVLARSVLARYIKWTVRSAILGPKSSRSGPVFNRSNRADRENIVIAVAVPHRRGHRQT

SEQ ID NO: 144144 - protein, 154 aa, Triticum aestivum
  Clone ID: PAT_TA_38562.pep
GDLEIQHLELYGLQEQGAAVRELENQLKINNVESQLYSLKIESLQSENQRLQTQLSESSKLTSQLELTKSKCKLLKKKLRLDAEQAKEKITSLQNIVDSFQCKEIIEGEVDGEAEKKLKRLEELENEARELRAANSRLQQENSHLTRRLELTRL

SEQ ID NO: 144145 - protein, 84 aa, Triticum aestivum
  Clone ID: PAT_TA_38563.pep
ELTIACARPSRKDKQSKYNVRQFGYIVRRPYVHASGITNLNTNILTKHNHLLEPPTYYHLYIAKLLQGIKHIIFSDLQILCRIL

SEQ ID NO: 144146 - protein, 58 aa, Triticum aestivum
  Clone ID: PAT_TA_38564.pep
LTRRPSAPGPTTAPPACRCHRRSSTTSTCPPASSHHASCFLPRKTWTCAAPRPVRPSP

SEQ ID NO: 144147 - protein, 100 aa, Triticum aestivum
  Clone ID: PAT_TA_38565.pep
SLVFLHLGSTYKRTQGRVLIPRPTPVPIHARRCLHATIRLVRSTPSTRLTRARRGPPSTECQRPPTTIANSLTQAHTPPRASAHRCDVPPTHRLRIWCSP

SEQ ID NO: 144148 - protein, 96 aa, Triticum aestivum
  unsure (1)..(96): unsure at all Xaa locations
  Clone ID: PAT_TA_38566.pep
DAVDWXTYGVFLXTLCSGKTVFRGPVNDHALQNVISENLRFPAFPVVINHAXDLIRGLLVKDLVNRLGTLRGATAIIHHPFFERLNWSLIRSAAPT

SEQ ID NO: 144149 - protein, 40 aa, Triticum aestivum
  Clone ID: PAT_TA_38567.pep
QRPNGVPKPTPARGTTAKPSAGTEERTPESEPTRNFDSTP

SEQ ID NO: 144150 - protein, 65 aa, Triticum aestivum
  Clone ID: PAT_TA_38568.pep
AVVNILSIPIITITEYNSKSRNFSLGSGRNQIYQGRRQLGPYNWKYRSGAGGFLPVGFGLGEGWV

SEQ ID NO: 144151 - protein, 119 aa, Triticum aestivum
  unsure (1)..(119): unsure at all Xaa locations
  Clone ID: PAT_TA_38569.pep
IRTQHPSAAASSFRLPRSLQLSSRRSFSPPSLAPIKXRSVLPERCTRTSPSSRHRFHSLSYCCLXHPGLQHAPRVRIVGLRNHTALSPVREKGNKVFGERSARLLASSSWTLTSTSPST

SEQ ID NO: 144152 - protein, 54 aa, Triticum aestivum
  Clone ID: PAT_TA_38570.pep
TPCVISIYQLYINIQLIELPLHLRGVTHMLILRHFHIFIVIVCALVHPLYILKH

SEQ ID NO: 144153 - protein, 144 aa, Triticum aestivum
  unsure (1)..(144): unsure at all Xaa locations
  Clone ID: PAT_TA_38571.pep
AKGQRHNTAXQGNNVKRKQADGDSDFVANTNTQNNNQRRKGKSSMPRFGGPKFNLEAIMNQPCPKHGSQDKPATHLWEDCFIMREYRNSGFYQDNHGPHGGSGSALTGPTLEVAVQTLDFRAKAIKAVSISNLIKVIYSNPSTR

SEQ ID NO: 144154 - protein, 50 aa, Triticum aestivum
  Clone ID: PAT_TA_38572.pep
SQYCSVLTFPFHIRLICTAADSYLNKLKLTAVVPLAKKRLIFLVGMERVP

SEQ ID NO: 144155 - protein, 89 aa, Triticum aestivum
  Clone ID: PAT_TA_38573.pep
TGLPNISVSIKHHWFYLLYCISISSLFSCSVPIVFSIISFRLLSTCVSMFTLFHCFRLYSCVIILSLRFTCEILPYIAMSHSTTFFCML

SEQ ID NO: 144156 - protein, 34 aa, Triticum aestivum
  Clone ID: PAT_TA_38574.pep
LLHFFLTTKDEFYLLAPSIYIGPNMFFEIAFDYR

SEQ ID NO: 144157 - protein, 59 aa, Triticum aestivum
  Clone ID: PAT_TA_38575.pep
GVVYQMGSANVIAGPESPTLKVVVVDYVYSFLRRNLAEGHKVLSIPKDELLKVGITYEI

SEQ ID NO: 144158 - protein, 78 aa, Triticum aestivum
  Clone ID: PAT_TA_38576.pep
RWLYINLCLLNFRVPLGHVSCTCSRWGITYHHLLVSLDYSICFATYGLQIDAAPYYQVAATQFTSGGQLPISYWVLIT

SEQ ID NO: 144159 - protein, 144 aa, Triticum aestivum
  Clone ID: PAT_TA_38577.pep
DADTTVWRAVLFPGFIPSRHANARAFFRKKSARRTTSGEVANRASTSQAPRPGPEAETNTRHAPDAPLTEDADGLSATNSEVESSMNHRRRRTILRDACFSQEALDAFNTGDAYLRAAQNGLARATEQYVKDIRVRKFDDYICQ

SEQ ID NO: 144160 - protein, 90 aa, Triticum aestivum
  Clone ID: PAT_TA_38578.pep
GRRGSRRKCGLRRGRVEHGRRTSQLAHHAQPPPMPYSSSKESPTLAVPDIGRRQVGRVADGAPVLGRHRVHCLAVASASGYAAIASRATT

SEQ ID NO: 144161 - protein, 101 aa, Triticum aestivum
  Clone ID: PAT_TA_38579.pep
SSIRILPTDTFTWSSSMSRVTDVSSYLQQIIISVCSQCHTRLRIPWVHAVPVSDTISRSLLVTQPVMSRMDAEQFLSLRAPYRTNVHLCVQPLPFIFIYVP

SEQ ID NO: 144162 - protein, 42 aa, Triticum aestivum
  Clone ID: PAT_TA_38580.pep
YVTRKLTSVLIPLGNRIQEKGFATSIMRGQGTLAVQGHKLGA

SEQ ID NO: 144163 - protein, 91 aa, Triticum aestivum
  Clone ID: PAT_TA_38581.pep
RCGPLCFSPGPARGLDIRMFSTNCKVQPKFDEWFLSPTLDQLEELSFEAGRCRSLPPSALRLMPTLHRASFSSCYLPQINAASALLLPHLN

SEQ ID NO: 144164 - protein, 75 aa, Triticum aestivum
  Clone ID: PAT_TA_38582.pep
RVPAQVSKALRSFLIDRILSKGYLQAYSITSTSIHVMHMHAAYICMNFQLEITQMTCMQVAYMELEIGKMFRVFF

SEQ ID NO: 144165 - protein, 52 aa, Triticum aestivum
  Clone ID: PAT_TA_38583.pep
RHMLERIRMLTLSKMITQLQPISTKCSNMHQSWPIDLDTHSDKLVEVEHRLD

SEQ ID NO: 144166 - protein, 115 aa, Triticum aestivum
  unsure (1)..(115): unsure at all Xaa locations
  Clone ID: PAT_TA_38584.pep
MAAVSKILSSYPGPARRLDIXCSLPTARSXAKYGEWFLSPSLDQLEELSFEAGXCRSLPPSALRLTPTLHRASFSSCXSXPAAPVLLLPQLKQLDLFDIGISKQAMEHLLRNCTM

SEQ ID NO: 144167 - protein, 107 aa, Triticum aestivum
  Clone ID: PAT_TA_38585.pep
VITMMYYMYDLCIVLCTIQLRVQHVLCRMEEAQCGCCNSRCRTSLSTATLFGIYFQPSFVFAAVTIYMNLLTVHSFCYFMLFPLMYCVCYLFLSYIDRTMQCEIGIQ

SEQ ID NO: 144168 - protein, 40 aa, Triticum aestivum
  Clone ID: PAT_TA_38586.pep
SCTSPMTSVVADVFHDYCGDRATRTNPRLTEVTLSPPRRP

SEQ ID NO: 144169 - protein, 76 aa, Triticum aestivum
  unsure (1)..(76): unsure at all Xaa locations
  Clone ID: PAT_TA_38587.pep
DGKVNKLIGLIVKWLKPGGHIFTRESCFHHSGDSKRNVNPTHYXEPRFYNNVSMECHSYERDGTSFEPYPVLSMCI

SEQ ID NO: 144170 - protein, 106 aa, Triticum aestivum
  Clone ID: PAT_TA_38588.pep
TCPITPYLDQAHQHIRRAACQDHQPKCTSLHGNATQEQPEEKEHRHRQNQATFGKHKNGNAYANKRKSEHANTKTGKTLMLSVNNNSDVILKHLRRNVPSETLVVP

SEQ ID NO: 144171 - protein, 109 aa, Triticum aestivum
  Clone ID: PAT_TA_38589.pep
LHCIFHDENESEQVEEQDLHRLVHAPWPIGIDIGVTVLGRTIDILERKCDEHFAIHQAEDSKLLGCMIDDSPEESPSLVLIESLMPLKEWAEDLYDSVMTQPACGFIIA

SEQ ID NO: 144172 - protein, 61 aa, Triticum aestivum
  Clone ID: PAT_TA_38590.pep
PQAMQVQPCVDGEAHTKGLSSQSMFAKMSRRGGNMQTEQLAMTRQGIRRCVVLRGVAGVSV

SEQ ID NO: 144173 - protein, 76 aa, Triticum aestivum
  unsure (1)..(76): unsure at all Xaa locations
  Clone ID: PAT_TA_38591.pep
RRQTFXMFIVKTLIENQSKTTTKILKQIQGTRYFLHILTQVMPKFMEKSDMTFAKIGHIERLKFAGTEMNQHSGKT

SEQ ID NO: 144174 - protein, 107 aa, Triticum aestivum
  unsure (1)..(107): unsure at all Xaa locations
  Clone ID: PAT_TA_38592.pep
MNTNRRRSRSPVEVHDDHSKGSDGYGRKENMRDLQNDSHARPGRGHELVRHSDMHAYGASRESXMHDDYRTYHDVRADDERSPXRTSRPNRESRADTYYDSSNRDGT

SEQ ID NO: 144175 - protein, 80 aa, Triticum aestivum
  Clone ID: PAT_TA_38593.pep
CSASARVLATSFSACFFFESRLSSLDPEESFSSLCRFLITVSVSCGLKFCLLQHQPDGRPNCDRAQCAALLYHLYFCPGH

SEQ ID NO: 144176 - protein, 39 aa, Triticum aestivum
  Clone ID: PAT_TA_38594.pep
SDLTTRLGSLVRDHLSSLPWEINSGVTSRMHLTDFRWER

SEQ ID NO: 144177 - protein, 53 aa, Triticum aestivum
  Clone ID: PAT_TA_38595.pep
ITNSPAQLPLLLGKLLYPLQDCHEPLQGVKTKPKPDTGSVDPDQLSASPFILS

SEQ ID NO: 144178 - protein, 81 aa, Triticum aestivum
  Clone ID: PAT_TA_38596.pep
ATRGRRDQHSAAALMAGLAPWSSGSLHSFPEVVYVEYQKEHTWEDRSTGLWPPFHSPMLIPSFKTRESEIPPRMFSVSCSS

SEQ ID NO: 144179 - protein, 54 aa, Triticum aestivum
  Clone ID: PAT_TA_38597.pep
DGSYYIKSFKNCIIDQCYACQLLINFTICTFPYVMSLLTIRLAYDISHYFLLVG

SEQ ID NO: 144180 - protein, 59 aa, Triticum aestivum
  Clone ID: PAT_TA_38598.pep
GTVALRSHSASCSISASRFRYHSQMQIPARVHMSVVVGLLCPAGVDRSVTHPRMSRIHP

SEQ ID NO: 144181 - protein, 64 aa, Triticum aestivum
  Clone ID: PAT_TA_38599.pep
SYRIALKSKIVLELNNRSVVCDFPDIFSGSVTMLSADRYVEFVIKLDFLQTTLLRLSCLVCSSS

SEQ ID NO: 144182 - protein, 54 aa, Triticum aestivum
  Clone ID: PAT_TA_38600.pep
SYHQHATHIKIILTVTYMLRCLTYGPDQCNFEIHKYRIIVESIYLLIHQLRLNS

SEQ ID NO: 144183 - protein, 107 aa, Triticum aestivum
  Clone ID: PAT_TA_38601.pep
FPSTGDITTAIDTHVVPTEEVSNDDSLSTRILNETTLQLYTFIATSTHIIIYMYIKTIKTQFIMIIMRMIRSTLNIANAHIWTLPRSEKIIIPIANIMIKIPPTRLD

SEQ ID NO: 144184 - protein, 71 aa, Triticum aestivum
  Clone ID: PAT_TA_38602.pep
HYHLTRIRVGRFFVPGIRHRISVFLCNVPMLTIPFNCSAVTWDRSSIASGTLFGDFEVNAGTTDAGLLIIQ

SEQ ID NO: 144185 - protein, 114 aa, Triticum aestivum
  Clone ID: PAT_TA_38603.pep
LGFVYVHNYTEKNQSKVLKPMYLCLIIKRSEKTKYDCLSWWKEFVIRCAIGSKAKHRRSHVSWRCLDVVVYNGSAAVIACERARQCVVVHGRLQWQRHEMSSVGVSGRPGILGP

SEQ ID NO: 144186 - protein, 120 aa, Triticum aestivum
  unsure (1)..(120): unsure at all Xaa locations
  Clone ID: PAT_TA_38604.pep
SRVHGAFVDVPTMLHTNDINIGDQLEVIINRRHINMMQHMLXLKYSHLISISAFKNPCANSIILQAPVSLTQSALDDDYLRRXGIDVYPRIVFDDYMFLYMRQIYEAKVTLFTAKYVNAA

SEQ ID NO: 144187 - protein, 71 aa, Triticum aestivum
  Clone ID: PAT_TA_38605.pep
YRNHVFGEYDPWLYVDALIYVNHIWSAEVLRSTRCLEYDGIVAGFFECGDRDKVGILELEHVMQHVIYTAC

SEQ ID NO: 144188 - protein, 60 aa, Triticum aestivum
  Clone ID: PAT_TA_38606.pep
LVSAIHYCISGIYIIILHHCRLSYCVCRAHFPRSSFPLPSTPINVTPIVLEQLIHVQYDF

SEQ ID NO: 144189 - protein, 117 aa, Triticum aestivum
  unsure (1)..(117): unsure at all Xaa locations
  Clone ID: PAT_TA_38607.pep
VLLPVGPARVLGLELGLELLLLGLQKPDLLHVPGCLVRQLRLEPVARHGCLAAFQLLSLELALELMHAGPQPGGDLCKSKQESSTSTSAKTRSFQRRFCLTTQQSARISXGYTSWCA

SEQ ID NO: 144190 - protein, 55 aa, Triticum aestivum
  Clone ID: PAT_TA_38608.pep
VVDIVPVTQLDADFVTFMTRFKLLLLRCTASKLLLTVTGYSNITTCDHVSRRPAN

SEQ ID NO: 144191 - protein, 68 aa, Triticum aestivum
  Clone ID: PAT_TA_38609.pep
RYDECYTRIRTVNVSAIRDNCISMFGFRMYSDRMWSSPDGCFTCAHQRSSMLACRVKWLAQRQSDGAA

SEQ ID NO: 144192 - protein, 147 aa, Triticum aestivum
  unsure (1)..(147): unsure at all Xaa locations
  Clone ID: PAT_TA_38610.pep
SGRLFSRNTRNVALTPEGESLLPLARRLIADXDNAEDELRQRFTLQRGRVTVAAMPSFAGNLLPPILKIFRARYPQVNVTVHDLINEQVLEMVRDRQVELGVAFEPSEGSSLAFTPLYLDRFIAVVPGDSPLAQCTEVDSISCRYRQ

SEQ ID NO: 144193 - protein, 78 aa, Triticum aestivum
  Clone ID: PAT_TA_38611.pep
FIILRKFSLASNFIWSDAQTPMELFKSYPVVIIVGSICYQNTLISACSYTKGTVQVLSPAQSIVSYSKSYKCLALSSV

SEQ ID NO: 144194 - protein, 109 aa, Triticum aestivum
  unsure (1)..(109): unsure at all Xaa locations
  Clone ID: PAT_TA_38612.pep
SVSRAAREKIRQAGEIAAGKPFLLQTKFVDPKYAPLNQKWSSPDAFLDLPKSVSDEARFFQAKEGHATEKLFWSQFSTPKCPLLLNEQMAQWAELHKISGPVDPEXSDR

SEQ ID NO: 144195 - protein, 63 aa, Triticum aestivum
  Clone ID: PAT_TA_38613.pep
WRTTSTKREVELWHENNIYRRIVRIIDVRTDCWQDLKGATNVREDLSCCDKSHEWHCVDLERG

SEQ ID NO: 144196 - protein, 51 aa, Triticum aestivum
  Clone ID: PAT_TA_38614.pep
VPCSTVESSGSTGYDGYWHLLIDTHMISKLLTYSNVHQRNNFMIRKSVLCY

SEQ ID NO: 144197 - protein, 84 aa, Triticum aestivum
  Clone ID: PAT_TA_38615.pep
VDGDSKCYRHPYEENFEGSSEEGTPSKSKFQLKLRDLRRSTSSFALLDRNYLTPIFTSQHEDDDDDDDNDDDSCEVLAIPRPSA

SEQ ID NO: 144198 - protein, 80 aa, Triticum aestivum
  Clone ID: PAT_TA_38616.pep
KKLNSSLEIMHGALHIAAVLMVVVVTPVTSLGQSDHINLYGGSSTAEAIQGQLGPGWKPRIENVPTSTSLFGSWSSLYFF

SEQ ID NO: 144199 - protein, 39 aa, Triticum aestivum
  Clone ID: PAT_TA_38617.pep
NNSVISFIPFIQVAIQQCIFTTPNSVASLPYVNLPPASS

SEQ ID NO: 144200 - protein, 147 aa, Triticum aestivum
  Clone ID: PAT_TA_38618.pep
GSTGMVRLRSSDGQELEVMEEAIAAASKTIKDALEKGGAADDAIPVPDVTGRVLSRVLEYVSRHFSDPAAAADPFDYIPNFDNPLKAFDDAFVQVDQDTLFDLIHAAECLDIEGLMDLACKTVADQMRGKTIEEIRKKFHVVNDYTA

SEQ ID NO: 144201 - protein, 121 aa, Triticum aestivum
  unsure (1)..(121): unsure at all Xaa locations
  Clone ID: PAT_TA_38619.pep
VSNNRFVGPVXYVCLEMPTLKYIDIRFNEFEGELPPALFDKPYDAIFVNSNRFVGPIPETIGNSTASVVVFANNKFVGCIPKSIGRMAKTLDEIIFLNNTLEGCMPLEIGMLTNTTVVDSG

SEQ ID NO: 144202 - protein, 74 aa, Triticum aestivum
  Clone ID: PAT_TA_38620.pep
SIWIPLVQHVSYYILMIFGRKHFAQVYNVRKLFNTSRVWTIHTPLVHHAVSALGTGTSAHPCIIGPTSQYNILP

SEQ ID NO: 144203 - protein, 105 aa, Triticum aestivum
  Clone ID: PAT_TA_38621.pep
SRVHGEEEEVGKEASLGDIINLKLVESGEKERLMELLRERLVECGWRDDMKALCRAYARKKGRNNVTLDDLIHVITPKGRASVPDAVKAELLQRIRSFLMSSSLW

SEQ ID NO: 144204 - protein, 55 aa, Triticum aestivum
  Clone ID: PAT_TA_38622.pep
CNALSSMICMIAKCTSTYASRRDILGTWDSFCSSKYIVAASVFQNILTVPRVADQ

SEQ ID NO: 144205 - protein, 92 aa, Triticum aestivum
  Clone ID: PAT_TA_38623.pep
DHYSFIATVFFMLIHVPRTMRSCNSRIPEEHLVCYQTSQRKWVIIKMLHRCLRRCLLGWHRSRLGFVTPCFGEVSLGPLANTHHYKPCKHCD

SEQ ID NO: 144206 - protein, 98 aa, Triticum aestivum
  Clone ID: PAT_TA_38624.pep
IDHVLDPSCCTKWTPLPFLHLAAPPYLGFSFLFQIFSRSIVVTKSEHFLFSIALTWTWLHHLSNCELHWYFLSIYTIVSSQIVVIHRSFFIFLRPLLI

SEQ ID NO: 144207 - protein, 52 aa, Triticum aestivum
  Clone ID: PAT_TA_38625.pep
GSTSCTNYVTQLYRHVPVTGRANFNPCFVSGHNHPICMRLISLLPYTKTIFK

SEQ ID NO: 144208 - protein, 40 aa, Triticum aestivum
  Clone ID: PAT_TA_38626.pep
TRQLTLHTLLISRVFLQIFQVTLILFTGEMSILHGLGNGT

SEQ ID NO: 144209 - protein, 111 aa, Triticum aestivum
  Clone ID: PAT_TA_38627.pep
GPDDTPWDGGTFKLTLQFTEDYPNKPPTVRFVSRMFHPNIYADGSICLDILQNQWSPIYDVAAILTSIQSLLCDPNPNSPANSEAARMFSENKREYNRKVREIVEQSWTAD

SEQ ID NO: 144210 - protein, 49 aa, Triticum aestivum
  Clone ID: PAT_TA_38628.pep
MGFLATSAIFFLAGFIACLFSLLCCNRGASTNIFHLTLVIYATVCCWMM

SEQ ID NO: 144211 - protein, 49 aa, Triticum aestivum
  Clone ID: PAT_TA_38629.pep
CSVVTTYYTSVVALIRTAIDFYSQRHDTERLYGNLLKTRTWPRNFTRVP

SEQ ID NO: 144212 - protein, 52 aa, Triticum aestivum
  Clone ID: PAT_TA_38630.pep
GIHGCSFSQILNDLLNILCSVEFTRANKWETQNYRPMWDTHQLARSTSRVGS

SEQ ID NO: 144213 - protein, 81 aa, Triticum aestivum
  Clone ID: PAT_TA_38631.pep
SKRTCHSIPRQKTSSRSIHCTSLDNVLYAKDGEIPILTHLEHIAGYPPFVIRLNAEQVSIANISEKLMTKMTHCEAPHYRP

SEQ ID NO: 144214 - protein, 99 aa, Triticum aestivum
  Clone ID: PAT_TA_38632.pep
VFNTPKSPRGTRCTYKSPGDSWMDIHFGPDTMKSQSWMDIPRAATCQIPIRVTWMLNLTSGLRHQATNRIPKRQKPHWKTKTAMQKMTTTTLICQILLL

SEQ ID NO: 144215 - protein, 77 aa, Triticum aestivum
  unsure (1)..(77): unsure at all Xaa locations
  Clone ID: PAT_TA_38633.pep
MGRRNGSMKRRGDQAALHAQRAAREGAMASKRIQKVLKDLQXDPPTSCSAGHVGEHMFHWHATIMGPSDSPYSGGLF

SEQ ID NO: 144216 - protein, 55 aa, Triticum aestivum
  Clone ID: PAT_TA_38634.pep
PVLRSRDVCDITSNELGTVMLSLGQRPSEEELREMIADVDTDGNGVVEFSEFLNL

SEQ ID NO: 144217 - protein, 49 aa, Triticum aestivum
  Clone ID: PAT_TA_38635.pep
NNHKESNFCRFQLTLYESRLLYPSSMPIILGLNSYPKQITMLFRTLEDI

SEQ ID NO: 144218 - protein, 36 aa, Triticum aestivum
  Clone ID: PAT_TA_38636.pep
YREVAVIRRHEVFFICLSLKLIESYQCTNVQHVIPK

SEQ ID NO: 144219 - protein, 72 aa, Triticum aestivum
  unsure (1)..(72): unsure at all Xaa locations
  Clone ID: PAT_TA_38637.pep
IXGATDGNTTLLHFVVHEIIRSGGFNSDKTGNVPDTVNPRVEQFKKDSLTVLARLSNVPSHMGKECTQRMAT

SEQ ID NO: 144220 - protein, 32 aa, Triticum aestivum
  Clone ID: PAT_TA_38638.pep
VASFGAYLMSRNIVKMSFAQEDTHQSQVQFAH

SEQ ID NO: 144221 - protein, 67 aa, Triticum aestivum
  unsure (1)..(67): unsure at all Xaa locations
  Clone ID: PAT_TA_38639.pep
TLEPGSESSSTTLVWPMSELMKNPEELAKAHMEVQKVLPRGHVVITNADPGEAHPXRLILTDALRLH

SEQ ID NO: 144222 - protein, 79 aa, Triticum aestivum
  Clone ID: PAT_TA_38640.pep
SADVLVNVAMPLAAIDYDRKLSTILPEIPLPQAEFDHCVVLHLLSSCFNVLYEVKLSNRIMMMSKHVIRLYVALASTPS

SEQ ID NO: 144223 - protein, 40 aa, Triticum aestivum
  Clone ID: PAT_TA_38641.pep
KSTVASVFPTNTVYIIEDYVFRSHVHLVHPSYTFVTFSTP

SEQ ID NO: 144224 - protein, 82 aa, Triticum aestivum
  unsure (1)..(82): unsure at all Xaa locations
  Clone ID: PAT_TA_38642.pep
RGRPARRTTLRRAAAYKRGRKNGKKSVDTYTIYIFKVLNHVHPDIGISSKAMSIMNSFINDIFYKPPGXAAKLARYIINPTI

SEQ ID NO: 144225 - protein, 47 aa, Triticum aestivum
  Clone ID: PAT_TA_38643.pep
SLILITMILFSASHPNLVGNHSLHHPFVTWDNAVVMEIITLLLIHNT

SEQ ID NO: 144226 - protein, 122 aa, Triticum aestivum
  Clone ID: PAT_TA_38644.pep
TILGPRNEALERDIDPEFKRFLLEPRNLKSFQTLLLYHVLPARHPAGSWPAASHPTLSGEDVEVAAGANGTMRVGHAAVKGPDAVLRPEGVIHGIERLLVPRSVQEDFNRRRSLAGISAVLP

SEQ ID NO: 144227 - protein, 82 aa, Triticum aestivum
  unsure (1)..(82): unsure at all Xaa locations
  Clone ID: PAT_TA_38645.pep
PNLTNFFFKKLKFDHIFFSCSNLTILKNSKQVVGCLHRMRIFVLNPLIYYTFFSDIVWQNLCSSARFLQXCPWTREFRPYGQ

SEQ ID NO: 144228 - protein, 51 aa, Triticum aestivum
  Clone ID: PAT_TA_38646.pep
FCVIKFLLLVLTIDDHCCTIYLVYSVTTFHCLFSFSTLLSIVGSSSIERSM

SEQ ID NO: 144229 - protein, 57 aa, Triticum aestivum
  Clone ID: PAT_TA_38647.pep
LRFEPFGRPPFFFFFFFFFSIFFFLFMFFFIFFFFFFFFLLSTHNMANAFIHLMNFP

SEQ ID NO: 144230 - protein, 84 aa, Triticum aestivum
  Clone ID: PAT_TA_38648.pep
ILLLRSAHDVSTSAYCRDIYQWTTNRYVCAITICGRINSTTKWPRANGCTRTVVIITLQNQVSYATCIRKFSVSISCTGLLRLE

SEQ ID NO: 144231 - protein, 84 aa, Triticum aestivum
  Clone ID: PAT_TA_38649.pep
FESTDCQKHCEHEQTLVKSHDRNYALNRRCIKDLIDANDDYSTKSLHNVQTATDCTVHNIFSFSYDGCSFYHDYRNEIIRSTCP

SEQ ID NO: 144232 - protein, 91 aa, Triticum aestivum
  Clone ID: PAT_TA_38650.pep
ERVEPGRESAGRSALGGSALEPTEWTTTPGCGGKPRQTVSKEAPVADGVPRAGVARARQLDARGEERWGGMHGHHGGWVVGRMARQVRPLI

SEQ ID NO: 144233 - protein, 111 aa, Triticum aestivum
  unsure (1)..(111): unsure at all Xaa locations
  Clone ID: PAT_TA_38651.pep
EISEGEEYDNPKASDAKKKQICEGEENGEDDEEEQEEHDGGGCDDDDDDDDDDDNEDDDDDDDDVAAEYDEDGVXEEDDDQDNDDDEEDDDEDSLQPPKKKKKLSPSKPLP

SEQ ID NO: 144234 - protein, 60 aa, Triticum aestivum
  Clone ID: PAT_TA_38652.pep
ISAKVDLALDAKYYYACPKRYRIVGNDHRWSPTASHKEDNQKSTSCNKFVTQLIPYLHAT

SEQ ID NO: 144235 - protein, 47 aa, Triticum aestivum
  Clone ID: PAT_TA_38653.pep
LLVALHHVIMPSSHLMYATHVIELYGSSVNLNRGIITMVISLYNISS

SEQ ID NO: 144236 - protein, 89 aa, Triticum aestivum
  Clone ID: PAT_TA_38654.pep
FGMVIMSLLCMRVQVAKASNPTQVEAKEVRLSDLAPMMLDDTDVETVSVIYSDCDYSSSYCVVKIEKGVRLIRQMSMCSSACMLSISLQ

SEQ ID NO: 144237 - protein, 60 aa, Triticum aestivum
  Clone ID: PAT_TA_38655.pep
GFRHVFHLCPPFYLCIASCHHAIMSFLFLTRLNKLHGCSVHLNRWIFTMVISHYNIPSQY

SEQ ID NO: 144238 - protein, 111 aa, Triticum aestivum
  Clone ID: PAT_TA_38656.pep
GATGGTNFVAVPNTARGHIGGALNTFVLQCQVINLYTVDTFHLLCATVATALTYKRRPEAYCGRIRTFWTGHAWQLVQELKNTKYTQTSRTRVLHIVCGPNLGKNSLALLV

SEQ ID NO: 144239 - protein, 77 aa, Triticum aestivum
  Clone ID: PAT_TA_38657.pep
LRTLRKLDPSISSYTYILHISSVSSNWSSISTSQAMLSYHEYIIGILEHGSWYRTVTSYSKLRVYLTRVYDFNTAWL

SEQ ID NO: 144240 - protein, 77 aa, Triticum aestivum
  Clone ID: PAT_TA_38658.pep
CVPSTRRTRRSLLTTPLPRPRARWFAGRGDGFEYSALSLSLALTVDVQQFNWCQIARSIMCTVVSSLLDLLKRRRAK

SEQ ID NO: 144241 - protein, 76 aa, Triticum aestivum
  Clone ID: PAT_TA_38659.pep
FLYTICLIFFSFSFSFSLTAFRSPFMPCLHATDALSALIIPGGFFNRSLFIRALCPTHVLSFGMYPLFTIICIDMT

SEQ ID NO: 144242 - protein, 51 aa, Triticum aestivum
  Clone ID: PAT_TA_38660.pep
DEKLRNGREAGRDQEVILKLLTFKHNPKHVHFPDSAEKRPSQLHTRLMHFN

SEQ ID NO: 144243 - protein, 151 aa, Triticum aestivum
  unsure (1)..(151): unsure at all Xaa locations
  Clone ID: PAT_TA_38661.pep
DMFFVYEVXTELIVNGYVDASFDTDRDDSKSQTGYMFILNGGAVSCCISKQSVVAVSTCXAEYIAASEAANEGVWMKEFISDLGVIPSASGPMKIFCDNTGAISLAKESRFQKRTKHIXERRFNSIRDQVQVGDIEICKIHTDLIVADPWT

SEQ ID NO: 144244 - protein, 30 aa, Triticum aestivum
  Clone ID: PAT_TA_38662.pep
PRTTCVTHKLHPTSSSLYRLIALHDTYRYD

SEQ ID NO: 144245 - protein, 63 aa, Triticum aestivum
  unsure (1)..(63): unsure at all Xaa locations
  Clone ID: PAT_TA_38663.pep
CACMPWSNVGWRNQXVKCXRGALAASEDPSLFTLAITSLSKFNLFHXNSSVRFDQQMQHCRCV

SEQ ID NO: 144246 - protein, 92 aa, Triticum aestivum
  Clone ID: PAT_TA_38664.pep
TWSSRLLRSPDSASSGFGGSMGSPVRWNMAAPFTGTRSSECIVWLLCSSGCLGGTNLPHFLLALFLGTTWRTFPNPWPSVPELSSVRHSRPD

SEQ ID NO: 144247 - protein, 39 aa, Triticum aestivum
  Clone ID: PAT_TA_38665.pep
RGRETRTGYLVKWIIDNASDRCEQYTTTKEKNHETSQIK

SEQ ID NO: 144248 - protein, 49 aa, Triticum aestivum
  Clone ID: PAT_TA_38666.pep
YRRSDGVTSSAQEALHKDGYCPPRKRQLSLGGLQPSNLVLRAMTRPDSP

SEQ ID NO: 144249 - protein, 76 aa, Triticum aestivum
  unsure (1)..(76): unsure at all Xaa locations
  Clone ID: PAT_TA_38667.pep
ENGEDAEEDQDDQEGGGRDDDDDDDDYDDHNDDDDYDDDDVAAEDDXDMDXQHDDDDDYDDEDDDDLLQPPIKRMK

SEQ ID NO: 144250 - protein, 70 aa, Triticum aestivum
  unsure (1)..(70): unsure at all Xaa locations
  Clone ID: PAT_TA_38668.pep
WCSAGRRTWPKTPGLPVRLPKRKVFKPIDSQLLNHNKSPTNPGYPNVQNYRMKLXEKCCGPLTTKGFLLL

SEQ ID NO: 144251 - protein, 75 aa, Triticum aestivum
  Clone ID: PAT_TA_38669.pep
RGHGKLMVQLCCAEDFPARDTSGRNNRCLCCAETEAVEQEDWPFAPAARVSSTVYLVSERSNKRTSPLISLGELL

SEQ ID NO: 144252 - protein, 86 aa, Triticum aestivum
  Clone ID: PAT_TA_38670.pep
GPRGKMKIIFEGYPIVYLLVALGGNTYCCVNSNDVTYSCNVTNMHSISIGAIKTMKQKNRGKIEPISLGLFNLCGPSTINAMRWPN

SEQ ID NO: 144253 - protein, 154 aa, Triticum aestivum
  Clone ID: PAT_TA_38671.pep
SPATSCQDFAAARSHHLASRCSFTMVHHQSPLERSSAASHHWSRTSCRRRRNTSSWGWRHTTQNTSAASFTSILMMASPAVHRSSQRHLITVLSASHGRHGSVALPSPPSGITPQPPVRAASHRRRPPCRGRRRRSAGHHHASSCRRGPGNLGP

SEQ ID NO: 144254 - protein, 88 aa, Triticum aestivum
  unsure (1)..(88): unsure at all Xaa locations
  Clone ID: PAT_TA_38672.pep
DTRDGGKLCTGRSAEAVQPINLLPKGGKKELLLEPFVNPKEQIQNGLLQPCGLTLQDHLRLGTNKTGITHALFLLMYTVVYNRHXKRK

SEQ ID NO: 144255 - protein, 74 aa, Triticum aestivum
  Clone ID: PAT_TA_38673.pep
APDGWLFLTHVTGSNYGGARASPRASPPSRSQTLVAHTQQPHRAAVDITVLSPRLGSAATGSAANLIHIHWFQQ

SEQ ID NO: 144256 - protein, 62 aa, Triticum aestivum
  Clone ID: PAT_TA_38674.pep
SPLLGLPNLREVIAAAAGDAGQVQAAHTFLEMKRTRLPKAIFSAEVLAPAPLVSSVRASSQS

SEQ ID NO: 144257 - protein, 47 aa, Triticum aestivum
  Clone ID: PAT_TA_38675.pep
RNYYSLKPFLEQGMISQIINSYPSVTSLIVQLRRNLPRIRSELVSMP

SEQ ID NO: 144258 - protein, 65 aa, Triticum aestivum
  Clone ID: PAT_TA_38676.pep
PVCHNGRIWATNISKIKRMSTSSGSDSRYVDVSRHYSRQEVHDCKKGERSQISSSHGVNDGEITS

SEQ ID NO: 144259 - protein, 99 aa, Triticum aestivum
  Clone ID: PAT_TA_38677.pep
GRKKKERETKRVDFSQRGASFGFSVHYKKTFQLPRDLSYTHRAWQKFIHRLGSFPQPASRRAVTRRGVAWCGEAGGGGGVRVDVPLVLILTHVGKEPPL

SEQ ID NO: 144260 - protein, 82 aa, Triticum aestivum
  Clone ID: PAT_TA_38678.pep
SWLLYLQSLKLLKDAIFDAECAPLFSLEVYGHIIGMFELNNLDLVVASPVEDYFIHIDDLPDDKKVCLMVALFLSCKDARGP

SEQ ID NO: 144261 - protein, 55 aa, Triticum aestivum
  Clone ID: PAT_TA_38679.pep
EKYYAIKDLSELIIQKDSTLYHSLTFLGNFYNSGKLSVLKQQHVYLQNKHGKGYP

SEQ ID NO: 144262 - protein, 40 aa, Triticum aestivum
  Clone ID: PAT_TA_38680.pep
KILISIHPYIKTMIKYQVDGNIQLTSYDSINYTQLGGSSL

SEQ ID NO: 144263 - protein, 48 aa, Triticum aestivum
  Clone ID: PAT_TA_38681.pep
VAGVFGAPVNVVGKGVTQAKDPNRGIEAGCTATDPIWRTDANRTVLRH

SEQ ID NO: 144264 - protein, 97 aa, Triticum aestivum
  Clone ID: PAT_TA_38682.pep
IALKTYIANYIKKRKQIEVEENTNEREETSQYSPIISYDESGNEEEPYIQPISLIRSSKKRIEPTHDVKKKKKRWRRKGRKVSLPNDVAPITHCDDD

SEQ ID NO: 144265 - protein, 85 aa, Triticum aestivum
  Clone ID: PAT_TA_38683.pep
GHIGSRSISEIPKIPKPSSMCLSETDNANDTKDKTQRLHMPAGALVDISNFMGTHSGNIDHAVNEKRRIEGRNTASSFKRPRSSR

SEQ ID NO: 144266 - protein, 88 aa, Triticum aestivum
  Clone ID: PAT_TA_38684.pep
GTREILGKPSMMNSSIAYHCIPRRVCPEHTWRISINHLCYYRSSQTFLITDLVAVYHTHLVKLNRFCSLGSTQTVHLSELYAVYRTHL

SEQ ID NO: 144267 - protein, 54 aa, Triticum aestivum
  Clone ID: PAT_TA_38685.pep
GIYRIIRWCITTMPVELMFVSAREIVTPAHNSFFDALENNNYWYIILYQSRLVK

SEQ ID NO: 144268 - protein, 109 aa, Triticum aestivum
  Clone ID: PAT_TA_38686.pep
YIKQKEARTVVSTYVGVTPHLVRKTMGILKKTTSSLSFFLAAFIVVMVATLLFSSCNPRKEKDKPTASPLSGKCFSRFFPNCTKQQCTKFCVQHSPGAVCIDKTTVAAL

SEQ ID NO: 144269 - protein, 65 aa, Triticum aestivum
  Clone ID: PAT_TA_38687.pep
EGCLMLSPSARDYWLSSSLLTHHPRCTASYPFFFSSVSSPSDTYIITLKVEFTYSKCIALSASTP

SEQ ID NO: 144270 - protein, 133 aa, Triticum aestivum
  Clone ID: PAT_TA_38688.pep
GQCESERRGRTVLCTCVGVSPQLVTAHTVIVKMTTISMSIDIVALTLVTGASLLFSSCHPLIDIDTHVDSPMSEKSLTRFFTHFTHHLYITYRIQPLTCAICIYVYHCCCATAYLYPSLSQSGYHQVLVKDGN

SEQ ID NO: 144271 - protein, 40 aa, Triticum aestivum
  Clone ID: PAT_TA_38689.pep
FGIVTIIYSCMITDCCCRAGEFIWFRCYISTIFSAVLKQP

SEQ ID NO: 144272 - protein, 101 aa, Triticum aestivum
  Clone ID: PAT_TA_38690.pep
AFFFLESNTHSFGLEQGLPGITTSSEDYFTDAGITTSSDFHTTFGLLASCYTDLCKIISVCEKYLFRSKEDESCRNQSLHIYLVASFMPSGSISFPGSVVR

SEQ ID NO: 144273 - protein, 75 aa, Triticum aestivum
  unsure (1)..(75): unsure at all Xaa locations
  Clone ID: PAT_TA_38691.pep
WAQRVFWVFFRLWFSRGATPFYHFPGFWRVPRRFSGFWFSRAGPFWQVPWRLPGFWLTKAGPFLAGCXDAFRSLA

SEQ ID NO: 144274 - protein, 83 aa, Triticum aestivum
  Clone ID: PAT_TA_38692.pep
GLFFFGGGASLASFFSPENFRPRPPLRHTHFNSNSTTAYTLRYHHRFLQEPPSLHRYHPRQFWPVFVFENLSCGFVSYCVSAI

SEQ ID NO: 144275 - protein, 52 aa, Triticum aestivum
  Clone ID: PAT_TA_38693.pep
YVKYWTDRPSTGCGFQGFMQWDLIGTMLRSVWDMTCNDGTCATLRTQYLQES

SEQ ID NO: 144276 - protein, 69 aa, Triticum aestivum
  Clone ID: PAT_TA_38694.pep
RVRRACQLSQQTILATVTFGFESNGPAASSIAALHAPAAQTSAGENACSCLQWPAVLPLRPHRPYYSHC

SEQ ID NO: 144277 - protein, 96 aa, Triticum aestivum
  Clone ID: PAT_TA_38695.pep
LIKHGHTLLNPIVGRVDIFGIYGPCPVGTGTVLISDSILLVNTRDADLGHDNTTTCCKLHLRVRGWSILLRQILFILLLLLKMYKMNLNEGLCKLS

SEQ ID NO: 144278 - protein, 60 aa, Triticum aestivum
  Clone ID: PAT_TA_38696.pep
KSKHNHNAWAKLAPMKVGQGQRDSSPLHQAARPNKNMQPGNGDLPQEGMNGNFLKKGPLG

SEQ ID NO: 144279 - protein, 47 aa, Triticum aestivum
  Clone ID: PAT_TA_38697.pep
LMSNYKRCKNCYHLSRLTSSMRYAGKMCELTWYLLVFYAIVIIDVLR

SEQ ID NO: 144280 - protein, 47 aa, Triticum aestivum
  Clone ID: PAT_TA_38698.pep
GRHQRGLWLHRVGYRERNLHIRITKLSFHVKESPIRIRDEVFYLVSS

SEQ ID NO: 144281 - protein, 138 aa, Triticum aestivum
  Clone ID: PAT_TA_38699.pep
RVQPRYADVEPAKLCGGCVDLGVGGGGVALEPAGQTHNRWRGWCGREREAVTVGRGGGGAVRPDGIILVEQVAAPRLLTGLQFPPLSSSRSSFVWTHLFVRYCVSSGGHLFRSAFPLNLRGEGLEEVHATMDCLDEIS

SEQ ID NO: 144282 - protein, 85 aa, Triticum aestivum
  unsure (1)..(85): unsure at all Xaa locations
  Clone ID: PAT_TA_38700.pep
GTVKMYMDNKSTIELSRNQFNKKQVSTTTIRFNTILNSIKEGLLTMIMLATIEQTSGQRPWGRVKVLGRCDFKLGVMEVSXGTQD

SEQ ID NO: 144283 - protein, 110 aa, Triticum aestivum
  Clone ID: PAT_TA_38701.pep
FAGSREENNERSNLGGALAPLGTMDTEYQGENLSTSRGMEEQARGGPSLPSLSMASECHRGNHLRSNRLYQHHRLHHLPNLFLAVHSPATRCNPLLEYGALCYILLPNYV

SEQ ID NO: 144284 - protein, 54 aa, Triticum aestivum
  Clone ID: PAT_TA_38702.pep
KLRNGKNPGFPKLNPLEENPPFPTWLNTKKAPTVSPSKNLPTLNGKWNPPCTGP

SEQ ID NO: 144285 - protein, 40 aa, Triticum aestivum
  Clone ID: PAT_TA_38703.pep
TSYACVCKLLSLQRAALSFFAGEKASFSIQYLFYLFELPV

SEQ ID NO: 144286 - protein, 40 aa, Triticum aestivum
  Clone ID: PAT_TA_38704.pep
PLIRRYRPRTPSSESGVNCNRIAWHVQSSPSISAPRGPGM

SEQ ID NO: 144287 - protein, 76 aa, Triticum aestivum
  Clone ID: PAT_TA_38705.pep
WRLRTRFQLEQEEHNHIFSGYYYKPSLPHEETQVSTFHLLVWGKTRVSHPNESSYHVSRYRSSKASCRCVGTCRVM

SEQ ID NO: 144288 - protein, 30 aa, Triticum aestivum
  Clone ID: PAT_TA_38706.pep
SQPSGQSELCPHRRSFTWMRCSPRYHQLNI

SEQ ID NO: 144289 - protein, 73 aa, Triticum aestivum
  Clone ID: PAT_TA_38707.pep
RNSQEASPDGHNTPGYARLSWRAQVSCAHLGHLLYFIFLPCTCPARLKIYINLPNMLTTISRRNPLFSFLAIF

SEQ ID NO: 144290 - protein, 82 aa, Triticum aestivum
  Clone ID: PAT_TA_38708.pep
ANEESITSHVRILMITTTVTKLLNRSHIYQIPSGTLQRRQDNEVRVTGFTFGPENLSLNLLPILANLKSLEYDSTLRPPFPV

SEQ ID NO: 144291 - protein, 96 aa, Triticum aestivum
  Clone ID: PAT_TA_38709.pep
TICMRIAVANCWSHVRCARGWRELAACYLYGWTGHASACKAQPGGSRGHAWIWIVHLMVSLMRELFAECARRVVCVHRYKKPSVYVLLELNRCVTM

SEQ ID NO: 144292 - protein, 129 aa, Triticum aestivum
  unsure (1)..(129): unsure at all Xaa locations
  Clone ID: PAT_TA_38710.pep
STGPLHGVDKENTDILMYCTGGIRCDVYSTILXEKGFGKLYTLKGGVSNLLKTKGXAEWVGNLFVFDDRLSLPPAKFAXAEVAAEEGGADNGDLSSSRWLGRCYLCGSXVEELXQRNCASIDCNRLYLC

SEQ ID NO: 144293 - protein, 98 aa, Triticum aestivum
  unsure (1)..(98): unsure at all Xaa locations
  Clone ID: PAT_TA_38711.pep
CVSSSSSMASPPLFPQHRRRXHRHLVLCETCASSGPRCGSFAHLSRSFWSPEFPPTSSFAVPLACAGGSLVFSAPRLRTRPRSSSLNQPATMAVAMSS

SEQ ID NO: 144294 - protein, 94 aa, Triticum aestivum
  Clone ID: PAT_TA_38712.pep
WNLYKDLYLGMEGVYSNDGLPQIALGLCDAHPLSFFLSFHTLIALVHPLHGNPYSLTLISVDGHLHRPLIHLVDVRVVNSMVIWAFFLDLSCFT

SEQ ID NO: 144295 - protein, 131 aa, Triticum aestivum
  unsure (1)..(131): unsure at all Xaa locations
  Clone ID: PAT_TA_38713.pep
MAILLAFLLLISYGTGNIHGSTTVNHGNNTDMLSLLVFKAATNDPTGVLRSWNRSVRHCDWTGVICSSPNFRRVVALRIPGQSLSGEATKLXQLDFREHELRGNIPEVFGQLSQLSRLDLGYNNFQGVIPP

SEQ ID NO: 144296 - protein, 58 aa, Triticum aestivum
  Clone ID: PAT_TA_38714.pep
FTNMTKVKSFKSYVFGQAEVATVNANVSLDDYQSRTGIHHRLDQAEVAGAQKRSSPPV

SEQ ID NO: 144297 - protein, 56 aa, Triticum aestivum
  Clone ID: PAT_TA_38715.pep
WLDFLFAIEDRDMVVEPMSATGSTQPRRPSIRSSPSASSKSVTACNLVPDQLPCQH

SEQ ID NO: 144298 - protein, 90 aa, Triticum aestivum
  unsure (1)..(90): unsure at all Xaa locations
  Clone ID: PAT_TA_38716.pep
ENMTNKELHDKFQQMMSEHVQDVLNRFEEAMEKIDGMEKKFETKLNXSFNELLARLPPPPPAGPNAXLQQQTTTSTNNVVFPNQVGTSTT

SEQ ID NO: 144299 - protein, 131 aa, Triticum aestivum
  Clone ID: PAT_TA_38717.pep
TIEFRWNLLERIKRNSEDWELDEGKESGIKLKYDCVKSLIDTDAFQKFSTKYGLDSEIVASFCESFATHIELHKEKWFKYHPPIKEEIKELVLLKEETILYNVDPVVPSAYIEKPHLSVLGLRNMLKFQLC

SEQ ID NO: 144300 - protein, 64 aa, Triticum aestivum
  Clone ID: PAT_TA_38718.pep
VGVSSSFTFPFWITNNICNFCSIHLIAESLYCRNCYNRFTHELLCWHQIFCWCVHYLWIGMFVY

SEQ ID NO: 144301 - protein, 52 aa, Triticum aestivum
  unsure (1)..(52): unsure at all Xaa locations
  Clone ID: PAT_TA_38719.pep
RNVCIVEIVITGSFMSXFXSGKCNTAIFNQTLHSNLVNSIHHPLPHFYHIQT

SEQ ID NO: 144302 - protein, 81 aa, Triticum aestivum
  Clone ID: PAT_TA_38720.pep
NPCCQLSRSSSSPGFSIQPRSVTPPEGQLNLVSRYPEPTQILFLFFGKTNKSNLRNKPDEPISNKEHTKRGRSRILTLNDS

SEQ ID NO: 144303 - protein, 50 aa, Triticum aestivum
  Clone ID: PAT_TA_38721.pep
LGNFNLRYIALCHISQGLYETCIHTTQLLNGCSVEFNLHVVSTMQVPVAP

SEQ ID NO: 144304 - protein, 91 aa, Triticum aestivum
  Clone ID: PAT_TA_38722.pep
GTILIRCYSPSLSSSCFLARPSSFLDRSRFCFKVLTSAVSAAEVSSAACNPILTYFYDSCVYLLRSSVRLLFPNTEPSIRGYCLCGTTRGP

SEQ ID NO: 144305 - protein, 61 aa, Triticum aestivum
  Clone ID: PAT_TA_38723.pep
CACESPCVLVRTPLTAPQPIKTSLLWMSRNGETSLVLLRPWSLLLGYMSSKTPPIGHGGMT

SEQ ID NO: 144306 - protein, 47 aa, Triticum aestivum
  Clone ID: PAT_TA_38724.pep
ARTLQLPITEPAVMYTFLYIQVAGFHQVENRSTFIIVDCRKPVEFPR

SEQ ID NO: 144307 - protein, 66 aa, Triticum aestivum
  Clone ID: PAT_TA_38725.pep
WFLSCVDAWSVDTRAFARLCAIGVSTCHYGTHCFVSYCVRPVLALLQNVSIECLACWFVTDHHYFV

SEQ ID NO: 144308 - protein, 44 aa, Triticum aestivum
  Clone ID: PAT_TA_38726.pep
WDSKLDWNLVARLNLIAYFPKFRRNQHNVHSHIDCPKPSVCEME

SEQ ID NO: 144309 - protein, 56 aa, Triticum aestivum
  Clone ID: PAT_TA_38727.pep
RVIKIIEDVQDNIIVCEKFPPYTNHSRISCMINIVIVKLQKISLSKPNVKPILSMI

SEQ ID NO: 144310 - protein, 81 aa, Triticum aestivum
  Clone ID: PAT_TA_38728.pep
TCREVQVLHAAHFRRICFAIKAERMISPFLKLLENDQESEKTINMKKFRIFRSFSTVYYLPHSDKLCRKYGKKYVFNHFQN

SEQ ID NO: 144311 - protein, 141 aa, Triticum aestivum
  unsure (1)..(141): unsure at all Xaa locations
  Clone ID: PAT_TA_38729.pep
GSHLSGSTAVNINGEIGPFFPTLCGVQQGDPFSPFLFNMVVDALATILDKAKAASHIRGITPTLPEGPGFPSSXYADDTIIMVEGSEANISNLKFLLLYFQQMSGLKINFDKSDVMVMGXEECLAIANRLNCRLGSFPMTY

SEQ ID NO: 144312 - protein, 80 aa, Triticum aestivum
  Clone ID: PAT_TA_38730.pep
VIAEDPNLHDIAVQSEIASTHSVGLALSAYRVSHGIRLFLGRHMEPQLMQIALLPRLWYGLVKQLLVRLVHQQFYVVQLL

SEQ ID NO: 144313 - protein, 70 aa, Triticum aestivum
  Clone ID: PAT_TA_38731.pep
ATKNRGATIYFTSRFDFGWFSRCYYFPLGRKILGGGNGFFWWNQPQVNGHGGNTPPYYPIYIFLVIILSP

SEQ ID NO: 144314 - protein, 126 aa, Triticum aestivum
  Clone ID: PAT_TA_38732.pep
GRNYGSTGITAKRPWNGDGVLGPQGSSGGLVSPNGTPAGNPFARGPGFYKLRSPSVLEALPFRWNRDIHRCLKVSDGQLRYVQIHGASEKPVVSIWTLSSSDSSKATWGSPTSLPLDVVLGRQQLQ

SEQ ID NO: 144315 - protein, 39 aa, Triticum aestivum
  Clone ID: PAT_TA_38733.pep
VHGQHKKEGEHNEGMMEKIKDKISGNGNCDCKKDGNHMN

SEQ ID NO: 144316 - protein, 75 aa, Triticum aestivum
  Clone ID: PAT_TA_38734.pep
KSMNPYLLVVIEATGNAHLISHLLNWTRQASICYCCKLGWSDRELGTENMISCTDISSPILFSPLTCSSSVSVAP

SEQ ID NO: 144317 - protein, 124 aa, Triticum aestivum
  Clone ID: PAT_TA_38735.pep
SRVHGQIGMSPAEAAEYNKYIIREVSSGSGTPLMPKRKFETYIFTLFNEDLKPGPVAERNFGMFQPDFTPMYDIGIMKDPVKTTSAPASVVPAVPQKVTAMPMVAAANALEAGVPTKANDSNNA

SEQ ID NO: 144318 - protein, 77 aa, Triticum aestivum
  Clone ID: PAT_TA_38736.pep
GENRKDCEHKEGMMENINDKISGDGHCDGNKDGDHKDMNDKTIKKDTKHGEGHKDDYDHHTTIISSHYHSTIFLGVK

SEQ ID NO: 144319 - protein, 74 aa, Triticum aestivum
  Clone ID: PAT_TA_38737.pep
PRGAIKNMLSLRWPVSKSNPSQEPTCRGQWKQFKLMGNCGRSQGQGYLHNASHVLTYSACAIHTTHGHLHKWHM

SEQ ID NO: 144320 - protein, 55 aa, Triticum aestivum
  unsure (1)..(55): unsure at all Xaa locations
  Clone ID: PAT_TA_38738.pep
GRGENAXDSDLQLERINVYYNEANRGPFVPRAVLKDLQPRNMDSVRSGPLRQIFR

SEQ ID NO: 144321 - protein, 71 aa, Triticum aestivum
  Clone ID: PAT_TA_38739.pep
YFERYTFIVNITTKKWQNLQGKKHKRRFQTKMVNLRPPLQQTTINQWLAQNNDCLKLTKFPGGVLFAIILI

SEQ ID NO: 144322 - protein, 57 aa, Triticum aestivum
  Clone ID: PAT_TA_38740.pep
GPRRRRQWLRFLDRQGGSDVQQQISFVRSWYYSVLSSSDFPLKIAGASVRCWCDMVM

SEQ ID NO: 144323 - protein, 79 aa, Triticum aestivum
  Clone ID: PAT_TA_38741.pep
SRVHRFYDSLYLDESVISCKAKLAAATMTNLQRTSDDSTQVEMPSTPIVSWPGCIYRNYEVAVSHVPIVSSFPGIVVVN

SEQ ID NO: 144324 - protein, 67 aa, Triticum aestivum
  Clone ID: PAT_TA_38742.pep
YESVLSCKFNLTAATITCLDRTSDDSSQVELPRRAIVSWPDCLDTTYDVAVSHVPIVSSSPGIVVFN

SEQ ID NO: 144325 - protein, 110 aa, Triticum aestivum
  unsure (1)..(110): unsure at all Xaa locations
  Clone ID: PAT_TA_38743.pep
GLSQQFVGAFIXGQKPHGQESDLHLLAHKEGEPLRKYIQRFSSVQHNIPNVHPAAVISAFHQNVRNRRMRDEMAMCKIKDVSELYALADKCARAEEGRRPPGEKCRSGRI

SEQ ID NO: 144326 - protein, 67 aa, Triticum aestivum
  unsure (1)..(67): unsure at all Xaa locations
  Clone ID: PAT_TA_38744.pep
YSEKFPFLSSAYAKAAIYHSEWAPSGITANRRAVTCPTGNGQVMSRQXGCNKYSPLRVIWSQRFFIL

SEQ ID NO: 144327 - protein, 74 aa, Triticum aestivum
  unsure (1)..(74): unsure at all Xaa locations
  Clone ID: PAT_TA_38745.pep
RGSTGEWEPMTESWGSIWRLDTRRPMQGRFSLRSTNESGKTLVAGEAHPXDWDPNXIYSSITPVRLIFFSRSII

SEQ ID NO: 144328 - protein, 118 aa, Triticum aestivum
  unsure (1)..(118): unsure at all Xaa locations
  Clone ID: PAT_TA_38746.pep
VHGILGEIIDHTEXILKTGMSPASEKNLVEVLLGLHGNEDFGFPITRSTVKAFILNIYAGGTDTSXMVWVTAELMMXSKVIRKLQEKIRAXAFREINLRTSGSCIKYLGLVIKETFKL

SEQ ID NO: 144329 - protein, 73 aa, Triticum aestivum
  Clone ID: PAT_TA_38747.pep
QCWRKRYNLRAKLTFSREIPITDLVGEFFGKVNRAGPFSTTSYCQKVIFFKGDKVGNVKGFPDSMFLNEGRLI

SEQ ID NO: 144330 - protein, 83 aa, Triticum aestivum
  unsure (1)..(83): unsure at all Xaa locations
  Clone ID: PAT_TA_38748.pep
FSENFGLKRRGVSGFVFDFGNQLILWTAKDCWNQKRTQTRKHEWESRWILKTNLICKEXGLVVDIWWWYMAAVVVAVVVYGYG

SEQ ID NO: 144331 - protein, 129 aa, Triticum aestivum
  unsure (1)..(129): unsure at all Xaa locations
  Clone ID: PAT_TA_38749.pep
STGRNGKRSVVEVLRRRLLEEPLVARRREQMIGTGRRLLHACDALASSTAFLILARVGFLRFPRRETDVXEEMGSLCVVFDPHRILVPLPPYIHYFFLHPFLVGCTSSTREMNTSLLCCHCMQLNIYTE

SEQ ID NO: 144332 - protein, 81 aa, Triticum aestivum
  Clone ID: PAT_TA_38750.pep
PHRECMHNGFHVGQNFECFYGFVCVWGGVRVQGTCHIVHIVQLTLCIDFWVKNERNNATNLNVTFGMYLTKYPWPRECSDR

SEQ ID NO: 144333 - protein, 66 aa, Triticum aestivum
  unsure (1)..(66): unsure at all Xaa locations
  Clone ID: PAT_TA_38751.pep
LLTNRWRPXTPSPAAFHSATSSSKITDSYFFCFISTCKLLNWIRRGNCICNYLGQAIPSLSRYPAG

SEQ ID NO: 144334 - protein, 63 aa, Triticum aestivum
  Clone ID: PAT_TA_38752.pep
SKRVISCRAQISETLDVGFRDFLNGNLMALCCAVIWKFSTRTVHVKFSYVQVICSNLAIFEIT

SEQ ID NO: 144335 - protein, 74 aa, Triticum aestivum
  Clone ID: PAT_TA_38753.pep
TCSRTRWVGFPRPPKTSQTKGQGPMGHQCTFLASISCQNSDKSTPSIRDTCSSDWINKSSIFPHLGKIVSSPPS

SEQ ID NO: 144336 - protein, 83 aa, Triticum aestivum
  Clone ID: PAT_TA_38754.pep
IAIMSLMNCCATAVSSLWLSLSLWCRSTTQLPRVPAMSIPHTFRAVSYSEQMPSSEQPADVHIMVLSRDDSMIDCHAAFHRCV

SEQ ID NO: 144337 - protein, 96 aa, Triticum aestivum
  Clone ID: PAT_TA_38755.pep
GETMCRITFPTTYFNSLSIMLPPWILSNSSAFEDCLHVRRLHTFPWYFIALIYFHQNYLSSYSIMVFLYGSDIYCHASFHCSVYYDTLHHCYLALP

SEQ ID NO: 144338 - protein, 54 aa, Triticum aestivum
  Clone ID: PAT_TA_38756.pep
MFTLCGLILEARENLFQDFWSPFSISPSFCSARTKKTRTEFGPYPSATPPGGSV

SEQ ID NO: 144339 - protein, 36 aa, Triticum aestivum
  Clone ID: PAT_TA_38757.pep
GFINKSVPGIILNGITDSFEFRNHLRIGKINCCPKE

SEQ ID NO: 144340 - protein, 128 aa, Triticum aestivum
  Clone ID: PAT_TA_38758.pep
MIICLLTLITSCRGRLKELKLKAFIWIFTGALVGFTIPGFAYIGLGDTSPGYAVNFYNIIPIAAFILAVLFRKEPLDMTSLVGNIRFIGTLVCVGGTLVITRYKGNVLHLWPTNIIGYHPKQARTAFG

SEQ ID NO: 144341 - protein, 88 aa, Triticum aestivum
  Clone ID: PAT_TA_38759.pep
FKNFLYLVPGALTTMGGSILHKTSSLADAISLLIVELERQFIHMHPSIQGIFLEFSNIEHSSVKRAATIFLAHEFIFIIKEASEIFAH

SEQ ID NO: 144342 - protein, 87 aa, Triticum aestivum
  Clone ID: PAT_TA_38760.pep
AWGCPQNASPLSSSFIGNFTWSYNFILHMISVLLGASCIILLIALYFTIIILCRTHPYGIQPTLIIICWNTLCASLISFELDSFWSN

SEQ ID NO: 144343 - protein, 146 aa, Triticum aestivum
  unsure (1)..(146): unsure at all Xaa locations
  Clone ID: PAT_TA_38761.pep
KVLFIGRQRTGSEYVMFIGSQPAWTEQPMETRPGVPQNGGNDLVFDRHGQNRILFIGRGLAYHKREETDLCWTXYGRNRVLLIRRGVAYRKTEETDMCWSIAVKTGVLFIGRGVAYRKTGLYGILFISNIDLLQPPHASIHPPSTR

SEQ ID NO: 144344 - protein, 53 aa, Triticum aestivum
  Clone ID: PAT_TA_38762.pep
LTGTDAVLDAQNRRAFLHRMGANEHVTTHQMEFRTFLRRTINCHLKPFITLTH

SEQ ID NO: 144345 - protein, 130 aa, Triticum aestivum
  Clone ID: PAT_TA_38763.pep
PYNHDVRSCWYTIRMRNKSQGKKCYPQQPISPSSPRRREARRRRGGTGDGRRRRNRSTKQKEGAALTEALRPRAYGGEIDALSPAAGWGRWRDRCSSRHLVVSLSPRICICERDLTITTSQPSQGRPIKT

SEQ ID NO: 144346 - protein, 84 aa, Triticum aestivum
  Clone ID: PAT_TA_38764.pep
GSTGFFLTLKEIIYESPSSRMFRRGIMATQLLATWTIVYHLLKCGIVVHLVNLRHPFLSTPLDAYLVSQPERWFYVSFRELFDL

SEQ ID NO: 144347 - protein, 82 aa, Triticum aestivum
  Clone ID: PAT_TA_38765.pep
WGLCHCCLFSLPLCYASAKQATSQTCVVITCSDGSYVYYVVSLCISHTMCFILKTTEYNIHGFTRYCNALRTNLVMQLTHRL

SEQ ID NO: 144348 - protein, 64 aa, Triticum aestivum
  Clone ID: PAT_TA_38766.pep
FDVNRLQMNSRENGTQHSQCRVCLLAHLFWAPLLRIDLSDQLAWFGGCKYTTEDASCDKPALVC

SEQ ID NO: 144349 - protein, 54 aa, Triticum aestivum
  Clone ID: PAT_TA_38767.pep
RAPTGSDQYSAGYAQRESKKEREREYILRPHTTRKRPTNGAPVLPTNGALPVRH

SEQ ID NO: 144350 - protein, 78 aa, Triticum aestivum
  Clone ID: PAT_TA_38768.pep
KYTNSLKVPWARKAKKLIQNVNVRTRSSVRCQSENWTLEKKVLLPCFNMTHPISKLQAGQPTASTSYPESRVLLTRPV

SEQ ID NO: 144351 - protein, 53 aa, Triticum aestivum
  Clone ID: PAT_TA_38769.pep
AGRLGHQQYQYLMYLRIIQIALPYSCAFLGYLERRHLRGQVDRARAWSITSRT

SEQ ID NO: 144352 - protein, 76 aa, Triticum aestivum
  Clone ID: PAT_TA_38770.pep
IEFCPRMSSPPCPALILPSPSQQMHVRSADADPLLMRRLLPPKNYDSLRRRYWQNSKRRMNGDCQVRYGNVHWCEL

SEQ ID NO: 144353 - protein, 67 aa, Triticum aestivum
  Clone ID: PAT_TA_38771.pep
ESSLNFVHAHGNSVNLDLQKISNKNNYPFGQFQPIKKIMVQRLALRSLKCLVVCTVQGKNLGCNAPI

SEQ ID NO: 144354 - protein, 78 aa, Triticum aestivum
  Clone ID: PAT_TA_38772.pep
GNGKVECRNRTPNVSLSRRKILQHETLQPQRVSTLNVLANSHQRAMMNKGYHYMHIWLVESSMVTVFAKSQFFPTTKE

SEQ ID NO: 144355 - protein, 65 aa, Triticum aestivum
  Clone ID: PAT_TA_38773.pep
FAGWNSTCLPINLCSGCNFGTVNYYLLCENKNDKREYTVRSRRSDGCLRRYACNLSDIPSRDPLT

SEQ ID NO: 144356 - protein, 119 aa, Triticum aestivum
  Clone ID: PAT_TA_38774.pep
KVVFIHNLVAKSHACNARVPYSSLNGVSVLSSAELYNSETKSWITLPSMNKRRRMCSGVFMDGKFYVIGGMASNTEVLTCGEEYDLEKGTWRLIENMSEGLNGASGAPRLVAVIDNELY

SEQ ID NO: 144357 - protein, 58 aa, Triticum aestivum
  Clone ID: PAT_TA_38775.pep
HRSQFLQYCSQFVQQRQEVIVIGKGHQAKGVPLCGKVQCSTIPRQLKTGSVGHRILGA

SEQ ID NO: 144358 - protein, 50 aa, Triticum aestivum
  Clone ID: PAT_TA_38776.pep
NLLYCHPALRINAKYRSCGFLNFFLMGSKVLFFRRNKFNYHHILSYPCTR

SEQ ID NO: 144359 - protein, 126 aa, Triticum aestivum
  Clone ID: PAT_TA_38777.pep
GYITCPILNWPMVAASVDTVSFMKAPSWCPYSFELLRVKTQSLGSDGGGYQWSFGTILESLFRRFPSHLSSEDWRTPLAPSGSSSRMCSGFVVIGVVWRCSAPLYLALSVCVVCGGGVSLYRRDAL

SEQ ID NO: 144360 - protein, 60 aa, Triticum aestivum
  Clone ID: PAT_TA_38778.pep
GVNNCESALLYRDLNEWNKRNNAVVQSSGSGSVLHQAVIFAYFENKHMLLCLFKHHEAHT

SEQ ID NO: 144361 - protein, 48 aa, Triticum aestivum
  Clone ID: PAT_TA_38779.pep
YLSIIFDCSMLLYYLFWLLRGSTLQFYIIFGTNLIYGRPAQIAVFCYF

SEQ ID NO: 144362 - protein, 108 aa, Triticum aestivum
  Clone ID: PAT_TA_38780.pep
VAANIIGKGVIQDLFTCAGVLPMLGGSILHKTSSLVDAISLPVVELERQFVHMHPSIQRIFLEFPNIEHYSIKRAATIFLANEFRFIMKEASEIFAHYKVDGGHPPIE

SEQ ID NO: 144363 - protein, 109 aa, Triticum aestivum
  Clone ID: PAT_TA_38781.pep
MYLLMVYTNDPFWVEHYIHIMELLLAAEKYKVVGFDLEYARARAGSRPKVVVAQMCVRHHVLVYHYCLTTRHCERFARFVNSPHYMFATVDITNDVKALENSGIACQNL

SEQ ID NO: 144364 - protein, 74 aa, Triticum aestivum
  Clone ID: PAT_TA_38782.pep
RWVKASKATTTTCQGRQAARRVHGLEGECWNKPRPTLHDPAGACMLIKPVRWSAVVAKCSVCARSNGAHGRVCC

SEQ ID NO: 144365 - protein, 44 aa, Triticum aestivum
  Clone ID: PAT_TA_38783.pep
SSRLWSQHSCHYLDTIPVDGHHGSKRLVAMKSDVCVGVDVALYV

SEQ ID NO: 144366 - protein, 152 aa, Triticum aestivum
  unsure (1)..(152): unsure at all Xaa locations
  Clone ID: PAT_TA_38784.pep
YRARIRGPTGQLIGKTPMVYLNKIVKGCVANVAAKLEIMEPCCSVKDRIGISMISDAEEKGLITPGKSVLVEATSGNTGIGLAFIAASRGYKLILTMPTSMSMERRVLLKAFGAELVLTDAAKGMKGALDKATEILNXTTNSXYMLEQFDNP

SEQ ID NO: 144367 - protein, 57 aa, Triticum aestivum
  Clone ID: PAT_TA_38785.pep
LCMITSNMILLRCMLLIAHLTLVDTLCLGVTGISRMLALNDGYGQEEGIDEALKVHS

SEQ ID NO: 144368 - protein, 58 aa, Triticum aestivum
  Clone ID: PAT_TA_38786.pep
VSGPTGQNKISWLIRWVSFLSWCEMRCYLRLRSSQTLLLLVRWCKYNIKVDRAARALS

SEQ ID NO: 144369 - protein, 86 aa, Triticum aestivum
  Clone ID: PAT_TA_38787.pep
TQSTENISPYRAYETILSLVIVIDGINIVSYLEMLHIYEHTTASTLLTDEASVHLQCATAWRSMMEDRYAVAKAKRLEFYYARRRR

SEQ ID NO: 144370 - protein, 76 aa, Triticum aestivum
  unsure (1)..(76): unsure at all Xaa locations
  Clone ID: PAT_TA_38788.pep
ISVGALVTVQYAQNVIIHTIHVSVFIVGTGGRISEAPQHSGFRIQSSGYRVSVFGSXHVWLLYFSFSTCQYCLIVV

SEQ ID NO: 144371 - protein, 136 aa, Triticum aestivum
  unsure (1)..(136): unsure at all Xaa locations
  Clone ID: PAT_TA_38789.pep
PTGTVHSPGQLNGNPXLPVQRRSWHPSHGCRGHGWPPRAPPWPITASNENPSRPRPFPLLSPVAPFFFRSNSSLETLTVTALVIVITATTVVAFAWEDVLEARHGRLHPSRAPNGAEVVHALAIKLVFAVHVVVTP

SEQ ID NO: 144372 - protein, 125 aa, Triticum aestivum
  Clone ID: PAT_TA_38790.pep
HERATDRRCCDACQADCEPCRPSGPLPRGRCCRTRIGSRRSQSTDQTGRREIRRAQLPRLEGWPTYVPPHASPTTEAVTDRISCDGERRGAKMLRGPTDIELPAATEGHRECTRKSASPRGRGAP

SEQ ID NO: 144373 - protein, 86 aa, Triticum aestivum
  Clone ID: PAT_TA_38791.pep
HRMSCTGCMEGIGRVLTDLMLHRFHHLLDDEKIVPNRTHLLSVFRCQCVVYSASELCFTQRMHTAIINVSMLIVACHTCLTDTMIK

SEQ ID NO: 144374 - protein, 56 aa, Triticum aestivum
  Clone ID: PAT_TA_38792.pep
KQCHMMTPRVLILYIYLSNIVYMYIGRRLQICNDTYFMFIFTPLYLKGSIKKGLIF

SEQ ID NO: 144375 - protein, 82 aa, Triticum aestivum
  Clone ID: PAT_TA_38793.pep
ACDPASAPWPGVSSSWSNQQQSIKITFFFKFSSSATLHLSGDVDVHNGRPRMHMYVLYDDRLKRIKKRLMPCFAGHLRGLTD

SEQ ID NO: 144376 - protein, 137 aa, Triticum aestivum
  unsure (1)..(137): unsure at all Xaa locations
  Clone ID: PAT_TA_38794.pep
FKGRRGLQTLNTSVTPKILINYENLGNLYIKLLLKNSYQKHVSEIFLKLFYRAQKFLFFSKIKSTITVSHPNGLTWFKHKLKHQNTITTVGNLXXVVXTPACLRPAAWLLRRPCTTHLHQQTFKTLARGQASRGKRR

SEQ ID NO: 144377 - protein, 38 aa, Triticum aestivum
  Clone ID: PAT_TA_38795.pep
PTTLRYCNELILYLYWCSTYCIPTSLCLYLIGHHYRVP

SEQ ID NO: 144378 - protein, 55 aa, Triticum aestivum
  Clone ID: PAT_TA_38796.pep
HLFLFFFFFIVFFFFFNFFFFIFFYLRFFFFFFFFFFFFFSRFAVLLLPNLTCFE

SEQ ID NO: 144379 - protein, 67 aa, Triticum aestivum
  Clone ID: PAT_TA_38797.pep
LKLKTTSNQRLYELFITKHEPKVNNKNKIGLPPNKRYRITPLARHKNTNRSRYCHLWYAIQKWPVDP

SEQ ID NO: 144380 - protein, 119 aa, Triticum aestivum
  Clone ID: PAT_TA_38798.pep
MILCIAKVVSHTSIICMILVYDTPHYNQHNAHNSYAHCINFDMTGGSLETDNQLHVRITDADHQRWEVPQDVIPRPEPALEDVLLHSSGMSNASLPGSSTMSSESSDLTDTIYTVPSTR

SEQ ID NO: 144381 - protein, 68 aa, Triticum aestivum
  Clone ID: PAT_TA_38799.pep
MILSWCILDAKKKKKKKKKKKKKKKKKKKKKKKKKKKKKKKKKKKKKKKKKKKKKKKKKKKKKKKQQK

SEQ ID NO: 144382 - protein, 87 aa, Triticum aestivum
  Clone ID: PAT_TA_38800.pep
ITILLYKACKGKTTMLESEGLQIRSLQKIQTPGDNKPTPFFIDTAPAQRNPTPTDNKQISMAKELVRSSPAKECQLHSKKRVRILAS

SEQ ID NO: 144383 - protein, 94 aa, Triticum aestivum
  Clone ID: PAT_TA_38801.pep
TSIVSPWISMTRGDIQGVTFQGTDSMENVSKLYVVCVSLFFPFFHSTCVVCFNVFSSLNFFCLAQMSRMSLLMKEVYGEAAYNSSRQPRPSARA

SEQ ID NO: 144384 - protein, 50 aa, Triticum aestivum
  Clone ID: PAT_TA_38802.pep
YAFILRHNSSTGSGRFISQDGVLHHDHWENSEDTQVHVLVDHGRIDTRVF

SEQ ID NO: 144385 - protein, 63 aa, Triticum aestivum
  Clone ID: PAT_TA_38803.pep
SRVDTVMEKCGTRVVAWDHEGLFQAARCAKYDGITDPLNIEILACRDGMLLAKDFLGLPICYH

SEQ ID NO: 144386 - protein, 60 aa, Triticum aestivum
  Clone ID: PAT_TA_38804.pep
QVFHFLEFFQSKNTDKWSGVSQLAYGVGDHPNLTSMLTMGVPTYFQKLVSFQRCSKIHHV

SEQ ID NO: 144387 - protein, 64 aa, Triticum aestivum
  Clone ID: PAT_TA_38805.pep
STFCTHVQYCPNAYSIFSKYLFKILILIQHSSNTFSTYFKYFFNILILISTFFKYLLIIFNTSR

SEQ ID NO: 144388 - protein, 49 aa, Triticum aestivum
  Clone ID: PAT_TA_38806.pep
PVFIYCVMHSIGYKSWCSAVCISSLSLDFESCCMHVSSSVGSSFTVCGL

SEQ ID NO: 144389 - protein, 48 aa, Triticum aestivum
  Clone ID: PAT_TA_38807.pep
TGIQMKQINNWFINQRKRNWHSSNTASSSEKTKKKRNVTGNDGTEQSW

SEQ ID NO: 144390 - protein, 90 aa, Triticum aestivum
  Clone ID: PAT_TA_38808.pep
WVGFFRLWSTDHARIEFLRNGFIFVLGGKASIENITPRALDRIFLCVRLGHTLVLVSLFSPIASNPLDSSLALIVILFRICFVHFCKIIM

SEQ ID NO: 144391 - protein, 75 aa, Triticum aestivum
  Clone ID: PAT_TA_38809.pep
TRAYTKTLRSLDLELALNDDFKLHHSFSIQLSMRCSSVQALRSAYHIRLNALPVGTATSNTTKFRSLDMTFLSIH

SEQ ID NO: 144392 - protein, 68 aa, Triticum aestivum
  Clone ID: PAT_TA_38810.pep
SCYLVAYLLFKSHSSIFVFSVIWEKAWNRGSVPREWIQNRVLLQTLKVLSSLLPLSLFCAHLMAWFGS

SEQ ID NO: 144393 - protein, 45 aa, Triticum aestivum
  Clone ID: PAT_TA_38811.pep
FPISEQLTGMEKKLVYQFKTKVNQVLCPAWMCWWLMWLPCPYCCY

SEQ ID NO: 144394 - protein, 88 aa, Triticum aestivum
  Clone ID: PAT_TA_38812.pep
GCFKVNFDPLPCDSRPVVQSMLNRFLQGFKLSTSSFTLGDHNNRVIDTNSDTGEANIHNGPSSNDTMAPTSLHMYNLQHTEDRFSLHI

SEQ ID NO: 144395 - protein, 81 aa, Triticum aestivum
  Clone ID: PAT_TA_38813.pep
NMPGAMMVITSGPIRSMSGCYILCILCILPVPASEPVSSMMLPSPLVSAPPSVRALSVSVSASVPSSGRTCERCLAVKKSR

SEQ ID NO: 144396 - protein, 115 aa, Triticum aestivum
  Clone ID: PAT_TA_38814.pep
TGNWILQFPYGLLVSGCSWWRLRRLSANFISVQWPSTYSRGTAKDSHLTLVAHHLTPPPVLTCPDKNLIHQVVFSNYLNPLGICCNYTVGKCHTPKAIEIVHNVCVTNTSCVLAV

SEQ ID NO: 144397 - protein, 146 aa, Triticum aestivum
  Clone ID: PAT_TA_38815.pep
TVYLDSGWICTYAPLQFSCFFFTSTNPPIYASYFSSQNGISLNRLLSVTVQHMHLNARLEDTGISLFSFREHTLEIIYITCPLGPVSVTQQLVYTVCLLFFRHTIDSRSESRRILHETFCPSSTRLRLQGLRGNGEIQCCYYSCRS

SEQ ID NO: 144398 - protein, 83 aa, Triticum aestivum
  unsure (1)..(83): unsure at all Xaa locations
  Clone ID: PAT_TA_38816.pep
DGEHKIAEEHTKTDGEHINDGXHKEGMMDXIKDQISGDGHRHGTMDGDHHENSDNTTHYDTMHGXGHKDDHGHCSSISDSDSD

SEQ ID NO: 144399 - protein, 104 aa, Triticum aestivum
  Clone ID: PAT_TA_38817.pep
KKKINKKTKNTKRSKAIPKLQFNGRSSSRVSPGFNFVVRRFNRLAPGHPFPSPPLPRCALSPFPPLTSPPTGPPPGPPSDPFFTLPGVWNTPRTLSVSPHRLPR

SEQ ID NO: 144400 - protein, 62 aa, Triticum aestivum
  Clone ID: PAT_TA_38818.pep
GGHTNCHNCGNFPVVDWLDLLVCLEVELFDRWQSFVRYSKLLNAHRWGLSFMWTVRCLILGL

SEQ ID NO: 144401 - protein, 88 aa, Triticum aestivum
  unsure (1)..(88): unsure at all Xaa locations
  Clone ID: PAT_TA_38819.pep
CKLANCHXLPTAFLIALLFLLLDVRLARIWQRQNGSMCSGSPIYGSVLIHERSIRVKLVARTRRFLKSSGSYGGPSHGHRQSPHGGAS

SEQ ID NO: 144402 - protein, 135 aa, Triticum aestivum
  unsure (1)..(135): unsure at all Xaa locations
  Clone ID: PAT_TA_38820.pep
ISPLAYHDMFCIMMPVHCTVIYCGSLLVFLFWVEPGDEYVNEEPVEYANEDPAFDNSENLAGKMIIPSISLLSLLASTRSFVMLALPAFVYHXYLLPCQPSNQLVLATVVWLCHRFCSAPLIALLVAGEDEVCLP

SEQ ID NO: 144403 - protein, 36 aa, Triticum aestivum
  Clone ID: PAT_TA_38821.pep
INYICKLSRKMHRLTWCTLFYCLTTLKYALGRTVAN

SEQ ID NO: 144404 - protein, 70 aa, Triticum aestivum
  Clone ID: PAT_TA_38822.pep
RTFALRVKSEGHAPCEDAAVHVIYKEAYMINALVTHAIQNVYLNAYRFTHAALVGTEGRDSIQVGTVDSD

SEQ ID NO: 144405 - protein, 119 aa, Triticum aestivum
  Clone ID: PAT_TA_38823.pep
RGTQTHFIPQNGIANPLQFENTIDNSKLYKPLGVKTNRPWCVKGYRDTLRNIAGSTHMLHQLFVPIQIFIMLNLPTPCLVLPPFHNIVHIDFFEKLNITNFGQVCGGKIFTSRISNMYH

SEQ ID NO: 144406 - protein, 42 aa, Triticum aestivum
  Clone ID: PAT_TA_38824.pep
CIQVYAFGILNINIFITKHCQNLQSLTIVEIYIHYIMEWIDL

SEQ ID NO: 144407 - protein, 103 aa, Triticum aestivum
  Clone ID: PAT_TA_38825.pep
RADEYGAALHDEDRVTRGCEDRPHREYHRPSHQCRSSHRVLTADVLPSAQLHTCASRQPFASWLTLQYAIMHVPSMYFINLNCQWDTHFILLKSRSSSVRYSQ

SEQ ID NO: 144408 - protein, 153 aa, Triticum aestivum
  unsure (1)..(153): unsure at all Xaa locations
  Clone ID: PAT_TA_38826.pep
PGSTGKNDEDTEEEEKEEEEEEEEQEEQEEQEEEEEEVDEEEEEEEEDDEEEEDEEEDEEEEDEEDEDEEDEEEEEXEEEEEEEEEEEEEEEEEEEEEEEEEEEEEEEEAIEKQTEEIQTDEQKHDDSRADFTTETILEPQSNIDTTNRKDNA

SEQ ID NO: 144409 - protein, 147 aa, Triticum aestivum
  unsure (1)..(147): unsure at all Xaa locations
  Clone ID: PAT_TA_38827.pep
FLQRINQGNSTIQPAGLVLSHVRSLGVFGGFVEIPSLEEFKHLCVLHLSHCQSLEEHHLENIVRLPQLRYLNLKNTEIRKLPEQIGRLGCLELLDLRHTCVEELPASIVNLKKLTHLLVDYGVKFPDGIXEMQALETLEEVRFSKTT

SEQ ID NO: 144410 - protein, 110 aa, Triticum aestivum
  unsure (1)..(110): unsure at all Xaa locations
  Clone ID: PAT_TA_38828.pep
TRLLMSCVSWLNQFDYVVFVRVEQVCLSHQVHCFLISLYKFASFVFCLSIISNSSSLRVELCGCCSVLVIKQLFTQGSSMCSLDSALYGKHNVENNQYNLSCLAALXKLK

SEQ ID NO: 144411 - protein, 70 aa, Triticum aestivum
  Clone ID: PAT_TA_38829.pep
TTLITSCLLRLNKFVLSHEVHCCLISLYKFASFVVCLAIISDSGSLRVELCGCCSVLVINATSQTEVFHV

SEQ ID NO: 144412 - protein, 120 aa, Triticum aestivum
  unsure (1)..(120): unsure at all Xaa locations
  Clone ID: PAT_TA_38830.pep
QGKRYLDXAFGGIVTVSCGHCHPDIVKAVQDQTKLLQHTTTIYLHHAIVEFAEALASKMPGNLKVVYFVNSGTEANELAMLMARLYSGNLGMIALRNGYHGGSAGTIGLTGLQTWKYPIP

SEQ ID NO: 144413 - protein, 52 aa, Triticum aestivum
  Clone ID: PAT_TA_38831.pep
GITNLNTNILTRAQLLINITHISHHHISKLLLRIKFILSNDLHGIFFFVYPS

SEQ ID NO: 144414 - protein, 69 aa, Triticum aestivum
  Clone ID: PAT_TA_38832.pep
MADEEVSDPKALLEDRTKAKCVYHWYEYQKCVKRIEGDETGQKHCTGQYFDYWKCIDKHVAEKLFDSLK

SEQ ID NO: 144415 - protein, 73 aa, Triticum aestivum
  Clone ID: PAT_TA_38833.pep
QAPVRPAKRSWLSEKFNVKKFKEFQIMLMLSKFVQNFRKCSRFLIFSTFKKNHDLNFVRSFLKCSSFFNVSNF

SEQ ID NO: 144416 - protein, 46 aa, Triticum aestivum
  Clone ID: PAT_TA_38834.pep
LHELYRSHDVEVGMNIDEANHRTCIHAHVVLNKSCIQMHIKTLSLP

SEQ ID NO: 144417 - protein, 118 aa, Triticum aestivum
  Clone ID: PAT_TA_38835.pep
PGTVGLILLEGGRPPDSGTFEGSGAVSGLGPDLEPWGVLSPSLLGSGRSPCGASRTTSSWIGTYWDNTSVSSVGRGEEAVGSEFTSDESSEPLDDASSRSLGGYINIFDIRESCATKE

SEQ ID NO: 144418 - protein, 68 aa, Triticum aestivum
  Clone ID: PAT_TA_38836.pep
HKTSSLAITYYEANQLLYLSMHAVDHHISQSSTPIASSSNTRKLCEHYHTSQNRQVIYGGNHRGNRAR

SEQ ID NO: 144419 - protein, 57 aa, Triticum aestivum
  Clone ID: PAT_TA_38837.pep
KQLSRIILPPTITPSGNETSAKGHNVEDETPLVAPTWGKKPTTGKFQDKCGRIWIKI

SEQ ID NO: 144420 - protein, 113 aa, Triticum aestivum
  unsure (1)..(113): unsure at all Xaa locations
  Clone ID: PAT_TA_38838.pep
GYPLIQGFLSYHTAGRALVSKAFCTCFYWPTARADAQDLVQHCVGCQLFANQSHMPPTAVQTIPITWPFXVWGLDMVGSLKEEAXKKKYLLVMVDKFTKWIEAKPVKTAESGP

SEQ ID NO: 144421 - protein, 62 aa, Triticum aestivum
  Clone ID: PAT_TA_38839.pep
ILLPRIQIAEVTRLWIPINTNDKVECRNRNPNVSLTRRKISCNMRRCNHVGQYIQCTGKFTP

SEQ ID NO: 144422 - protein, 63 aa, Triticum aestivum
  Clone ID: PAT_TA_38840.pep
LNYSPLDFFRYWFDAKNSTQPNRKRRIALCNSAFAALFSLLPLHLAYCCATVILARPGLSCFD

SEQ ID NO: 144423 - protein, 64 aa, Triticum aestivum
  Clone ID: PAT_TA_38841.pep
LTRHTFILVLLWRTFFGRSILYSHGEKQCTHTLVLSQPLASTRRSTFFEARSAFVYKEASQLTF

SEQ ID NO: 144424 - protein, 96 aa, Triticum aestivum
  Clone ID: PAT_TA_38842.pep
LTFFKYQINIFWIHGQHFFYTDFTFFKWLITFRNTSLTFFNTWSTFFAYAFNIFNCLINIFHIFIYFQMLGLTCFKYMINFFHTHCIFLYTFSLYT

SEQ ID NO: 144425 - protein, 125 aa, Triticum aestivum
  Clone ID: PAT_TA_38843.pep
RVHRWNQHYLLLEPRFFAASTSFYANVFLLVCCIDFFFCYCLFCWFQQPFRRRSCNRCVAKLEPASTDAGTMHIFATSISMFCWKPSHFCWKYAIYLFAGTISFFCWILDFCWNVFVFATNGIEN

SEQ ID NO: 144426 - protein, 56 aa, Triticum aestivum
  Clone ID: PAT_TA_38844.pep
RISQRVGWGFFFLETQCRRRRSQHVHTPSMRAPMSSLGLEPGWAGSTTRKKPSHLG

SEQ ID NO: 144427 - protein, 109 aa, Triticum aestivum
  Clone ID: PAT_TA_38845.pep
FLQGSTFYLWLLSYIKIMTRDNLLKRNLNKSIDLFFFSEPESVQHLLCDCLVARLVWKQISCLFSMQIGVSVESVTSLWVAGKILDALNTAVAAVLRALWKHRNAMIFN

SEQ ID NO: 144428 - protein, 96 aa, Triticum aestivum
  Clone ID: PAT_TA_38846.pep
STGSMAGLAVGATILLNVLIAGPVSGASMNPARTVGPALIGSEYRSIWVYVVGPVAGAVAGAWAYNLIRFTNKPLREITKSTSFLRSMSRMNSVSV

SEQ ID NO: 144429 - protein, 90 aa, Triticum aestivum
  Clone ID: PAT_TA_38847.pep
GQVHEDFPTIIDKVKLTPVGKWRQQLVQTMVVVVRWSRNLDAFLLLCFGCFVLLVNFGNDLDHFPKKMHVKCYLYSIDTYKYIIIIYDKS

SEQ ID NO: 144430 - protein, 53 aa, Triticum aestivum
  Clone ID: PAT_TA_38848.pep
GPPVLYILCFPCTISVPKMSYIWYRYFWRLNYSKKRLIFGKEGVYIKPLAHCV

SEQ ID NO: 144431 - protein, 49 aa, Triticum aestivum
  Clone ID: PAT_TA_38849.pep
INTESNLDPFSRSQINKTRRSEFKRRNIKTGSKVRTPTSYIKLKTKALG

SEQ ID NO: 144432 - protein, 41 aa, Triticum aestivum
  Clone ID: PAT_TA_38850.pep
HCGSELMLHASIDKIGSCRAPECFFSFVQLYFVNSHMSMFA

SEQ ID NO: 144433 - protein, 54 aa, Triticum aestivum
  Clone ID: PAT_TA_38851.pep
CLKHNYFFLPFLFFFFLVFFFFPFYFFFFFFFFFFRRHKNRGAGSFISQAGLDI

SEQ ID NO: 144434 - protein, 43 aa, Triticum aestivum
  Clone ID: PAT_TA_38852.pep
KGISGSLKNYFSNPSWFQRGLGVLSSPFQVSDERVNMMQHSNA

SEQ ID NO: 144435 - protein, 72 aa, Triticum aestivum
  Clone ID: PAT_TA_38853.pep
TLGNMTDTDEAGGSQSQLGRAHAYLDFLADQERQQAGTETGADDDGGGAGADTDATNDTDTKTGADDVANYS

SEQ ID NO: 144436 - protein, 101 aa, Triticum aestivum
  unsure (1)..(101): unsure at all Xaa locations
  Clone ID: PAT_TA_38854.pep
RLHRALSAACHAETTRKCPRSCRQQPGRLYTQSVNHTIEAHHQKVQLIARLHATRRLPTNTCTNPSDPPTTXMPIGIGATCQLLVALYEGICRRLGRRLSF

SEQ ID NO: 144437 - protein, 56 aa, Triticum aestivum
  Clone ID: PAT_TA_38855.pep
NQSSISHYSLQILPPHTKTNIHENIKISSLHTIIIIKAYKSNFQSHQYPQIISFTY

SEQ ID NO: 144438 - protein, 62 aa, Triticum aestivum
  Clone ID: PAT_TA_38856.pep
KEWKLKVSRGSSCTSTYETTPYSAKESEPPPALLPRRQRPPGQPAVVARCPFILLIPFLLDP

SEQ ID NO: 144439 - protein, 106 aa, Triticum aestivum
  Clone ID: PAT_TA_38857.pep
VLESRSRDSYFSTTSWSSCWTSLTRASRFSREARSLAALSSALANAFLRAATSVVAPNTVHDTFVSTNHASFLNIHTGYYIPWLSSSCFLTRSSSSSARSRSCFSP

SEQ ID NO: 144440 - protein, 67 aa, Triticum aestivum
  Clone ID: PAT_TA_38858.pep
CLFYSVTLGSLHWPSINNHPVRESSSGKHVIRRLSNRPISNRVNTENARNDRTSYHLHTVMRGLDSP

SEQ ID NO: 144441 - protein, 95 aa, Triticum aestivum
  Clone ID: PAT_TA_38859.pep
PPTPFTCYDTSDHLSPIFIEKTLEMQKKLKNLNNSAFPYQENSRKIRNLLKTKTICHGALNCSYEAMKKIRKFSRMSKTDVLSNTPFLANLNTFR

SEQ ID NO: 144442 - protein, 57 aa, Triticum aestivum
  Clone ID: PAT_TA_38860.pep
VEFESNFCKGYLLTSDFLMMWSHMGWPTRNRPMGLLFLGPTVTQPTGDENTGRCYSR

SEQ ID NO: 144443 - protein, 85 aa, Triticum aestivum
  Clone ID: PAT_TA_38861.pep
HFEVDNVEEHGLRWLLKKKRKNKEKKKPHRLKKQNRSKRRHIDNITINGNRNKQRTLHPHYRITTTCNKHYDSNIIPNKLNAGVR

SEQ ID NO: 144444 - protein, 109 aa, Triticum aestivum
  Clone ID: PAT_TA_38862.pep
LCISLRSIRLVWPTRLIYLQGERCFLISSILRCPHSMTGGVTRHVFVLLLLRGKRHGLIILLGFILYTLCHHTSCITLFVMNLISGEASIEVLSKWSNSSRCRQESVYL

SEQ ID NO: 144445 - protein, 59 aa, Triticum aestivum
  Clone ID: PAT_TA_38863.pep
LVAVKKKKKKKKKKKKKKKKKKKKKKKKKKKKKTKKKKKKKKKKPKKKNKKQKKKGAPQ

SEQ ID NO: 144446 - protein, 139 aa, Triticum aestivum
  unsure (1)..(139): unsure at all Xaa locations
  Clone ID: PAT_TA_38864.pep
FGRHCLEKIREAQKDDKEIAEIKEKMSEGKAKGFREVEHDTLWFEDRVYVPNNAEIRKLILQEAHESPYSVHLGNTKMYLDLKDRFXWTGMKKDIAEYVAVCDACQRVKAEHQKPAGLLQPMPIPEWKWDKLGMGFITG

SEQ ID NO: 144447 - protein, 73 aa, Triticum aestivum
  Clone ID: PAT_TA_38865.pep
VILIAPGRNLSISNNVNPRIWAGNTDIKVQAPQFITRPMGLFMTLNAGNKKQTTGGASRGPLFLKPGSGIAHA

SEQ ID NO: 144448 - protein, 70 aa, Triticum aestivum
  Clone ID: PAT_TA_38866.pep
NLRILEICKQAYGTKGLIFSPDLRYEPGLKGIAPFSPGSCLKPGLKVPFEPGLMPLASRTRTNAPIGLGS

SEQ ID NO: 144449 - protein, 50 aa, Triticum aestivum
  Clone ID: PAT_TA_38867.pep
CHMVISSTLWWYSFYGETTTVPSGRAEMSTAIVSVQSGMSEPDPSAPWTW

SEQ ID NO: 144450 - protein, 53 aa, Triticum aestivum
  Clone ID: PAT_TA_38868.pep
FDAAEKQNRYAHDYNFSNLQKRAFAMIRFSVDECTNYPGHPSLVGFFKFETFA

SEQ ID NO: 144451 - protein, 98 aa, Triticum aestivum
  Clone ID: PAT_TA_38869.pep
YLFQLMYAPRIYTTISGPAVYSRFSDDRFHACKEDAKFTWVRALDFTPNHSFGKCSTLALVLDEGAPVSFILNSLPLSGELGELVISSMEFFGPSTWN

SEQ ID NO: 144452 - protein, 121 aa, Triticum aestivum
  unsure (1)..(121): unsure at all Xaa locations
  Clone ID: PAT_TA_38870.pep
TGTRTLSPPSPTRHPNKKGKHRHKKGKAKDKSKRHTYKEATGTDVASDIRENGKEEAVIRIADDGECRKSNKGXGRHXDKNNVNVSIVSGSIENGAGDEHANKSGSMAMNPRSEGATDKLN

SEQ ID NO: 144453 - protein, 81 aa, Triticum aestivum
  Clone ID: PAT_TA_38871.pep
ASSDSTRMSRLLRSTTTIISYGNWNRFIICKLYDNTATKTYGQFIIPALFWIHAKSSYGSAQITSRLPPTVYQRALYSTLL

SEQ ID NO: 144454 - protein, 47 aa, Triticum aestivum
  Clone ID: PAT_TA_38872.pep
RACSSGDGLLMKCRSSSPTANCTDAQATYSSSFKYDTLPLSYPCQPG

SEQ ID NO: 144455 - protein, 80 aa, Triticum aestivum
  Clone ID: PAT_TA_38873.pep
KNVYNFIKNLPYQENVCKFENKCLKNQTMFMIFFKSLCIKMLIKLNRMFVKMLSVLQQNVAMAFGDYDFFSAVVTHRPFC

SEQ ID NO: 144456 - protein, 82 aa, Triticum aestivum
  Clone ID: PAT_TA_38874.pep
MTSLTTNTKMIRTRRTRSKFNNCKTTNLMKHIQMSNTNTIHMQTIMFMMNMTFASRVLHRPLLAASLYDPSLPSLSCDFITL

SEQ ID NO: 144457 - protein, 73 aa, Triticum aestivum
  Clone ID: PAT_TA_38875.pep
KHKSLKPQPPLLVSYKALSLSLSLSTLTLPSTRTLCLHWTSPPPLPLAILLVPGPVTIPSLIMWNRYVRSSKN

SEQ ID NO: 144458 - protein, 61 aa, Triticum aestivum
  Clone ID: PAT_TA_38876.pep
VVEVLCFSHQVLCWAELLIVIALPRGAGGVYIDHRVSCCFAVPGFYRQIFIFLRFFVSFTR

SEQ ID NO: 144459 - protein, 52 aa, Triticum aestivum
  unsure (1)..(52): unsure at all Xaa locations
  Clone ID: PAT_TA_38877.pep
LRWSFIRLELSALWMVFDHYIIRPHFYKNCVLTKAALNNPGSLLILXEQXLS

SEQ ID NO: 144460 - protein, 74 aa, Triticum aestivum
  Clone ID: PAT_TA_38878.pep
RTDAVGHTKYELFFFPFSPFLHCHLSFVFFFAGNFFFIFIIFIFFLLILFLIYLSFFLFYFHFFLKSTIYFQIF

SEQ ID NO: 144461 - protein, 50 aa, Triticum aestivum
  Clone ID: PAT_TA_38879.pep
DLASSFSSYRDLLNWTLYPDKTSTEKSVRSVSVLNQITTVSTVANQFISC

SEQ ID NO: 144462 - protein, 138 aa, Triticum aestivum
  Clone ID: PAT_TA_38880.pep
RRAHVQAHDLRMIPITWPFAVWGLDMVGPFKRSKDKKTHLLVAVDKFTKWVEAEPLSKCDAATMVQFMKKVIFHFGFPHNIITNNGTNHSKGAMKDFCQREHIRLDVSLVAHPQSNGQAERANQEILRGIKPRFMVPL

SEQ ID NO: 144463 - protein, 57 aa, Triticum aestivum
  Clone ID: PAT_TA_38881.pep
RSLVGREDTDELTCLRTSLLKHQIFELFIGLQFSGGNIWFFIFLVPPKWFDQGPWRD

SEQ ID NO: 144464 - protein, 73 aa, Triticum aestivum
  Clone ID: PAT_TA_38882.pep
CVSYKCCGASKSRVPVCQLHACRPCLMDDRSTACSMRWNETTADTSTTAAGTDDVTGAVTAVAAVCVVPSTLE

SEQ ID NO: 144465 - protein, 39 aa, Triticum aestivum
  Clone ID: PAT_TA_38883.pep
LFVRPFVDFPKLIFVKFEDFLVLCGLCLYYVFLYRSPST

SEQ ID NO: 144466 - protein, 51 aa, Triticum aestivum
  Clone ID: PAT_TA_38884.pep
TKEWKGKHDYKIKQNNGKENCVYTLLLGVYPSHVQAEHGIQGGRESTQPFR

SEQ ID NO: 144467 - protein, 94 aa, Triticum aestivum
  Clone ID: PAT_TA_38885.pep
TCKGVAQLVAISPELINHIMLKSCLISLKQMIHREDNLAVLKAIESHMATSDHTHIRKLLRTSNSSIPSMHASVSPGYKYNTLSKLSCIPNPKH

SEQ ID NO: 144468 - protein, 69 aa, Triticum aestivum
  unsure (1)..(69): unsure at all Xaa locations
  Clone ID: PAT_TA_38886.pep
VALQTPDALLITHRDTVPPXVHINIYTRSEYRIGSRLLYVRFLVNLRIIVPISLDTTVVFSHCHHAMSK

SEQ ID NO: 144469 - protein, 119 aa, Triticum aestivum
  Clone ID: PAT_TA_38887.pep
NPWPDGKVETSFRSCNASRLHQTASSSVPNPALSLELPAGSSLRTSDPRKTRGRPAPSGPRSSRTRRAPPAPPAQQPRLHRSSPEIPLDALTTLVPPRPRRLHCRDLIGPIFVDPRRPT

SEQ ID NO: 144470 - protein, 133 aa, Triticum aestivum
  Clone ID: PAT_TA_38888.pep
RRAYALLVHTLSKMRSCAIGERSNMEIRIIELKYTMIDAELLPVASTSHTVSPRETFPFVCTSQSVAPRKTFSFTSTSYTVSPVKSFVITLTMHTILTILTFALMNGSYIVRTRNCMGKVVHQTQFLLGKRLP

SEQ ID NO: 144471 - protein, 71 aa, Triticum aestivum
  Clone ID: PAT_TA_38889.pep
LTAGRRSGSTVSSCQCRTSRVELRLAIVHLHGERVLRHDPCLDGHDGYDAVVNEVIHVLVDREPLADDHVL

SEQ ID NO: 144472 - protein, 108 aa, Triticum aestivum
  Clone ID: PAT_TA_38890.pep
IVIYPYLEDWITNHTLAIDMGALCLAIHVSISSVRCYIVWVSPLAYPNLFGTRCFVVVVHFAHRPINDLTLAITLHVHHLYLSELDNFCPNDSRISFIAPWWICFKET

SEQ ID NO: 144473 - protein, 112 aa, Triticum aestivum
  unsure (1)..(112): unsure at all Xaa locations
  Clone ID: PAT_TA_38891.pep
FTRLIFQNCWHIIAKDFMLLIQALHESRFYSFGALSSSIITLLPKNEXPMHLGDFRPINLIHGTAKIFVKALATTLHSLLPSLISQAQSTFVCKRSMHENFKFVLNTARTLH

SEQ ID NO: 144474 - protein, 59 aa, Triticum aestivum
  Clone ID: PAT_TA_38892.pep
LFLTRLRCPLHVYSSGHIVVVLRRSPVQITSATPRRRANGTHRLLRTSTGSRVQGTSSS

SEQ ID NO: 144475 - protein, 66 aa, Triticum aestivum
  Clone ID: PAT_TA_38893.pep
SWKHEARCCQDGWKNVRNKIVTMSISIIITEFTTYFFCIIMKSGADRLRDRYTIKLLYYADCVLDA

SEQ ID NO: 144476 - protein, 81 aa, Triticum aestivum
  Clone ID: PAT_TA_38894.pep
WAELNRLSGLAMTYVMDCLGLGGSKPTSYFNLVQQLLDVVPRLEAVKRSACTEGARLALARVKTYWADMEPANDACDDSDR

SEQ ID NO: 144477 - protein, 99 aa, Triticum aestivum
  Clone ID: PAT_TA_38895.pep
CKCKQTSAERAKQKKQGKEGDIVAYLLHRAKVAAYLKTQTIKTSNTQSRFYLNHHTDSSAHRGYATHPTLGVLGLSSRALCPVQSSEFSLGVATSLVVV

SEQ ID NO: 144478 - protein, 63 aa, Triticum aestivum
  Clone ID: PAT_TA_38896.pep
SFSSRNSTSELHFPRDLSRFSGPSCPVPVFTAVDRPRRSRRQHHRGEPLVLIFFLKEKNSYFR

SEQ ID NO: 144479 - protein, 116 aa, Triticum aestivum
  Clone ID: PAT_TA_38897.pep
QVCVAILRNPWRIEGIFFEDLTHNPRLNVVYNTCYLIPSIPLCSAPYFSSKVPQCSARLEFWMKIPLAGLEVCLGSFHRWAHACGHTWWRGSTYEDPKYTCHHTPWYCSQDETHTI

SEQ ID NO: 144480 - protein, 56 aa, Triticum aestivum
  Clone ID: PAT_TA_38898.pep
ACFKHIIISHHCNAFSVGQCHYQSALAKPGYSMVLRGRLPVEWIFPKLRFQHFRTF

SEQ ID NO: 144481 - protein, 81 aa, Triticum aestivum
  Clone ID: PAT_TA_38899.pep
TGDRYDEDDRNPTVTAAKKQHPQPPFLQGWRHRQIHRQGKEDPQQERLMTRCGHRPVQVNFFGISAVRPKLAHKQECASSC

SEQ ID NO: 144482 - protein, 33 aa, Triticum aestivum
  Clone ID: PAT_TA_38900.pep
LRLSKSTTHHHITIEQRRQDPSYTYIASKITRP

SEQ ID NO: 144483 - protein, 38 aa, Triticum aestivum
  Clone ID: PAT_TA_38901.pep
CMVPNNTGITHSGSTITPGTQELDQPIHVLARRFTCPR

SEQ ID NO: 144484 - protein, 74 aa, Triticum aestivum
  Clone ID: PAT_TA_38902.pep
EKSWGKRRETKVGEGILKVERRKGRTLGPGVRLKFFKDGFCPLVLAWFVVRLHGLPFQFPLGICWLLRGLSNLG

SEQ ID NO: 144485 - protein, 75 aa, Triticum aestivum
  unsure (1)..(75): unsure at all Xaa locations
  Clone ID: PAT_TA_38903.pep
YISSPSXGVFGAKXXDQIPXPHRRDVSSFPPLEHVRPPXSTSLPTQSAPRHVANPRSXQPLPSPXTSPPPVRSRE

SEQ ID NO: 144486 - protein, 85 aa, Triticum aestivum
  Clone ID: PAT_TA_38904.pep
PHGLEFIHYSENCLFRIMFQIIVLMVFVVNEFPCYSNPGGFFIPSTLSFLSLHLGPFCNLGFMEFTLFSIGIFCSFVEIGFLLLI

SEQ ID NO: 144487 - protein, 74 aa, Triticum aestivum
  Clone ID: PAT_TA_38905.pep
DFQIFLQKFHRILEFHKLFAYLKKVFIFSNFVHKLKNVRFKKYVPAFIICSQIAQEFHKIFPLLKVVQNKILKN

SEQ ID NO: 144488 - protein, 78 aa, Triticum aestivum
  Clone ID: PAT_TA_38906.pep
AEVWFLIKEPSSPIPLQNFGPTLSLQEFGATSGKPVLNDTTGRPALPCKLIQIAGSGGTKFFQGAQIKFNRLVKICKF

SEQ ID NO: 144489 - protein, 73 aa, Triticum aestivum
  Clone ID: PAT_TA_38907.pep
EAGTCNMSGGTVTSGTIRRGLHGHKRTRTARSEKRPTNSLRGGELVDTEWCPRRLRNRDLAGEDEAYGSVDLP

SEQ ID NO: 144490 - protein, 98 aa, Triticum aestivum
  Clone ID: PAT_TA_38908.pep
FWGAGFFFFFFFFFFWFFFFFLFFFFFFREKCKPLIGKKFGPKLKQNFWTDVGQSRIFPPFIFGKRVNPLMNVCQNPWFFLLIFLLFPFVLLQLLLGC

SEQ ID NO: 144491 - protein, 41 aa, Triticum aestivum
  Clone ID: PAT_TA_38909.pep
PGPRVTLTHSVELMKPVSKQQQPVSHHVTIPNTITERILNL

SEQ ID NO: 144492 - protein, 148 aa, Triticum aestivum
  Clone ID: PAT_TA_38910.pep
HGDEGTTHPKGPSRPVIELPDIRGDTDCFAGSAGVGMPHKLKQVQGDDSWMFEEISVSPRSLCLNEEGESVVFEHRESGSCVEHRESGSPVDDYLPHAIGSCEESKISPYFLDLDPRTSGKKCQEVDHWNHKRHHDCPAGDCNDQNEF

SEQ ID NO: 144493 - protein, 124 aa, Triticum aestivum
  Clone ID: PAT_TA_38911.pep
GQNRENAETERDRVTDPISGGVLAPPTAVETMDPDGKPFSHLGRRSRKKKKKKKKGGSLPLASGGAGVPPGAIIITTIFTNTSAIFTNISITFPLYLQRSNFLEPFVPFNLTLFRLVHYYYPMM

SEQ ID NO: 144494 - protein, 127 aa, Triticum aestivum
  Clone ID: PAT_TA_38912.pep
AWPLRYTHTCAHTHTTHAHTPRFRCTPHVLRASVVSDESECISASRTSRVNPSRVTSLTTHAVAYNNTHPISHGLEESVVVDVGAAQESVLHTGLSTLRHCAEVRCSRHYWQRLRLLRRLPDTMVRP

SEQ ID NO: 144495 - protein, 44 aa, Triticum aestivum
  Clone ID: PAT_TA_38913.pep
RYIRTLTQGIKFLPPLHLPFTYLVYKPFNLELLNFWIILLDYLY

SEQ ID NO: 144496 - protein, 123 aa, Triticum aestivum
  Clone ID: PAT_TA_38914.pep
TGQSNSNSESLPKTMAPSGPETKPNRPFQLQQRPAITMGFWNWLPGKKANQDHEAGSSSTSPETAATYSTSLMAFSISHLQLGPASGRTLRWRYADGTGRPAPRCRGLLPSPPREPRVRVPSP

SEQ ID NO: 144497 - protein, 111 aa, Triticum aestivum
  unsure (1)..(111): unsure at all Xaa locations
  Clone ID: PAT_TA_38915.pep
LASLRETDRIRQISQKNFLYVPNINMGSEMRLGARLLPASFFATLHTCPNWAWLSIYRIKTNICMLIGYLHXLQPKRAKTKGLMFACGLCLRGNTXPVVWLCTGQLCGNLL

SEQ ID NO: 144498 - protein, 63 aa, Triticum aestivum
  Clone ID: PAT_TA_38916.pep
YSESIICDHSLTRFTLFRYLLMLETVDLETDTYLVTAAIANLCHRTNAPILPSPRHCPRDLYI

SEQ ID NO: 144499 - protein, 65 aa, Triticum aestivum
  Clone ID: PAT_TA_38917.pep
RGERRSTDGTEKQVAKLMDEDIGAAMQFLQSKALCMMPVSLAMAIYDTQHSQDGQPVKPEPNNTA

SEQ ID NO: 144500 - protein, 128 aa, Triticum aestivum
  unsure (1)..(128): unsure at all Xaa locations
  Clone ID: PAT_TA_38918.pep
AQSSTSNNSFLGSPPQENLVRGDFLFWKAIILPQNKGAQMEHHLDAKSPALPATLTITKDDKDEXVVNFARSLWYAQQQQLQGYLMGSLSRDILWQVATLQTPAEVWSAINTMFATQSQAQAINTRRP

SEQ ID NO: 144501 - protein, 108 aa, Triticum aestivum
  Clone ID: PAT_TA_38919.pep
STADLNFFRSSNAVCFQNMYLFMRCFFSPPAASVWAGPEKEYPVRNPASLPQNAADRRSRGRHRPGVGTGATMGRATTRCKINEAEMGFPADQAQSTGTHQFFYQLEI

SEQ ID NO: 144502 - protein, 60 aa, Triticum aestivum
  Clone ID: PAT_TA_38920.pep
STGRTNASPAATRYTSGAAGTRKTAAPWELVSRPEYGTVLYTIKLNAVCACSGKCHVAIV

SEQ ID NO: 144503 - protein, 66 aa, Triticum aestivum
  Clone ID: PAT_TA_38921.pep
GKISPRREETPAASVDEGGRQWRSHGLDMKVLDTERNSVESLYMKTSEREREREREDDIYAIRREL

SEQ ID NO: 144504 - protein, 59 aa, Triticum aestivum
  Clone ID: PAT_TA_38922.pep
PFNYIYFTYKFCLKSNFVKFDHIRGKNINIYTINQYHCITELIFILYIFSIIDVDISLI

SEQ ID NO: 144505 - protein, 34 aa, Triticum aestivum
  Clone ID: PAT_TA_38923.pep
YDTLTLPIFAYIRLKSEIFYNIRMFFDSVTFLSN

SEQ ID NO: 144506 - protein, 79 aa, Triticum aestivum
  Clone ID: PAT_TA_38924.pep
MIRFILLQNRQGKTRLAKYYVPLEDSEKHKVEYEVHRLVVNRDPKFTNFVEFRTHKVIYRRYARLFFSICVDITDKDLV

SEQ ID NO: 144507 - protein, 68 aa, Triticum aestivum
  Clone ID: PAT_TA_38925.pep
TAKSVLSYLIFRAYTDDVLIYVLTNQSDAVLSPLSAATRCNYSLSIPCNAWSQTISLLEQLQRPVHLI

SEQ ID NO: 144508 - protein, 105 aa, Triticum aestivum
  Clone ID: PAT_TA_38926.pep
NRMKFYFGRLDCLVSSRKLCRGLASNTLLKFRFHSSSGSATKSLNRNSNVACLMSPLCTISWRCVRVCSLQVGNTVTDQSSGVSPPAGSAQTQFGHWTRGKQTMH

SEQ ID NO: 144509 - protein, 98 aa, Triticum aestivum
  unsure (1)..(98): unsure at all Xaa locations
  Clone ID: PAT_TA_38927.pep
NCCRNTCRKQKANVLXXGNQCTRXTLELSCVQVQLVPYRLXXQQNWAACKXXFTXXQYPKEGLXIEHNGKVXKPIRLSPIAYSRIIEFPVDPTNLRRL

SEQ ID NO: 144510 - protein, 38 aa, Triticum aestivum
  Clone ID: PAT_TA_38928.pep
SFQGLSKDLMDFGIRSGKILTLGMAIALNWNFSRFTNS

SEQ ID NO: 144511 - protein, 37 aa, Triticum aestivum
  Clone ID: PAT_TA_38929.pep
VDGVRKKWGGGVMGSKSQAKTKARERLIAKEAAQRMN

SEQ ID NO: 144512 - protein, 85 aa, Triticum aestivum
  Clone ID: PAT_TA_38930.pep
GRRATELLQPPPAIVQLALSMGSCSTTPPRATVHPALHRQLFNPPSTGYCSTFPAQSLREYPFLSLGLFSLNIRYTHTYTDREID

SEQ ID NO: 144513 - protein, 57 aa, Triticum aestivum
  Clone ID: PAT_TA_38931.pep
GKGIHQNKSEAVSFDLLCTGWWKTYSTACISTRFPVARVKESLQRDTVDVFPCTISS

SEQ ID NO: 144514 - protein, 52 aa, Triticum aestivum
  Clone ID: PAT_TA_38932.pep
TYGKSCGAKTEHICTYGVGKILASATTCYLYIWPQNVSTSGLLLLVSFTGLK

SEQ ID NO: 144515 - protein, 127 aa, Triticum aestivum
  Clone ID: PAT_TA_38933.pep
DSEDVNYMALSKDEVSLGDEEFVVPEDPVEQQRFKRRLIATAKCLKKKQQQLQADQDLLTDRWTEVLAPEQYRLKRPTKSYPKRRLLPQFEEEALEPTLLALDAADRPPRGRDKAAYHPVHQPAARR

SEQ ID NO: 144516 - protein, 129 aa, Triticum aestivum
  Clone ID: PAT_TA_38934.pep
PVTSASFPRRYRVRSCSGAVEEREIDGFHRRHRRPSVLRRAVHCRRRLRRVGQTTHHIKCGPFSLAPGGIAVARPQTGGLHGGRAVPGAVGAPEADGQGTGQLLGTGDPAAAVLHGVQGLRVPLRGHDE

SEQ ID NO: 144517 - protein, 61 aa, Triticum aestivum
  Clone ID: PAT_TA_38935.pep
GSTGNTIIYGLNLLFSQPNDEDPLNHEAAAVLRDNPQKFQRNVQMAMSGGYVDNTHFPRCK

SEQ ID NO: 144518 - protein, 74 aa, Triticum aestivum
  Clone ID: PAT_TA_38936.pep
KFSIISRTYACLFDALPLDPTCITPYFTTANSTSNSDELTWTTRPITRTHDYLLHSSPRFTVLTRLSIGDTHRP

SEQ ID NO: 144519 - protein, 42 aa, Triticum aestivum
  Clone ID: PAT_TA_38937.pep
KKKSNYVSEPGKTRLLCHRKDSYTNSVYSKYTFGTKLTISQG

SEQ ID NO: 144520 - protein, 60 aa, Triticum aestivum
  Clone ID: PAT_TA_38938.pep
RSCSTVKKKKKKKKKKKKKKKKKKKKKKKKKKKKKKKKKKKKKKKGPPKRIKPNLPGKEN

SEQ ID NO: 144521 - protein, 36 aa, Triticum aestivum
  Clone ID: PAT_TA_38939.pep
VILQDYSIDPSALSKLRINHVCIRYVLLMLEVDSLC

SEQ ID NO: 144522 - protein, 70 aa, Triticum aestivum
  Clone ID: PAT_TA_38940.pep
SCLINRAGPHLSLTQGSQPGPTGGQSQSRLPAFSRRRARRGSGSGFGHFGHQMDRGDHRIRRVDIPQPID

SEQ ID NO: 144523 - protein, 50 aa, Triticum aestivum
  Clone ID: PAT_TA_38941.pep
THNTDSVHYHNCIEYIQFHKYLLFNHQHVLYRYTICQYKLGCINYSTTST

SEQ ID NO: 144524 - protein, 51 aa, Triticum aestivum
  Clone ID: PAT_TA_38942.pep
SWVDGFLERKCLDEGLDCDTISRICQTYDLDKVDVLKYRDLEWPSSASRTT

SEQ ID NO: 144525 - protein, 47 aa, Triticum aestivum
  Clone ID: PAT_TA_38943.pep
GHSKLAISNINGDFDANDPKMAAYLNAVLKMSARFVGLDKVGPLRGG

SEQ ID NO: 144526 - protein, 110 aa, Triticum aestivum
  Clone ID: PAT_TA_38944.pep
KDIFFRNRGSNILGVYQNKSDFFQVCEQVLLFYYFGSAATHEHIASKRKRLAAFASHSPPHARELGVLHGPSGTTHSLGKACCLAFSLSCGTAVEKTDYEQTSRLPSTRE

SEQ ID NO: 144527 - protein, 44 aa, Triticum aestivum
  Clone ID: PAT_TA_38945.pep
TSVSPCTIDLPCLNEDPVNAFGEVHIVMLWFSILWISILPRPIP

SEQ ID NO: 144528 - protein, 90 aa, Triticum aestivum
  Clone ID: PAT_TA_38946.pep
YGSSSLHGRHTEPPQPPPSPCSASMLPCRATPLPDAVMCRLLAVITDLRARCDMPCAHHRRSCCSSCHCRVTVVTQPADPIRCIDALRTL

SEQ ID NO: 144529 - protein, 63 aa, Triticum aestivum
  Clone ID: PAT_TA_38947.pep
DKHQRWRLYRLVSRSPLNVVFRVKVGYFCFLKLSLFVCDEGCNVEMLATKRKQAIFVCSKSVL

SEQ ID NO: 144530 - protein, 58 aa, Triticum aestivum
  Clone ID: PAT_TA_38948.pep
WKLRCKTFILITARQFGPGEIVAQVKPLLILWIKILAQVKFPVDGGGRGGSNRGIPKV

SEQ ID NO: 144531 - protein, 64 aa, Triticum aestivum
  Clone ID: PAT_TA_38949.pep
IQFSDATIWRRNSSSSPWSKRKEEMRQGLVTFSIPSQTGAHIRRSRRPFGKWRSRSREFAPAQR

SEQ ID NO: 144532 - protein, 64 aa, Triticum aestivum
  Clone ID: PAT_TA_38950.pep
TDTSATCPSSMTSSRTQILLGYLHFGSRNPFLIRWMTCSIRNSCLPALIFSHCWCMLGVTLLCC

SEQ ID NO: 144533 - protein, 100 aa, Triticum aestivum
  unsure (1)..(100): unsure at all Xaa locations
  Clone ID: PAT_TA_38951.pep
GSTGGRTYNYGYYLADVIYQKWKTFVNQLKNPXGKKILDFNNAKAAAKKNLEKAFWILQAQFAIVRGPARFWDQKMPWYIMYACVIMHNMIIENERGQEI

SEQ ID NO: 144534 - protein, 53 aa, Triticum aestivum
  Clone ID: PAT_TA_38952.pep
INMPCHSSHTYACAHALRPTCLKIPFNLLHMELTRAQVRKNKLFQTVMVRRCM

SEQ ID NO: 144535 - protein, 77 aa, Triticum aestivum
  Clone ID: PAT_TA_38953.pep
SYTRTSTTVSSLPNASSYPHPQAAWSCSSSSQFFTCRTVGPLHEAGHFEACPQLLICSSISATSVRVLDCTVRTQLA

SEQ ID NO: 144536 - protein, 135 aa, Triticum aestivum
  Clone ID: PAT_TA_38954.pep
TFHWTTKIWHVRLWRRRSSTGALALPGYAPLPSFSRKYQSKTQYGFSRICSLPKLSDPSLSTFSFLGGSPAMARTTRFCSRARRARSYAAARAAVSAASAAAMPVARRALSALILSFPWRAHQSRWDSHSAGPVI

SEQ ID NO: 144537 - protein, 64 aa, Triticum aestivum
  Clone ID: PAT_TA_38955.pep
LGMNFFCNSVGGFILHHSGRISRMYRSYYSIGFYWEDSLYFIVQETGLQLKQCLNWFMNQCTRN

SEQ ID NO: 144538 - protein, 37 aa, Triticum aestivum
  Clone ID: PAT_TA_38956.pep
YIFLNICLTIFEEKINIFSNTRPTFFLYTFSIFQMPC

SEQ ID NO: 144539 - protein, 46 aa, Triticum aestivum
  Clone ID: PAT_TA_38957.pep
TGPTFAGPRGEGTVVSIDQDDPLSLQTVCPYLVAPTIVGNFVLTMG

SEQ ID NO: 144540 - protein, 56 aa, Triticum aestivum
  Clone ID: PAT_TA_38958.pep
HGVQLMRAQRLVLAESQVTHINISSKGRSQCTKPPCTPTWPRNDSFTTTSSIPHSH

SEQ ID NO: 144541 - protein, 76 aa, Triticum aestivum
  Clone ID: PAT_TA_38959.pep
LEMLAEKIAQRCEKARNKINPQAASSSTTSSTGTKMCHFSLLPYISHIEAMKASGDTFNIHQNRSNFRSPFIPFFP

SEQ ID NO: 144542 - protein, 74 aa, Triticum aestivum
  unsure (1)..(74): unsure at all Xaa locations
  Clone ID: PAT_TA_38960.pep
GSTGGKTHRKQLATKAAKESXAPTTGGLKNPNGKRPGTVALREIRRYQKSTELLIRNRPSKPLMREIPQDFKTD

SEQ ID NO: 144543 - protein, 54 aa, Triticum aestivum
  Clone ID: PAT_TA_38961.pep
IFWTARFFLRFFIFFFVGQVCFHFAKKIHRLPRFGGWIRLTWSLGLFYSLLMND

SEQ ID NO: 144544 - protein, 94 aa, Triticum aestivum
  Clone ID: PAT_TA_38962.pep
RWLRVSRRCGRGCIGHGGRRRGRGPGGERRCQQGRGDIQEAIHVAGRCLGHSREAGWCVASSGAPVLTSLPAWREEAADWRGPAQCWDARWAPR

SEQ ID NO: 144545 - protein, 95 aa, Triticum aestivum
  Clone ID: PAT_TA_38963.pep
NQLFVGTGKGTHREINNVFLRSSRFITVTLLTCNVNHVYVHDITYHLNNIDQSLMLCRPSQCRINDQVGQTTKKIFQLSTNEISWRINIYVRECE

SEQ ID NO: 144546 - protein, 97 aa, Triticum aestivum
  unsure (1)..(97): unsure at all Xaa locations
  Clone ID: PAT_TA_38964.pep
RRQKWAQFAGVRTCETYESDTPXYPKPFPDSVTPSYSFSLLPSFSLAFAAAPPPRPQHHTPAGTLRLCHLRGSSRAPRRFLSVSIQPLSTNFYSHLA

SEQ ID NO: 144547 - protein, 105 aa, Triticum aestivum
  Clone ID: PAT_TA_38965.pep
HENIVRHLLYQDTVRRMGIDPTKIRRSSTSFKGVTPGLYTNCTGSVLLEVVFGSSDNLHREKLIFHIAPFKSGHQALLGREAFARFNAIAHYVSLTLKMPGPRGI

SEQ ID NO: 144548 - protein, 51 aa, Triticum aestivum
  Clone ID: PAT_TA_38966.pep
TNLLTQCPVPFSVFAYLFVSQKNHTKRSSNTMKFYDNFSWTRRDPRSFEGG

SEQ ID NO: 144549 - protein, 70 aa, Triticum aestivum
  Clone ID: PAT_TA_38967.pep
WQEVAERWRTGHLTTILMAHWKSSQANTVIATNGLMTLLIARLDHRKVIACLTLLKLIKVWFLFFSLMVE

SEQ ID NO: 144550 - protein, 144 aa, Triticum aestivum
  unsure (1)..(144): unsure at all Xaa locations
  Clone ID: PAT_TA_38968.pep
PAWGAEXXDPFVPGGIASHHIAAGTLGILAGLFHLSVRPPQRLYKGLRMGNIETVLSSSIAAVFFAAFVVAGTMWYGSATTPIELFGPTRYQWDQGYFQQEIYRRVSNGLAENLSLSEAWSKIPEKLAFYDYIGNNPAKGGSRG

SEQ ID NO: 144551 - protein, 88 aa, Triticum aestivum
  Clone ID: PAT_TA_38969.pep
NALKLFNNLRTTIMYVRIIPPLTNVHQPWEVPTSPSRRNLCSEPTSTDQSTVSATAGTLPATKPTRTTTVTATKGNRPPTPSAPWPGE

SEQ ID NO: 144552 - protein, 77 aa, Triticum aestivum
  Clone ID: PAT_TA_38970.pep
LEMPSYIINQHYKLAKRYKCIAPSIPEFCQIIYYCTSESPDTSSASRLKTRAGRTQKSQQTMEGTNRSSVAATQIII

SEQ ID NO: 144553 - protein, 109 aa, Triticum aestivum
  Clone ID: PAT_TA_38971.pep
MTKKKFRKKYGYCEKADVKWKPYAPDFKHKNLAKLTIYGFQPNDNFKRYIRCVVEHAVNITEISLYDRKLCGRCGDKVYQSRYPRTAEERKRTAEGLGLTSPAVIHFRS

SEQ ID NO: 144554 - protein, 79 aa, Triticum aestivum
  Clone ID: PAT_TA_38972.pep
QLYIDLTSTSNQPIIIYMIISTHQIGVSIHTCTRAHHSSATRACTQKTIVILFSHTDQMGHNSRKTWKRTEPCAYIPSS

SEQ ID NO: 144555 - protein, 43 aa, Triticum aestivum
  Clone ID: PAT_TA_38973.pep
GKFDATRLNFQPTRVYPFPGCQPEVHALDLGYNFGGERLCLEV

SEQ ID NO: 144556 - protein, 57 aa, Triticum aestivum
  Clone ID: PAT_TA_38974.pep
RSYNPGADGPNQKNNPLVPNSKLSENPNPDKIRLPKFRTNRKKKISSSSKKKTKSGK

SEQ ID NO: 144557 - protein, 103 aa, Triticum aestivum
  Clone ID: PAT_TA_38975.pep
CRIVVLTNVPFEIPLTHIKFLSMLITMVVFLMLITKMCAINLAKLRTPVIWKEKWCFLARSYCSLPFEPLNLKWWRLKFLFMEAICFLATVKIEDPILCTFPS

SEQ ID NO: 144558 - protein, 74 aa, Triticum aestivum
  unsure (1)..(74): unsure at all Xaa locations
  Clone ID: PAT_TA_38976.pep
ACRRQIRCMSLVKAKLSLCRCCKHRLYIHKDESDYSYAYTLHHWLFLIGHTTYGLQESSVIIHQLPGRPXIFDR

SEQ ID NO: 144559 - protein, 91 aa, Triticum aestivum
  Clone ID: PAT_TA_38977.pep
AEVLLPLFDFLCLVLGIGVSSTMAASLFAGASPLSAASSEVSMILSLGIGGLSSTSMATSGSFAGASLLRDELSPPCLDLFSLAGASLSPS

SEQ ID NO: 144560 - protein, 57 aa, Triticum aestivum
  Clone ID: PAT_TA_38978.pep
CFPLVKSVVFYDKSTLWSCLSGTTCSHVCSRTSSCFGACYRSSSPGNPVTLSRRRAN

SEQ ID NO: 144561 - protein, 69 aa, Triticum aestivum
  Clone ID: PAT_TA_38979.pep
CRPYCSGGLKWLLRLRAKLLGAQSRGSRRQSMATRSAQSTDRVNPRLRLRQKVQKLLNYKTIQRWHKRW

SEQ ID NO: 144562 - protein, 76 aa, Triticum aestivum
  Clone ID: PAT_TA_38980.pep
HPQLGIKTRIDLGITIFGRQFFDDASISLRNFFLSRDYKTFRHNIDKFICSNQFLNDSKNIGMNTYRFKICSFLIR

SEQ ID NO: 144563 - protein, 55 aa, Triticum aestivum
  Clone ID: PAT_TA_38981.pep
FWGGPFFFIFFYFLKYFFIFYFCELNFLIFYFDFFFFFFFFFYIFFFIFFFFFFF

SEQ ID NO: 144564 - protein, 58 aa, Triticum aestivum
  Clone ID: PAT_TA_38982.pep
MVSVSKKKKKKKKKKKKKKKKKKKKKKKKKKKKKKKRKKKKKKKKKKKKKGAPQKVQI

SEQ ID NO: 144565 - protein, 55 aa, Triticum aestivum
  Clone ID: PAT_TA_38983.pep
LPTELSVINQAAAAFQHFFRGLLSMVDCFASVVVRFRVPILCCACRATLTLVLVV

SEQ ID NO: 144566 - protein, 71 aa, Triticum aestivum
  Clone ID: PAT_TA_38984.pep
TLAVVLDFTFFTQMSNDSETFCNVFIYNFFSFFLIFSEFLELQKYGGCSNLYRLCPVFTYCCYSFIICVCL

SEQ ID NO: 144567 - protein, 48 aa, Triticum aestivum
  Clone ID: PAT_TA_38985.pep
FFGHSILYSHEGKRCMHALVLSHPFAGTCRSAFFLKLGAHLYAKRHPN

SEQ ID NO: 144568 - protein, 68 aa, Triticum aestivum
  Clone ID: PAT_TA_38986.pep
RSRNDALDAVIAHRARALPCQLHGHHDTRHRDVTRGLQTLSGDVSFQGGAFMSLWLDLRCYGEVGTKF

SEQ ID NO: 144569 - protein, 50 aa, Triticum aestivum
  Clone ID: PAT_TA_38987.pep
KVRYFTLSLTGTPFSCFFALPPVSISTWFHLEQKFHDQFYCGDNVLILPQ

SEQ ID NO: 144570 - protein, 59 aa, Triticum aestivum
  Clone ID: PAT_TA_38988.pep
KFQGNFNHNNNNNLTIHGQMALQVHRIPNRRFPGLVHFLMSLLRYYRCTSRYIAKGIHI

SEQ ID NO: 144571 - protein, 92 aa, Triticum aestivum
  Clone ID: PAT_TA_38989.pep
HPMMAKINTDGDGFTNLTNLTPFGNANPGPIKDFPKVFKTSQFHPTLPSKEPMHLRMASYINFMQLPTPVTIQPQLHLRPALNLYDQIFCYY

SEQ ID NO: 144572 - protein, 77 aa, Triticum aestivum
  Clone ID: PAT_TA_38990.pep
PYGNTFIILLQTLVIYVSHAHIIHTINHIITMEFIGRPYIHGMIFVHRSKQEWHVYLRETSIYTHSLFTHTSGPRLQ

SEQ ID NO: 144573 - protein, 107 aa, Triticum aestivum
  Clone ID: PAT_TA_38991.pep
PWRRRLFPRRCSTGNAHRLFHQQSCHWCQYMHGFRKQGRSKEELFTMVLNCVSDALCNAASEKRLSLRCDLCGSAQVRSRDLIVHEGGGVCRDIVCHGGAEPLVHAV

SEQ ID NO: 144574 - protein, 74 aa, Triticum aestivum
  Clone ID: PAT_TA_38992.pep
GRPGSVRTLNAPNTSAHPVSTFFYQIVLLVCCTHLHVSIPSPSGGSFHPARPTLTTQVSNTDDFLPFTNTYMSL

SEQ ID NO: 144575 - protein, 72 aa, Triticum aestivum
  Clone ID: PAT_TA_38993.pep
KGYGLVMALDVPRSITIFVGFDIIQFFVISLCVGGWLMLSRMDYRHSHLQCIARLSTMAHVSSLLLTCFRRP

SEQ ID NO: 144576 - protein, 91 aa, Triticum aestivum
  Clone ID: PAT_TA_38994.pep
DCEVRFVPADNLLGEHGDYDGHDVDPFGTDVNVMSHCECMQTLPFVKIWHAVMMLKTVRDVTFVASRVLYGIYIPRSSLRQSGKQSSKIIA

SEQ ID NO: 144577 - protein, 53 aa, Triticum aestivum
  Clone ID: PAT_TA_38995.pep
TGGIKVHLPIFTWSEHIPQRLTFRNGGSSDYLFHIFISHMYPRSFAPSGITIK

SEQ ID NO: 144578 - protein, 64 aa, Triticum aestivum
  Clone ID: PAT_TA_38996.pep
SDTLFITGQFHHGPLMGIKWYTVHYGPVLPRVVNGPRVIRASYGPKDVMGHTWAVSWNCHGRCP

SEQ ID NO: 144579 - protein, 51 aa, Triticum aestivum
  Clone ID: PAT_TA_38997.pep
TFWGAPFFFFFFFFFFNFFFFFFFFFFFFFFFFFFFFFFFFFFFFPPSTRE

SEQ ID NO: 144580 - protein, 90 aa, Triticum aestivum
  Clone ID: PAT_TA_38998.pep
ELLMVSQNWGHSPCRVPARWAGPRTPCRFTSGPHQGGPWLEEGILPKTWRLLQILRCRLQHNYLIHSRPWYNPSQPWYLYKPGGQGSYMK

SEQ ID NO: 144581 - protein, 43 aa, Triticum aestivum
  Clone ID: PAT_TA_38999.pep
ILPFGFLNINHNYWKINPKVKLNLNLNQPMRPLDYPACPAGSP

SEQ ID NO: 144582 - protein, 96 aa, Triticum aestivum
  unsure (1)..(96): unsure at all Xaa locations
  Clone ID: PAT_TA_39000.pep
FGSPSHQHHNPSXQSHAAGRSLRLCGSLARFRLATVSWRLPSPAARAVPPAVFGSRCGDLYLSSLLPIGKTYVYPAVILFLFNQKRGTGVTETAGT

SEQ ID NO: 144583 - protein, 75 aa, Triticum aestivum
  Clone ID: PAT_TA_39001.pep
QHGANSQKTRAMQVSVVGWEKHTHQCMHGMHTNFKCVISGHVYLTVCHNVYCRNSLPFVFHMGRPWLYFYESVEM

SEQ ID NO: 144584 - protein, 124 aa, Triticum aestivum
  Clone ID: PAT_TA_39002.pep
FRVDSDDKNTWVLDWMTENTHYKAPASELLHALPISPPPEGARCVYQEPELTAHYMQVIMKPLKPGQAPRTKFLVRQLLYVPRTVYRILTKTMSPIKGHDSSDKEIVGIMKNLLFSVIHAIPVN

SEQ ID NO: 144585 - protein, 32 aa, Triticum aestivum
  Clone ID: PAT_TA_39003.pep
TWMKLARYEKKNIMIYIFKKKKHSKWVLPVDP

SEQ ID NO: 144586 - protein, 51 aa, Triticum aestivum
  Clone ID: PAT_TA_39004.pep
YFNADSSLDGNFISLWTICGTSAIYLRSLWLNLSGRFFRVRVDNFVGFEEV

SEQ ID NO: 144587 - protein, 114 aa, Triticum aestivum
  Clone ID: PAT_TA_39005.pep
SKTPRRSDNNNNDVKLKHSRPNVPSMKQVAPSPTATVTRASNKKRFARKFKRGTIKLDCIVKFHKLLDKNLKFAKNKMRLTTLHDKSKLRETILLVKVVITLDPNTMKSNATAN

SEQ ID NO: 144588 - protein, 101 aa, Triticum aestivum
  Clone ID: PAT_TA_39006.pep
RGGKGLSEILSPGCRDLSQTSSSAFCRRRAIARRAIACSSEMHYSYSFLFDFSFVFVTVLFVSFRLLIGLSFAVTFLLILRFIGLGIAVGLYRMSVLRESG

SEQ ID NO: 144589 - protein, 99 aa, Triticum aestivum
  Clone ID: PAT_TA_39007.pep
TLWGARFFFFFFFFFFLFFFFFFFFFFFFFFFFFFFFFENLRPLLQLVIFCMLHTSIALSFLYTLLFSYMLITSSGFPKVRDYVGLFIACCNAIHVHII

SEQ ID NO: 144590 - protein, 62 aa, Triticum aestivum
  Clone ID: PAT_TA_39008.pep
KLNTRQKNGLFAINLIPSHNPKHEARIVKQFRILTRSGHNASPEKLLMDATYFVLNIFTLAA

SEQ ID NO: 144591 - protein, 74 aa, Triticum aestivum
  Clone ID: PAT_TA_39009.pep
HRVSSRTSNAQDTSVPRSCQASSKRKIIIIIKYISDTIDYEQTLWLQLMSPTPMCGWMIFRPRRRMRMSRCACY

SEQ ID NO: 144592 - protein, 65 aa, Triticum aestivum
  Clone ID: PAT_TA_39010.pep
TLHVSFLLAFSLFASLPFFFFFFFFLLNLTFLAFSVCRFTGYNACIGIDTSMPQYQMYCILPEFR

SEQ ID NO: 144593 - protein, 68 aa, Triticum aestivum
  Clone ID: PAT_TA_39011.pep
KLAIATSCTSFVSNDQTKTAYGSPPLSIPHIYLQYSDCFIIFLLVLRLLAGIDLRGQADRASGIVSNL

SEQ ID NO: 144594 - protein, 51 aa, Triticum aestivum
  Clone ID: PAT_TA_39012.pep
ETWFCSFPVFTRIEHFHLQAIFNSIVSQIEQPSHILCNLWIHIYTYFSQPM

SEQ ID NO: 144595 - protein, 78 aa, Triticum aestivum
  Clone ID: PAT_TA_39013.pep
DTLSLLDCISLSLPVLNSLHAYSQNISFTRGGVDALLQSYEEKLELEVSTLQEFYNEWESNIIINIKNYYRYALCDLG

SEQ ID NO: 144596 - protein, 48 aa, Triticum aestivum
  Clone ID: PAT_TA_39014.pep
FARLLARLAVYHFYSPTQTLDSCETCHTLRYLGMGPWFFQQLRNVQRV

SEQ ID NO: 144597 - protein, 69 aa, Triticum aestivum
  Clone ID: PAT_TA_39015.pep
LGRAPDDMGGLASPCSIHSKLVPPRSPKDVPISLYSRLRYSMHGHILNCYIPLYICSAIHYQAMNCPGS

SEQ ID NO: 144598 - protein, 84 aa, Triticum aestivum
  Clone ID: PAT_TA_39016.pep
WKKIMYRWARKLTTGQRNQIKARRGTAVSSRGLSWCAYKWSGKHALLAMKYTMRGDRFASYTRRITRIPRLGLIPSSAGSRARL

SEQ ID NO: 144599 - protein, 58 aa, Triticum aestivum
  Clone ID: PAT_TA_39017.pep
AMVWVGRFVRQADATLDSPNCYSKHYTTLSYINFFGHMQSMVVLHDTRYLRVTLCLGP

SEQ ID NO: 144600 - protein, 48 aa, Triticum aestivum
  Clone ID: PAT_TA_39018.pep
NAHQVFDVMFARLSVKENHFDPYTVSKVICVFHPKHTYSSLDTTFVIF

SEQ ID NO: 144601 - protein, 53 aa, Triticum aestivum
  Clone ID: PAT_TA_39019.pep
KVNRCQYRPNLKADECTKCDCFCIKISNEAPKDPLLARNPVRPMFSSRRKLLF

SEQ ID NO: 144602 - protein, 57 aa, Triticum aestivum
  Clone ID: PAT_TA_39020.pep
GTSMCFAWSVILFYFVLLAVLFYFVLLAVCIAYQDLKFGGVKYSSDIYLIIRLHIGY

SEQ ID NO: 144603 - protein, 78 aa, Triticum aestivum
  Clone ID: PAT_TA_39021.pep
YPSGKDMIWYVYVLVCLSKVFSYVCVYIYVKLNEFKKKQRKHGLYMLFAVCWYTAKSFAVCWLTANMPCVSYLSNLGQ

SEQ ID NO: 144604 - protein, 87 aa, Triticum aestivum
  Clone ID: PAT_TA_39022.pep
GGINEEDEDGGYVALDGGAADQPQLDRASSNEACASMPLAAGDDQAKLSSRPLLYPKLPPPQSCAIRPLLSWPDLASLTLLSCLFTF

SEQ ID NO: 144605 - protein, 84 aa, Triticum aestivum
  unsure (1)..(84): unsure at all Xaa locations
  Clone ID: PAT_TA_39023.pep
LFLSRPHFWPIVMDWLXLVAFGDYMFRLLMFRMSMYLDLAELMIGSMIPFNVVSIMALIISYLCIFSKMMHFSGKKHTLIFGRY

SEQ ID NO: 144606 - protein, 75 aa, Triticum aestivum
  Clone ID: PAT_TA_39024.pep
AQTHVLRGIRTLYLGSRERFVHLFEHHAEEMLNSSSSLRVEFPHTEGPAFTRLDSTNWHNLRYLNQTEISFIEIS

SEQ ID NO: 144607 - protein, 48 aa, Triticum aestivum
  Clone ID: PAT_TA_39025.pep
EISKQRREILVQIIHLESERIECTCMHALHEPEREMGSLILQHHIITY

SEQ ID NO: 144608 - protein, 128 aa, Triticum aestivum
  unsure (1)..(128): unsure at all Xaa locations
  Clone ID: PAT_TA_39026.pep
SAILGDHERFLVRFXRDHCSFQKGGPLLSAGMSVYTPMNYHGLNXPVMQRGILSLGGLGHFYVNFSKAFGMNVTVIISSTGKNHEVLDRLGADCFVVTRKADXMKAAMSTMDGIIHTVFANIPMVPLF

SEQ ID NO: 144609 - protein, 102 aa, Triticum aestivum
  Clone ID: PAT_TA_39027.pep
HFGPFFASRLASRGAASIYMSCQNGDRVHLLRDPHQYGLGNITMPFARPHGNGQVLRLERAGRGAFDIHCLYKRIKIPPFSHAFFLLLPSHLRAIAPYSTPS

SEQ ID NO: 144610 - protein, 53 aa, Triticum aestivum
  Clone ID: PAT_TA_39028.pep
FKIAPCYSCSESHKLSLYTSGNVSLWNLECIFLRWASSNALGPHEQASWMHTH

SEQ ID NO: 144611 - protein, 119 aa, Triticum aestivum
  Clone ID: PAT_TA_39029.pep
EKQGKHVHQPICIDYPNVTSGIRSCVPKHTSSESIEYPIVTTGIPRKTYIKSSQIHNSETSKVKLNSSQEGRGGETPYDPTIVSKLVVHQDRAKSRAREREREIKHIATGTYLSPECEL

SEQ ID NO: 144612 - protein, 70 aa, Triticum aestivum
  Clone ID: PAT_TA_39030.pep
LLLDALHVATPFLQTYFTSRLFLQSVCTIHSDLTACAHVLTPSATFQSFTDLCRNLIARQMVHHYKVELG

SEQ ID NO: 144613 - protein, 63 aa, Triticum aestivum
  Clone ID: PAT_TA_39031.pep
MLHLCHIALHYHVVDIVFVPNPPFIIISYMSLLGGCISRYTSLRHAHTLIFCSKYCLVLPHFS

SEQ ID NO: 144614 - protein, 62 aa, Triticum aestivum
  Clone ID: PAT_TA_39032.pep
GTRQVGMVPDSRSASPPGQTSSLTLLSISRDITIYFCVRLMSILCMRKMTMYLCTRHMPTLF

SEQ ID NO: 144615 - protein, 94 aa, Triticum aestivum
  Clone ID: PAT_TA_39033.pep
VIQSHVQVLCNVYMYEAVETTTTGGHLTRLFSIHHMYSTCVCARTYALSAAPRVGIHPSLQVHPLAVVLPFAAAFFPGFLIENTRYSVRCACWC

SEQ ID NO: 144616 - protein, 62 aa, Triticum aestivum
  Clone ID: PAT_TA_39034.pep
SYLGCTSKKGQYSSTGPSTYQIIKLMNANHMTLIKSSLTIIPMCPRERFPSYKNLLSIVLCY

SEQ ID NO: 144617 - protein, 67 aa, Triticum aestivum
  Clone ID: PAT_TA_39035.pep
VGNTVHGRTSGSLGHASPHVSAPVSRPQWDTTRTYPPEPRYPTICLQHTSQLSTRNRCADDVVDDYS

SEQ ID NO: 144618 - protein, 138 aa, Triticum aestivum
  Clone ID: PAT_TA_39036.pep
DVCGEEVTKIILSIVRREESPECINDTVLVLIPKVTSPTALSQYRPISLCNVLYKIASKVIANRLKLILPDIISEEQSAFVPGRLITDNIISAYECLHFMKRSRSKSNNFCALKLDMMKAYDRVEWTYLRAIMTKLGF

SEQ ID NO: 144619 - protein, 48 aa, Triticum aestivum
  Clone ID: PAT_TA_39037.pep
KYVILPASNLLVGWLKNMQEISMKSLLTIDTFYTYITRCLTSHPLRLQ

SEQ ID NO: 144620 - protein, 104 aa, Triticum aestivum
  Clone ID: PAT_TA_39038.pep
PACRISSRGALDSDRASFASRKALLRSTVLALLSSSRIAQRLAASFSSRVIVDIFSPHWRRAAYSAFKLCRFLLGKRHCYSGACFFGPGHLGPKDLDRGGTICL

SEQ ID NO: 144621 - protein, 97 aa, Triticum aestivum
  Clone ID: PAT_TA_39039.pep
RVHGQGAVQLEIKKGHMYLSRGWEKFYRAYDLQLGYFLLFRYDDDANMLIVKVFNKTMCRMRYAADDDAGNGSSSSGTGYSQSSSDYGCSESSSDSG

SEQ ID NO: 144622 - protein, 63 aa, Triticum aestivum
  Clone ID: PAT_TA_39040.pep
TLRSSLWYLCLWHRLYIVCVFRFRCSMFFVSNSSSVYSFRVILCQVQRDLMSLFQRLFLVCEL

SEQ ID NO: 144623 - protein, 50 aa, Triticum aestivum
  Clone ID: PAT_TA_39041.pep
APKPKNTDDAQTMPSNKDTISKNDEFSYILTGSLLDYPVSSVTAVYASPS

SEQ ID NO: 144624 - protein, 75 aa, Triticum aestivum
  Clone ID: PAT_TA_39042.pep
VEAEIIYWGVASIYKDRDGAALLRRCPWRFTSEGHVAIMQHIGGCSMFPRMPGLSGGRSRFSGVQARRIEHLKQI

SEQ ID NO: 144625 - protein, 62 aa, Triticum aestivum
  Clone ID: PAT_TA_39043.pep
CDCVRDCDWEMSPDVRSQITSLKRHVLTTQQVQRIEEELGDVLRRPVFNSKLMQPEIVVLRK

SEQ ID NO: 144626 - protein, 134 aa, Triticum aestivum
  Clone ID: PAT_TA_39044.pep
NEVTEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSALGPQAVSKHMIAV

SEQ ID NO: 144627 - protein, 85 aa, Triticum aestivum
  Clone ID: PAT_TA_39045.pep
ENEKNYCDMQNMCLRTGTTIFISIWIALHMDDGDHIYGDSTRGSLRLLNLIATGCPHTLALAATVGVGGSAYSTPYGRRLMINEK

SEQ ID NO: 144628 - protein, 50 aa, Triticum aestivum
  Clone ID: PAT_TA_39046.pep
HSSKKLNIAQYSQCFCHAPHKPSCIVNILKANIGTLGLLYNGIVQWDKCC

SEQ ID NO: 144629 - protein, 98 aa, Triticum aestivum
  Clone ID: PAT_TA_39047.pep
YGSQHEHLRRVWGPVVGALRAPTNRAPYQAAWTEKCNQTGQHNLAQTLRLNDTRRPNPYLGPIHVALSLHGAFFNLSRRLEAKPSGLCGSPNIHIMNQ

SEQ ID NO: 144630 - protein, 56 aa, Triticum aestivum
  Clone ID: PAT_TA_39048.pep
GVMHHVSLILHAIFCNVCDYLQVITCWPYYSVIYTCSNCCIVSSCSSSLSTCQALT

SEQ ID NO: 144631 - protein, 136 aa, Triticum aestivum
  Clone ID: PAT_TA_39049.pep
SRRTPNVSGDIGESKKYVIHPQGGMTIPFGGEKPTPERWSWIDPSVFKLRSETFLRDKKKCPAPNYAAYYPIGVDLFASPKKVSHIAEHIDLPQVKSHDKLPSLLIVNIQMPTYPAAMFLGDSDGEGFSLCLYFKI

SEQ ID NO: 144632 - protein, 48 aa, Triticum aestivum
  Clone ID: PAT_TA_39050.pep
NNLKVGKRFNFPNKCPLVLNSGLFPGENNYVNDLRFNKNFPGKFKISP

SEQ ID NO: 144633 - protein, 62 aa, Triticum aestivum
  Clone ID: PAT_TA_39051.pep
PKAPHDSSSRSLKHLRHRDAPLGVPPFFFNNYRLVSVEPKFLLLHMCCAIRAMPFCFALPAV

SEQ ID NO: 144634 - protein, 71 aa, Triticum aestivum
  Clone ID: PAT_TA_39052.pep
AADAGVYLCGRCATHDGCHELARRLHQPCQQFNSFCIANFGLMIDVAKDFRIISIHRIFQIQEQMNLDTAT

SEQ ID NO: 144635 - protein, 90 aa, Triticum aestivum
  Clone ID: PAT_TA_39053.pep
MDICGGGKFQRGMVCPWSCRRGRSICRIHIDVSACISSLFSVPPFSDFFEAMMLVYGFHLLDFTPNAMACMAIFAHLCEIFVGVAPNMDL

SEQ ID NO: 144636 - protein, 106 aa, Triticum aestivum
  Clone ID: PAT_TA_39054.pep
LLLSPYTSKPEMSAVIKPIMYHEALYYISRSMYVCMPYGMYALMHDFVQKLKETGTPHRACMKVNLVSRKAGHVKPAFGNLNCRLRKPSALRIRSLTLGTGWAPGR

SEQ ID NO: 144637 - protein, 108 aa, Triticum aestivum
  Clone ID: PAT_TA_39055.pep
THGSRGRSGTAIARPEILVIFLVTTSTPRILSPQARYTMLALNWLIAPISRIWSKGSGPGGCLFQIWAKAVLLARVPGVALVVGRDQVNHLGFSFGPLEVLHFPLVDP

SEQ ID NO: 144638 - protein, 75 aa, Triticum aestivum
  Clone ID: PAT_TA_39056.pep
LKDNISHPSDTTTTHHTSPCPAGRNRLDEGQARVYPRKRLSRIFPGRHERHMRVIAITSMSIANSKKFHLCTQSV

SEQ ID NO: 144639 - protein, 99 aa, Triticum aestivum
  unsure (1)..(99): unsure at all Xaa locations
  Clone ID: PAT_TA_39057.pep
TWHEPAWTVAPAPGWKLRPSSDCRRSARRACWRASMSGCWTDPLPSTSLTALAHPDLLPRLCVLSARNGQRRPSRFXVQVIAPPSNDRSTVRPSVYRPH

SEQ ID NO: 144640 - protein, 77 aa, Triticum aestivum
  Clone ID: PAT_TA_39058.pep
IPFVMTKSLLTLMGHSRISDDTIWPISAIRVCSSGKQARIRYNRIYMETKMYPDVLFLGGELVTAREVGIHGYGPNM

SEQ ID NO: 144641 - protein, 64 aa, Triticum aestivum
  Clone ID: PAT_TA_39059.pep
LCIFQGLYGYVFHFLFHCSSKFLNFLKCGKNYKKIIEHFLKSMIFLQIREHFFQICELFQIHER

SEQ ID NO: 144642 - protein, 35 aa, Triticum aestivum
  Clone ID: PAT_TA_39060.pep
CCSIKLSIKGHPLMDELFNFELNHSYFHRAEPNGH

SEQ ID NO: 144643 - protein, 85 aa, Triticum aestivum
  Clone ID: PAT_TA_39061.pep
GCPCASVLRCRWCHRGTHSSWGSLWCMASSALHVNIASYVHGQGVIFLLDGCSDASILQRNLLLSFILWDTFCGVIYLGFRSASQ

SEQ ID NO: 144644 - protein, 74 aa, Triticum aestivum
  Clone ID: PAT_TA_39062.pep
CKGRPNETTAQRSNSDTTQRSPTCQVERTTQSSVAPLVRVNGQAYDPTAMFVVPSYEGFWQGIGENWPKFRARG

SEQ ID NO: 144645 - protein, 124 aa, Triticum aestivum
  unsure (1)..(124): unsure at all Xaa locations
  Clone ID: PAT_TA_39063.pep
VGQNGNQNGHHSKLSDFQRTNPPNFSQVADPLDADDWLRTMEKKLEIARTEGNDKVPFATHYLEGAAAIWXENTKAMWPINEEVTWEKFKDKFRKYHIPTGVMKAKQREFLALVQGNQYVAEYL

SEQ ID NO: 144646 - protein, 78 aa, Triticum aestivum
  Clone ID: PAT_TA_39064.pep
GEHKKAEKHKKKDGEHKKDGEHKEGMMEKIKDKISGDGKKDGDHKEKKDKKKKKDKKHGEGHKDDDGHGSSSSDSDSD

SEQ ID NO: 144647 - protein, 119 aa, Triticum aestivum
  unsure (1)..(119): unsure at all Xaa locations
  Clone ID: PAT_TA_39065.pep
WTRWPWRVARPSRGLRPMREPKHPWPRPSTPLAPGPASSARHALPPARPPCRHGPGPKHXGPPRASPPVPGSAAXRAPGPPRPCHGVSRRASPRKRQGPPPGSSAHPGAGAKRPPLWRH

SEQ ID NO: 144648 - protein, 72 aa, Triticum aestivum
  Clone ID: PAT_TA_39066.pep
FNPNRMIFGVCIYWWKRGLESKARQCGTKRRQKYMKQRRKEADGPKGLRPAARTLQLQFFLNKIRPKNEKAG

SEQ ID NO: 144649 - protein, 68 aa, Triticum aestivum
  Clone ID: PAT_TA_39067.pep
RSCSTVKKKKKKKKKKKKKKKKKKKKKKKKKKKKKKKKKKKKKKKKKKKKGPPKRLKLNIREKEIKNP

SEQ ID NO: 144650 - protein, 86 aa, Triticum aestivum
  Clone ID: PAT_TA_39068.pep
GCRIRPVTSSSLHLARRQNHLHRHRSRDDRCLPKLRLDGHRPRPMPCPFPWNRLSCGALEAPIHSETPPRLRGARTWCIDRIVVEG

SEQ ID NO: 144651 - protein, 63 aa, Triticum aestivum
  Clone ID: PAT_TA_39069.pep
HIVCTVFRPRKVVSFLRYKKKKKKKKKKKKKKKKKKKKKKKKKKKKKKKKNKKKKKKKKKKII

SEQ ID NO: 144652 - protein, 35 aa, Triticum aestivum
  Clone ID: PAT_TA_39070.pep
GILHTLCIMCQFHVRPLTAPCLHRRLHQLTDVIHH

SEQ ID NO: 144653 - protein, 53 aa, Triticum aestivum
  Clone ID: PAT_TA_39071.pep
AIIFASPRKKVEVVYLKSKPRRGKWERIHEVKTPFTTRRQAGSTGHVAGSTAG

SEQ ID NO: 144654 - protein, 70 aa, Triticum aestivum
  Clone ID: PAT_TA_39072.pep
QTWPAHLPSAMPYVSDLSAHTRYRLDLVAFKPVATITCMAYCQHSPLRHDMAACSSSPSRPPDASVFLAA

SEQ ID NO: 144655 - protein, 36 aa, Triticum aestivum
  Clone ID: PAT_TA_39073.pep
AYRFVLFSRIQCTCHINFFEILKFQIFFQIHIQTSF

SEQ ID NO: 144656 - protein, 137 aa, Triticum aestivum
  unsure (1)..(137): unsure at all Xaa locations
  Clone ID: PAT_TA_39074.pep
RTSALRRVAWHNQGEPKKCQEKENSVPVNGFNQALPPKGATLDPDQDPSDHGNANNDDGLPNEYVLRARLNLLLQKLAENDPNPYGTPPTKKEAVXTLPTVKIXEVVNCSICLDDLDIRSHAKQLPCEHKFHPPCIL

SEQ ID NO: 144657 - protein, 64 aa, Triticum aestivum
  Clone ID: PAT_TA_39075.pep
GICQHGSFERDCSISSINDFLVKFARTEVFLSVWMVAKLKLPHLLFNQFPFWYGTFLLGYRVSR

SEQ ID NO: 144658 - protein, 76 aa, Triticum aestivum
  unsure (1)..(76): unsure at all Xaa locations
  Clone ID: PAT_TA_39076.pep
WCLDDGHEDLCSTADSXSQQRIMMAELAERVSEMVRGSGHRDAQRYGGWSGDHVALQVAILPQWRAMPSTDPVXSG

SEQ ID NO: 144659 - protein, 124 aa, Triticum aestivum
  unsure (1)..(124): unsure at all Xaa locations
  Clone ID: PAT_TA_39077.pep
PGRPRRAELTNWFAPCHNPSIAAAHGNFMTCSIESPWETCRLVAHFNRHTTDDPFIRLYTKANDGSYIDHKEIPLVWHHYDADXNFGSCQANELLNHLESVIANNPVVVNTCHYIVAVHPQGIS

SEQ ID NO: 144660 - protein, 93 aa, Triticum aestivum
  Clone ID: PAT_TA_39078.pep
PSYPFFFFFFFFFFFFFFLYHLGENILVIYEQQHWKLKHKTLDIKSLMVIQQMNRGGRTNITAKSTYREIPFSIFPHPHLVVIPGWVWLFGPG

SEQ ID NO: 144661 - protein, 117 aa, Triticum aestivum
  Clone ID: PAT_TA_39079.pep
GICEDVPVVVANVTILTDFVILEMPEDDNMSIILGRPFLNTAGAVIDCNKSKITFHINGNEHTVHFSKKQFQVNGINVIEKSPTITIGSFQIPLPTVKKKFEMLNVGEMHFPIEVNL

SEQ ID NO: 144662 - protein, 66 aa, Triticum aestivum
  Clone ID: PAT_TA_39080.pep
SPPDHRSGYRALLFAGHCSVNIVCVLCDMSKLKRRCELGVVEDHSVFRYCSSHSVCIVVLVMMNKQ

SEQ ID NO: 144663 - protein, 58 aa, Triticum aestivum
  Clone ID: PAT_TA_39081.pep
WTASTTRSTTTATATARRTARTTRTTTATATTTATTTTTTPTPTRTPAASTPAPSTAP

SEQ ID NO: 144664 - protein, 85 aa, Triticum aestivum
  Clone ID: PAT_TA_39082.pep
DKKRDMTVEPAEIRGKEAVCGSRVYSDGHCGEYLRIPLRIRVASISPVLVGAKVNLQSKCKKCLCAGERLSRGMRPVLAFAGVFN

SEQ ID NO: 144665 - protein, 77 aa, Triticum aestivum
  Clone ID: PAT_TA_39083.pep
HGNCCWMATANYDTWQLTFPLHGNYQPFHLFFIFLRFLPRQTYFCSFLIPFSCALFFCRVKKTTTRGAKHISIDLPV

SEQ ID NO: 144666 - protein, 74 aa, Triticum aestivum
  Clone ID: PAT_TA_39084.pep
NDGEHYMVGEHMDGMLEIIFVKISGHCHCDRMNDCDHKDINVYNTNNVNIQARAIWTITATASSASTATSTEPS

SEQ ID NO: 144667 - protein, 122 aa, Triticum aestivum
  unsure (1)..(122): unsure at all Xaa locations
  Clone ID: PAT_TA_39085.pep
MNFIRLSSSPWGCEILFVKKKDGMDRLCVDYRPMNKKNIKSKYPLPNINELFEQLKGAQVFTKLDHRMGYHQIRIREQDIPKTAFQDKICYXEYTVMSLGLVNAHPTFSHMMNFIFNPDTND

SEQ ID NO: 144668 - protein, 76 aa, Triticum aestivum
  Clone ID: PAT_TA_39086.pep
FAFKGNLVLIFLGGPFFFFFFFFFFFFFFFFFFFFFFFFFFFFFFFFFFFFFFVQERYFVYFIHSGRDTTMHIYNF

SEQ ID NO: 144669 - protein, 94 aa, Triticum aestivum
  unsure (1)..(94): unsure at all Xaa locations
  Clone ID: PAT_TA_39087.pep
EVWRQTXEPKGFRLSRIKTEFVRCGFSTTSHKEEVSLDGQVIPQKDNFRYXGSMLQDDGDIDEDVSHRIKAGWKKCRQASSVTIVPQKLTLQVL

SEQ ID NO: 144670 - protein, 92 aa, Triticum aestivum
  unsure (1)..(92): unsure at all Xaa locations
  Clone ID: PAT_TA_39088.pep
IIANGSDEVASFVIDSDSQLEGLAEEEGYANNXFGPIMLVQEEDYFHDGFGDTVEVQEGDPAECSGDTMEVQDGDRADCSIDRTESGQVNIY

SEQ ID NO: 144671 - protein, 78 aa, Triticum aestivum
  Clone ID: PAT_TA_39089.pep
NYSAVVFSRAICYGMCRINHSAREYYKDTSESNTRADRSVNLTSMTKKTDYIKNSYHVSKSNKNSYNFLTVKIESIEW

SEQ ID NO: 144672 - protein, 104 aa, Triticum aestivum
  Clone ID: PAT_TA_39090.pep
LIQKKSKKYKTCAHSLIMSYSNEKKNINMVYIHFYEKSFTKLLFLKQCSMELKGESSGHPRVGGVLKMKSVKTSPKLHFGLTKKDLNLLFSFSCFKLVLYIIFY

SEQ ID NO: 144673 - protein, 84 aa, Triticum aestivum
  Clone ID: PAT_TA_39091.pep
FSTRVCTHSLRQHSRSLQSFKRTTRVRDTLLPARTHICFVLFFPTEFSANRPSHPLIFFQRPATFELFFLQPAIGNSPILFQPN

SEQ ID NO: 144674 - protein, 105 aa, Triticum aestivum
  Clone ID: PAT_TA_39092.pep
IITFVLHHVFKKTSQLYFGSKPVNHPYLAVIELCDSRDEAERCYLFVKQIMWTHKGLLRLTPVFQSTYWDTPGCEHTPDSTLQQLDVMAGPGTSDSDHLLSYTSR

SEQ ID NO: 144675 - protein, 88 aa, Triticum aestivum
  Clone ID: PAT_TA_39093.pep
LMMFFKYACVLFFSRAVKMDRPSVERTCRPKHGSGHPCPPIRSKRTKSGQNRCPFESIRWSCSKGLFGFSRLLRLNSRSGASYFSFFM

SEQ ID NO: 144676 - protein, 93 aa, Triticum aestivum
  Clone ID: PAT_TA_39094.pep
YWTELCFNSDVVIPEYAVMNDTQRLCGGIADMNFPLMTRHEVTDQWFYACMYRRPQSENAEPSYGRWYVADDLLKCNCPCSKECSAETPSTSG

SEQ ID NO: 144677 - protein, 53 aa, Triticum aestivum
  Clone ID: PAT_TA_39095.pep
QDPLIHSWPANRGIVVHSHLINIVIATATSMFQSVLTVTHNRITVCIKEPPNI

SEQ ID NO: 144678 - protein, 49 aa, Triticum aestivum
  Clone ID: PAT_TA_39096.pep
VPEFIHNPENSLIRILFHIIVMMLVVCSAVPCHQTQDELCIRSASDYSL

SEQ ID NO: 144679 - protein, 117 aa, Triticum aestivum
  unsure (1)..(117): unsure at all Xaa locations
  Clone ID: PAT_TA_39097.pep
ESWCCWLTKTIQNLKICNAVKRVKIYENKNTSYMVNEDEYNEVVMSVPYADFYDFDTDRTXALFIENQVWTAYDEYEMPQWYALVHKGITRRVDASQFGNVAITGLSTHSHIKSSEH

SEQ ID NO: 144680 - protein, 57 aa, Triticum aestivum
  Clone ID: PAT_TA_39098.pep
ILSTYSAASSSSVRNFLTLKFLSEEFIKVTYSPRLVDITHFQLVSEQGTPFFCVILV

SEQ ID NO: 144681 - protein, 53 aa, Triticum aestivum
  Clone ID: PAT_TA_39099.pep
INFLYLFYPCEEQKDIKVFLQSMNVRIILNKTVVHLKLSTQNHASLRPKFDGY

SEQ ID NO: 144682 - protein, 71 aa, Triticum aestivum
  Clone ID: PAT_TA_39100.pep
IYMLFAYKTLYVCVMRCLCAYRLVSYPSSIRYVNDCRECSPPLHQSVCACESVQQVQRAMFIRFKFWSRKV

SEQ ID NO: 144683 - protein, 67 aa, Triticum aestivum
  Clone ID: PAT_TA_39101.pep
SFSFSFSSFFIFSFVFFFFPFCVCCKNTEELDFQSNCDIEARWTSFSFVKKTPIILPLCQYLPCYIC

SEQ ID NO: 144684 - protein, 40 aa, Triticum aestivum
  Clone ID: PAT_TA_39102.pep
LLQHCPSEERMMDTMISPQVRMILRTNFKYLQGQNRGPYI

SEQ ID NO: 144685 - protein, 77 aa, Triticum aestivum
  Clone ID: PAT_TA_39103.pep
NSSSSCYPKGSLQRSSHLNTAKQFHPSESKFNPTTTNTVICCLSLSKFSDPHHKTPASCRILPQNPSRSYILAAPHL

SEQ ID NO: 144686 - protein, 117 aa, Triticum aestivum
  Clone ID: PAT_TA_39104.pep
WMPQHTAAPAVQCCRANASMHVRTMLCLLCFSARPSVGSAVQSEKHGWMNDWPPLINLTLFTHSLAVAFWYVPLTRALCTCMAQDARRVAGGDGVGARAEGDGGRAGVRRLAVGGHR

SEQ ID NO: 144687 - protein, 73 aa, Triticum aestivum
  Clone ID: PAT_TA_39105.pep
CSKGTRYANGHKFRKLGGLETCQSSSVDEAYTPKRITDSNPCSPELDVPDRVLTRGRRIHHQSHRTDLPPTAR

SEQ ID NO: 144688 - protein, 45 aa, Triticum aestivum
  Clone ID: PAT_TA_39106.pep
DNDAISAMRAGKLSYSKLNKYWLESSHKRVSSVVLLIFPLCLLLY

SEQ ID NO: 144689 - protein, 76 aa, Triticum aestivum
  Clone ID: PAT_TA_39107.pep
LLTKLKHARWQLHVSAVTWSEVQRVLVGVVGAGRVEEVGRRVHGVWLRLILLHLVRLIHFLHVDDLGVAELLAEAC

SEQ ID NO: 144690 - protein, 85 aa, Triticum aestivum
  Clone ID: PAT_TA_39108.pep
NLFFFFDSKILFKLIILTNGFYVNYKQKSSRNENEECSSNKCKNIYFHNLIVYYYYFFFLWNISGFNPIEMRNLSLVNLLRLIRL

SEQ ID NO: 144691 - protein, 73 aa, Triticum aestivum
  Clone ID: PAT_TA_39109.pep
KPTHDEECRHELVIGRRRGECQCLLLLECERGRSRKPDREWYAEHNGVPSSFRWRSEGSGETRGGSLGRGLVL

SEQ ID NO: 144692 - protein, 76 aa, Triticum aestivum
  Clone ID: PAT_TA_39110.pep
GRKMKFFYCFFSTPNCTLMYFSSLFVIFVILGDNNYMFGHCFRIFNMYQSCYKQDRVFLHRCWDPRQMDHKVFKKE

SEQ ID NO: 144693 - protein, 69 aa, Triticum aestivum
  Clone ID: PAT_TA_39111.pep
KNAFSKNKNFFKILSNFKIKLDFPNCSREIKKIIKIFFLMYLFILYKHKIFCSLKVINFKIFYFLIKRK

SEQ ID NO: 144694 - protein, 36 aa, Triticum aestivum
  Clone ID: PAT_TA_39112.pep
LSSQNVYYNLWLCSTKAIMDERGSLIYYLNCRYCSM

SEQ ID NO: 144695 - protein, 48 aa, Triticum aestivum
  Clone ID: PAT_TA_39113.pep
FLLLFFFFFFFFFFTLYFFFSFFFFKTRVKRPCIDERMSITCLSSGAM

SEQ ID NO: 144696 - protein, 41 aa, Triticum aestivum
  Clone ID: PAT_TA_39114.pep
IPDDRHVRCRVIETCLSKIVPIWGYDNPCLQGLNITCMFVT

SEQ ID NO: 144697 - protein, 78 aa, Triticum aestivum
  Clone ID: PAT_TA_39115.pep
TRSWGTLKHFAIPFMVSQSTFHKVSLDRPKAEGPFGLDGISPAQRVDGTSQTGVVKTVAGIERYGHQFRKHDCMGSPV

SEQ ID NO: 144698 - protein, 57 aa, Triticum aestivum
  Clone ID: PAT_TA_39116.pep
HSVVLRPSMYLNPHERVDKHHRSNEQRNIIVMTHGSTTARKHDTLNNDEDRYTVDRS

SEQ ID NO: 144699 - protein, 41 aa, Triticum aestivum
  Clone ID: PAT_TA_39117.pep
FFFCVSQSPLSSFLCYSPFKNKPKNIYSFLIITLPSYIINH

SEQ ID NO: 144700 - protein, 48 aa, Triticum aestivum
  Clone ID: PAT_TA_39118.pep
CGARPDEPIMQIVHACRSQRVVSWLVAGGRACVVARVSVVRASVLDRI

SEQ ID NO: 144701 - protein, 37 aa, Triticum aestivum
  Clone ID: PAT_TA_39119.pep
HLHQLVRKLRIMIMTLQNRILLEARRSTRSKIRTRVV

SEQ ID NO: 144702 - protein, 120 aa, Triticum aestivum
  Clone ID: PAT_TA_39120.pep
HGLLFIQPPLRATPPATVQPPLHGHPSTLHYSCSPPRGRTIHPVLHGVLFIQPQPARSIGVLFIPRQRHRSLFIHPPPPATLTVHPRGSIDQLLLAAVAKESLDRVQLTAIDRSPGFSNT

SEQ ID NO: 144703 - protein, 134 aa, Triticum aestivum
  Clone ID: PAT_TA_39121.pep
LHTNSGQIKSQTRRAWPSILYMHRIMQPHPFPHQTRVVIKPYQPWRRLSPRPVWRNHQSPARSRDNSPRESRGCERDWVGRGLEPVAACSVASHWFPRQGGLSGAAQRASSAARPRSVAAAAAVAVGVLPTRIP

SEQ ID NO: 144704 - protein, 63 aa, Triticum aestivum
  Clone ID: PAT_TA_39122.pep
QRYYRLGLKEHTFEQLARHTDKTVWFTGPNLMLSITAPASDTSCRFSRITIGISPCLQHHTAS

SEQ ID NO: 144705 - protein, 28 aa, Triticum aestivum
  Clone ID: PAT_TA_39123.pep
LSAHGACDIILTLPGYSFPAGSDKRLLL

SEQ ID NO: 144706 - protein, 51 aa, Triticum aestivum
  Clone ID: PAT_TA_39124.pep
IMHISALTTHLMHKNVQTNHDDSQKITQHSCCSKLIPEIFLKQYEAMDIVS

SEQ ID NO: 144707 - protein, 66 aa, Triticum aestivum
  Clone ID: PAT_TA_39125.pep
PMIVEEERRDAYRGIPKLRCLRLLEILSWGALGIPKLELLCVLNSSHITVSLFIKSFIHNKLNKNS

SEQ ID NO: 144708 - protein, 98 aa, Triticum aestivum
  Clone ID: PAT_TA_39126.pep
ASMRASVGSATGPGHCSSTWLTVLFRLTSGRWPWRGYVFRPLRTETPRRPLPLRDGGVAAGAQGPGESSGECISWHCVLITVSCVLVVSVTMELLSSV

SEQ ID NO: 144709 - protein, 140 aa, Triticum aestivum
  Clone ID: PAT_TA_39127.pep
DTAPVVGRSTTGDLPADTGPKLLMRLVANKRSNQPSLRPCRAREDHLHEGVLQGQITRVTPAAIKLRMQRFSKGNFIGTSVQRCRTVLSCTKRATFLFPEPHSAVGSEFHLRRTGDRDSDDVATEGQRFSGGDIGGTSLR

SEQ ID NO: 144710 - protein, 137 aa, Triticum aestivum
  Clone ID: PAT_TA_39128.pep
NSRFDDLVTIVQKYYAMESAWKTESKFWDNPAPNTSLVQNKRVHHYQAPVLNTKKPKTPKGYGTVLEGWLNGPCKIHSTEGATPTHSLRACWILRQVAKSGEKLLASESQPSNTSTVLTVFETLASNYMRKQTLRNL

SEQ ID NO: 144711 - protein, 103 aa, Triticum aestivum
  Clone ID: PAT_TA_39129.pep
HRVPCLLLPSTLDAQFVTPYPRSAGFDTETGAFTESSAASSPRGLMAPSIIYNNAVRGEVFLPGQIFMFGGFALWANSLGHLEQIDSYLPGHQISFGKPRLRH

SEQ ID NO: 144712 - protein, 77 aa, Triticum aestivum
  Clone ID: PAT_TA_39130.pep
KMSIGAKCFLDSFRLLFCRQMYALHHFCVTRNSKMLLTMYFIFCGAQAGACIMLGHVPFFLSFILKYWSIAHVVLSM

SEQ ID NO: 144713 - protein, 109 aa, Triticum aestivum
  Clone ID: PAT_TA_39131.pep
AMVNLHFLFYVACPLITRSSDVFFSSLLINAASVVKSISSDKLCILKRKKKQINLWLDGYEDSGILSRIEFKCQTLFDVGAHIFLNLFQPFQYCAFSGRRRSRRLRMRF

SEQ ID NO: 144714 - protein, 77 aa, Triticum aestivum
  Clone ID: PAT_TA_39132.pep
SAAYVIFTCFGVAEMLIFIFVKPPIYFITKKAMKLEHHSLLLRVESCCCYAVGMVAKKHYGKLRRTLLKFFGWLLMS

SEQ ID NO: 144715 - protein, 85 aa, Triticum aestivum
  Clone ID: PAT_TA_39133.pep
ECKERTNKNHIVVKLVTRLCVQPIITIFHLVNHSLSGPVHVEMFRPSRRHERVKVIPALGAADAPRIAADARPLVSAPVGRIVDR

SEQ ID NO: 144716 - protein, 78 aa, Triticum aestivum
  Clone ID: PAT_TA_39134.pep
SYFTKFQSSKLGDAPLGIPPYFFNNDRLLSVEPKFLLHHMSCAILALLLYFALHHLCIRYHHVKFFNEIDSLHRFKTI

SEQ ID NO: 144717 - protein, 61 aa, Triticum aestivum
  Clone ID: PAT_TA_39135.pep
TGLVNKPLFESKDKQLWNISKSKEKHAKQLEHPNAGEKSPSRKQVNGSGITLSLMRSTLTN

SEQ ID NO: 144718 - protein, 139 aa, Triticum aestivum
  unsure (1)..(139): unsure at all Xaa locations
  Clone ID: PAT_TA_39136.pep
LPLDEQEPYRNRRQTISQNVMVAXDFDLKFVHIHPGWEGSASYARVLNDALNHGFEVPDGKFYLVDADYANTPQFLAPYRGTRYHLNEQGRVRQRPQNHRELINLRHAQLRNHVERIIGIWKMRFPILKVTSHYLIEKQ

SEQ ID NO: 144719 - protein, 35 aa, Triticum aestivum
  Clone ID: PAT_TA_39137.pep
HYGSSLIASFFLHNTFAPFPWLLRLTEGTPLVCSF

SEQ ID NO: 144720 - protein, 48 aa, Triticum aestivum
  Clone ID: PAT_TA_39138.pep
TDYPDPTELTWQVYILGEFDVLVHSLLISFVLLFNKSGQNRCKDDNGG

SEQ ID NO: 144721 - protein, 45 aa, Triticum aestivum
  Clone ID: PAT_TA_39139.pep
LSTASQGKRERGIDKSNAEPIIVLRSYDPLSKEIHLKLVFIQERR

SEQ ID NO: 144722 - protein, 59 aa, Triticum aestivum
  Clone ID: PAT_TA_39140.pep
QVKTVFKSLSITRLYTEVAYRYALQIKITAEISLKQKKILLQKPDLLFDLHTAINQPWT

SEQ ID NO: 144723 - protein, 81 aa, Triticum aestivum
  Clone ID: PAT_TA_39141.pep
DWRGRGATMLVRVIYLSLCAPIRSISRWLGGLAPACPPLLRHWEDPCVTIILLDDVQLNRLFTRGVSNKLYLSLFSLTGNT

SEQ ID NO: 144724 - protein, 46 aa, Triticum aestivum
  Clone ID: PAT_TA_39142.pep
YHPCCGASGLCTSSGRVQFASRVKTSDCHGDYCLTEIPMLPWWIEQ

SEQ ID NO: 144725 - protein, 70 aa, Triticum aestivum
  Clone ID: PAT_TA_39143.pep
QYESYLFFDKKKKKKKKKKKKKKKKKKKKKKKKKKKKKKKKKKKKKNKKKKKNKKNKKEKKKKKAGFLKV

SEQ ID NO: 144726 - protein, 64 aa, Triticum aestivum
  Clone ID: PAT_TA_39144.pep
MHCYNGRFSGLLLLAKKKKKKKKKKKKKKKNKKKKKKKKQKKKKRKKKKQKKKKKGPPKRIKPN

SEQ ID NO: 144727 - protein, 56 aa, Triticum aestivum
  Clone ID: PAT_TA_39145.pep
SHTSFKCRVVIIEVSIHRSVMIIIQYSIVPNKIRKAKSCKERPNKKRERPSCNHVL

SEQ ID NO: 144728 - protein, 75 aa, Triticum aestivum
  Clone ID: PAT_TA_39146.pep
VEAISSRDSFSSCDFLFSLHHSFEATHFPGFLPTVFSSFLHLETLHSPKVKKRVALRLAKGKKEKANPSVRPSAR

SEQ ID NO: 144729 - protein, 115 aa, Triticum aestivum
  Clone ID: PAT_TA_39147.pep
FSTKNCTDIRCSVSSSKFQLSVSIPITAVFVYLLGPSCYHRCFNSRQIMQGYLCIFIFFRGLPPCIHDDWHHELYEPNCLIATNPWALSQRIVVQSIGGLILATLSEKFPYFYNK

SEQ ID NO: 144730 - protein, 46 aa, Triticum aestivum
  Clone ID: PAT_TA_39148.pep
TSSGLGVKLVLTTCVYITQHKLLYSDGCEQINSVYVVNYFRIPSAR

SEQ ID NO: 144731 - protein, 76 aa, Triticum aestivum
  Clone ID: PAT_TA_39149.pep
KITRSCSYQYPISPPNLGTFNQAIFSPKIIASFWTKRMFVKQVPFCQVHLVRNFYSIFICPKHAALPNLSSSGYSM

SEQ ID NO: 144732 - protein, 54 aa, Triticum aestivum
  unsure (1)..(54): unsure at all Xaa locations
  Clone ID: PAT_TA_39150.pep
KHPWILNNGPTTPFFALSNTIIIYINSNCPEAFCAAPKYSAWVICKFTWSTKFX

SEQ ID NO: 144733 - protein, 90 aa, Triticum aestivum
  Clone ID: PAT_TA_39151.pep
AAPEFVSTRFLFLHRNVCIHAQAVTHTDFLPMLQTTRNGSPTFRNAYWARPNEANQQALFGPVQRLESFQVLKESSSSIKKKIFKGQPIL

SEQ ID NO: 144734 - protein, 52 aa, Triticum aestivum
  Clone ID: PAT_TA_39152.pep
PKLRLLPLLISCSIKTLPKTSKLHNTKLNRKLISSISIIKQITTLGTVVNSL

SEQ ID NO: 144735 - protein, 140 aa, Triticum aestivum
  Clone ID: PAT_TA_39153.pep
MIVALEENNDMHESIDNYDSDDLIEISLDEHDACYSYGHDTNIYGDEFAIVSDVKHEIVAIAPILDSSLNRKHDCDEVIINYINVNCVNDMQNPKLGDASFAISTICCNDHDWDDSSYDLENLFKPHDEHEIDNNVCNNI

SEQ ID NO: 144736 - protein, 91 aa, Triticum aestivum
  Clone ID: PAT_TA_39154.pep
WFCRKKGHLHTIPCNEQEWDKELAYNRHFTQYMNIIHTSSEIQTYRPTTVKIQMKIRQPQMLDPRLSQLGSTTDHQEKTHSNDHVPRRTPT

SEQ ID NO: 144737 - protein, 54 aa, Triticum aestivum
  Clone ID: PAT_TA_39155.pep
KILNGKNPGLTNLNPLEENPLFTNGGNIKKARTYPPSKNLPTLNGKWNPPLSGP

SEQ ID NO: 144738 - protein, 104 aa, Triticum aestivum
  Clone ID: PAT_TA_39156.pep
ILARMLEYIPYQVPSGEDKRRDEEAKSEPHVLLIQTRRISISTKEDNRGEESEIPSSEGRKRTTPEDLETKVSKREKKPSPGGPASEGVLAAQCPQGGQPSTKL

SEQ ID NO: 144739 - protein, 49 aa, Triticum aestivum
  Clone ID: PAT_TA_39157.pep
VCFISTYCFLSKNSLSLPWSAILLMQDNCSLHQHDVANLPIRLAYRVCD

SEQ ID NO: 144740 - protein, 47 aa, Triticum aestivum
  Clone ID: PAT_TA_39158.pep
LIDRRDTFASIKWYQISRLLGEILQFFVVYIGSVRHTDSPRIFQTKN

SEQ ID NO: 144741 - protein, 72 aa, Triticum aestivum
  Clone ID: PAT_TA_39159.pep
PVQLPVLRVCRTTTPRPLRDPQHYKYFNNIRNKQIALSYSCSFFDCLQEKTFVVRLIMPHPGQYPLGLGLAT

SEQ ID NO: 144742 - protein, 61 aa, Triticum aestivum
  Clone ID: PAT_TA_39160.pep
LMRLIMSSFPDPKYLPSRQISLRYSDMHIGILAKNLIGHPQAEHNTTHSSQNTKLDSHRSS

SEQ ID NO: 144743 - protein, 103 aa, Triticum aestivum
  unsure (1)..(103): unsure at all Xaa locations
  Clone ID: PAT_TA_39161.pep
YSDNIVGHTSNVFGLRKQSPGLHLFSSLSSRPFTQPTXYRQIQLKLSRQPAAILARASESFPGPDPGSRHRCVRIIPKHVQNVSVSYLDFHSLSILDRRIFIG

SEQ ID NO: 144744 - protein, 139 aa, Triticum aestivum
  Clone ID: PAT_TA_39162.pep
HYHLEDAPQTQMHKSQKALLHAKAKLHEKKRRPRDEHHQDVVTATPTTSTSLPSVIKASSPSDVRHLRLLPMSSHTLTSSRTRRPPMSEGDTSIVGSPSRKMAENGNFPSVMETSYEVPHHMDLLQQYGNKTIEQVPFP

SEQ ID NO: 144745 - protein, 98 aa, Triticum aestivum
  Clone ID: PAT_TA_39163.pep
QEGFLALLPGSLHKSQHTRYPSQTLISCMTLFAISLSFSSRPVHPCRFIRPLFSVRILLSSCSSHFLPLCLKLGKLLSIWTVVFTWKIMMLMLMNPVS

SEQ ID NO: 144746 - protein, 73 aa, Triticum aestivum
  Clone ID: PAT_TA_39164.pep
HKKEGEHKKDGEHKEGMMEKIKDKISGDDHGDGKKDGEHKEKKDKKKKKDKKHGEGHKDDDGHGSSSSDSDSD

SEQ ID NO: 144747 - protein, 120 aa, Triticum aestivum
  Clone ID: PAT_TA_39165.pep
TAEQNTASHCNARRLGIQYRVQPMASMSTLQVRSLNAMCNVEMLPSLSCFEVLRVLALEGPYDSHHPSHLEHVGKLVHLRHLKLSSMDIGELPKEIGYLKFLLVLDLGRNSISELPESIG

SEQ ID NO: 144748 - protein, 100 aa, Triticum aestivum
  Clone ID: PAT_TA_39166.pep
GSEALTLATDLHVQSICVATDCLEVVTRIKDDFPCMFFPILQDIKHQRRAFRAVEFIHESRRHNGEAHALAKAAASLPPGRHVWLSSMPDIICIPMTVYA

SEQ ID NO: 144749 - protein, 58 aa, Triticum aestivum
  unsure (1)..(58): unsure at all Xaa locations
  Clone ID: PAT_TA_39167.pep
TSTSSSSTPSPTPNPSSPVQCXPPPGLPLLGPQRCLDHPPMHHGRLEVCERLFTAHDC

SEQ ID NO: 144750 - protein, 102 aa, Triticum aestivum
  Clone ID: PAT_TA_39168.pep
GAGRPPRHMTYIWWILQKMEMAMEQWGMTPPRNSRSAGVSGAALNPAKEKNGDSGTGDNTTPDSAEEHPPQQDSAQEDGEASPHERAADREVEDDNYTPPSE

SEQ ID NO: 144751 - protein, 53 aa, Triticum aestivum
  Clone ID: PAT_TA_39169.pep
CLVYGSSLICHVHHTQIRTRRTSAMSSKHYLPQVTDVNDIKLNLGVRRRCGGT

SEQ ID NO: 144752 - protein, 56 aa, Triticum aestivum
  Clone ID: PAT_TA_39170.pep
LKTRPNFWGVTLFYILQDAWSCFKILVFYRLGFRLSSGILQFSAQIQPFHLIPMHT

SEQ ID NO: 144753 - protein, 53 aa, Triticum aestivum
  Clone ID: PAT_TA_39171.pep
IALSLSNQEIGSVISISSTTYQLTIKTHVVVKRLTSRRRYIQGRHCNTRRIST

SEQ ID NO: 144754 - protein, 107 aa, Triticum aestivum
  Clone ID: PAT_TA_39172.pep
EKPVREIWGREISGATRGKRGYLTHIGCVSLRGKKFGGTFGGNLGDGQFQSGITGGGKKVLNSGNLALVVDFIPKVSAHAGSAVTDSCFLRTRIHRWGRLGGRTRRP

SEQ ID NO: 144755 - protein, 80 aa, Triticum aestivum
  Clone ID: PAT_TA_39173.pep
CMTYCMAATISTTLVTRAARRWRVESGRRLSGLNRPSKQECRAEAASAIGHLKRVGMRRQRPPDIAQNDSTTSTQCQPSP

SEQ ID NO: 144756 - protein, 69 aa, Triticum aestivum
  Clone ID: PAT_TA_39174.pep
TRRHMRPQEPYSVKHHVTSINSPLTHDQSMVQIAPSFGLTDLAIRTGSHAFSRYLPFPLRNYPMQLRPV

SEQ ID NO: 144757 - protein, 41 aa, Triticum aestivum
  Clone ID: PAT_TA_39175.pep
RRLTRSGLRCGPTAAPSQTPGSQVRPAHSDIVLIDAKFCSS

SEQ ID NO: 144758 - protein, 99 aa, Triticum aestivum
  Clone ID: PAT_TA_39176.pep
GHSYTVGGTTTSALRPTSSVRHPILHLARAATHTPSSTARDGRLSSTALDQDPFIASSRFIGAVVHLAVAAPTTASSTARGYIPRPGRLLFKVFFRLGP

SEQ ID NO: 144759 - protein, 101 aa, Triticum aestivum
  Clone ID: PAT_TA_39177.pep
SQRGYLELSSIVASSSFAPSNLYAYFIDCGWMLHFSQADEHNAPLLLGAYYHQFDTQLQEFYHQLEAGGFPLSGDLQFSVHRHGVPFSCKFSMPESVLMIR

SEQ ID NO: 144760 - protein, 72 aa, Triticum aestivum
  Clone ID: PAT_TA_39178.pep
ASGKVSLLCLLLIVFYFFLQLCGFIKNTKSIPKIMQLLMTTVRNIFYSKHFSLGLFEHLEYFIVFKCPNANK

SEQ ID NO: 144761 - protein, 43 aa, Triticum aestivum
  Clone ID: PAT_TA_39179.pep
QLSQVTDAMHSLTNLRTHAGSVPLHESHDCRNGLRIMKRTITE

SEQ ID NO: 144762 - protein, 123 aa, Triticum aestivum
  Clone ID: PAT_TA_39180.pep
MCLLFLFLFLVHMMYTHLSQTIRVAVRTALVALIAFMPTNPGGALGSLDYKKEDRRALAIKSRETPPKFGSPERQSVIDEVKFPTHFEELLKYAPFCFFDTKNCCKHRSMSKCSVKLHLFHNC

SEQ ID NO: 144763 - protein, 42 aa, Triticum aestivum
  Clone ID: PAT_TA_39181.pep
RVTLSSLGFTGFKRKSEEIESSGKGRCKFFQARKLELIRKFQ

SEQ ID NO: 144764 - protein, 110 aa, Triticum aestivum
  Clone ID: PAT_TA_39182.pep
MENNRRPFWDIFGMTSGRKIVPAQQAVDQDASAAKVDQIDMESNDIRRFEQLRRELIELERRVQKSTDGAKKEEFQETEVPDETMSPSESAPPLSGPPGSVIKKENVITK

SEQ ID NO: 144765 - protein, 99 aa, Triticum aestivum
  Clone ID: PAT_TA_39183.pep
VIGWGPNWIWPPSPVSMGVCSPMCPAAEVSPSGAALTASCISPWPGILRDNTSVSSMALGEEAAGRDPLSITFGSSEFPEDEDRSKSERAGLQVHDSTC

SEQ ID NO: 144766 - protein, 90 aa, Triticum aestivum
  Clone ID: PAT_TA_39184.pep
VHYSTLKWGLVSFRKRTLQFSGKFWGGEFSKFGVKIQWTMEQGLAKAKPWGCPWRPKMIKGHQKHNSWGAPGRHPLFRPHQPVTLLGAKF

SEQ ID NO: 144767 - protein, 81 aa, Triticum aestivum
  Clone ID: PAT_TA_39185.pep
AQQCKPTQMLLIPSYQGPFYQVHVYTTHYKKQHDSSITMIIKKGTTFPLLKPASNNTIAIKFSNNEPRHVQNNPKFVVHVR

SEQ ID NO: 144768 - protein, 66 aa, Triticum aestivum
  Clone ID: PAT_TA_39186.pep
GKTWQGLVTWPDKGAIKISYQLVLPKWYFLHNYLHWPESCKNSRGVLARLNCAKFGGEKLFCRRIL

SEQ ID NO: 144769 - protein, 49 aa, Triticum aestivum
  Clone ID: PAT_TA_39187.pep
KCRNDYLQRAYFSRYTMSRIDIVACIIILNTWFTSYIRVVLLMLFFSNS

SEQ ID NO: 144770 - protein, 69 aa, Triticum aestivum
  Clone ID: PAT_TA_39188.pep
MYIKLKVHKKRHNPEEQRIYFYQGLLLTNCFVLYNIVMFTRKEGTKFACSPRVCPSVLPRTWFNLIETK

SEQ ID NO: 144771 - protein, 77 aa, Triticum aestivum
  unsure (1)..(77): unsure at all Xaa locations
  Clone ID: PAT_TA_39189.pep
GNAVVNTKEIDTKRPPARATAESGSKRTRAAELHNLSEKAVXRFXVVNHFSLSFAPLFYCSLLALFSRLLIACLLDW

SEQ ID NO: 144772 - protein, 144 aa, Triticum aestivum
  Clone ID: PAT_TA_39190.pep
MGRGKIEIKRIENQGNRQVTFSKRKNGILKKAKEISVLCDAEVGVVVFSSAGKLYDFCSPRTSLSRILEKYQTNSGKILWDEKHKSLSAEIDRIKKENDNMQIELRHLKGEDMNSLQPKELIMIEEALDNGLTSLHEKQMEHYD

SEQ ID NO: 144773 - protein, 56 aa, Triticum aestivum
  Clone ID: PAT_TA_39191.pep
LSIGNPGLVIYINCKIHHNKTMAQCGEEIMDNKTSTHLEMASDFIKIKEAKDAQQL

SEQ ID NO: 144774 - protein, 122 aa, Triticum aestivum
  unsure (1)..(122): unsure at all Xaa locations
  Clone ID: PAT_TA_39192.pep
GQVRVDRDDIVIQQDLSPLWSVHLKGRVNGAVKTCGEIFNMFDTYLNFSNPLIAKKFDRRACGWAYGMNMFDLSEWRTQNITAVYHYWQEQNEHRLLWKLXTLPAGLATFWNXTXPLDRSWH

SEQ ID NO: 144775 - protein, 78 aa, Triticum aestivum
  Clone ID: PAT_TA_39193.pep
SGRLRCIVENVRKILYKHTHLLRFVIVLNHSIPFYDDCACTLGMYSATLTTGLHSSGGGARTRIKKEPKEFTQELKHT

SEQ ID NO: 144776 - protein, 79 aa, Triticum aestivum
  Clone ID: PAT_TA_39194.pep
SNSSRPCKNLTRKTHLRFHEDRVCGSKTSAAEQNPYLNLHNLKKHFRGRNCTNIVHHILHSSSHDQKTTSIVILHTTLN

SEQ ID NO: 144777 - protein, 61 aa, Triticum aestivum
  Clone ID: PAT_TA_39195.pep
FFRWEPQGRKDQGKEVALVEALQDPLFVSLLGWLPCVGLATEPADQHCLSVVEAVEVVLAM

SEQ ID NO: 144778 - protein, 74 aa, Triticum aestivum
  Clone ID: PAT_TA_39196.pep
HLKFIAVNFEEHWRSTGEGLETMELSGRFRVRRTFILVILRRIGPLINIVALQLSNPVQNEDHDDALKWRSHLS

SEQ ID NO: 144779 - protein, 40 aa, Triticum aestivum
  Clone ID: PAT_TA_39197.pep
KLLMSLPRGKKILTTAGKGNTKRLKIPDILGPNIGQGWKT

SEQ ID NO: 144780 - protein, 86 aa, Triticum aestivum
  Clone ID: PAT_TA_39198.pep
LFFGNWVGFSLSRFCGLRFEGWGIAFYIFFKIFPKVGPVKFLGLGFKFNQFWNYFLDTLRLCSFGHWIVPRTIGLGFSLFAFRPQD

SEQ ID NO: 144781 - protein, 78 aa, Triticum aestivum
  Clone ID: PAT_TA_39199.pep
TTTNMPRSRPRVMVLYQLLIDCNGNRVNVEVVNVSGGMTKFFYNIQYGIVSFPARENGIFFLSLPLPILKPSNFLLDQ

SEQ ID NO: 144782 - protein, 82 aa, Triticum aestivum
  Clone ID: PAT_TA_39200.pep
LLMMFFFLAEIQNFTIVFSLHLYLRCAQENTLCRLILVENINRSPKSGLRSCQAVPTAAAHIHTLNALNLWSSASEFILSPM

SEQ ID NO: 144783 - protein, 56 aa, Triticum aestivum
  Clone ID: PAT_TA_39201.pep
LASTVDNAISLGWMDPTCHVSTQVSRLWLLCFVTVHRTVVMFFFPHFVNLKFLGAF

SEQ ID NO: 144784 - protein, 60 aa, Triticum aestivum
  Clone ID: PAT_TA_39202.pep
FMKSRRVRPLDWVTGCFARRVQLPWCCHSGQLPMKLGTLLRSRVCNRLLALYLVSASRPT

SEQ ID NO: 144785 - protein, 78 aa, Triticum aestivum
  unsure (1)..(78): unsure at all Xaa locations
  Clone ID: PAT_TA_39203.pep
RTIGHHELQPEQHVTRFPTEGHKPXTLRRVFHCPGIVHHHYQNSMLLSLKSLPFPNLTNIPGNMSGYLGRHLVCFNTN

SEQ ID NO: 144786 - protein, 89 aa, Triticum aestivum
  Clone ID: PAT_TA_39204.pep
YQCASWPSDGWHTRNARMCRWSSGWNSSKFEPGLRVLLKGVASNDKNPLVLLNIRSWGNLSIPLPVHCVPLGFLKLMIKSFLLRQNELY

SEQ ID NO: 144787 - protein, 82 aa, Triticum aestivum
  Clone ID: PAT_TA_39205.pep
SRNYNAREKSGRCQNPNRGNPRYKPEPKGPVVQIGGGTFVTNRKFWTSAIVRHDYRPTYASGLGNRNSQADVSSHNSNFLFT

SEQ ID NO: 144788 - protein, 101 aa, Triticum aestivum
  unsure (1)..(101): unsure at all Xaa locations
  Clone ID: PAT_TA_39206.pep
RRKSKXRKRQGTPGLPATPNGGKENPPPLRSNPMPTERTGDGVTNNLQLCLQNKLWGLPRPVHQANNRRQLEPKCPITQWETKHGKGNTSIKIIKTKDDTT

SEQ ID NO: 144789 - protein, 100 aa, Triticum aestivum
  Clone ID: PAT_TA_39207.pep
EGVATPGLLKHWTTAWRWRQRLSSPPASYRCTLTSSTVSSFHSRRQSSTPTPTTTPAMTPTTTPATTPTTTPATTLMTTPATTPTTTDSWLVIYTHLCVK

SEQ ID NO: 144790 - protein, 73 aa, Triticum aestivum
  Clone ID: PAT_TA_39208.pep
STDLVRFAYQTHGSPSSSMDASRQLYHAQAHTETHPHSSRSNSITHPALYPSPSLSLLSLCPILFPVLQFCMD

SEQ ID NO: 144791 - protein, 153 aa, Triticum aestivum
  Clone ID: PAT_TA_39209.pep
DRKREEFCSLTQNKMAVDAYSREFENLARYATEEVSMDAKKQARFQRVLTPKLRRDLHLHHCDTFQALVNKAINAETAQLTYEESRKHTRILGSSSGSSSQKRRIWVPNSALPSGYTPRPSYVVPSPAQSYVPPMSIGRPFFSAGPGRPGLPD

SEQ ID NO: 144792 - protein, 78 aa, Triticum aestivum
  Clone ID: PAT_TA_39210.pep
APAHRPNCSSGQAPAARYIRSPPSDCFVLKVKHAEKKTRTGNTKKRTASAHARSVCSPAARDSPRLPVLAFHWLSSRP

SEQ ID NO: 144793 - protein, 53 aa, Triticum aestivum
  Clone ID: PAT_TA_39211.pep
AVFLLLFGRRLWNLVGTFYFVNKMAVCITLMQWPGRSPFRKKKKKKKKKAAAL

SEQ ID NO: 144794 - protein, 97 aa, Triticum aestivum
  Clone ID: PAT_TA_39212.pep
GRRESARRPTGDGGGDSGRSLIWGTWSWGRTNRAVKSEVAVARSKKCATAKLATAHSSIRATPIPFSFFPFFIYFSLHFIFFPFTFFYFFHFHLLSI

SEQ ID NO: 144795 - protein, 152 aa, Triticum aestivum
  unsure (1)..(152): unsure at all Xaa locations
  Clone ID: PAT_TA_39213.pep
GLLKLWGCLYGSTRNPHHVEWMYHTGKLKVTHKVRVKFYVGDYTDMVICDVIPMDACHLLLGRPWQYDHNATHEGRTNTYSFWDSRKRRVLRPMFENAIKGMDMSXLKKKVAKTASKPRTVSFEGEGDDVTIDCAIPCTLQIGGFCIQVRST

SEQ ID NO: 144796 - protein, 102 aa, Triticum aestivum
  Clone ID: PAT_TA_39214.pep
VRPVRVDRVAFKEMPKEGCLTVRRGSVAWIGSGPEFLISLADHAEWRDAYTVFGSVVPEDMAIAEEMSMLPASTDVWSGVTVRLLKDPVYIKVKRRSNATAY

SEQ ID NO: 144797 - protein, 119 aa, Triticum aestivum
  Clone ID: PAT_TA_39215.pep
LTLSPWIIGTFIFPSLLASSVPSIALYHLESWCKLSPVHTNPVIRYGLSHINLLISSSKQPPYLPNYGISIAIPRYYCHATFHRSVYHHDIHYYCYIAFHDHVVDIVFVAKFTMHNRST

SEQ ID NO: 144798 - protein, 85 aa, Triticum aestivum
  Clone ID: PAT_TA_39216.pep
RADREHKKAEEHKKKDGEHKKDGEHKEGMMEKIKDKISGDGHGDGKKDGDHKEKKDKKKKKDKKHGEGHKDDDGHGSSSSDSDSD

SEQ ID NO: 144799 - protein, 111 aa, Triticum aestivum
  Clone ID: PAT_TA_39217.pep
MSPSSSSMERRNELLQVACCCFGHCNRPTGEVEDGGRGGDPCLGAVMPPRPWRRYCCCCPTEAHLCSSAGRRNGGHISLGGVWRTAKRDSTGYCSSPPSTSAILHGLRSTR

SEQ ID NO: 144800 - protein, 56 aa, Triticum aestivum
  unsure (1)..(56): unsure at all Xaa locations
  Clone ID: PAT_TA_39218.pep
MQNLKLGDASFAMTTICCDDRDWGDFSYELXNLFKAHDKYEIDNSVCNIIESGFGR

SEQ ID NO: 144801 - protein, 64 aa, Triticum aestivum
  Clone ID: PAT_TA_39219.pep
LSQRICSAVSDEARMSYHVCGNQFATRIEYMGRHSISAVARQDRFLLTPACYFLVLLYCHLTSL

SEQ ID NO: 144802 - protein, 54 aa, Triticum aestivum
  unsure (1)..(54): unsure at all Xaa locations
  Clone ID: PAT_TA_39220.pep
CLMFLCRLLTSLASLSCLLWHHCILCLGLAILIFLFPLPVPRVVSSXSCHEMGA

SEQ ID NO: 144803 - protein, 84 aa, Triticum aestivum
  Clone ID: PAT_TA_39221.pep
CAICAKIIRSKARLFKKMKIIFLGAKVPVFQQDQNNYHHKPSQRSYLAQTLIKTQNTSKHRLDELLIQKQKRKILGCLPTSAFH

SEQ ID NO: 144804 - protein, 75 aa, Triticum aestivum
  Clone ID: PAT_TA_39222.pep
STTERGYTTHSTMPEPIMACGCTRKFLGMKYHMIPLSLGGGPRVITRVLRDSHGQAPVSLGAPNNPPRCVLNLPP

SEQ ID NO: 144805 - protein, 34 aa, Triticum aestivum
  Clone ID: PAT_TA_39223.pep
RQCSNNYDHHTSIYLQLLNYNPKLELDMTPGRPG

SEQ ID NO: 144806 - protein, 89 aa, Triticum aestivum
  Clone ID: PAT_TA_39224.pep
IDSFSKTSKLCIINRICQKQNSLYQSEHSLGLCYPHSFYQNYETYTSCTSRQFTMNHNRLTFQLKMYNRALQPKFLSCTVHTSIHCKHL

SEQ ID NO: 144807 - protein, 76 aa, Triticum aestivum
  Clone ID: PAT_TA_39225.pep
VVTVDCERMVLFIVSVGWWRAGQWAPGQVTGPTWYRRYGSMHAAPGYFSKHGWHVHLYPFGLVHGRIFVLANLGAR

SEQ ID NO: 144808 - protein, 81 aa, Triticum aestivum
  unsure (1)..(81): unsure at all Xaa locations
  Clone ID: PAT_TA_39226.pep
SRADGSINLELCIILYKQXYRTTMAMPLAIVHQFDDDDFHSFVHGWLAYEKLTPTPPVWLPLRLQHRVLVHAKVHDFSMVV

SEQ ID NO: 144809 - protein, 124 aa, Triticum aestivum
  Clone ID: PAT_TA_39227.pep
APGVFYPYQTVQMQHAVHDHMYISEVQLSANWCCIVYSTKTAVQASRYKWCNKQGMGLLHMSPSKGKLPMVLTTDLMLVMHTTWIFIVAFILPCLYASSVRQVCCRPGPLANCVLQVGGKNGTK

SEQ ID NO: 144810 - protein, 55 aa, Triticum aestivum
  Clone ID: PAT_TA_39228.pep
IRNGCVNNGNLDLNTPTNTKFLPLCQAGVNLSCFPPDLTDAPNWGPRRKLQHWNP

SEQ ID NO: 144811 - protein, 47 aa, Triticum aestivum
  Clone ID: PAT_TA_39229.pep
TFVSRRGQNMPFSPDWWHQPELKGALVTVGATNRDGCSGYIYRTCQF

SEQ ID NO: 144812 - protein, 53 aa, Triticum aestivum
  Clone ID: PAT_TA_39230.pep
NGSLVCVTISRLNYCKEFIVSKICSRFDLNIVFAVEGVIIKLPVINGDLPICG

SEQ ID NO: 144813 - protein, 63 aa, Triticum aestivum
  Clone ID: PAT_TA_39231.pep
KPFVVLTDHNGLVLHMLYFAWNFCIKLVPHQLTVILGLMSTRAIFWELTPGDSVATDLVSEPG

SEQ ID NO: 144814 - protein, 120 aa, Triticum aestivum
  unsure (1)..(120): unsure at all Xaa locations
  Clone ID: PAT_TA_39232.pep
SRADGGGETQDRKLFQYRDPAVVAAVWNRLATAWIRPRPRLQTPSACRRPPRGADQGASDSSFNNMDGLRLPSTIGKAKSYASSSLGALRKKMPQSGSRSLHTSRPRSAPVAXRPMVPPS

SEQ ID NO: 144815 - protein, 69 aa, Triticum aestivum
  Clone ID: PAT_TA_39233.pep
RRNHSGSVNSKGSIDRSGSVTRSLQCNRSGSVGKRLARVVIWMIRLQRIYNFLCIHAMFIIFLHDFGMI

SEQ ID NO: 144816 - protein, 117 aa, Triticum aestivum
  Clone ID: PAT_TA_39234.pep
FKEFNYDNCSLIYCISLLQSRLNSPHSYNQNKAFTKHIVDAMMQSFEQKLELEVSIPRKLYDEWEPTIKIKIKDYECHALCDLGASVSMIRKTLCDVLGFREFDDCSFKFASCGFHY

SEQ ID NO: 144817 - protein, 103 aa, Triticum aestivum
  Clone ID: PAT_TA_39235.pep
FKTAFLSRHISQTTGPHKRISTGYFMEGNAKLQSHAVTSMRQPKEERRGHLMASRFIRRGVPCQCQPTGFIRSCGLPVSWRTGVPPGSHVRTAHQGRSKLSIP

SEQ ID NO: 144818 - protein, 73 aa, Triticum aestivum
  Clone ID: PAT_TA_39236.pep
VLEQTSTQLVKLYYMDSKKHLPDRIVPLGVPFFGYACIDVHVRTANRSAENKTSGYFCCSEREHLLFTDRIFP

SEQ ID NO: 144819 - protein, 56 aa, Triticum aestivum
  Clone ID: PAT_TA_39237.pep
QPKLSSKVIFFLVQKSPLLFSFIIDVSMVWLLVLTVQLINGSCLIIFISVSLVEGL

SEQ ID NO: 144820 - protein, 39 aa, Triticum aestivum
  Clone ID: PAT_TA_39238.pep
IEYLDLNYLSFILVLVHLWFWKLNSLKVCHGHFDPTRNS

SEQ ID NO: 144821 - protein, 49 aa, Triticum aestivum
  Clone ID: PAT_TA_39239.pep
RERTRFYCCVKTGTFNALTCLTVNYWIEVWFFLNSSEFTVSILNKPVDR

SEQ ID NO: 144822 - protein, 80 aa, Triticum aestivum
  Clone ID: PAT_TA_39240.pep
SIYTFSELHSRSRVAYRESPNFLRNINDFPATISPASRSSSFFALIAERMSFLVATAFSSPMLWLGFPFPRTRQRSNGGF

SEQ ID NO: 144823 - protein, 127 aa, Triticum aestivum
  unsure (1)..(127): unsure at all Xaa locations
  Clone ID: PAT_TA_39241.pep
IKSXKNFNSDSPNQNYPRKAGNQYNQNWWVFKQSRKIKPRQKGAQSPSQGNDEPHQQNTGSQKTFPQEVKTVNSLHVIVRKTNTALAKTSVARSTPAEHRYWMSKPITFDHLDTTXRPSSKKKKRPL

SEQ ID NO: 144824 - protein, 132 aa, Triticum aestivum
  Clone ID: PAT_TA_39242.pep
LARICQIHSTSGRPANHTNQNCWVFKQSGRLKAGHKGLDAPSEDNDEPHQQSTGSQKTFPQQVKTVNSLHVRLWETNMELAYEQVSHCLHHGIIDIASKHEQFSNNGHDCNDFTINSLEVHCAINTQNLNLG

SEQ ID NO: 144825 - protein, 42 aa, Triticum aestivum
  Clone ID: PAT_TA_39243.pep
LASVCSFIRFKERVHRLGPDNERSFVNLFIVFLFLGFNPRFF

SEQ ID NO: 144826 - protein, 37 aa, Triticum aestivum
  Clone ID: PAT_TA_39244.pep
VDGQLNMLVVGQTSMTTDECNRLLNSGEKNLQLLNQK

SEQ ID NO: 144827 - protein, 64 aa, Triticum aestivum
  unsure (1)..(64): unsure at all Xaa locations
  Clone ID: PAT_TA_39245.pep
FWNILKILGEESTRWGPPVSHEGEEHALAPGRAPYLVGPLAVPDSHLLLYGVFFPXKNHREAFG

SEQ ID NO: 144828 - protein, 147 aa, Triticum aestivum
  Clone ID: PAT_TA_39246.pep
MSCWSSSLLDYCMLVSLLVMNYLLELIMNLPDIPTIQKPNSRQFPELTMAGFADALMPDKFIGVHFKRWQVKTTLWLTALKVFHASVDAPEGMTDEDRRKFQEANTMFVGCILSVLADRLCDVYMHINDGKILWDALNAKFCASRRP

SEQ ID NO: 144829 - protein, 91 aa, Triticum aestivum
  Clone ID: PAT_TA_39247.pep
IAARNLNNDLSLYECLRQCTALDIELASQRRHKRTSSGNIIIDMLPSCKAMWQCMFISQNDRSWTLRASISQTCLWKYPVSLVSCILCGCD

SEQ ID NO: 144830 - protein, 62 aa, Triticum aestivum
  Clone ID: PAT_TA_39248.pep
LITCCRCMLSLDLAGACLLFFLFFEKGGTRPLHLDYAYNHFINYSHKTLHSHTPVRLNPPST

SEQ ID NO: 144831 - protein, 88 aa, Triticum aestivum
  Clone ID: PAT_TA_39249.pep
REDPNYLPRRPMECIGLSSTARLRGTPIKQHLPPAQPLQAKYDSNTFGNRTPKSQAILLVSQAIRCCGNQSQRADRSASKFNRIIDKS

SEQ ID NO: 144832 - protein, 78 aa, Triticum aestivum
  Clone ID: PAT_TA_39250.pep
VMSGDCLYQENKGYVQLLFRSPLVVQPTQQKVHYLEVASNCRKSEEPHFDSANVFPRDGSWSRSTFSVTRMKLLAIDG

SEQ ID NO: 144833 - protein, 65 aa, Triticum aestivum
  Clone ID: PAT_TA_39251.pep
GSTNKDLHRICGSQCGHPGSAIGRCLGHVYIVLEPVGSARLTFVDDIILYELCMLVTKCCSESRM

SEQ ID NO: 144834 - protein, 50 aa, Triticum aestivum
  Clone ID: PAT_TA_39252.pep
TTVIFSVLYFTLILPHILIYDIFEQEHYFIYFIHVAIQQCIFTTSNSITT

SEQ ID NO: 144835 - protein, 46 aa, Triticum aestivum
  Clone ID: PAT_TA_39253.pep
LHNYSKLIDAHLYLFGVFSYLLHCVTYNFLAHGGGFILNDLHISRD

SEQ ID NO: 144836 - protein, 125 aa, Triticum aestivum
  Clone ID: PAT_TA_39254.pep
VQLQPFSDIGTFSISTETGMGVVDITDKFMLDVMFIKLQLPPLMFFCYKVGERLAVTLKVRPSTQHQRRDYEAMSLSGYSYNSTEDAVDIAAARVIKYMETMRAKVLKDYSYNELQLMRVNFVCP

SEQ ID NO: 144837 - protein, 55 aa, Triticum aestivum
  unsure (1)..(55): unsure at all Xaa locations
  Clone ID: PAT_TA_39255.pep
FSLSWVIVLKKVERYVXXDLLIYLHFFVYGLASWPSCKVSQNNQIALLEFAFLCA

SEQ ID NO: 144838 - protein, 67 aa, Triticum aestivum
  Clone ID: PAT_TA_39256.pep
FVFKFFFVFYFIFFFFYFFFFFFFFFFFFFFLFFFFFFFFFRNTMQTQTLTTRAHTFYESTHVKFRT

SEQ ID NO: 144839 - protein, 99 aa, Triticum aestivum
  Clone ID: PAT_TA_39257.pep
FLCCFRIKKHIFQKSMVDWSSVDSQTQCKWANPFLQASGRQIRRRLGALVGISYVAEWRGFAKAVLRLGRPTYMLLVVSCWATKKTTDKGRLRSRVLAQ

SEQ ID NO: 144840 - protein, 60 aa, Triticum aestivum
  Clone ID: PAT_TA_39258.pep
RTNGLRLGSNAQHGNLSGLPNFLVPPGQPKFKGPVHFPDSRILTKTHVARLHWGGLECSS

SEQ ID NO: 144841 - protein, 65 aa, Triticum aestivum
  Clone ID: PAT_TA_39259.pep
TEQAVKFKGENKLTACPFLLCSSQINVHITCAHSFQYVVLFQVYKIRKWPGTHRSTPPKGSNLTN

SEQ ID NO: 144842 - protein, 44 aa, Triticum aestivum
  Clone ID: PAT_TA_39260.pep
PARHVIAVTQSMGPARQTERKGTDRRTEYRTWAKRHVASLNTTH

SEQ ID NO: 144843 - protein, 145 aa, Triticum aestivum
  unsure (1)..(145): unsure at all Xaa locations
  Clone ID: PAT_TA_39261.pep
RVDVGDYVDCVLLRQALRVERDXEVDILRRDDGQSQGHQCVEEVVTIEAVEGGRHHRAWAHGLEAYVKVVRELLDDVELVEEADEDLRQIRETKLLSKRPFAFEALRKNLRSSLVVGRKPVLFTNFQNRVMVALIASMGLASSQL

SEQ ID NO: 144844 - protein, 141 aa, Triticum aestivum
  unsure (1)..(141): unsure at all Xaa locations
  Clone ID: PAT_TA_39262.pep
RVDGKLTTAPVLVVPDIHKSFEVYCDASRKVLGCVLMQEGKVVAYASSQLRKHEENYPTDDLELAAVIHALKEWRNFLLGNWCEIYTDHKSLKYIFTXPELNLRQWRXLELVKDYDVDIHYHPGKANVVADALSRNPSSGN

SEQ ID NO: 144845 - protein, 90 aa, Triticum aestivum
  Clone ID: PAT_TA_39263.pep
GNKPIDRHMFFLLNIGEKLATNQLIAKHAKCWQLPALPKIGLPTIGMPKIGCKPISLYIINIIHTGKKKPGRYSTMEDRHQDDVFGFAFS

SEQ ID NO: 144846 - protein, 102 aa, Triticum aestivum
  Clone ID: PAT_TA_39264.pep
HGEERLRRPVICKFPLARTADVQRTGRTHEAEGFGLVFMLLLHNELPHEKPMIPIEASKRFLSSYAKSLLMISQCPYGDIIKGKLQKYIGRGSIAYSLLPSI

SEQ ID NO: 144847 - protein, 95 aa, Triticum aestivum
  Clone ID: PAT_TA_39265.pep
NFLSDFFLRETEYMELELRSAEPQGGHETGGAPRGVGAPPPSWTGCGPPIIDYFASIFIFSKKCLRGFSGHSENFCFLHIKQHHGSSAENSVSPG

SEQ ID NO: 144848 - protein, 35 aa, Triticum aestivum
  Clone ID: PAT_TA_39266.pep
LGLIIHFYIIFGTNLINRRPTQKLRFLANSIVPDN

SEQ ID NO: 144849 - protein, 43 aa, Triticum aestivum
  Clone ID: PAT_TA_39267.pep
THLQCDPVSFEGEWARRVTVDGFMRKPCYVPIDLVSSLAQERR

SEQ ID NO: 144850 - protein, 130 aa, Triticum aestivum
  Clone ID: PAT_TA_39268.pep
QISHYDSASFAIPDHCNQNYAHIVHASEFIARLTVASTANNDRHESLHNCDPDHLTALSLAEHDALYSCGHDANIFEHQFAILPYVTHEIIAIALILDSSFDEDHDCNDFTINSLDVNCAYNMQNLNLGD

SEQ ID NO: 144851 - protein, 53 aa, Triticum aestivum
  Clone ID: PAT_TA_39269.pep
PVSDQLVQPPKFTSAIDVSYINRNWELLPLCIRSMAHSYFSLPHHLYARLFPF

SEQ ID NO: 144852 - protein, 44 aa, Triticum aestivum
  Clone ID: PAT_TA_39270.pep
RDRRHPDSSEKDFATSLTCELYMIEAYCDIKATSELLEEDIAVK

SEQ ID NO: 144853 - protein, 94 aa, Triticum aestivum
  Clone ID: PAT_TA_39271.pep
WNMAICIYNKVYITAGSGMGNCTALVDQNTHTTYHIIPTHHPPHPPPQMSTNAPPTPKPSPPHTQQNKKRGPPKGSNLNSPLQETSNPPKTVPQ

SEQ ID NO: 144854 - protein, 57 aa, Triticum aestivum
  Clone ID: PAT_TA_39272.pep
GQDIPGRRGVSRVLDGLGEMRFKKILEKKSNVKLLIEKRDRRAVWFRLHSSSHTSFC

SEQ ID NO: 144855 - protein, 80 aa, Triticum aestivum
  Clone ID: PAT_TA_39273.pep
VHDVRQLQHFERQPWLNIRKCYKQAVSARMSKELRNPNRNFNVICNRTIIPIGQLGKLSIRFMLVASNTSQPSSFCPTIH

SEQ ID NO: 144856 - protein, 147 aa, Triticum aestivum
  Clone ID: PAT_TA_39274.pep
GRRGQINYEELKAGLERVGANMKESEISQLMQAADIDNSGTIDYGEFIAATLHLNKVDREDHLYAAFQYFDKDGSGYITADELQQACDEFGIEDVRLEDMIGEVDQDNDGRIDYNEFVAMMQKSTAGFGKKGHQYNVSVGLRDALNI

SEQ ID NO: 144857 - protein, 49 aa, Triticum aestivum
  Clone ID: PAT_TA_39275.pep
IRPMLLNFSLSDEEFQPSLAKDCYLIVTSLVCKCFAFNILYYLAALCAT

SEQ ID NO: 144858 - protein, 136 aa, Triticum aestivum
  unsure (1)..(136): unsure at all Xaa locations
  Clone ID: PAT_TA_39276.pep
MTLVGGAISWKSKKQTSVAQSSMEAEYIAANEAVKDGVWLRNFLVSLEIVENASDPVTXYCDNXAAINLSKDSKFHSRARHIEGKYHYIRDVINRLKTVRLAFLPGNDMLADPLTKPLSQELFCKHVRNMGLKIFD

SEQ ID NO: 144859 - protein, 74 aa, Triticum aestivum
  Clone ID: PAT_TA_39277.pep
VRQRYLREAFGMYASSSTEATMTTMITPASLRRTLSRLGSHELGVDECTAMICRFDLDGDGALSFDEFQVMMMA

SEQ ID NO: 144860 - protein, 98 aa, Triticum aestivum
  Clone ID: PAT_TA_39278.pep
DGGDSAVPFVVALFSCMHWIFYSLVKTNSIPLLRSNACSCVIQGFKILPYVGYSPRAGRHHAHAFFLIVDGSAFALNVTVSVLLVRQPSRVKVLGRVC

SEQ ID NO: 144861 - protein, 72 aa, Triticum aestivum
  unsure (1)..(72): unsure at all Xaa locations
  Clone ID: PAT_TA_39279.pep
RSRVILAATSFXASRGSHCSSRHSNDFRRHSTWSSTSLPSPGNFGKHAMHQEKLQSSVISTNRIYTTPSVHK

SEQ ID NO: 144862 - protein, 64 aa, Triticum aestivum
  unsure (1)..(64): unsure at all Xaa locations
  Clone ID: PAT_TA_39280.pep
HYGGLQEFCEDDDAFKIDMNQFRSIWGLMLGILLLGINRPGEAGLSPQWFTXTEAHEDRRWCFM

SEQ ID NO: 144863 - protein, 65 aa, Triticum aestivum
  Clone ID: PAT_TA_39281.pep
LFVSGYILDITNNSVGIHDGLIKLDVRQLPESFRPSKSLAVHIGGALPNKLPEPFRPSKSLDMLD

SEQ ID NO: 144864 - protein, 91 aa, Triticum aestivum
  Clone ID: PAT_TA_39282.pep
TTRRKLISQTGQVPLYLYKDFLTENCCNCLLPYEYQSMRLLPSSWRGCHLMAAPCRRPGYHCRQQRNFAPGSEFQTPHPLPYFACRWRPAT

SEQ ID NO: 144865 - protein, 59 aa, Triticum aestivum
  Clone ID: PAT_TA_39283.pep
RRSVEGRPFRGATDTLSRLVAVAGPSNRPKVTRPWQIFFFVWVQVRVLPLAFRIRMNVK

SEQ ID NO: 144866 - protein, 141 aa, Triticum aestivum
  Clone ID: PAT_TA_39284.pep
WTGFEDIIAWQPNRTRIFSVKTAYHLQWMHTNRAHANMMESASPTYGGSAPLAVWNTLWKVQVPRRIQIFGWRVLRGIVPLKAILTNRHIGSNGACPICHQGAEDIRHLLFLCVHAKEVWRRLGMLQLVEDVVLVDSGSII

SEQ ID NO: 144867 - protein, 47 aa, Triticum aestivum
  Clone ID: PAT_TA_39285.pep
SFSTFGVVQNRSLIFSPFPVQNSSCRHSPSSCKPYKIRVKKHNYCDT

SEQ ID NO: 144868 - protein, 109 aa, Triticum aestivum
  Clone ID: PAT_TA_39286.pep
TVLSILRACKVHFTSAIDPWHVKYPGSWRYYIQNNDWHVTQVLVNIIYIMYSLFSKKTVFCSFSYFTRRARGSIWEQTKLPISLNSFIAYFGVATLALYASAPNHVLAQ

SEQ ID NO: 144869 - protein, 87 aa, Triticum aestivum
  Clone ID: PAT_TA_39287.pep
TPKLFHMSPPYLPIYGIYLPFQVNLYVPNSKSSNKYPVLYARIAHVSTRVVRIFHVRRVILKRSGLRSSLTRKWLVIGMPSPMLYAN

SEQ ID NO: 144870 - protein, 95 aa, Triticum aestivum
  Clone ID: PAT_TA_39288.pep
NATYDLEVDQACTRYTIINTIKARRRVLPLREGPDLGKYCLLCPLLPINLRYTVRDPLPRGLPVFTTDTYNVAGADVEALSFRSVPPPSYIVVET

SEQ ID NO: 144871 - protein, 62 aa, Triticum aestivum
  Clone ID: PAT_TA_39289.pep
YDFKQNWGDSREYISHHDSIKNKFTSVPLTKCRRGKLHIRCSYTLAGVPTPGSVNHVSLTCP

SEQ ID NO: 144872 - protein, 74 aa, Triticum aestivum
  Clone ID: PAT_TA_39290.pep
TEEPVASTPWKNKSCCRRGILDDDLFWPEEQLYCMVPCNTCQVKGRLRMILLRMKPSFCSTVNLSGSNLVATFP

SEQ ID NO: 144873 - protein, 60 aa, Triticum aestivum
  Clone ID: PAT_TA_39291.pep
DVLNNLFIEHKQKESMQNLVSVIYQFVSRERKVSVFQQNQINSYHRLSYRFYLAQTLNET

SEQ ID NO: 144874 - protein, 63 aa, Triticum aestivum
  Clone ID: PAT_TA_39292.pep
ARLGKGDFVQGGLIWLNPGFSRYELFKRMALESILGACLEGFGLDLTAKLGLNLLGGPIFFAY

SEQ ID NO: 144875 - protein, 102 aa, Triticum aestivum
  Clone ID: PAT_TA_39293.pep
KPNKKFRVWESGKIQEDAEDGQDGNRVKQTRLGETRVFLGGKVSEYGPFIDSALHGKIDADQEVPDIQVGNMAAALDERRRNRERSSMTYAFEDDLVIDLLG

SEQ ID NO: 144876 - protein, 92 aa, Triticum aestivum
  unsure (1)..(92): unsure at all Xaa locations
  Clone ID: PAT_TA_39294.pep
CWLLGAIWWTTLTPKNLRSFMIFLTNGWQISLNLAGQVVAPQRRSQAGRKQRGTKVRRVAPFERRTWFHDGGCSGFAVVGVFGXSVIVLCKC

SEQ ID NO: 144877 - protein, 67 aa, Triticum aestivum
  Clone ID: PAT_TA_39295.pep
AEWKPTSTTVLGRWRSRSPRGAATRTNKPERIGTSRRPQLDWIRLTGGPPHLPVKGNYSPSDVMMSS

SEQ ID NO: 144878 - protein, 55 aa, Triticum aestivum
  Clone ID: PAT_TA_39296.pep
CPSCSIWHLPKFMVFSWSAASQVRHHGYMLLLGCEILHYLLIPRSTLVLFYVTHW

SEQ ID NO: 144879 - protein, 33 aa, Triticum aestivum
  Clone ID: PAT_TA_39297.pep
GLYFVCPGATSLVTLYEVLTQELLFLGFYLICF

SEQ ID NO: 144880 - protein, 66 aa, Triticum aestivum
  Clone ID: PAT_TA_39298.pep
ACVGFSLEEERVLQERRDKYFPQLENQGINPVGDNTQITEYLHKQSHNLHPTRYRGCQSLHGYLQK

SEQ ID NO: 144881 - protein, 36 aa, Triticum aestivum
  Clone ID: PAT_TA_39299.pep
RERPMMLKVITYKCMGLFKATFETRSKGIDIQGGYC

SEQ ID NO: 144882 - protein, 95 aa, Triticum aestivum
  Clone ID: PAT_TA_39300.pep
PLGFMEYLGIYIDERQWKGLLWAPLPIRARQGPLARLGVLWAPQASPLALPWLPSCLLGKKISKKFHCVWTPFDMDILQSKKQAKNNNWHLALCQ

SEQ ID NO: 144883 - protein, 102 aa, Triticum aestivum
  Clone ID: PAT_TA_39301.pep
RLDGAVEYMPEEEVKSTAAERLKISMERIALLKAAKPKMPPAKTEQEEEERKQSEELDGFGNPKGPSTLSKLTAEEAEHRALQAAVLQEWHQLCKEKVMKAQ

SEQ ID NO: 144884 - protein, 64 aa, Triticum aestivum
  Clone ID: PAT_TA_39302.pep
NLLRNEPPPLFEAESGLVESPLGSMTEPVLDKKLILLIIESDTSSSVKSAAILYRRRLNQCSDP

SEQ ID NO: 144885 - protein, 65 aa, Triticum aestivum
  Clone ID: PAT_TA_39303.pep
EMSYGKLKYIKNDHCIMKRLAFSLQLYRFDWKIITGCIMKFCCYIRKYPENQIQPLLVSSAARSR

SEQ ID NO: 144886 - protein, 78 aa, Triticum aestivum
  Clone ID: PAT_TA_39304.pep
VAFHIKNSVFIIYLLKDEQELNVIFGTNVIQRTWSASQEAPEAATRVEGTPPHRARPPSRGPLGRPPTYFFLLYTRRP

SEQ ID NO: 144887 - protein, 90 aa, Triticum aestivum
  unsure (1)..(90): unsure at all Xaa locations
  Clone ID: PAT_TA_39305.pep
MPAALAHMALVLHSRTGNMNAVKALIAADYCAVKVXLPMNFXMGVSYKIPEFIKMNPPGNVPVLDTLDANVFESSAITCYVARPNGDNLF

SEQ ID NO: 144888 - protein, 99 aa, Triticum aestivum
  Clone ID: PAT_TA_39306.pep
RRARSTAVGPSRALRQTGVRLGESTARGGGSVPRMARDGCCDAMADCARRSRRPAERSQAELRWRRRRGEGTLLDAGGAYVMPSSLTHGGHWFVGLSFC

SEQ ID NO: 144889 - protein, 84 aa, Triticum aestivum
  Clone ID: PAT_TA_39307.pep
TGMHVSRPFHTTDVARASRIVHELPTQITISSGRVGARATSTHWEGFMRTHACVCAQTVSCMSSQSMTYIYTVLQAKKSPPKSN

SEQ ID NO: 144890 - protein, 64 aa, Triticum aestivum
  Clone ID: PAT_TA_39308.pep
LVFLWVISSIMCGQRTLHYIERKCHFQLLHRLQSFTWNTICVLAMYRITSTPPLKLNIMPLIIP

SEQ ID NO: 144891 - protein, 70 aa, Triticum aestivum
  Clone ID: PAT_TA_39309.pep
SHPGGASSIIDGHVDVCLRCICLWWICLYLVVFRLRSCVFKLDPCDIRYSSSRWLLFWCVSPMGFSTFTS

SEQ ID NO: 144892 - protein, 68 aa, Triticum aestivum
  Clone ID: PAT_TA_39310.pep
SGILTYNKSLIYFGETASESRPSSTLTYMFVLRWFSSSLYLVTTAGSRSRMETIPVISVSIMAGTCPS

SEQ ID NO: 144893 - protein, 54 aa, Triticum aestivum
  Clone ID: PAT_TA_39311.pep
RRGQKEGSTFKCRFSCLTKASKSSFSVMTCKSASILISGLKSGCHGKIKLYYID

SEQ ID NO: 144894 - protein, 61 aa, Triticum aestivum
  Clone ID: PAT_TA_39312.pep
PSFVTRRWSDVVRFYRTSTQSRTLTGDLAAYSPCGPGIAVDVFDAQPKQLTCTTYHAALLS

SEQ ID NO: 144895 - protein, 56 aa, Triticum aestivum
  Clone ID: PAT_TA_39313.pep
IKTNVETFTAATLSYIIITVSIYRALLTSHMSTYSDSFSSTLVMTGHYPSSRPTLS

SEQ ID NO: 144896 - protein, 79 aa, Triticum aestivum
  Clone ID: PAT_TA_39314.pep
RRSRRDRAHVIRTVLDDAPILLTGASPAMTSRRRKSQAHRRDLLGPHWSIRCSVRCCGPEPDLAPRQRYDNAAQRARER

SEQ ID NO: 144897 - protein, 91 aa, Triticum aestivum
  Clone ID: PAT_TA_39315.pep
GCCSGGGCCCGCCCCCCCLGSRLISASRHTTRFPTITEGQITIGYFCSPSDFCITDGTPSAISRRLCLVGHYHNSRRYCRVIPSPTAITRR

SEQ ID NO: 144898 - protein, 74 aa, Triticum aestivum
  Clone ID: PAT_TA_39316.pep
GIRQRFPYRRNETKTSRTAGRRSLWSPRRHHHQSLWQAKTTFVRISCTSCPLSNWPLWVPFPLNIWEEDRGLYK

SEQ ID NO: 144899 - protein, 46 aa, Triticum aestivum
  Clone ID: PAT_TA_39317.pep
CMETSDMFVDHRIIDTQTSPVDRSIAFLLFQELSWQVVGAVDGLRY

SEQ ID NO: 144900 - protein, 37 aa, Triticum aestivum
  Clone ID: PAT_TA_39318.pep
HRLCYTLGSGWIHVPDALCAKLHGFRQISAIDISRKL

SEQ ID NO: 144901 - protein, 71 aa, Triticum aestivum
  Clone ID: PAT_TA_39319.pep
ILANPDSNRFAPADFHVASTIFIVGPRLPRPIAAYRPYDFSDLVMEQIVPAYEYRIRRKCTAQSRSTHIIK

SEQ ID NO: 144902 - protein, 54 aa, Triticum aestivum
  Clone ID: PAT_TA_39320.pep
ERAITSLRLLLIWMHKPSTLHVSKVLHTFNHTCLLRESLTSTQAVFEFIITQLA

SEQ ID NO: 144903 - protein, 129 aa, Triticum aestivum
  Clone ID: PAT_TA_39321.pep
LEDHEICSYDEHVQNLEELSTIDITDERSRDDVATLLFRSKKLRMLGVRANRGGNTHGVIPFLNELRKYNLESLIIESDLCGLDEWEPWPELRRFELTKLLPRVPESWASLDSLTHLDFAIRKIQATDV

SEQ ID NO: 144904 - protein, 51 aa, Triticum aestivum
  Clone ID: PAT_TA_39322.pep
LRHHHQAFLSLRFQDLPLCGSSLCISPWAGADTRHSSHGSKQAVIVCVQNT

SEQ ID NO: 144905 - protein, 119 aa, Triticum aestivum
  Clone ID: PAT_TA_39323.pep
PGRRAGVVIGSGMGGITALSDGIASLVTKGCGKISPLCIPHAITNISSALVAMDAADGFLGPNFSISTACATSNHCFNSAADQIRLGRADVMIAGGTEAGIIPIALGAFFACRALSQRN

SEQ ID NO: 144906 - protein, 43 aa, Triticum aestivum
  Clone ID: PAT_TA_39324.pep
LCFLMSYCVHGDFFSFRLSYIIPSMGNTLIMMIITPLMTTPHD

SEQ ID NO: 144907 - protein, 80 aa, Triticum aestivum
  Clone ID: PAT_TA_39325.pep
AWRQQDGKVGERPAQGKRITHFWQNASTTVGIGYKRHQIQLQQESCFATMQKRGRVFVTTGVAFCYKCYHFLLHKSTVEL

SEQ ID NO: 144908 - protein, 108 aa, Triticum aestivum
  unsure (1)..(108): unsure at all Xaa locations
  Clone ID: PAT_TA_39326.pep
NGQAERANAKVXRGLKTRTFKKKLEAYSRGWLDELQSVLWSIRTAATKPTGETPFFLIYGAEAVLPYEVKHRSTRVLAFDETQQDATRRMDLMLGEEYRRQALLRAAR

SEQ ID NO: 144909 - protein, 69 aa, Triticum aestivum
  Clone ID: PAT_TA_39327.pep
FYLALSIAFLWTSLVARHRPLPTTYSSFPSVTGANTRHGSTRGLKVRSAPVYGSGVNCALAACSRNGNG

SEQ ID NO: 144910 - protein, 51 aa, Triticum aestivum
  Clone ID: PAT_TA_39328.pep
DFIAGYHVYVHLTDERPKLGHGAKANAADTWGPWPRRAFNDLHVLHLLLTA

SEQ ID NO: 144911 - protein, 55 aa, Triticum aestivum
  Clone ID: PAT_TA_39329.pep
SIFTTLFFLQSLCSDVMCKLVTDSYCAVFSLGIMTRQLLVLNFMPCRRNWKVLRT

SEQ ID NO: 144912 - protein, 66 aa, Triticum aestivum
  Clone ID: PAT_TA_39330.pep
YKVLKTKINKEGNLKLYKSKSEHEKDEHHWSGGYPELVHAHGNFVNLELQKLFNKIIIPLYKFILL

SEQ ID NO: 144913 - protein, 54 aa, Triticum aestivum
  Clone ID: PAT_TA_39331.pep
EGVEREEEKDGSHDHHEGGHEEAEGARVLVQHRHGVQRRLSYTYVRTTALAIAV

SEQ ID NO: 144914 - protein, 51 aa, Triticum aestivum
  Clone ID: PAT_TA_39332.pep
QSHATGLYAAMDVICIGSRPNLKSRVSNADHAKYATLDDAFGGRITSSVNS

SEQ ID NO: 144915 - protein, 69 aa, Triticum aestivum
  Clone ID: PAT_TA_39333.pep
YIQKCKMCMKKSSHNKYFFEKNVSHVFKKCSTCIKNVSYLGKILSGYNNVPILYEKGQDQPMETNKRKK

SEQ ID NO: 144916 - protein, 47 aa, Triticum aestivum
  Clone ID: PAT_TA_39334.pep
LSLMCSYRGRCVKVTQLGPTHICSLPACCVLHQNLHHHSTFVASFPS

SEQ ID NO: 144917 - protein, 62 aa, Triticum aestivum
  Clone ID: PAT_TA_39335.pep
PQLVSINFTILHRHRVSRSMQSLFSRDTGFSSHRVATIDTLRDHIFCRHHMCTFEENHFVIV

SEQ ID NO: 144918 - protein, 73 aa, Triticum aestivum
  Clone ID: PAT_TA_39336.pep
HPESHPDLWGNHSLHHPFLTWDNALIMKIITLLFTYNSRITTRYLEQNMTLCECLRRCTGICNESRATCMKEL

SEQ ID NO: 144919 - protein, 52 aa, Triticum aestivum
  Clone ID: PAT_TA_39337.pep
RWNESFADDLDTPRGIVSGRVALLRRSTEHSAPASHRIQSKETRGRALYYTL

SEQ ID NO: 144920 - protein, 58 aa, Triticum aestivum
  Clone ID: PAT_TA_39338.pep
GPDRLPSGLPSSSLLLPQPLSSSCFSYDVLGFASNYCMLCLKCCVGALLLLSDLARSF

SEQ ID NO: 144921 - protein, 41 aa, Triticum aestivum
  Clone ID: PAT_TA_39339.pep
RSVLKIGEQNRRTAFYNWDHKLETVRRIIVVLVGLMLMLTR

SEQ ID NO: 144922 - protein, 119 aa, Triticum aestivum
  unsure (1)..(119): unsure at all Xaa locations
  Clone ID: PAT_TA_39340.pep
YTDGYLGKDQKVVVAQLCVHHHVLIFHYCMATKPCDRFARFVSNTDYTFSTVETCNDVKALKVTGLACKNLVEIREHYRVWGSLKKDSLVELASAIIDXYYDKMKQDAKRTNPVSWHGA

SEQ ID NO: 144923 - protein, 126 aa, Triticum aestivum
  unsure (1)..(126): unsure at all Xaa locations
  Clone ID: PAT_TA_39341.pep
RREVIPIAAKKCAISDWEPLSSKVANRVCPWRGRFMSSGARLILTNSSLSSLPMFTMGLFLLADGVHSKFDTPWSRFFWEGAGPKRKYHMVKWQAVCLPKAXGGLGIINSKLMNIALMCKWIWKMT

SEQ ID NO: 144924 - protein, 64 aa, Triticum aestivum
  Clone ID: PAT_TA_39342.pep
PDSGGCEVCRADDHGGEAGVQPLMEALPNPYVLCMFLCENCVMIKSNGILISQIALLLIHLNYL

SEQ ID NO: 144925 - protein, 72 aa, Triticum aestivum
  Clone ID: PAT_TA_39343.pep
QFTTNVHQYMPLDMVTKTMVCLCKGFVCNARVQWLFVLEPFLLLGFLRLWACSKGNPGCYRFSGAFSPSISP

SEQ ID NO: 144926 - protein, 46 aa, Triticum aestivum
  Clone ID: PAT_TA_39344.pep
GSLQIKSMILKPLCTLHVNVFSHEILHTCSIHLSLVGNFFQNFWRL

SEQ ID NO: 144927 - protein, 53 aa, Triticum aestivum
  Clone ID: PAT_TA_39345.pep
PSRSMRLTPWFLINSKFLHEVHEFLTNVDSMDKTHSHPSTIASLSKTVHFMPV

SEQ ID NO: 144928 - protein, 63 aa, Triticum aestivum
  Clone ID: PAT_TA_39346.pep
IEGCMSSNVLWLSTIEISYTFQFVSGQLEILSAIEAEALRKVSHLGSRTGPEQRRLEGEELPV

SEQ ID NO: 144929 - protein, 59 aa, Triticum aestivum
  Clone ID: PAT_TA_39347.pep
CRSLSAMRQAGLPLGPWSHCVIPRARRNHPTYKVIPNLLFLVGHVHMVQQQSDLRKSRI

SEQ ID NO: 144930 - protein, 111 aa, Triticum aestivum
  Clone ID: PAT_TA_39348.pep
IQKEELQLALFITPSGQNLFIDRVFDLFDEKKNGVIEFDEFIHALSVFHPCSPVEDKINFAFKLYDLRQTGFIEREEVMQMVIAILNESDMKLSDELLEAIIDKGHHNIFS

SEQ ID NO: 144931 - protein, 80 aa, Triticum aestivum
  unsure (1)..(80): unsure at all Xaa locations
  Clone ID: PAT_TA_39349.pep
QYRSVLIPKKRENGSVEEGLLPLTPAKKKKKKKKKKNTKNKKIKKKKQKKKKKKLEKXTKQKKKKKRPPKRFKPNLPLNA

SEQ ID NO: 144932 - protein, 48 aa, Triticum aestivum
  Clone ID: PAT_TA_39350.pep
LFWGVNLKLSSEEHHIGLDYMQNSNLLLQFSGLVLTFTFLILISQSSY

SEQ ID NO: 144933 - protein, 43 aa, Triticum aestivum
  Clone ID: PAT_TA_39351.pep
FCIVWFFFDFFGLFFFFFLFFFFFFFFFFFLYAKYLSCTEIIK

SEQ ID NO: 144934 - protein, 69 aa, Triticum aestivum
  Clone ID: PAT_TA_39352.pep
GGTSRDERRRCTDVVRRTQRVETRWGRWAALPTGHSVVNQLPTSATQYIIQTWLIAQLTKRRWICRVIV

SEQ ID NO: 144935 - protein, 51 aa, Triticum aestivum
  Clone ID: PAT_TA_39353.pep
TRQWNIPYNYNVWLLHTTAAAGTYSATLDVHVASLRNKTFNAEGNQATQLT

SEQ ID NO: 144936 - protein, 74 aa, Triticum aestivum
  Clone ID: PAT_TA_39354.pep
GRLGMSNPRRVMSIHWPSYDIEYFLQGCPPICRSLINPGYEIIALPQYDLNLRNRPFYVIVLPGNTLTHSPTVL

SEQ ID NO: 144937 - protein, 69 aa, Triticum aestivum
  Clone ID: PAT_TA_39355.pep
GHTSIHPGNGSPWTLTHTPYHASSQESYLPIHPFTHNTHAHEHSHAHGHEHGRPLACHIRGQVPDAYGI

SEQ ID NO: 144938 - protein, 45 aa, Triticum aestivum
  Clone ID: PAT_TA_39356.pep
PAIEEITGDAVMASQTSRTVNRATNISALVLIKLMYKDVPIRCGV

SEQ ID NO: 144939 - protein, 65 aa, Triticum aestivum
  Clone ID: PAT_TA_39357.pep
LSREATSETYGPRVYSHHINLYHFIYLLCFYFTFIFTLHLSIKNTKNIISIDLTLVSDREGIDNP

SEQ ID NO: 144940 - protein, 118 aa, Triticum aestivum
  Clone ID: PAT_TA_39358.pep
ASLAMVAGPTFHSLLPYSTSKSTHLISSPTEYKSLAAQLAHPYVVRIDEISKRAYIQKQREYIMVSTYNGNKNYPSKTNQIFSSQMVNVVGVITGKQRVGTRSCCRVQRRGKTACIID

SEQ ID NO: 144941 - protein, 59 aa, Triticum aestivum
  Clone ID: PAT_TA_39359.pep
TGMTGFGFGYCSNRFEPVKRVGFYILPSSCPVGLKIHPSPSPNRVKTRGDAGFGAPLPS

SEQ ID NO: 144942 - protein, 86 aa, Triticum aestivum
  Clone ID: PAT_TA_39360.pep
IKFESFGGPLFFFFFFFFFFFFFFFFFLFFFFFFFFFFFFFFFFFFKYITNNIPHIRYIEENKSSIETTRALESKYIRPLPVCPGL

SEQ ID NO: 144943 - protein, 52 aa, Triticum aestivum
  Clone ID: PAT_TA_39361.pep
NQYMTLFKGKEFKLAELIDSSRRKKNVSILKICSIFRQILSLYTIVRGWLYF

SEQ ID NO: 144944 - protein, 58 aa, Triticum aestivum
  Clone ID: PAT_TA_39362.pep
RADGHISLKMTAKPAYIKNMQMAASPHQKVIFSKSMATFKSILKVEGVTNSDDHNFSH

SEQ ID NO: 144945 - protein, 106 aa, Triticum aestivum
  unsure (1)..(106): unsure at all Xaa locations
  Clone ID: PAT_TA_39363.pep
TGELWKLLSLKHGSGNDCLLEDFATHGGDTNDVFFDEPDHEHQKPMALLMDLYPGVLTGIHSIDYQILFNQKTSYLSDHGGGAGDTWASGXHHGQQVVDNILDMVN

SEQ ID NO: 144946 - protein, 51 aa, Triticum aestivum
  Clone ID: PAT_TA_39364.pep
CFFIVFFFFYSFFFFFFFFFFFFFFFFFFFFFFFFLVHVSESCFLSIQQYV

SEQ ID NO: 144947 - protein, 85 aa, Triticum aestivum
  Clone ID: PAT_TA_39365.pep
LSLLPCSHLSPCLSPPSHPVRWTDPAHSDNGCPRDCQPHFDRTLHLPSAPLLPFALLLGDRFPGLLPAHHRLVTLRHYLHALGHH

SEQ ID NO: 144948 - protein, 71 aa, Triticum aestivum
  Clone ID: PAT_TA_39366.pep
LFTTNRVYATGVEHGLIVFRPAIVCDILPDEWTRTSRRPSGPVYIDLRGSRLFAFQWTCASRRPCGLIYIN

SEQ ID NO: 144949 - protein, 37 aa, Triticum aestivum
  Clone ID: PAT_TA_39367.pep
GHDVLNHAILVLAVLSMIAVLIGVIRGILVIPVGPGL

SEQ ID NO: 144950 - protein, 81 aa, Triticum aestivum
  Clone ID: PAT_TA_39368.pep
HSSGRSRASSHNVGEIDERLGEVWQTDTVARYGACDIISLQCFTCLTDHGTSNNNLAAVNSTVLVTLTSINHVGIHASPLV

SEQ ID NO: 144951 - protein, 85 aa, Triticum aestivum
  Clone ID: PAT_TA_39369.pep
VDGAGTASVVRSMNDKFDLVIVGRRGEDRDVEGSALTSGLSEWNECPELGVLGDMLATAEFASKVSILVIQQQAGITTGGDADYQ

SEQ ID NO: 144952 - protein, 55 aa, Triticum aestivum
  Clone ID: PAT_TA_39370.pep
ALMTHARLPGSATTQRQHASKIVIELTHECRIEILFIVQNSCNEQQKLGHLSRYK

SEQ ID NO: 144953 - protein, 85 aa, Triticum aestivum
  unsure (1)..(85): unsure at all Xaa locations
  Clone ID: PAT_TA_39371.pep
EWVPCLEFSMVGFVFREHNSSPGYYDGRYWAMWYLPMFGCTDATHVLNEVEEVXKDYPDAYVRVIGFDNLHQVHFVSFIAFRPPG

SEQ ID NO: 144954 - protein, 49 aa, Triticum aestivum
  Clone ID: PAT_TA_39372.pep
RLTSCRNWPLWHPPSDPAYHVFTKQHDEDFATTLPHYTLQCCGIPVPAA

SEQ ID NO: 144955 - protein, 112 aa, Triticum aestivum
  unsure (1)..(112): unsure at all Xaa locations
  Clone ID: PAT_TA_39373.pep
SEYRVDVDVIDKLCVSTNITSLAHDTHLSMFKNLTSKVCVYCNVGRHTHNSSTVSHRQLXTLGVACHIGCIGHGKYRQDTQHGANFTSLSAHYNDDXVGPTRTCVVSIVSRH

SEQ ID NO: 144956 - protein, 57 aa, Triticum aestivum
  Clone ID: PAT_TA_39374.pep
RLDCQAKEPQGGVLVFVSGTITTGPGEQPLKFSQMFHLLPAGGSFDVQNDMFRLNYG

SEQ ID NO: 144957 - protein, 64 aa, Triticum aestivum
  Clone ID: PAT_TA_39375.pep
SGSTATTKTSSISAGHRRALALSGGIRFPRCAVRFYSVSSVTSTPFGIPTVHTPATRATTASSS

SEQ ID NO: 144958 - protein, 82 aa, Triticum aestivum
  Clone ID: PAT_TA_39376.pep
YKVREKWTTRENKIMVMQVRESELCNMQNHKKEGKLFRKREKRVQWPYEWCPTAWVKVLNGTMETPRGAESHICVFSHNISR

SEQ ID NO: 144959 - protein, 80 aa, Triticum aestivum
  Clone ID: PAT_TA_39377.pep
RVSEVLAHTTVRYTSGILCTALELSNGHDIDVHSVPAGLLQRFVRLLGAGDTEVPYVLDALARKLRAPRRPQDALVITTM

SEQ ID NO: 144960 - protein, 136 aa, Triticum aestivum
  unsure (1)..(136): unsure at all Xaa locations
  Clone ID: PAT_TA_39378.pep
SEYDLATHACNYWICDGIIQKDTDIAEAWQVGERLQGDIRWNMDYRDNEXPLAFYGMPSAYHTGHHQLMDLCWSLMESFXSRTFQHFDKLGVMKLSRCSFSFSSPPFLCCHSLRFLWLDHCQNLGKRNGAQFGEED

SEQ ID NO: 144961 - protein, 65 aa, Triticum aestivum
  Clone ID: PAT_TA_39379.pep
IFELIFKIGCVMQISTSNAGDCTPLCNAVFFIQEWMREHQSEDGQQPGRENAIFCSKMKFVKGLA

SEQ ID NO: 144962 - protein, 143 aa, Triticum aestivum
  Clone ID: PAT_TA_39380.pep
RVDTFKWIFDEFVKMMGGKRPITILTDQARAMEVAIADVYPDATHRWCKWHILKKAKESLGSNYTKKSDFRAEFHKLVHEMLTIEEFEDGWAALLEKYSLKNNTYLMQIYKTRQKWAKPYFAGKFCARQTSNGRSESANHMLK

SEQ ID NO: 144963 - protein, 131 aa, Triticum aestivum
  Clone ID: PAT_TA_39381.pep
AIGSGDWFKTIISRKKSNRGKSKHAQVAAQRNGANLPHHKPSNAPSSSIDPQDTAALEDWATTRIQNAFQRHKATRTLRCLKRLQPLSIVGHSNRVTSQTSATLNSINSFHKSKAEPTQRRAFIVPDGLNT

SEQ ID NO: 144964 - protein, 96 aa, Triticum aestivum
  Clone ID: PAT_TA_39382.pep
GRPVGTGEGSTKLVHDVDCPMDFDFSPYVSANGGVEQKYDLYGVIHHRQYGPKGGHYWCFTKYNGEWYEINDERVTSITKEGVEKKTKKVISFSIK

SEQ ID NO: 144965 - protein, 110 aa, Triticum aestivum
  Clone ID: PAT_TA_39383.pep
VDGKIYDVTAYLDDHPGGADVLLAVTGMDGTDEFDDAGHSMDAKALMNDYFIGELDLDEAPDMPEMEVFRKEQDKDFASKLVDYAVQYWAIPVAAAGISAVVAILYARRK

SEQ ID NO: 144966 - protein, 63 aa, Triticum aestivum
  Clone ID: PAT_TA_39384.pep
IAHPLSSKLSLIWMIAVTMLLIVRRCHIDRDMSSKGWPANLVRVSLFTLSSVLEVTRLGAFDH

SEQ ID NO: 144967 - protein, 137 aa, Triticum aestivum
  Clone ID: PAT_TA_39385.pep
AKAREGDSSGRDRERRGDDSTAAMSALKFCSKCDNMLYPQEDKEMHILLYACSNCQHQEIATDSCVYKRVLRKSADEPKDTLKDAAADASLPRTRSVKCYNCSYPEAAYFQAPTTGEVGLTLYFICCSPTCGHRWVD

SEQ ID NO: 144968 - protein, 93 aa, Triticum aestivum
  unsure (1)..(93): unsure at all Xaa locations
  Clone ID: PAT_TA_39386.pep
GGPVELKRAAEDRITIRWTFKKFNEGIMRDILDPLLEDRVDEDVLXKLQTVGFQCDPLTQDDRLTVTEVLEQLWDIRKGDRMRFRIASNHLLI

SEQ ID NO: 144969 - protein, 138 aa, Triticum aestivum
  unsure (1)..(138): unsure at all Xaa locations
  Clone ID: PAT_TA_39387.pep
AIIENKEEDYGMFVWPCSVILAEYVWQQRPRFSCSRVVELGAGTSLPGIVAAKVGAGVTLTDIAHNTEVLDNIKQVCGLNNVNCXGLTWGDWDEPVLDLHPDIILGADVLYDSAKFDDLFAMGTFLLGNSPVAVFITT

SEQ ID NO: 144970 - protein, 124 aa, Triticum aestivum
  Clone ID: PAT_TA_39388.pep
GSTAAANRCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIA

SEQ ID NO: 144971 - protein, 147 aa, Triticum aestivum
  unsure (1)..(147): unsure at all Xaa locations
  Clone ID: PAT_TA_39389.pep
TGLVIPGRPTDRGQLRCTCHLNQPSTPPPRRRRLRSTTASAAMVNVPKTGNTYCTNNDCRKHTLHKVTQYNKGKDXLSAHGKRRYDRKQSAYGGHTNPVFNKKAKATKNIVLKLHCQTCKHFSQRAITKCKHFXIRGHKNGRGTSLF

SEQ ID NO: 144972 - protein, 61 aa, Triticum aestivum
  Clone ID: PAT_TA_39390.pep
MWKLPMFGATDATQVINELEEVKKEYPDAYVRIIGFDNMRQVQCVSFIAFKPPGCEESGKA

SEQ ID NO: 144973 - protein, 53 aa, Triticum aestivum
  Clone ID: PAT_TA_39391.pep
EHRNLLYLHLFFKQQASAQHAFFQVLPTGLGGPLAIGTTSAARPCLSFAMSAR

SEQ ID NO: 144974 - protein, 117 aa, Triticum aestivum
  Clone ID: PAT_TA_39392.pep
MSPQTETKAGVGFKAGVKDYKLTYCTPEYETKDTDILAAFRVSPQPGVPPEEAGAAVAAESSTGTWTTVWTDGLTSLDRYKGRCYHIEPVAGEDSQWICYVAYPLDLFEEGSVTNMF

SEQ ID NO: 144975 - protein, 64 aa, Triticum aestivum
  Clone ID: PAT_TA_39393.pep
DMNKTVAINTLSEYMMHLLVKHPDILLVNTDSRGLIDKAWYSCIPLFVSYSADDYDQEFMDYKV

SEQ ID NO: 144976 - protein, 70 aa, Triticum aestivum
  Clone ID: PAT_TA_39394.pep
VYVCHHPAERQQQSCSLKGDIPHLELSTMCLDCSYVGWTDFQCSFPKVTTSCIENIWHGQHLRHDIVLLI

SEQ ID NO: 144977 - protein, 136 aa, Triticum aestivum
  Clone ID: PAT_TA_39395.pep
MTLNSLRMLVMKDLACCTQLPDGLCQLPWLEYLKVNCAPAIKCIGPEFVRPQSHRCYPSSCMVTAFPRLHEMDLLELVELEEWEWDEEVQAMSVMVELTFTRCNLKCIPPGLASHAKALIKLTLWSMWRLHSLENF

SEQ ID NO: 144978 - protein, 95 aa, Triticum aestivum
  unsure (1)..(95): unsure at all Xaa locations
  Clone ID: PAT_TA_39396.pep
IRSKWVPCLEFSNVGFVFREHDISPGYYDGRYWTMWKLPMWGCADATQVRKEVDEVTREYPDAYVRVLGFDRLRPVQCVRFMPFTPLXCDESGRG

SEQ ID NO: 144979 - protein, 81 aa, Triticum aestivum
  Clone ID: PAT_TA_39397.pep
TKVGFIVREHNSSPGLLHGRYWRMCDLRKFGCTDAKQLINNVDEVKKEYPDAYVHIIRFHNMRQVQCVSFSTFIPPGCDES

SEQ ID NO: 144980 - protein, 93 aa, Triticum aestivum
  unsure (1)..(93): unsure at all Xaa locations
  Clone ID: PAT_TA_39398.pep
FKSYREGLMSPQTXTTARVGFKAGVKDYKLTYYTPXYETKETDILAAFRVSPQPGVPPXNHGXALPAESSNGPLTTVWTYXLTTHDRHKGQCY

SEQ ID NO: 144981 - protein, 33 aa, Triticum aestivum
  Clone ID: PAT_TA_39399.pep
LSCAMMSKAQYRRTFPITYQMPNVKSMSRRSCC

SEQ ID NO: 144982 - protein, 100 aa, Triticum aestivum
  unsure (1)..(100): unsure at all Xaa locations
  Clone ID: PAT_TA_39400.pep
FKSYREGLMSPQTETKACVGFKAGVKDYKLTYDTPXYETKDTDILAPFRVSPQPGVPPDESCAAITAESSTGTWTTVWTDXLTSLDRFKGRCYHIEPCCW

SEQ ID NO: 144983 - protein, 59 aa, Triticum aestivum
  Clone ID: PAT_TA_39401.pep
VYIGLYLLGRPLFFFFFVFFFPLGTKMFQFGQVFSALLLIQAGSLKGDLIWDFPNLCLF

SEQ ID NO: 144984 - protein, 95 aa, Triticum aestivum
  unsure (1)..(95): unsure at all Xaa locations
  Clone ID: PAT_TA_39402.pep
NMRRRLNLDIPQKNTFLLRQHGLAATDHLXGVKFGTGILDDEDINHLKDRGNHSVADPLQDQVGLALGRXQHAVQKTICTVLIRQSKTTPQTLVT

SEQ ID NO: 144985 - protein, 150 aa, Triticum aestivum
  Clone ID: PAT_TA_39403.pep
NSRADRLKKTEGAGLEVLRIINEPTAASLAYGFEKKNNETILVFDLGGGTFDVSVLEVGDGVFEVLSTSGDTHLGGDDFDKKIVDWLASTFKNDEGIDLLKDKQALQRLTEAAEKAKMELSTLTQANISLPFITATADGPKHIEATLSRA

SEQ ID NO: 144986 - protein, 108 aa, Triticum aestivum
  Clone ID: PAT_TA_39404.pep
MSPQTETKAGVGFKAGVKDYKLTYYTPEYETKDTDILASFRVSPQPGVPPEESGAAVSAESSTGTWTTVWTDGLTSHDRYKGRCYHIQPVAGEDSQWICYVAYPLDLF

SEQ ID NO: 144987 - protein, 63 aa, Triticum aestivum
  unsure (1)..(63): unsure at all Xaa locations
  Clone ID: PAT_TA_39405.pep
SSDLVYLSIGHNLEEHSVVLVRXGKVKDLPGVRYHISQRTLDAVAIVNRQQRRSKYVVKTPLG

SEQ ID NO: 144988 - protein, 69 aa, Triticum aestivum
  Clone ID: PAT_TA_39406.pep
QVLWGNGLARIDSVTKPRLIENFHAYRERHGHAICISIKVLFSARVDAIVGACTSLSLHECTGLRYIKI

SEQ ID NO: 144989 - protein, 67 aa, Triticum aestivum
  Clone ID: PAT_TA_39407.pep
RRQKGIQCNLFCKKRKVYKNEYACMYISSTLLNLTELQTKEVQFTWFRLKKYNLLGFTYEEAEKEPD

SEQ ID NO: 144990 - protein, 50 aa, Triticum aestivum
  Clone ID: PAT_TA_39408.pep
KMFIEFGKSLSILKKECVYSEKSSSVFKKLVDLRKEFNRFFKKLVDFKKR

SEQ ID NO: 144991 - protein, 44 aa, Triticum aestivum
  Clone ID: PAT_TA_39409.pep
RSHSQIQRLFIGGSAYVSLITHWFTEHHIIGEHMALLFAVSPGI

SEQ ID NO: 144992 - protein, 115 aa, Triticum aestivum
  Clone ID: PAT_TA_39410.pep
LYHDAISSFLDVAQPFYSHSITFFSRNLFTYCSMPVGGVCMSLHSQEINSKRRPNIVKIPEDFVVQTDIQSTKVVPAHSSRRATPSRARNGGLCPSWVPLELLICYINTPIFLKP

SEQ ID NO: 144993 - protein, 65 aa, Triticum aestivum
  Clone ID: PAT_TA_39411.pep
QSRSNKYLHVYQNEIKLMDSATPLITRASSVFHLDGYIFFIEECTMLELVDARQSRSSCTQHSLY

SEQ ID NO: 144994 - protein, 67 aa, Triticum aestivum
  Clone ID: PAT_TA_39412.pep
RADCSIKALNTASCLRVSWYDLLYRMYDHVYLSMYHNTCSVCVVMCTAIAYVCNLPCRVRCLYRYHL

SEQ ID NO: 144995 - protein, 90 aa, Triticum aestivum
  unsure (1)..(90): unsure at all Xaa locations
  Clone ID: PAT_TA_39413.pep
QSCIIQEYIXVVLICPIFPTSVDRKIVAFSFYLSQKLLFHLRTTRIIGIHATTKVQNVCNCMHPKLRATQGVKRVRNCDETCVAMRSKHA

SEQ ID NO: 144996 - protein, 65 aa, Triticum aestivum
  Clone ID: PAT_TA_39414.pep
RVLGASNRSARSWTSPRKQEYLRTDLSYASSDKMSSTNSETDRTRRRPRGWDRPNYSWSWSAGCT

SEQ ID NO: 144997 - protein, 65 aa, Triticum aestivum
  Clone ID: PAT_TA_39415.pep
SRDQNSATLSLSLSLSLYYIYIYQQFLAISGRSPKLNVVNFNLIKFKEGSTKSSMHSNLNIDSFA

SEQ ID NO: 144998 - protein, 52 aa, Triticum aestivum
  Clone ID: PAT_TA_39416.pep
MAVPKKRTSISKKRIRKKIWKRKGYWTSLKAFSLGKSLSTGNSKSFFVQHNK

SEQ ID NO: 144999 - protein, 93 aa, Triticum aestivum
  unsure (1)..(93): unsure at all Xaa locations
  Clone ID: PAT_TA_39417.pep
RSFRIHSIVEHQKLLTLQIFQSRFGHAHYTHSHLGKGTLNRTILSGRCFLHNLSLIIKHGLTLSGSPSQYSSSREFTLSVXIXXIFKVVLIFC

SEQ ID NO: 145000 - protein, 101 aa, Triticum aestivum
  Clone ID: PAT_TA_39418.pep
HDKCVHHYAICLDLKNQRFEVLDSMRSEADADLTTHGEYFINNLKETWNRHYENSKVQIRHFPIEYVATMKQGNRYFPIFSSCVLQTNAHPLFFVTSELKL

SEQ ID NO: 145001 - protein, 85 aa, Triticum aestivum
  Clone ID: PAT_TA_39419.pep
ASELHLIRSELPYGLRAILILTKYGHSIFWRPKIVVCTTSDKGTHCFRLKSRTASDSQVNFMVSFVGRNFSHTSFCCIFFNIFYE

SEQ ID NO: 145002 - protein, 77 aa, Triticum aestivum
  Clone ID: PAT_TA_39420.pep
CPWPLVPVLTRIRTDGPPCGRCGEPRQEALWSRLVTPTGTNRHPRVSCSGARVFLFFSEGGRFGGFVWLINVFHILC

SEQ ID NO: 145003 - protein, 50 aa, Triticum aestivum
  Clone ID: PAT_TA_39421.pep
STWISAVIWICLLICFGSITTCGYIVVQLLQVSYQDPVYHLLLNSHSKKT

SEQ ID NO: 145004 - protein, 56 aa, Triticum aestivum
  unsure (1)..(56): unsure at all Xaa locations
  Clone ID: PAT_TA_39422.pep
NXSHLAKRSSTYKVGAGIHSASKPPFIFLSWSYLQNLVWTIKLALINSQAYMHLDI

SEQ ID NO: 145005 - protein, 118 aa, Triticum aestivum
  Clone ID: PAT_TA_39423.pep
CWTSRRTLATIHGELGSSRIEENPHAATWGAGTVQEVIPQVGEMSLRRVGGIFPQNKGAEDLCPRQRRLRVDGAQRLPPSSMVTTSTLHLLTSRSGRNSAGSVTTDEERDRVDTVILF

SEQ ID NO: 145006 - protein, 50 aa, Triticum aestivum
  unsure (1)..(50): unsure at all Xaa locations
  Clone ID: PAT_TA_39424.pep
SYQPTITEVLIVLLKKLRIQXLCRAHQKRKKTVGPHKGRTFPDCRQDVDI

SEQ ID NO: 145007 - protein, 75 aa, Triticum aestivum
  unsure (1)..(75): unsure at all Xaa locations
  Clone ID: PAT_TA_39425.pep
TFALRRSDSAGGTSLPKGEIEAIVITNNPLIFGRPIFINIFNSTNSSQTXVPVFNLCTRTSDWYLWVTSSVDYIL

SEQ ID NO: 145008 - protein, 102 aa, Triticum aestivum
  unsure (1)..(102): unsure at all Xaa locations
  Clone ID: PAT_TA_39426.pep
RPGPARRPRSRCTEWFRTSGPECFSRYIRAAEIPNNFRLATGISKFTSESKPEIWLEGYRIAVXIDGGNDNVAMKHVXLMLEGSARAWLTRLPTGSIFCWDD

SEQ ID NO: 145009 - protein, 46 aa, Triticum aestivum
  Clone ID: PAT_TA_39427.pep
IWAHVLMLYSLSILVIHRFFNYIQCMVYMQLMSTLDYTICCMCETH

SEQ ID NO: 145010 - protein, 94 aa, Triticum aestivum
  Clone ID: PAT_TA_39428.pep
ILTKNSDHDSYFFLLLFFFFLRCCCKRIYLCYIKEKKRSMRTNSPSCRGRICRGRSGSRLPGKRADRLLFKLIYRCWGAASNGNSETESERGPV

SEQ ID NO: 145011 - protein, 68 aa, Triticum aestivum
  Clone ID: PAT_TA_39429.pep
RLIRTDTHGSTRIHHPLVCTYVYIFVVLYSVHCTHNYLKCVTSRSRLATHTMLPADVTRKKGHVTIGP

SEQ ID NO: 145012 - protein, 72 aa, Triticum aestivum
  Clone ID: PAT_TA_39430.pep
NPSFLTIHLSADILYDSWSPAMTVSSVCISILSMLSSSPAKERPSDNDRYVRNCRNGRSPKETRWWFHDDKV

SEQ ID NO: 145013 - protein, 90 aa, Triticum aestivum
  Clone ID: PAT_TA_39431.pep
KQGLQSRQCYLLKQISCWLQIALQMRIQRQMTSPIIPLRCMLKLGRVILLISCICCIAMLSFFIIYTILNTISLVDTSYMRLPSSHFLSI

SEQ ID NO: 145014 - protein, 78 aa, Triticum aestivum
  Clone ID: PAT_TA_39432.pep
VGAQSVTVRMVYIKKMLGPTKPAWSICDGFCDGSPTSVIKGPLFSGPTTAYKSVTVVVTGHGFPVIFMTDSRNVSTNP

SEQ ID NO: 145015 - protein, 106 aa, Triticum aestivum
  Clone ID: PAT_TA_39433.pep
NRRKDSSVDDLHGMIRHENRLLVLIGEHETDDVIPHVFTLLCADSQEALVHVVRVSDTDMTYLLNPNDVVHVQGIKADKRKIQLLHVKHVKYVIEWRKNLSTGKLA

SEQ ID NO: 145016 - protein, 125 aa, Triticum aestivum
  Clone ID: PAT_TA_39434.pep
IHNKCRGFFFLEKEDASPASASGQCIRPLYVLSTKTLQSSISVSLKPPSRQHLSLLLPLNAVEPNTKQISHQILISNAGCPILATYRDWVTRQSGPLTEAAAAFFHRSISRAGTDAQIFSGLRST

SEQ ID NO: 145017 - protein, 65 aa, Triticum aestivum
  Clone ID: PAT_TA_39435.pep
VHVGIPTKTGGVPCLVPAIRNERLTKDFKGPRKVPNYTADLQPAAWIESYEMAMELCDARIIRLQ

SEQ ID NO: 145018 - protein, 105 aa, Triticum aestivum
  Clone ID: PAT_TA_39436.pep
GPPPPAYTCDCSSMGSCSSSLHRLLFNQPSTGYCSTNPPRGPVHPTPHQELFIQTPSTMLTVHPGKEATVFDRLQLAAVAKESHSGLVNSKGSIDRSGSVMRILQ

SEQ ID NO: 145019 - protein, 145 aa, Triticum aestivum
  Clone ID: PAT_TA_39437.pep
GATSSASSSSRARRCFSGPMRSPIRYREGPLDYEPFTPCDCREKPKAAMWISWSDENPGRRYKTCYRSRRGGCEFYEWHDNPIADPFLKQLVIDLRDQVWLFERRNAALQDATRTAETEAANLSRQLSEAMESGMDSRAKIMVAP

SEQ ID NO: 145020 - protein, 96 aa, Triticum aestivum
  Clone ID: PAT_TA_39438.pep
STWISLGHDARRLHTSLLFLHGLPMLSTLCLPQTTLLTPHYENCTLILVSLPTPHAYKLRSSNRLWVIRDDYLCYPRLVYYCIHVSIHMATLFNSA

SEQ ID NO: 145021 - protein, 113 aa, Triticum aestivum
  unsure (1)..(113): unsure at all Xaa locations
  Clone ID: PAT_TA_39439.pep
VDIDHDTQVKQAMTEINAAAKMMVAASENAEADKIVQIKRADGXAEAKYLSGLSIARXRYAIVDGLTDSVLSFSVNVPGSTAHDVMDMVLITHYLATNKDIGASSKSSVVLIP

SEQ ID NO: 145022 - protein, 70 aa, Triticum aestivum
  Clone ID: PAT_TA_39440.pep
VGCLSKLGQYPSVGPPTYQIIKVPNRNLMNVMKTSLTIIPNVSSGAPFSLLDLSRLILCYIKDWATLLHF

SEQ ID NO: 145023 - protein, 132 aa, Triticum aestivum
  Clone ID: PAT_TA_39441.pep
TPPILAAHNSSLSARILDAALSPQSHQCTRMPPKRPIEGSGDVGAAEAPEHGVNMETEVSVPADKVENEAANNRWWVEKEPQVTPASLDFINNLPDDMLIGIISLLPIKYRARTAALSRRWRTLCFRTRVDP

SEQ ID NO: 145024 - protein, 44 aa, Triticum aestivum
  Clone ID: PAT_TA_39442.pep
SHALGCAYICTSRPKDLLNRLVFWTSNAYTDMAKRLVLGLLISH

SEQ ID NO: 145025 - protein, 63 aa, Triticum aestivum
  Clone ID: PAT_TA_39443.pep
HTEAAQLRQCSQNLERFTENCEHLLNTEYFLDSVNNFLEQKHFSKFQNSIWKQNHFVKSMNFL

SEQ ID NO: 145026 - protein, 77 aa, Triticum aestivum
  Clone ID: PAT_TA_39444.pep
AAVSSATSSSVEYVPDIDIWAGAPLIVEASKSTVTQILLSSHISRRYSASGIPSSASTMSSMALKGILMIVGASCNV

SEQ ID NO: 145027 - protein, 70 aa, Triticum aestivum
  Clone ID: PAT_TA_39445.pep
LLHECQDFGQRWGPASREFIPRRRHSSEPQIRITSSCLAFPSKSSPHRPVTYDFLDFDRSFVSNILCFVQ

SEQ ID NO: 145028 - protein, 81 aa, Triticum aestivum
  Clone ID: PAT_TA_39446.pep
FFVVGDLWFVQVKTSSMTHSLLGLLTLMVAPCCVCPEHGVVRRHKCPIVSGHGKTKCSCHVWLRPILALTSLSHIIDCHWF

SEQ ID NO: 145029 - protein, 73 aa, Triticum aestivum
  Clone ID: PAT_TA_39447.pep
TNRRAHMARGDLTIHDSECMVFGSLSFKPRHSFLDAGKTMSHAWLDQWPSIIYHKSRYVKPDLHILGTDVSFH

SEQ ID NO: 145030 - protein, 70 aa, Triticum aestivum
  Clone ID: PAT_TA_39448.pep
FPLSTSTKATASGALTRENRINNDVVRGDFFSHYCHPVFSSNFVVGDRLKVNRFLSFSIEIGLVKCLKKR

SEQ ID NO: 145031 - protein, 112 aa, Triticum aestivum
  Clone ID: PAT_TA_39449.pep
ANASVHIIHPITWYQLLWLSRISSTHLPHRRRTPLPSPPSPLGPLPLLRLHPPSPPLPSPPPLLPPPATPLSTSTTITSPTMSSSNWILLRIISPSGAPSSVSSSSSIACRT

SEQ ID NO: 145032 - protein, 140 aa, Triticum aestivum
  unsure (1)..(140): unsure at all Xaa locations
  Clone ID: PAT_TA_39450.pep
AGPILRVQTTGQLVYELGGIDRRVIERFEDESAEMKKCGKYAWVLDKLKSERERGIAIDIALXKFETTKYNFSVLDITGXTSYGDCAVLIIDSSTGGFEAGISKGGLTLEHVLLALTTGVEHMICCCNKVNVLTHHACFY

SEQ ID NO: 145033 - protein, 56 aa, Triticum aestivum
  Clone ID: PAT_TA_39451.pep
LLSSESQLSKLTVQYEILTKLKSCGGKWQSCMSSGCLHYCIWVQAPVNGYIHICMH

SEQ ID NO: 145034 - protein, 69 aa, Triticum aestivum
  Clone ID: PAT_TA_39452.pep
RVHQDTLIDLMLAANYLDMQSLLDLTCKTVADQIRGRTLEEIRKKFNIRNDYTKDEEQEVRRENSWAFN

SEQ ID NO: 145035 - protein, 64 aa, Triticum aestivum
  Clone ID: PAT_TA_39453.pep
KSIVKRILSKKYGISMWIPIFGTGTMYSITHGAHHIQGNQLSSIFYFKIINSLQKGMDKYKYLY

SEQ ID NO: 145036 - protein, 126 aa, Triticum aestivum
  unsure (1)..(126): unsure at all Xaa locations
  Clone ID: PAT_TA_39454.pep
VHVALVCVSRFFKKICSYVTSISDMEKLEXENAETLCTLEAIFLSSFFDLMVHLXTQVRLGGPIKYNNMYPIERSSMNLFSCMRLKGFVRTKSHPEGSIAEGYHFDESITFCSHYLQGCETRFNKN

SEQ ID NO: 145037 - protein, 121 aa, Triticum aestivum
  Clone ID: PAT_TA_39455.pep
FWTKNDSFAWKNTFFYSAIGADFLSLEAQTHLFYFAKGTNLLFMEAYVCSFCKRHRFASARGTVVLQSFFSFCKRHIFASRGGKDLLPREVPLVKRKIGKEVRKKHVSSSVFFFFHFFLFY

SEQ ID NO: 145038 - protein, 140 aa, Triticum aestivum
  Clone ID: PAT_TA_39456.pep
NTSLVFCEARDSKVPDSFPDSEPSTPLPIEPNWAPIMEFAAADIFQHSPFGDILNSLKSLSLLGEPWPDYGQQGWDADDKEIQSPPTTHFVATVDDLTGMLDFDSEDIDGMDANAGDDQDPAPLGQWKATSSYYIYIVDP

SEQ ID NO: 145039 - protein, 53 aa, Triticum aestivum
  Clone ID: PAT_TA_39457.pep
CEPTIWTHPINGFELTCFLSKKLLSDEEALHTRLGQTTLPCIFLPLIYWVLCI

SEQ ID NO: 145040 - protein, 111 aa, Triticum aestivum
  Clone ID: PAT_TA_39458.pep
GPRGGGGAAWPCGLACPAGALAGVECQYEDDLASREPLRGGYPPAKSTQGALPRRSVWHEEHNKMGSARCSQLKIIFPCHLFICVNDAQPRKNKACRTQLCYAMLLSCDLL

SEQ ID NO: 145041 - protein, 35 aa, Triticum aestivum
  Clone ID: PAT_TA_39459.pep
LRGVNGDFVKSQGHMPAQSLGGAHSPDAEAGGPPP

SEQ ID NO: 145042 - protein, 62 aa, Triticum aestivum
  Clone ID: PAT_TA_39460.pep
SLIHQMWMPPVTRFAWIDLEPHARHWWQIHHRSPYAHAKDTTRHGSIVEDDGPCLVNDYFLQ

SEQ ID NO: 145043 - protein, 96 aa, Triticum aestivum
  Clone ID: PAT_TA_39461.pep
HLEQVLAKSVLRGFLGKKQFKLLVCRVLCLGLKTSNMVLVWVRLVLNGFSSHNRMSTSSYSASWFPRSCSASCSRARTLASCPGAHTRPPVPRART

SEQ ID NO: 145044 - protein, 38 aa, Triticum aestivum
  unsure (1)..(38): unsure at all Xaa locations
  Clone ID: PAT_TA_39462.pep
RLAVTPNFSVDFGTXPDGRSVGHDMRHPAGDCTSDRWI

SEQ ID NO: 145045 - protein, 141 aa, Triticum aestivum
  Clone ID: PAT_TA_39463.pep
SPPGETVGAPQSERYSTPNSKSGSIGACLLSTRRRGWVHVPSVPPFLARSGQRPSVLYLHQTSAVSYLHRTPAVRMGAAVRLVHGPLDANALVRRLDRLLGPGIHLGEVEEHGRRILELVISDEVANLELEIALQMYYERV

SEQ ID NO: 145046 - protein, 52 aa, Triticum aestivum
  Clone ID: PAT_TA_39464.pep
VHNAEEERKAIMWEETNGLVSEYAKIHLGQHSSWEPAVPPLGSMVKGSLSPL

SEQ ID NO: 145047 - protein, 81 aa, Triticum aestivum
  Clone ID: PAT_TA_39465.pep
RIRFLPLLPDPLVMSGSISQGRWAASSVTEEVITKLWKARYLTAEVPHRLRNKGHVIPTPKSIERVYFICHFLRRLEYAIH

SEQ ID NO: 145048 - protein, 55 aa, Triticum aestivum
  Clone ID: PAT_TA_39466.pep
VNALEDKHKDDNYQDCQTEDWAGIYTVLLVKYLLTSAHHVWTLSFKVYQLIQFQK

SEQ ID NO: 145049 - protein, 34 aa, Triticum aestivum
  Clone ID: PAT_TA_39467.pep
QFSASASNSCNAVANQVLFYGRGLCRIDRSYSPV

SEQ ID NO: 145050 - protein, 122 aa, Triticum aestivum
  Clone ID: PAT_TA_39468.pep
VDSHKRELVKLFCICHSRMEDIIPKDSPVRLVAFNLGYLPGGDKQIITVPETTELALQAASRIVGSGGLISVLVYIGHLGGRDELDIVESFASSLPADTWVSCKFEMINRPIAPVLVLLHKR

SEQ ID NO: 145051 - protein, 69 aa, Triticum aestivum
  Clone ID: PAT_TA_39469.pep
FPGPRGRFIFFFFFFFFARTHFLACEDVAGGSQQSGGNVFFAKYSGPSGGSPLSGGGIIILRVIRRHFL

SEQ ID NO: 145052 - protein, 73 aa, Triticum aestivum
  Clone ID: PAT_TA_39470.pep
SQGTKHCHKIRTTSLDLNHGLEVASECTIKSQMPRLYRPYRNHLMNRNLVFSRISVLGTAREAEPIPWRGDDC

SEQ ID NO: 145053 - protein, 92 aa, Triticum aestivum
  Clone ID: PAT_TA_39471.pep
YDTLCHTSDSCRSSSNEPPHLPIMGFPYPFRNILACNFRPIRLSRHIHHCHIAYQDHVLDIVFVGQPSCTSPSGMSLVDQCLSRFSAGCIHK

SEQ ID NO: 145054 - protein, 53 aa, Triticum aestivum
  Clone ID: PAT_TA_39472.pep
LGRVLGSTLGPQVVPKSQIMFDPDRSPSRITCDSWNRIKPNRFLPLSVRPFRF

SEQ ID NO: 145055 - protein, 43 aa, Triticum aestivum
  Clone ID: PAT_TA_39473.pep
ITHHRFSGSIYRDDVAAADRMSLSNDHPDATMMINTCMRYHRD

SEQ ID NO: 145056 - protein, 89 aa, Triticum aestivum
  Clone ID: PAT_TA_39474.pep
LWCCDDNLFKCNLQFAKASAKENKKSLGLDFNPGPSAPRDDGTHDAEPNIIGPFYNLEGLISHIVVQGAAVEHSADDTDSDEAPAPPKP

SEQ ID NO: 145057 - protein, 95 aa, Triticum aestivum
  Clone ID: PAT_TA_39475.pep
GPQTIWKDRIDAHSRLMRHYFVENLTYPESYFCRRFRMSTELFRRITEKLTSHDPFFQQRRNAARELGHNTFQKVTAALRMLAYGIPADLVDDHL

SEQ ID NO: 145058 - protein, 80 aa, Triticum aestivum
  Clone ID: PAT_TA_39476.pep
LPTVISLLLDIILLAIHHLLVGQFGLAIVDAEGLRWRIIPLPVVESVNPCFSGFIGKSAGQLIYIDCGGSEGYVSNAVWT

SEQ ID NO: 145059 - protein, 76 aa, Triticum aestivum
  Clone ID: PAT_TA_39477.pep
SMKPEMRARRIKIYGMALRRGDSLENGKHLIYTTMHVFVLPMKPHFNGDYVYFSFWTIKVRYVAIENKNKRPTFLF

SEQ ID NO: 145060 - protein, 47 aa, Triticum aestivum
  Clone ID: PAT_TA_39478.pep
GSRSINIGCRCELLLPWRQILLGLFSLRHCVHVLIAFLARKIEHVYF

SEQ ID NO: 145061 - protein, 144 aa, Triticum aestivum
  unsure (1)..(144): unsure at all Xaa locations
  Clone ID: PAT_TA_39479.pep
GSSLGENGHSLGKMGGQINGHLNYGFHGVGAFNPHSLPDFRNGQSNGISCNLGTISPIGVKSNSRTAEGMESRHLYKVGSANLGGHSSGHTEAPGFSRTGSCPLHGHQVAWNNSXNSHHHTSSRMLWTNSGSFINNIPSRPPMQ

SEQ ID NO: 145062 - protein, 73 aa, Triticum aestivum
  Clone ID: PAT_TA_39480.pep
NYKNQGFYDQKRNKIQKFKTQEKNLEKTDKKKNRISEYREWRTRKYLKKMLASDTSNSFPKHKDKICLLPKHT

SEQ ID NO: 145063 - protein, 78 aa, Triticum aestivum
  Clone ID: PAT_TA_39481.pep
RFRRPLLCMLQTGTHPPLRCAGPFSLPKLATKSIKPEISLYSINGTNHPDPNAYCDHFSFFFLFFLFSLFFYFYFTFS

SEQ ID NO: 145064 - protein, 60 aa, Triticum aestivum
  Clone ID: PAT_TA_39482.pep
TAHYIIRDISTVCFIHIARPYVTHVFFRMRSMNYPLLPHRTSGGTPRCILRYRFCKHIET

SEQ ID NO: 145065 - protein, 70 aa, Triticum aestivum
  Clone ID: PAT_TA_39483.pep
PRSTYQRQLMSNKWMSSVPPVTQHLFPASIEQFTSAKSPLAPVVHRLSDPIAAAAPSRSTLMWNARCTSS

SEQ ID NO: 145066 - protein, 108 aa, Triticum aestivum
  Clone ID: PAT_TA_39484.pep
SFLFWFLCFSVFIYRFRYFFIMLHCFLWFFISLCIFWFLLSFICFFRSFCCFFPLDPLLSSISGTSSAHKVALHFRSSRTTGLGWATSCRSVTISTTGSLPVICSLKA

SEQ ID NO: 145067 - protein, 131 aa, Triticum aestivum
  unsure (1)..(131): unsure at all Xaa locations
  Clone ID: PAT_TA_39485.pep
AVPRYPRWSEQPIVWTREDHRPQVGNPGQLALVVRSPXAGGYKFSKVLMDGGSSINILXYDTFHRMNLTDKDLKPSSTVFHGVVPGKSAYPVGKIALEVAFGNEYDYRAETLNFEVVKIKSPYHTLFGRWT

SEQ ID NO: 145068 - protein, 38 aa, Triticum aestivum
  Clone ID: PAT_TA_39486.pep
WVDAHSHRSCKAAGETLIAASSRSARETTHLSGYRGPA

SEQ ID NO: 145069 - protein, 56 aa, Triticum aestivum
  Clone ID: PAT_TA_39487.pep
ILDHGLSRVVYLPLHGYRFISIVCLQNSHVLKTFIKIAYSPPSSRYNILSIGIKAR

SEQ ID NO: 145070 - protein, 91 aa, Triticum aestivum
  Clone ID: PAT_TA_39488.pep
AGSADLDQINDCHVLTCKPRPCSPSRPVRAPPSPVRAPARRPVRQRSPCPVLRSRHRPRQLLLHGVCCVSRVCFSPGIDQKHVCTCVHLRV

SEQ ID NO: 145071 - protein, 80 aa, Triticum aestivum
  Clone ID: PAT_TA_39489.pep
SRVSCQGVHVYSRAVLSPVTRWRSLRLGLLRFHCPPLNHCRDLCCWKRFNGVHWWQLIKTYSGQRHLMSSRIGKNAMSRR

SEQ ID NO: 145072 - protein, 56 aa, Triticum aestivum
  Clone ID: PAT_TA_39490.pep
GSRHITRQTARLINSLMAERKSYEILLFPDDRHMPRQLYDRIYMEERIWDFVDRSL

SEQ ID NO: 145073 - protein, 70 aa, Triticum aestivum
  Clone ID: PAT_TA_39491.pep
TFALLNLWLHHRVELVVIASSPLEFHRLSRRHRTIINIFAIYYHPTIYNAAAIYNHQSESTYIIAIYNHQ

SEQ ID NO: 145074 - protein, 52 aa, Triticum aestivum
  Clone ID: PAT_TA_39492.pep
TADHYALQVLMLLISLHVAKLTLDVSVRDVGLGPEMNIQSTRANACDRSRTF

SEQ ID NO: 145075 - protein, 91 aa, Triticum aestivum
  Clone ID: PAT_TA_39493.pep
GRAPKTTERCVLSGVARGCGWQKIGAWINLGAYYIVGIPSAYLIAFVLQVGGTGLWLGIICGLMVQVLLLMAITICTDWDKEAGNANDRVF

SEQ ID NO: 145076 - protein, 75 aa, Triticum aestivum
  Clone ID: PAT_TA_39494.pep
VDQAIVRMSLVDTDAALPADRHPERRLKASFKAFEEAELPRLKEEKPGLTLKQYKDMIWKLWKKSPDNPLNKATE

SEQ ID NO: 145077 - protein, 66 aa, Triticum aestivum
  Clone ID: PAT_TA_39495.pep
AEHMRLHSRCSYQFTMQLNDLESLIAPTRELPIQSNPIQSAANQLREYFLRFFYNLRRIALQQGST

SEQ ID NO: 145078 - protein, 60 aa, Triticum aestivum
  Clone ID: PAT_TA_39496.pep
ESIHAECAVLSPNIAQNPAFFSCLVPKLQTMNVNNSSLSGHTLAVCSIDWHWLHLFSSLG

SEQ ID NO: 145079 - protein, 51 aa, Triticum aestivum
  unsure (1)..(51): unsure at all Xaa locations
  Clone ID: PAT_TA_39497.pep
SRVDSSTRKPCRQYNPCXCQSACGKQCPCPINGACCEKYCGGQSQQQLQVL

SEQ ID NO: 145080 - protein, 67 aa, Triticum aestivum
  Clone ID: PAT_TA_39498.pep
QKKSQVLITIALHITALRRYANDQTHSYLCLTLCVFAIYYQALRYARHQTSHRFSLPPRATPKISAG

SEQ ID NO: 145081 - protein, 35 aa, Triticum aestivum
  Clone ID: PAT_TA_39499.pep
DKSDPPVLYVVTARHLYFSMERHVHARLRIAAFFF

SEQ ID NO: 145082 - protein, 121 aa, Triticum aestivum
  Clone ID: PAT_TA_39500.pep
QLQEMVRMESEPLISLALILTVASLNLRWLHLFVSKLSAWVLTVEMNVPDGFQFKTNQFHLYCILRSTIKKESAVVMVVMVSSPLPSHLAFLHRNGCAHERVCMMALSSGEWTVYCHSWIA

SEQ ID NO: 145083 - protein, 89 aa, Triticum aestivum
  Clone ID: PAT_TA_39501.pep
AQLVPWWTSEVKLYQYLQALVQWPTRSVRSKGSVPFFLGLFLRFVRWPVAGIILELYGSFVLFSGYGAPIQAFLYQIPIIGWILQYPFQ

SEQ ID NO: 145084 - protein, 88 aa, Triticum aestivum
  Clone ID: PAT_TA_39502.pep
SVEVASARRTLLKGCVFESYCWSLFIFVISHPYSKWAGPGELALCERATTRRKMRRIGVPLERLGCSFFGPWAEQQIRIRPKILTGLY

SEQ ID NO: 145085 - protein, 71 aa, Triticum aestivum
  Clone ID: PAT_TA_39503.pep
RPCVCIYACERNSVFQLRLVKRVVHSSQKESEREGYRESMCVRLPDTPREIVSMCEREMPVHIKCVHLCGR

SEQ ID NO: 145086 - protein, 40 aa, Triticum aestivum
  Clone ID: PAT_TA_39504.pep
NASYKLQVILTIIEIEHTWLNTQGTTNYTWKQPGITTLIV

SEQ ID NO: 145087 - protein, 72 aa, Triticum aestivum
  Clone ID: PAT_TA_39505.pep
ACNLDNYEPSLESRGTCTWDNYETTSQLRVKVDIRQAVAAMPSRSLNRADLEYMTRKEQVDGERRARKKMVA

SEQ ID NO: 145088 - protein, 94 aa, Triticum aestivum
  Clone ID: PAT_TA_39506.pep
IKSRHNLSKYKQNLRFTYIDKISPHPSKPLFPSSKCGQLLSPCKASTISKIHCPLDFRVPLLHHLPPANNTSTTSSSKWHLSIVFLHRSPAPNL

SEQ ID NO: 145089 - protein, 94 aa, Triticum aestivum
  Clone ID: PAT_TA_39507.pep
ISGRNPLVVVECGNTPDVTFLICNSNSCHFRLCDMIFPSWLGFCLSFCILFMSCISYHVIMCISFAFVFISCIRSFSHCPCRNPTLPHAPVAPL

SEQ ID NO: 145090 - protein, 88 aa, Triticum aestivum
  Clone ID: PAT_TA_39508.pep
TPFSIGSPLPVPPFFLTPLPPARAAILDQRRGGGGGRGGGVCGGSGAPLAVGHRLFDIVCAMAPHTPSSSPMPVSSTPPPLLARWLGR

SEQ ID NO: 145091 - protein, 117 aa, Triticum aestivum
  Clone ID: PAT_TA_39509.pep
KKSLLASKDPGYSTYAARVPEGKCYVETWPAEVFLLRFDHIFEMFLTRRLDFTIVRLFVLHMTFVMKSEEVPQICVADPYYMHESFLSLGDFERETAREYLQNIMVQNKDREIVLVP

SEQ ID NO: 145092 - protein, 109 aa, Triticum aestivum
  Clone ID: PAT_TA_39510.pep
KSGGANCDLLVVALPWCSRLPHVHSDSWGDHFSFRWCGIFLIRTDVNVPMLFISHEWTWALTFHIGAANRFCAACRVRAALADDDLDGSSSFLRFTLRVACVVLGLHTG

SEQ ID NO: 145093 - protein, 59 aa, Triticum aestivum
  Clone ID: PAT_TA_39511.pep
IASQMMILQRWPYNLYTELESITASTVSPACEHENATANSTKQLQKGSRNAQSGTDGMN

SEQ ID NO: 145094 - protein, 36 aa, Triticum aestivum
  Clone ID: PAT_TA_39512.pep
DHQNVTSHVDPINKRFRAQSPGTHKLIVRRRGFEHS

SEQ ID NO: 145095 - protein, 127 aa, Triticum aestivum
  unsure (1)..(127): unsure at all Xaa locations
  Clone ID: PAT_TA_39513.pep
RFTVEERAELRLSGIYVRNSXWVNEDSTYKYFEVSMQDNANCHVWSDTWSKCVXGQVHKHSEXNARMSSGKKHNCMHAKGRLLDEYWPLRRTNWRRIQAVFDPGVLLTALCRHCSWEPERYDFATTV

SEQ ID NO: 145096 - protein, 92 aa, Triticum aestivum
  Clone ID: PAT_TA_39514.pep
PFFPVAIALSTHNRVSTLFILIASLPLTHDGAPTFFVPVESPPSILNWAPTIFVFFASPLSTQMGLDFFSKLQVHLRLATVGQPLSSCMSAR

SEQ ID NO: 145097 - protein, 147 aa, Triticum aestivum
  unsure (1)..(147): unsure at all Xaa locations
  Clone ID: PAT_TA_39515.pep
PGRDRSQTRRDRRYPEDERDSHHRRRGEERAAHDGLSRSRLQGRIKLPGETSLDRLGPHPHLEKERGHRDRLSPPKQTDLRAKLHDRLKARSNEEVPGNLKSSVVKASSGEDAGVVNFSGPKSLAELRAKKAAYRSGXNTVKNAGRV

SEQ ID NO: 145098 - protein, 95 aa, Triticum aestivum
  Clone ID: PAT_TA_39516.pep
DSQHRSDTCRPRAQLAPTDLCIAWVHCPVPCRALARDWIGPIIALRRIYIATSLMYHLSCNMHAHRSVTDHAPLPCLSPNTLYSLASDSMSSVVY

SEQ ID NO: 145099 - protein, 93 aa, Triticum aestivum
  unsure (1)..(93): unsure at all Xaa locations
  Clone ID: PAT_TA_39517.pep
ASRAVTWMDLAAARDSDDISHTVSYSDIYRIAKGVVEDPSHNLLESVAQSIANTTLLKFPQISAVRVKVGKPHVAVXGVVDYLGVEILRHRKA

SEQ ID NO: 145100 - protein, 79 aa, Triticum aestivum
  Clone ID: PAT_TA_39518.pep
HQQNGNIIHDILLFHTYICLPWVPERQTIVIEQRKSTSLSLNGWLWHSLHYTFDQHHPIVSQILCSKICSLYWFTLISR

SEQ ID NO: 145101 - protein, 95 aa, Triticum aestivum
  Clone ID: PAT_TA_39519.pep
PIDIVPSASFCFSMFFTSQKINIKRSPNAMKLYGEFLCSRRNTTGPGCAWGVPRGEHNPPERARRPRRTLVVCGHLGCPPGPSLSSINTPIFQNP

SEQ ID NO: 145102 - protein, 72 aa, Triticum aestivum
  Clone ID: PAT_TA_39520.pep
QYGTEPWSTNGLTTFYIQLPSSTAILKAKREPFSRPLKAPKDCPRHVSASPRDSAIPTTMVPIPGSVSPRPE

SEQ ID NO: 145103 - protein, 87 aa, Triticum aestivum
  unsure (1)..(87): unsure at all Xaa locations
  Clone ID: PAT_TA_39521.pep
FVNPRRGQDLRXSIIAIHGLGTELAKWSPTAIVTFRYEPDIRINQEFMVTYTHLANYHRVETSPTTIFDIARVTQHVAIVVPSAYTY

SEQ ID NO: 145104 - protein, 145 aa, Triticum aestivum
  unsure (1)..(145): unsure at all Xaa locations
  Clone ID: PAT_TA_39522.pep
SRVVSDGLSGGLDLFXSKEVEVSLESFNLSHIDVKVGKDNKNWCFTGFYGEPRVANRHHSWQLLRTLFFVQHEACICMGDFNETLQGDEHFGANARPERQMRAFREAAADCALLDVGWRGVPFTWDNKQQGNANVKARLDCAMVN

SEQ ID NO: 145105 - protein, 66 aa, Triticum aestivum
  Clone ID: PAT_TA_39523.pep
LPFMLNLPMIITYSIATYHGSRSRWCRVCAWVHPCNADKSEWLSSGPRYALRASPHQALSALPFSW

SEQ ID NO: 145106 - protein, 71 aa, Triticum aestivum
  Clone ID: PAT_TA_39524.pep
TISFRIVGCFIVIPYGVVVRLMYQFKMFMCSLKLNKVLSQLCIICHTLFILYHHRVTPTPGKGKENRVAPN

SEQ ID NO: 145107 - protein, 75 aa, Triticum aestivum
  Clone ID: PAT_TA_39525.pep
FPSGYTAVLSWQCRFIKSHHQACLEISIVRQTQLSKIAMSNHNMKIAVIPALHHNKTLPRKIETRCMISGKCSSD

SEQ ID NO: 145108 - protein, 110 aa, Triticum aestivum
  unsure (1)..(110): unsure at all Xaa locations
  Clone ID: PAT_TA_39526.pep
MLSPTLLLLLGFLCVFAITRLTCPXPDGLAFSTVVPLKPSYASGEQIVFSCQPVYVSRGRIRQFTCPLKGLWLISTLKCTPILCRFGWDVSPXTVRYTAFAYRNTMRFSC

SEQ ID NO: 145109 - protein, 82 aa, Triticum aestivum
  Clone ID: PAT_TA_39527.pep
YNSSILSVFPAEACEVISGYACSADIYPEVKLDTNPVSRPVASEPVDREYEEYNSPKTVFREEACDDLGGEFCEPDFQKDAN

SEQ ID NO: 145110 - protein, 75 aa, Triticum aestivum
  Clone ID: PAT_TA_39528.pep
FGGSIGSPVRWNMTAPFTGARSSESIFWLLCALACLEAVIFRNLFISFFLGTPSRPFLNPYPRVPRLSTVRPPAS

SEQ ID NO: 145111 - protein, 61 aa, Triticum aestivum
  Clone ID: PAT_TA_39529.pep
QFPILSRLTTPCPRLGIISTTYPFPTDRLYYSLAVRIAHRCPLIPVLSDLGVPLQLRRLVV

SEQ ID NO: 145112 - protein, 78 aa, Triticum aestivum
  Clone ID: PAT_TA_39530.pep
PTPQLAFGLAPFTIYYSSGRYTSPIATPSCRYLFRRVLPRGVSDSEFYSHPCLDVSLRVHFIPPLYFPSSGDNCTITP

SEQ ID NO: 145113 - protein, 92 aa, Triticum aestivum
  Clone ID: PAT_TA_39531.pep
LFTSNITAPISATYHFSFPAVNLLMSCVTSVLWANMAHNGCTHLQPNPTQLDHIRASRQGSSCCPQQAYLTPDEQHYSSPHSESLHYLHLHR

SEQ ID NO: 145114 - protein, 89 aa, Triticum aestivum
  Clone ID: PAT_TA_39532.pep
IKFELSSNLSYVYTCKKVQNNLIKQFIIHRMQGYPYMYHDLLLAPCHSNFMQLSIQINSNSKAQEKALGLLPADRKSQLVVTSRPAQIP

SEQ ID NO: 145115 - protein, 116 aa, Triticum aestivum
  Clone ID: PAT_TA_39533.pep
RGKSGTHSGQFPIPIRSLLQTLPFLSHHVRLIVLLSPSSADFPLDLIRCPFCGVDLETNVARTGSRAGQRFYKCVRYDVSSSVFYQISISSFPVLGSVLTPASRMFLANFLAGSRV

SEQ ID NO: 145116 - protein, 119 aa, Triticum aestivum
  unsure (1)..(119): unsure at all Xaa locations
  Clone ID: PAT_TA_39534.pep
YALSLLLDDKYSQRPLLPQHLTKNALNIHIPIIARSGIQPLQKLILXRFINHNVGTGENIPWVQQQIDIRFTPVDNMIKGCAEKFAMAXDKSTLADVFLAPQIFAAVNRFQIEISNYPM

SEQ ID NO: 145117 - protein, 86 aa, Triticum aestivum
  Clone ID: PAT_TA_39535.pep
NSVILMIICAKRFPLGDSASRCDHNGLVTGVSPTRTHKIPSIDHGVAWHVSAEETISNCFTIYGAKLQSGDAAMGRLSFNTKVGCQ

SEQ ID NO: 145118 - protein, 92 aa, Triticum aestivum
  Clone ID: PAT_TA_39536.pep
FAFVTLVMMVMWVDRCLRDVVNWTCIALMANLYCKHPQLQQKYDGKLNLRMKHVHPNQPQTKQLITSDLGVCHCRQPIIYCITSQCVPPRPI

SEQ ID NO: 145119 - protein, 84 aa, Triticum aestivum
  Clone ID: PAT_TA_39537.pep
QDRGQDWRRASREFLPPMHHSGSSTKTVTSTCRTFGVKSSPQLGRSQYEFRMFYWSSFNIPSSSALTHIVRLILLTPKHSMVTY

SEQ ID NO: 145120 - protein, 133 aa, Triticum aestivum
  Clone ID: PAT_TA_39538.pep
SRAQVIRKNNENLAERRYIKRIMESVFQHMLPDCSLRLYGSSWIKLGFNVSDTYIDIQFPTIMSHPDVLLLVQECLNNNDSFIDVDANFHARVPMVVCREKQNGLLCKMIARNENACLTTNHLTALGKLQSNL

SEQ ID NO: 145121 - protein, 61 aa, Triticum aestivum
  Clone ID: PAT_TA_39539.pep
DFALLPLAATTTCLNPDRKVNSFKFSSEGKKLSRRSGNSNIAPVIYNHRLDTTVTNPYPGL

SEQ ID NO: 145122 - protein, 89 aa, Triticum aestivum
  Clone ID: PAT_TA_39540.pep
RKQTSIHENINLTLLLPGTGVRKELDNPEVQGIIIAISKGGSDKYGVSNPQRAKGKINILPSPICHRYNCTYTERLLSSRNEKYNYIVG

SEQ ID NO: 145123 - protein, 87 aa, Triticum aestivum
  unsure (1)..(87): unsure at all Xaa locations
  Clone ID: PAT_TA_39541.pep
TPAVTGAEIXGTTIRPTKCVHVDRDNLYKEVQILLPRRFFMSSQDVPLFSSLSKIVSFQHYNNSIPQRKLWEKNIESLERLGTKGFL

SEQ ID NO: 145124 - protein, 129 aa, Triticum aestivum
  Clone ID: PAT_TA_39542.pep
VRHSRGHLPRWMQSVVRSEWTAEVFDMELLRNQSSEEQMIQLLQLAIDCVAQVPDARPTMSHVVVRIEEIKMSGGSTEETNQQQSTLISNGMRERSRLPVAVAPFIPFIDLTNAIFFDGGAGCFFTSSF

SEQ ID NO: 145125 - protein, 46 aa, Triticum aestivum
  Clone ID: PAT_TA_39543.pep
YGLAFRANREDTVDVKFLVVTLNAYGRVRLLLPEEPWFTSVVNDYR

SEQ ID NO: 145126 - protein, 82 aa, Triticum aestivum
  unsure (1)..(82): unsure at all Xaa locations
  Clone ID: PAT_TA_39544.pep
FRAVVELDIGRDNYDPQKDNRITGAVNLIHVPRSRITVCMHGDAQHVREAEKTGLXDAMHVEAPMTMTNSEKHVKRLARTYH

SEQ ID NO: 145127 - protein, 69 aa, Triticum aestivum
  Clone ID: PAT_TA_39545.pep
HMNSYISINFLLKFSVFSSDISCMRNIISVIYFMVTYFDTEHQSIVDYTFVNNVHDDVLPGYAKCRWTF

SEQ ID NO: 145128 - protein, 93 aa, Triticum aestivum
  Clone ID: PAT_TA_39546.pep
FFGGCVVTLTYWSTITIPPCINAVKWLCVVYSCATKTLSSSSRLSRMSSSTSSVSLAHMSSSSSPTTRISLVPVWKELWSCRRRSHWPWSIPF

SEQ ID NO: 145129 - protein, 39 aa, Triticum aestivum
  Clone ID: PAT_TA_39547.pep
GQQTRAYISNHSIETQENSRKDPNRTRNKQRLKLTRVKT

SEQ ID NO: 145130 - protein, 57 aa, Triticum aestivum
  Clone ID: PAT_TA_39548.pep
MRTERMSPLLALGILVAGLCARVHCLPENVSPEEQHRVTSVDGHSLPSTNTDFSFSL

SEQ ID NO: 145131 - protein, 50 aa, Triticum aestivum
  Clone ID: PAT_TA_39549.pep
SLGKKKLHTYISMVSYLPTTFPRELLFYATYANLTKSHISSICTIQYKTT

SEQ ID NO: 145132 - protein, 68 aa, Triticum aestivum
  Clone ID: PAT_TA_39550.pep
TVSYSRPCIDTRSTTEFRPRNPQLMTSVIPLRHSDATPGGMTQTISACHMWSSVITFVTYDSISSHIK

SEQ ID NO: 145133 - protein, 61 aa, Triticum aestivum
  Clone ID: PAT_TA_39551.pep
DWMQRAVRSFLNPLCTGARGERLWLLIPPSSPCGDARHGLIGGQGGISCRTQRPAMRRRLA

SEQ ID NO: 145134 - protein, 66 aa, Triticum aestivum
  Clone ID: PAT_TA_39552.pep
KEQSKMWTLRFQLLHVLAAGPHISKSLDNIVQLGLLLCGPDFRLIVFRGRWVNYPLLPHRTRGGTP

SEQ ID NO: 145135 - protein, 76 aa, Triticum aestivum
  Clone ID: PAT_TA_39553.pep
FNNDGGVHLLMQSPGFQHPFQKNRLLLSSSVCTVLSMLSELLITPTSDLNTLLFVYEETTYIFLACNPFCDFRRPA

SEQ ID NO: 145136 - protein, 62 aa, Triticum aestivum
  Clone ID: PAT_TA_39554.pep
PPFPLRPISLSLSAGPCAGLRLPLCSFNVQEEHRATVMAPPPLPLPLVPTTDIFPTFHQHET

SEQ ID NO: 145137 - protein, 134 aa, Triticum aestivum
  Clone ID: PAT_TA_39555.pep
ACVVNIGAQVTQVVCVEDGVALPHTALALPYGGDDISRCLLWVQQRHRTWPNFKTDPMKKPIDMLMLNKIKEGYSQIRSGSYDAVSVVHSYEHEKSVGHQKTRLSALSVPPMGLLYPRLLIPEEFPPPPRPWFH

SEQ ID NO: 145138 - protein, 57 aa, Triticum aestivum
  Clone ID: PAT_TA_39556.pep
RARFGFGPQMGPNIGRTINGLDLVSVRKWAQILGEHLTVQIWFRAVNGLLLSRPLLG

SEQ ID NO: 145139 - protein, 53 aa, Triticum aestivum
  Clone ID: PAT_TA_39557.pep
RVDTFIKNVSHYISFDSGAIVHDYYSHVVPATINFSSHGDCHLGTGHRAQSDT

SEQ ID NO: 145140 - protein, 59 aa, Triticum aestivum
  Clone ID: PAT_TA_39558.pep
ISKNIELHILLRLKRGTHPFSYCLRTHSSVVNYSCLFGGAPMRMMNPSMVVFPSNKMSE

SEQ ID NO: 145141 - protein, 89 aa, Triticum aestivum
  Clone ID: PAT_TA_39559.pep
VDTLGDSGSLELFIEQRGGVGGHRGWHNPPGRAWAPRRTQVGCAPLGHPFGTSLAQLVSSGPEKITKKFHCVWTPFGIDCLRSKRLAEE

SEQ ID NO: 145142 - protein, 82 aa, Triticum aestivum
  Clone ID: PAT_TA_39560.pep
WQETTSINGNIAYIRNIELAQEVDDDEMNTYHTKEPIGEEFINPKWLYTSKHLPTTHTGYPITDRSDGLTVCHVYTLFKSNA

SEQ ID NO: 145143 - protein, 75 aa, Triticum aestivum
  Clone ID: PAT_TA_39561.pep
VVLRVVALTVAPSILNMVNEHEESGDHLARMTVGTHQGHSRMYASSSLLYTTIIFLLHPGFLTSRSHTIVNLYSQ

SEQ ID NO: 145144 - protein, 63 aa, Triticum aestivum
  Clone ID: PAT_TA_39562.pep
LWKEHTHSDSRVSGPDLGGMYQQMHAFSRHHEDATGATDIDYTTPSRSSEHLAADDSNLDLQN

SEQ ID NO: 145145 - protein, 73 aa, Triticum aestivum
  Clone ID: PAT_TA_39563.pep
IESVRSYLQSTKKATKKIRVSSSYPNQSEPLHNLFRIFALLNLRLHRRVKLLVLESGHKLSRRRRTIVIALPS

SEQ ID NO: 145146 - protein, 59 aa, Triticum aestivum
  Clone ID: PAT_TA_39564.pep
FSLHFSSFHICLYSLSLGLSCLLLCSHFLMFLVLLCFHSTFSVYVNNLFLMQTNLWLDG

SEQ ID NO: 145147 - protein, 65 aa, Triticum aestivum
  Clone ID: PAT_TA_39565.pep
STSTTTMSTIYIDRRDTLASIKWYQISRLLGEILQFFIAIYYHREDHRCHIPAPHIHHQAEFFAY

SEQ ID NO: 145148 - protein, 52 aa, Triticum aestivum
  Clone ID: PAT_TA_39566.pep
LCHKDILFVKMSISSHCMLFTYLASKSGYRHSCINQTSKSSLWMTSTSYHRI

SEQ ID NO: 145149 - protein, 83 aa, Triticum aestivum
  Clone ID: PAT_TA_39567.pep
FSNATMIYQMSVACLISRITIIARNCLNTRNMYVTISFYVVHQQRPAAPLDNTSEGQRVYSATTWTRLHGCFSDIRTHFRELC

SEQ ID NO: 145150 - protein, 145 aa, Triticum aestivum
  Clone ID: PAT_TA_39568.pep
NQHHSSRIPFKNHHRRVKVLWRSRSMEEYNTYMRIAERDLVKLARMLEIQSWFDNKDQLAMTATSMAKYLQQSEKVAILPKRVAREYIELLLWAMVQRNSPNPIVRQRWWEYRSKMEHPPEIDGSSIYRVPFVRVLCYSEPVESV

SEQ ID NO: 145151 - protein, 101 aa, Triticum aestivum
  unsure (1)..(101): unsure at all Xaa locations
  Clone ID: PAT_TA_39569.pep
STKVPIMSLDTSAVLAVASNIVTTIIRKAHAYIMVHLNGSMPMSLVGTHEPATXCELDSIRWPNAYFYKMLNASIASILXSKLSIPKSRFYLKFHHSNRSY

SEQ ID NO: 145152 - protein, 103 aa, Triticum aestivum
  unsure (1)..(103): unsure at all Xaa locations
  Clone ID: PAT_TA_39570.pep
STRQDVDRKHLVTCVREMHPSAHICQMAIDITMXLADETLASVSTGSQLPRQSXSKEPHLRRNMGHALNVHSTPSLLCEPEHSDADDSYGIHLHMNLPHALTQ

SEQ ID NO: 145153 - protein, 41 aa, Triticum aestivum
  Clone ID: PAT_TA_39571.pep
SHMPLNEVIAASRGEVGVAFWTIDLHRCPVDPPRDCLQSSP

SEQ ID NO: 145154 - protein, 89 aa, Triticum aestivum
  unsure (1)..(89): unsure at all Xaa locations
  Clone ID: PAT_TA_39572.pep
PGDILLQVELKASVVTHHHTCNSSRXRCLDTGVVLVEYYDATCSWGRDRRKGGRRDNRQQVKQADAILLCFSQIMNELAIEKVRRTKTD

SEQ ID NO: 145155 - protein, 73 aa, Triticum aestivum
  Clone ID: PAT_TA_39573.pep
FFIFFFCGTGNRKWVINSFSIIQDIFPNKNVKLVPICLRRRSSSAVSNPVIVFTTQWPQLLFQYSNWHYSNGH

SEQ ID NO: 145156 - protein, 88 aa, Triticum aestivum
  Clone ID: PAT_TA_39574.pep
DCTRNLVRYAGSASDKFNRPPKNLETNSDFCGGGSELLNFVNRPGDALILPACDGSSTSCPPHAPHIHCPVDQKNKNNNHKTENWSEK

SEQ ID NO: 145157 - protein, 75 aa, Triticum aestivum
  Clone ID: PAT_TA_39575.pep
RSTQIPMVHHIIAPSQMGAYTYSIRQSPGGCSILERDSHHRCLRIGFREFLCTMGHRSRSRYSRATLFGSIVTFS

SEQ ID NO: 145158 - protein, 85 aa, Triticum aestivum
  Clone ID: PAT_TA_39576.pep
SRVHMNHTSTPDIPKFRALRRDNTPNRADRGLYVDGTSLLLDLFWGRMNTFHCKRCAFFLHVCLSVCQKSYRTLSVPVRLPGGFI

SEQ ID NO: 145159 - protein, 139 aa, Triticum aestivum
  Clone ID: PAT_TA_39577.pep
RPPPASTRDCSSTGSCSPSLHRVLLHGLLFNQPSPRASIQPPLHGLLFIQPSTGYCSTSPPRGCPVHSALHGVLFIHPQPARSGSCSSRCNTTMSCSSNLTGNCSSTPQQRSLFIHRQHRSALVIISSEGIARSLGFSN

SEQ ID NO: 145160 - protein, 87 aa, Triticum aestivum
  Clone ID: PAT_TA_39578.pep
QEVLRIPCMISITNIFHPTDKITTHHTPHAMPDTLVSTRNWGQARVYPRQRLSRFPSGRHERHTRMIIITSMSISNSKEVSNKHACK

SEQ ID NO: 145161 - protein, 103 aa, Triticum aestivum
  unsure (1)..(103): unsure at all Xaa locations
  Clone ID: PAT_TA_39579.pep
SEELTVGERSLISGGYKNVNGDSRASRRIMSSIEETEERPGIHDRVRLIKEEHRKIXTELNRICDSIINLLETHLIPSSTAPESTVPYRSMGDDYYSYRAQFM

SEQ ID NO: 145162 - protein, 122 aa, Triticum aestivum
  unsure (1)..(122): unsure at all Xaa locations
  Clone ID: PAT_TA_39580.pep
CVVAAIFHMSXDHIRAXTLSGHSAIDVTMTPDSNLXLREPISACWTPSLHSAMPSISAAIKVWDETPLHHPSSQHLLQDDAPRRESDRTPSSSDPEDPDLGFPPEHPELDGADCQRCLDHRQ

SEQ ID NO: 145163 - protein, 60 aa, Triticum aestivum
  Clone ID: PAT_TA_39581.pep
SGANYYIRLNIWTALMYFLRQLMFASHTNDFVCLGKQVTIAALSPKFALYFDEALVSARS

SEQ ID NO: 145164 - protein, 47 aa, Triticum aestivum
  Clone ID: PAT_TA_39582.pep
HLQRKVSCTTLTAHPRGLGLAALARSLTRPPKFFLSFHGLAVDTLSS

SEQ ID NO: 145165 - protein, 42 aa, Triticum aestivum
  Clone ID: PAT_TA_39583.pep
FQHCSVLTLVKSLMLIATNVYNRELDIETVHLVINYHIPGFP

SEQ ID NO: 145166 - protein, 146 aa, Triticum aestivum
  Clone ID: PAT_TA_39584.pep
QYNMGYYLTDGIYPQWAAFVKTISELRGNKQSHFATMQEAVRKDVERAFGVLQACWGILWSATMMWESETLWQLMTCCAILHNMIVEDEGDGVAQTHDFEAPREQVEIPEDQDVAQLMNFLQMHQNLQDQQVHMQLLNDLAEHMWT

SEQ ID NO: 145167 - protein, 55 aa, Triticum aestivum
  Clone ID: PAT_TA_39585.pep
GRSHLSAVVERRHLCITPWRSPIQHVLSNKFPEATVLIKIIPEEIPSGLAFQIWH

SEQ ID NO: 145168 - protein, 52 aa, Triticum aestivum
  Clone ID: PAT_TA_39586.pep
LSLVPNNLDKMQIGSSEDVNDLNYDYDNERWVADRGGVSRSFDEMVDFALVE

SEQ ID NO: 145169 - protein, 68 aa, Triticum aestivum
  Clone ID: PAT_TA_39587.pep
VINNPVVAQSAPVTPTMRVYPPRVDAPLRCITALGVLQLGNHSHPRLMTPPLDRITDVVESRTKCLES

SEQ ID NO: 145170 - protein, 113 aa, Triticum aestivum
  Clone ID: PAT_TA_39588.pep
LRPPPPSPRGFSSNRVQLVWMVGWGSNETARGASGDRDGSSTTRPDSQALSSEEKPACGRATYTPDTGLVLRGTPNPPFRKIRAKDNQRRFTRVGELVKCYRVDVSFSDTMTP

SEQ ID NO: 145171 - protein, 66 aa, Triticum aestivum
  Clone ID: PAT_TA_39589.pep
SECSYTYHTGAAACCNTRYRSISSTCCRYTYALACRSHLRARRLNAASRWCSLRCHNYHQLCSPPR

SEQ ID NO: 145172 - protein, 119 aa, Triticum aestivum
  unsure (1)..(119): unsure at all Xaa locations
  Clone ID: PAT_TA_39590.pep
RSGCTXRRLARSGRRGWSHQRESCRSPKRIGAVGVGEEGLLEVSLVARRGSGEMXEWCWVEGELEAPFYSRSEAVAENGITPAMITVRQWSNKGLRVGAAADWITSFNPLLNLGRLGRY

SEQ ID NO: 145173 - protein, 145 aa, Triticum aestivum
  unsure (1)..(145): unsure at all Xaa locations
  Clone ID: PAT_TA_39591.pep
LFKRTVFFVSIGSNDFIHYYLRNVSGVQMHYLPWEFNQLLVNAVRQEIKNLYNINVRKVVLMGLPPVGCAPHFLSDYGSQNGECIDYINNVVIEFNYGLRYMSSEFIRQYPDSMISYCDTFEGSVDILENRXRYGFLTTTDACCG

SEQ ID NO: 145174 - protein, 56 aa, Triticum aestivum
  Clone ID: PAT_TA_39592.pep
RLYVHASGIRNLYTNILTNYNFLLVLPTYYHLYIAKLLQGIKHIIFSDPQVLCRIS

SEQ ID NO: 145175 - protein, 131 aa, Triticum aestivum
  Clone ID: PAT_TA_39593.pep
TNFERLLTMPEHDQPDHEGLFPASKRRTSKKLRWQSGYCEYKRKALLMKVGFCDAFVWSLNTNEVHEVAAMANFLSKQIPKSKRRPKGCIYGGRGGNFVALGEGVRNQPYLLFPTLTDSKNNLYLCISKLH

SEQ ID NO: 145176 - protein, 52 aa, Triticum aestivum
  Clone ID: PAT_TA_39594.pep
WSTVLRSSRDTQSHFRTCHTQVGYVHGCLHEYSCASRNACTSVIIESPFVAL

SEQ ID NO: 145177 - protein, 73 aa, Triticum aestivum
  Clone ID: PAT_TA_39595.pep
NNCSSIILSALCFHLYTLSAPCPNRAIRPDLLDASRDSQRCRPYLARRTAALSLGADGDISHGGANVCPCTRD

SEQ ID NO: 145178 - protein, 60 aa, Triticum aestivum
  Clone ID: PAT_TA_39596.pep
MSDNIVAPVNCSLFTELFEIYFSSRSCFQVFVIILSQRNYFMSSSILDANQCTCNCYEHE

SEQ ID NO: 145179 - protein, 82 aa, Triticum aestivum
  Clone ID: PAT_TA_39597.pep
ILGRIEYLSALKSVWCQLVSQDDNKRHVATFTWTGRPLIYSRLRCKLENDPRHGLTNYQFWRTGGMACDALHVIAFVLPLSL

SEQ ID NO: 145180 - protein, 82 aa, Triticum aestivum
  Clone ID: PAT_TA_39598.pep
HRGAPRGLLLSHEELLISHSKWAGPFTLFYRCFESVLFSLLFLFFLSFFLCFSPVFVILFTIIFGFHVSLVFLWLILSLHNQ

SEQ ID NO: 145181 - protein, 51 aa, Triticum aestivum
  Clone ID: PAT_TA_39599.pep
CIPPSLDFHYILWDRCLLLELEIPTFFDKWNVSLVRLLWRNPCYLCYVFLA

SEQ ID NO: 145182 - protein, 96 aa, Triticum aestivum
  Clone ID: PAT_TA_39600.pep
RVDSTIENIDICFLNQNVFLGILLYELLEKFLWAICGLPSETARRRELMYEARGRQTGSLSWKPGCCFLGATYFYNLLKIEKYIFFKKNCSLCVIS

SEQ ID NO: 145183 - protein, 126 aa, Triticum aestivum
  unsure (1)..(126): unsure at all Xaa locations
  Clone ID: PAT_TA_39601.pep
MCHGMHSLNEISGSVVAGFHYPSIAGALADDNMLGICFDVCDVVLXIDSNQMGGGXVIPTVITDIYPSQLTAKPTLLHPVYLPDIQAPDNALGGTXGVLNHKXEHMFDDMHIAVTPLYNIDAYLPV

SEQ ID NO: 145184 - protein, 67 aa, Triticum aestivum
  Clone ID: PAT_TA_39602.pep
YEHTHKCILMIPCYWNLIRWDSNHHRMPFMHTGRNPGKPLSWVDTGLSLVLRRDGCVRYGMMRYGEW

SEQ ID NO: 145185 - protein, 38 aa, Triticum aestivum
  Clone ID: PAT_TA_39603.pep
PRPPPRKPPSHLNTGHLCLYQVLLYFHVARSDFTLFRT

SEQ ID NO: 145186 - protein, 109 aa, Triticum aestivum
  Clone ID: PAT_TA_39604.pep
HGSTCLDILSRIITLRYHGKFSSRGHRQRLVVLEGLVLQEYKNGQKQQTTVAVQVNDANESNELTESKHNDYLVASRIQIIYPHTRLFIIIAMTITPNYTICGVLFKKL

SEQ ID NO: 145187 - protein, 55 aa, Triticum aestivum
  Clone ID: PAT_TA_39605.pep
PIRPSNRHCTDNKSLPPHIILNINFIIEVEHLYKSLIPSAKGLSLYFYVESSLWS

SEQ ID NO: 145188 - protein, 62 aa, Triticum aestivum
  Clone ID: PAT_TA_39606.pep
AVLADMDSIGHEAQLRRFELAKAVTLVAEPFTLQNGGLRLTSKVKRPRANAYVTKELAHMYT

SEQ ID NO: 145189 - protein, 88 aa, Triticum aestivum
  Clone ID: PAT_TA_39607.pep
PLYRLGLRSPRQALPQSRPKRVQHVDILADIGFVVMRLRRVLRQIHLHRYQQSSSTGPDDHVFADFRTLYERKVYTQFSRSGYLNLSP

SEQ ID NO: 145190 - protein, 62 aa, Triticum aestivum
  Clone ID: PAT_TA_39608.pep
KQIRQYAHLPGEMFYILQSNSSISLSTRAMLIPGANLTYRVNNRHKGGECKCMSCPIVTIAC

SEQ ID NO: 145191 - protein, 52 aa, Triticum aestivum
  Clone ID: PAT_TA_39609.pep
SRGHAIDDIDLYKVKPLDLPARSRLRSLDSQWYFFSRLDRKHANRGLSNCST

SEQ ID NO: 145192 - protein, 66 aa, Triticum aestivum
  Clone ID: PAT_TA_39610.pep
HWQSSVPAKSTPSWKELDAAFLPNFQGTYVRPPDTDDLSQIIQQLVESARQFWTRFLTNKNQIVTP

SEQ ID NO: 145193 - protein, 100 aa, Triticum aestivum
  unsure (1)..(100): unsure at all Xaa locations
  Clone ID: PAT_TA_39611.pep
GPLFTGSRNHGHLSRLVHPQASGAPVWVQGSDRFKHSYSKHCKVFTLHGGSSDVHIAQFGELNPDLLFXLQVHYEKHKSMCYRLHVYVLPFFRFYRGAQG

SEQ ID NO: 145194 - protein, 70 aa, Triticum aestivum
  Clone ID: PAT_TA_39612.pep
TGQRTRGVYIGSAPCGEGEGLVQFEVVLLGFRLPGSKYALPGSQSVVSCPKPPPGHPFIYTVEPVNEGPV

SEQ ID NO: 145195 - protein, 62 aa, Triticum aestivum
  Clone ID: PAT_TA_39613.pep
GLWNIGVFIEQIRGAGRTYVGITHLCAPRPPGAPWWFLRALGHPSLPSSGHLVSSGPLSNHT

SEQ ID NO: 145196 - protein, 36 aa, Triticum aestivum
  Clone ID: PAT_TA_39614.pep
VSLARKIFLFWTIYVSLYPMFCLYLMNACVRTNIDV

SEQ ID NO: 145197 - protein, 52 aa, Triticum aestivum
  Clone ID: PAT_TA_39615.pep
IGPGIFLMVQRNHLNLLYIHSSLNAIPPSLLINRGGSLLHHFCSSLFLTVSF

SEQ ID NO: 145198 - protein, 49 aa, Triticum aestivum
  Clone ID: PAT_TA_39616.pep
STSKDGTPLPLSHCIIISRLLCYILQFFLLYIYSGLQTYTLLKYYGQFS

SEQ ID NO: 145199 - protein, 46 aa, Triticum aestivum
  Clone ID: PAT_TA_39617.pep
QQAETSKEPKHAARQRTGHTHAPRGHRPKRTTKPPAQATGRAPRTE

SEQ ID NO: 145200 - protein, 56 aa, Triticum aestivum
  Clone ID: PAT_TA_39618.pep
PIITMSVLCIVAFTNIYNLCHPLVAARFLGRGSVDLENISVVSFTYPSYTYPSGFV

SEQ ID NO: 145201 - protein, 68 aa, Triticum aestivum
  Clone ID: PAT_TA_39619.pep
LSRLLRRGPPCCRAPACPSAARVVCFLLAGVGAAALGWGRFLRWVCRGGPFPRVPVVSSALVLGFLFS

SEQ ID NO: 145202 - protein, 93 aa, Triticum aestivum
  Clone ID: PAT_TA_39620.pep
RAAHRQKKTRQTSKQETTRQPGTRAHRTRSSTATDAPRKHPKEGRRNPTEQRQDRHPHPEEKPKQRTERADTRRPAAARQTAGRRPQKQPKAT

SEQ ID NO: 145203 - protein, 81 aa, Triticum aestivum
  Clone ID: PAT_TA_39621.pep
KRKTTPLCIYSPEHPRLLARVALFTHSYRLQDLKKPRGSNSLSLRSKNSGFLSSPMVTEPDVPPSAHEGEEGQCSVRRDPV

SEQ ID NO: 145204 - protein, 91 aa, Triticum aestivum
  Clone ID: PAT_TA_39622.pep
LALGALAGVSGSYVHNILLFVYFLLFRNFFFNISTDTRGYIHTHTLTSMNAHTHTLTFLDAHKETLPSMSTSERLSRHIIFKFTKSPLALR

SEQ ID NO: 145205 - protein, 67 aa, Triticum aestivum
  Clone ID: PAT_TA_39623.pep
AITLRTVRSSPRSSGSSFHSPGGPSNLTSLPRGAFNLLTFPLPAVRARGFLSLVEYCDVLDGTLECH

SEQ ID NO: 145206 - protein, 71 aa, Triticum aestivum
  Clone ID: PAT_TA_39624.pep
RPELGSPVWGPGSALLILVLLRILSVQIWHKFYLWDLQHCATDLTGKTAMVTGANSGIGNAVSQELAQRGA

SEQ ID NO: 145207 - protein, 59 aa, Triticum aestivum
  Clone ID: PAT_TA_39625.pep
QTSTNLKMIPHNTNQYVLRTSSSLGVKKFHSGRQVRQSNLFRSPTQLDHLNKPHSWLKY

SEQ ID NO: 145208 - protein, 91 aa, Triticum aestivum
  Clone ID: PAT_TA_39626.pep
SQFLSTKHGFSLYPRVVRNVPKGDWGGDGSEMERCPGDMKTPFSTIFPSPDASYPHSVRNYPLQCTPVLGYRAFAGLGFVQYTMRSTRKLG

SEQ ID NO: 145209 - protein, 81 aa, Triticum aestivum
  unsure (1)..(81): unsure at all Xaa locations
  Clone ID: PAT_TA_39627.pep
PVDVDECTLQLSSLXEDPPAGCHHLCHNYIGGYFCSCRPGYELQPDGRSCQAECSSDLFTEPSCYISSLEYPRPXPPDLPC

SEQ ID NO: 145210 - protein, 82 aa, Triticum aestivum
  Clone ID: PAT_TA_39628.pep
IESVLHTDSPRGCHVAKFMVSSPSQKHAELCLIYPGLCFVHLEVAASCLLAGLTVESLTSSSTACKLPRSWSTIIYEASIDS

SEQ ID NO: 145211 - protein, 140 aa, Triticum aestivum
  unsure (1)..(140): unsure at all Xaa locations
  Clone ID: PAT_TA_39629.pep
ALPTDTXYRIEVHIPGRTFGGHTEPINFEFTEFNWIIGRDVAIYRALGHLREEYRAELDHSDLAMVSRRARNGDIIRTIEDDSTLSYIQDLECLLRKREIQTRRNSKTHRKLLFRELELEEKARADFLGHEEEITDFMEI

SEQ ID NO: 145212 - protein, 116 aa, Triticum aestivum
  Clone ID: PAT_TA_39630.pep
AEATRLDRDAILQGLGLSLFFREEEPLFVLWEKGKSPAASCVGADRRASRSSLASTRSLQLLTRNMVETPKDPPYTVLESFRSIPCMYFRNLLLSDKMQLILHCFRMKSLGPADAK

SEQ ID NO: 145213 - protein, 66 aa, Triticum aestivum
  unsure (1)..(66): unsure at all Xaa locations
  Clone ID: PAT_TA_39631.pep
LTFVDVQSKFHHDTCNYDTXHAFVVHDXDYHTWYAAGFLSFYPCSTVPDSSVYMNVTTILDWVRNI

SEQ ID NO: 145214 - protein, 87 aa, Triticum aestivum
  Clone ID: PAT_TA_39632.pep
MCLRGRSACHCSSAADALVMRCLYGVVTQRLPNCPGLQIVPDSGDGGAMTTARLRLASVLVIVARWSTDLDVIRIYGVCCTAMIEND

SEQ ID NO: 145215 - protein, 137 aa, Triticum aestivum
  unsure (1)..(137): unsure at all Xaa locations
  Clone ID: PAT_TA_39633.pep
VWRLLLSGFCSRVHCLAEKVTPXEQHRGTSVDGHSLASSRGDFAFSLYKHLALNDPSKNVIFSPLSISIALAFLSLRAHDHTVTEILEGLKFNLTETAETEIDQGFQQLLQTFNQPSNQLQLSVGIAMFVSDELKLL

SEQ ID NO: 145216 - protein, 91 aa, Triticum aestivum
  unsure (1)..(91): unsure at all Xaa locations
  Clone ID: PAT_TA_39634.pep
HSSQVTDTDFSQDLIARICSTSDKFSHDXLGYHAQMCTVLFVAGTLVIYAVWHALIVVLCPASEPHGLSVRSLIEALHPSSHSAPPLRVTL

SEQ ID NO: 145217 - protein, 58 aa, Triticum aestivum
  unsure (1)..(58): unsure at all Xaa locations
  Clone ID: PAT_TA_39635.pep
DLKEEKKKISAAVKKMYDIQAKNVKILIRPDGTKKAYLKXTPAYDAHDLASPLGIILP

SEQ ID NO: 145218 - protein, 70 aa, Triticum aestivum
  Clone ID: PAT_TA_39636.pep
RGSTLFWKETHISKTTQEWRDALIRARVTSWNVQRGKSGSYYRIWKRKRRAASRCQWPSIVVVELNRPST

SEQ ID NO: 145219 - protein, 107 aa, Triticum aestivum
  Clone ID: PAT_TA_39637.pep
YNSAPFVGVTFHNSDSWAPHVDGRRGWVTRDNRRQVFHKMKLMIRRDDEESRVGMLITAAGRPPTPHRWAAVEKMQGGPGPISGVLELVRTSIGGGSRKDEIFSSVV

SEQ ID NO: 145220 - protein, 36 aa, Triticum aestivum
  Clone ID: PAT_TA_39638.pep
SRVDRTGVLATPSYDSGLLKLLTLDVVALLTFISVM

SEQ ID NO: 145221 - protein, 102 aa, Triticum aestivum
  Clone ID: PAT_TA_39639.pep
PNPRRWEGSIVVNNIISKRSYTHGCVDIGILNGKDYFFASWVKVYTKIVHHKFARQPQICIMPVETRHVTSNNTRECSYCRNAILHVKIYLFKGNRIYLYHA

SEQ ID NO: 145222 - protein, 115 aa, Triticum aestivum
  Clone ID: PAT_TA_39640.pep
TGELGQATTMGRKGSGAQLIWADRMGDLLGPLGRQILQFRSSFLLTRLRTLAQARTEAISILHGAFFLERFRILDWWREGRSLGQTGTRRDDDKRDEMAYVERVQRETRFESLRR

SEQ ID NO: 145223 - protein, 118 aa, Triticum aestivum
  Clone ID: PAT_TA_39641.pep
SSPTSLLPLFPLLHTAAATLRSFVVFPWKIPLLLPPYQFATHLCPLQWRPLRQRGNRPHMADTVIMNYNSEGGGGPMMTVGGGIYSCIISRHLFSTRPLSHHLGHPSASGIASCSSIH

SEQ ID NO: 145224 - protein, 75 aa, Triticum aestivum
  Clone ID: PAT_TA_39642.pep
VIIGCGHLRFQLLHVLAAGPRISKPLDDVVQLGLFLSGPEFGLVVFRGRCVNYPLLSHRTKGRASDGILSCRLRS

SEQ ID NO: 145225 - protein, 127 aa, Triticum aestivum
  unsure (1)..(127): unsure at all Xaa locations
  Clone ID: PAT_TA_39643.pep
PRSPFFLGYHALLGREAFMRFQAIPHYGYMXLKMPGPNGIITLVSDPDIALRTENKTASLALEALSKALAAEELTALRSRVDRDDVILDKXPKSTSFKPAEETVKFQVHPTDPKKTALIGVNLGRTV

SEQ ID NO: 145226 - protein, 97 aa, Triticum aestivum
  Clone ID: PAT_TA_39644.pep
PINIVPSASYCFLHVFYIAGNQYQTESKCNKLHGDFLWTRRHPMGQGNTWGVLRWEHNPPGTLGGPGAPWWVVPTSGAPRTASLLYKYPNFPDTLGE

SEQ ID NO: 145227 - protein, 75 aa, Triticum aestivum
  Clone ID: PAT_TA_39645.pep
CTAVDLPIHKTPQTLMKQVTPLRLSTKCHRHHFSRASDSDFTMHVQRTKTLPTNTKQSAKHAKDQSAPTSATSLD

SEQ ID NO: 145228 - protein, 75 aa, Triticum aestivum
  Clone ID: PAT_TA_39646.pep
GSLICTGSSLHSDDQITRIPRHLPLRRWLNSSLQNTGSAQGKALVHEFGRVKSFSSLFRSGEAGSHVNYLCFSPG

SEQ ID NO: 145229 - protein, 84 aa, Triticum aestivum
  Clone ID: PAT_TA_39647.pep
FVQNFLDFSLFERKVQNFQEIHSFKKWSLSTKIVRHFGKKFEISIFVHVVKFTLLKKNSELQKMLTFLTNRISEKFKISEFAHI

SEQ ID NO: 145230 - protein, 140 aa, Triticum aestivum
  Clone ID: PAT_TA_39648.pep
VDSEKQSWNALWKVKVPPKLKVFLWRLAQQSIPTVDLLHHRNMSTTTRCGLCGAEDSWQHSLLHCTVARCVWALHDQDLVEALNNTKEPDAKRWLFAIQDMLSPEEFILVVTTLWELWFARRQVLHENIFQSPLSTLHFI

SEQ ID NO: 145231 - protein, 54 aa, Triticum aestivum
  Clone ID: PAT_TA_39649.pep
STLHSRMTRITTHGASSFPSSGEFAPSSLCSCSWPLRHCSWLGFTTVWAQLATV

SEQ ID NO: 145232 - protein, 108 aa, Triticum aestivum
  Clone ID: PAT_TA_39650.pep
VVSQTCVHFPQYSYFKMNFTFGFHLPMSSRSIQFLCYMAAIQVSMGVGASLELEHVEENIIGEADAIQAPPNYGHSASDIGYYGEGDCKVLSLHRRRQAPSPAPTRAK

SEQ ID NO: 145233 - protein, 142 aa, Triticum aestivum
  Clone ID: PAT_TA_39651.pep
GPDDFTWKLTESGVFSTRSAYHMQFLGSTRSPLMAAVWKAWAPAKIKFFAWLLAINRLLTADRLMARQWPNCYFCPLCMRSLETNVHLFQECPWAQRLWATGADRFQLPSCHPDNWSITTDTTEWLLGLTTNAAHAKKGEVH

SEQ ID NO: 145234 - protein, 145 aa, Triticum aestivum
  Clone ID: PAT_TA_39652.pep
RGSTTCCTSSHGTGTGASSSAMHVSSRDTEFTGAAPPLEAELLMPFWLLPSENPIMLLALRSTHFRLTLIKFVRSTRYLLASVELPPQEIPSPSSPRCCRLSFSATGFAGSSGPLFFLACSLFSSEESPSKALGLFRGGADFADS

SEQ ID NO: 145235 - protein, 52 aa, Triticum aestivum
  unsure (1)..(52): unsure at all Xaa locations
  Clone ID: PAT_TA_39653.pep
MLSVVRQDRSPCDRGSYIITLQFSHLYPNHXPSFQIISPVNHPKIYTESTIR

SEQ ID NO: 145236 - protein, 76 aa, Triticum aestivum
  Clone ID: PAT_TA_39654.pep
CLYRMKGQSALFSSSNQQTELGPVVNACATPGVQAQRRELTLTALNNRQDDRSSLQLLTLLRHTIHPNVDPRVLYL

SEQ ID NO: 145237 - protein, 112 aa, Triticum aestivum
  Clone ID: PAT_TA_39655.pep
QVVPFNERVGFNDLTGDTLKFKANKRKYTVKCHKGPTKSAMYGSGWRKFVADNKLGKGQLVLFYLDQPSPRAVFLCDSIRNGAEAEGSEGENDYMEVSDEEDEDIQADNVQC

SEQ ID NO: 145238 - protein, 47 aa, Triticum aestivum
  Clone ID: PAT_TA_39656.pep
VWRLSLKIHSSTQGMGCYHPQKHGNTSNKTHTPINWFDGPSLLIFCG

SEQ ID NO: 145239 - protein, 73 aa, Triticum aestivum
  Clone ID: PAT_TA_39657.pep
VVEGVLKIGLKPLVATDWLPSCSYFGLGIWRFILRSALLPLGSDLKSSAKSVSTKMLLSRSLWFCVDPRVSVL

SEQ ID NO: 145240 - protein, 95 aa, Triticum aestivum
  Clone ID: PAT_TA_39658.pep
QEKHFSSHRRRRQFATSLMAYRPWRCGGSRPHASGRDLVLVLVRFSVLVGTVWRRRHPLVGIMFPTFYPVPIVLLPSLEGVSRFLRLILRDSGDP

SEQ ID NO: 145241 - protein, 126 aa, Triticum aestivum
  Clone ID: PAT_TA_39659.pep
TPCVARPSSLSSPIDIYSRGAYRLHSRRIYNVIDNVQAKPKHAQYFNNHIDAAQGRRGKTARRAWLEQRPRFRRRVYHSVHGLCRRHTHTPPPCMRNAKQRPKMTTTQLNRMCPAVLSAGVINRGL

SEQ ID NO: 145242 - protein, 62 aa, Triticum aestivum
  Clone ID: PAT_TA_39660.pep
LIFLCNDYVMLQVIQLQLLETTWQLRNGCPIPQNVNLSESPYWKNIIMYHLKDPKHFAHCLV

SEQ ID NO: 145243 - protein, 30 aa, Triticum aestivum
  Clone ID: PAT_TA_39661.pep
PGATFLAKVQLSYFVRVTFLDGGYELKLNI

SEQ ID NO: 145244 - protein, 32 aa, Triticum aestivum
  Clone ID: PAT_TA_39662.pep
LHYVVRAGNLFRLAALTPRQADVVVPPAWTRE

SEQ ID NO: 145245 - protein, 123 aa, Triticum aestivum
  unsure (1)..(123): unsure at all Xaa locations
  Clone ID: PAT_TA_39663.pep
PDINAAAMMRVAANEKAEADNIVQINRADGEAKAKYLSGLGNARQRQAIVDGRTDSVLRFSVNVPGTTAXDVIDMVLITQYFDTKKDVSASTKSSAGFIPHGPGAVLDISTQIRDRLLHGQSA

SEQ ID NO: 145246 - protein, 40 aa, Triticum aestivum
  Clone ID: PAT_TA_39664.pep
PGRQRRRGLGIVNENMTHRTCNIYCTIELCFLRRRSIFVQ

SEQ ID NO: 145247 - protein, 37 aa, Triticum aestivum
  Clone ID: PAT_TA_39665.pep
DSRVDVIHYQCTAHLQNCHCIILAITKYPRIQIVHVI

SEQ ID NO: 145248 - protein, 124 aa, Triticum aestivum
  unsure (1)..(124): unsure at all Xaa locations
  Clone ID: PAT_TA_39666.pep
KHFFQRTSRAIKRGTWTCREIQSECGTHAMWHKTGNTLPVMVNGRQTGXKKVLALHTNKNFDQQRTNWVIHQYHIGDLEQEKERELVLCKIFYPTNTRARSSLVLVVVLPCRPQVGIVVNDLLV

SEQ ID NO: 145249 - protein, 109 aa, Triticum aestivum
  Clone ID: PAT_TA_39667.pep
NGTRKNKGAWGWNADEETKSALRRKHGSSSPGFAAGERLAVKSAAAAAAGGGEKSWMGSGRKVCVVGGSSNHGHRPASQLCSWRKHQGEVPYISSYLKFIVLAAPCCIS

SEQ ID NO: 145250 - protein, 139 aa, Triticum aestivum
  Clone ID: PAT_TA_39668.pep
SRVVRLNESVFVIEMGLLKLENAYKFPNLRCRGWACRTKLPSNTALRGFGFPQAGLITEACITEVAAKCGLPPEKVRMIHMYKEIDQTPYKQEINTKNLTQCWKECMATSSYTLRKAAVEKFNSENYWKKKGLAMVPLK

SEQ ID NO: 145251 - protein, 91 aa, Triticum aestivum
  Clone ID: PAT_TA_39669.pep
MHLHFHHLLKCGVVAYLVNLRHLFHSIPLDVCFVFQLERCFNDSPRELILSCLIFEEIDPSRVFPFLSLSCWLEFSEQDIETKMVIESTFL

SEQ ID NO: 145252 - protein, 87 aa, Triticum aestivum
  Clone ID: PAT_TA_39670.pep
LAAIHEGITLALSWTELDLVVESDCADALHLISAVGKDRSAHTHKVMEIRSLLAQERRIQLQKIKPSVNLASHTLAHLGRTQQRTAV

SEQ ID NO: 145253 - protein, 94 aa, Triticum aestivum
  Clone ID: PAT_TA_39671.pep
NDELIIQFYSMAHFYPDGRIVWMSEGTRYQSTIEEWASLINAPEESEDDLDIYAKKKMDHNSMSHMYKEIPDEALEIFKFGSVHFLLSGLPTIN

SEQ ID NO: 145254 - protein, 97 aa, Triticum aestivum
  Clone ID: PAT_TA_39672.pep
KWMQDRAFGTRAIGELNLEFVDELPVLALDVVAIIGGIVYLSIFQPSLPSASGWFLSFCIETKELKKVCPITRSETSYPYVMAWPPVLVGNKVNSLG

SEQ ID NO: 145255 - protein, 139 aa, Triticum aestivum
  Clone ID: PAT_TA_39673.pep
QGSTEFYNFNSQRPSTRYWVFGPVKFEVFLPDLNTWFLYDTSVLFEAKVSRPHMFIDGALYVHTGLHDILVLEETSSGIPPSLRTIKLPHEDGAFMGRFGQCCFGQSSGGLHYALPEEDARTILVWSLDVDEPYEWSLK

SEQ ID NO: 145256 - protein, 141 aa, Triticum aestivum
  Clone ID: PAT_TA_39674.pep
AEQRVSSSGFRGQVNVLSNNFVQRFQPVEEGQRLSIFAGLVVVYVDDFLVDVDVQVNGFLHDEALHSEHGLEVHILHRDLRQLQGLQCFKEFFTLEAVEGGRQRGAWARGLEGYGKVVRVLLDSGELVDGAGHHLAHARGE

SEQ ID NO: 145257 - protein, 87 aa, Triticum aestivum
  Clone ID: PAT_TA_39675.pep
PAHMKFFLDNGANEATTWPSPYLILNRDRSMFISITSTPSLDRTGGLDLFCPNYNCIPTCNCEAHLSFVVLVASTPWTHNSSNVGLG

SEQ ID NO: 145258 - protein, 91 aa, Triticum aestivum
  unsure (1)..(91): unsure at all Xaa locations
  Clone ID: PAT_TA_39676.pep
KCWKQKFAREESEDDVKKLLDFFKKMQKINPEFFYDXEVDADNRVRNVFWVNTSCKGSYEDFGDCVTFDTMYKTNKFHMPLGVFVGVNHHL

SEQ ID NO: 145259 - protein, 80 aa, Triticum aestivum
  Clone ID: PAT_TA_39677.pep
MKRCSRLNLKTQSFQNLKTDAFDQLKTSGRSWIKKVLFSLWSAYTTMCRITQGNLLEQNLALALPRVYLSLSVSPHSSIN

SEQ ID NO: 145260 - protein, 84 aa, Triticum aestivum
  Clone ID: PAT_TA_39678.pep
DIVANQPGLLPGTNLGDYLSNLVQFEMLEVEIFRYEYGKPLVKLDHPPLTTMMQRLHEWYMDTCRKSGKDSLMVRIKEEHMFIG

SEQ ID NO: 145261 - protein, 126 aa, Triticum aestivum
  Clone ID: PAT_TA_39679.pep
RRSSWRKETDGDGLLHRGRTPVSMEHHFFAKCFRENKEGRGWSLCGVEEEVEVHKKEGLQFLETDGIYGKEGWLFLFVRCGCTFLRCVSVCVEGAEGAVQKEEEGEDALGGRKRKWREIDEGGIKG

SEQ ID NO: 145262 - protein, 84 aa, Triticum aestivum
  unsure (1)..(84): unsure at all Xaa locations
  Clone ID: PAT_TA_39680.pep
YVHFASCFYTDIYCIMGCYYTLYHSTYAYSLLFYKVYMKRENAGSWNSGLXKEQILETYSAQLQKXRHFTELIFGIYKKYWAKK

SEQ ID NO: 145263 - protein, 113 aa, Triticum aestivum
  unsure (1)..(113): unsure at all Xaa locations
  Clone ID: PAT_TA_39681.pep
VDEGHEDGERGRGNGIEVSTNEENYFTPSCVTLSATEIDQFIKCLMGIKVNSGYCGKISRFLDXKNKSFNWMNSHDCHVMMTXVLLVAIRWIMEKHIHDMPNGLCNIFDINSR

SEQ ID NO: 145264 - protein, 92 aa, Triticum aestivum
  Clone ID: PAT_TA_39682.pep
YFVKGQPIHTLHERLITKFHTQHGKNGWQAATKPMVVLVESVQHHGCEHVAVDPHVIALPMKCAPDDLEPRYLDGDGVSRRSCDPSHSRRFD

SEQ ID NO: 145265 - protein, 96 aa, Triticum aestivum
  Clone ID: PAT_TA_39683.pep
GSTTTPKDSEDTLRCSPKNICSSPLQFPTTIISLWITTTYTCHSYNHSPLILLLQDTPNFSLLFREYLYLVPCSSLPRKYPYGQFLALIEYSIIPR

SEQ ID NO: 145266 - protein, 67 aa, Triticum aestivum
  Clone ID: PAT_TA_39684.pep
VDCQLPHEAAGAARAGWLCASIRAEELVVRGGCVQRLRHIINVVDIVIVLARKVALAVSCIYLVRLC

SEQ ID NO: 145267 - protein, 40 aa, Triticum aestivum
  Clone ID: PAT_TA_39685.pep
HSPADFSLNSPLGGGQPGRVKRKNQKKASGGGGDDGEEED

SEQ ID NO: 145268 - protein, 127 aa, Triticum aestivum
  Clone ID: PAT_TA_39686.pep
ATEYSPFATNLRDMVVNVHLKMELCHAIPKVHKLNDVIHCEDGGMVDIMHPRSVPHGVRTRSILCALEVAKMNGAMYCGLLPSNLGRSHETCIHRGRTRWSYTVGLPLSHCSYTQSTGVCGSLQRLI

SEQ ID NO: 145269 - protein, 119 aa, Triticum aestivum
  unsure (1)..(119): unsure at all Xaa locations
  Clone ID: PAT_TA_39687.pep
HRCFIFXSNNVSNTLSIPHQWRLQPWIPQALPTQEEEEHERKRKTECGGGRSHPVPSRVLLRAFVCTCSSFLEASLQPKTRSPWPSPSKSRLVANIPLSLKFGLTSSRCHVKPPGSHGT

SEQ ID NO: 145270 - protein, 141 aa, Triticum aestivum
  unsure (1)..(141): unsure at all Xaa locations
  Clone ID: PAT_TA_39688.pep
MGEGDEDVGEDDGVVGVDRCHTMITPAVFRRHQERGGESPPPSSSLAYPLDGRRVPPLVHGVHGXVEGQEPLRDWISLSLRFYFPFHRSGQKPFLNYPEIRNSNCAEILTXFFSRYKFPCARSRSPTNVRGGHNPPPCAWA

SEQ ID NO: 145271 - protein, 147 aa, Triticum aestivum
  unsure (1)..(147): unsure at all Xaa locations
  Clone ID: PAT_TA_39689.pep
APHCHVEHDLALSSDNAQSVAQVSAPTISSEPTMPIXDGWLDATPETAISTAIEPDTSXVPRKARDSEVPDSVNPAPLSVKPDWAPVMEFTATDVFQHSPFGNTLNSLKSFSLSGEPWPDYGQHGWDADDEEIYSPPTTHFVASVDP

SEQ ID NO: 145272 - protein, 91 aa, Triticum aestivum
  unsure (1)..(91): unsure at all Xaa locations
  Clone ID: PAT_TA_39690.pep
MAEENAPIAVDAQVAGPITVLGEPIVLMTALQLVMNRSCAHDRLVKGLRETASAIDKHAAHICVPAEDXEQPEXLKLVKALCADHNVHMVT

SEQ ID NO: 145273 - protein, 85 aa, Triticum aestivum
  unsure (1)..(85): unsure at all Xaa locations
  Clone ID: PAT_TA_39691.pep
HMATLIPXTWQLLAFHXLFNFFRFLPLQIFFVHFLIPFSHAFFFCRVKKTNTRAAKHIIRDPIERLHSKLSTSGNSDVLEAPVDP

SEQ ID NO: 145274 - protein, 117 aa, Triticum aestivum
  Clone ID: PAT_TA_39692.pep
LLCIQSEGKPFFGKFGGYVQEKKNESILLRRILTTKASGPNSERNKTKFDTLIPVPRHRPREKQGTSPPARYTSCYLPIFSIDRLPQIVIKSMYSSIVARNEWLILVQQSPPVYDET

SEQ ID NO: 145275 - protein, 55 aa, Triticum aestivum
  unsure (1)..(55): unsure at all Xaa locations
  Clone ID: PAT_TA_39693.pep
SRVDGYRQIESXEEWSESGDRYAGGTTGLLSWAVILAGLLCGGVLLVDKSSALAG

SEQ ID NO: 145276 - protein, 79 aa, Triticum aestivum
  Clone ID: PAT_TA_39694.pep
GPRKVRTCMQPINMQMLVFSYIGSAKPNWDKYAKGKKTMQVTCNAQYATILHTCRGTTWGIAAYWYGHESVCIFAHLMY

SEQ ID NO: 145277 - protein, 91 aa, Triticum aestivum
  Clone ID: PAT_TA_39695.pep
WSLYLNLISFNRNLYLKQAMHSLVLSVPRDQHAQKLELLFSGRTRSAHLSHFHKDNITKFELFLILKFRLTFKQILKINVYQYKIQQILHA

SEQ ID NO: 145278 - protein, 145 aa, Triticum aestivum
  Clone ID: PAT_TA_39696.pep
LAGRHHPPSTSATVHPRFTSASLHLRLLIHALLFIQPPALLHRLLFNQSSPRGPVQPPSTGYCSTSPPRGPIHPALHRVLFIHPQPARSGSCSSSGNGLYYHGVLFIQPPLGTVHPPPNNAHCSSRGSRFDHLQLAPVTKELLDR

SEQ ID NO: 145279 - protein, 76 aa, Triticum aestivum
  Clone ID: PAT_TA_39697.pep
SYLPNVVAYSGRGGDMYRVHDPLACITHVPLASWAPPSATGGSARMNVLLKFTTFFRIIVGFVSNLTMFINSIFTD

SEQ ID NO: 145280 - protein, 63 aa, Triticum aestivum
  Clone ID: PAT_TA_39698.pep
IVDTLKMFIKCNFKKLNTISIRYTHMYAYSTEYHVYTAAQKVRRLLTLASNFKPLQVFHQISI

SEQ ID NO: 145281 - protein, 41 aa, Triticum aestivum
  Clone ID: PAT_TA_39699.pep
QIQKKFTNIKDDRKMKINKNEKEKKRRKPKMIFLKTGVKRL

SEQ ID NO: 145282 - protein, 120 aa, Triticum aestivum
  Clone ID: PAT_TA_39700.pep
SRAKCVATSTISKMMRFWSCSSRTQSQGFLSLPQCIRKSSSFLLDLVLLEKGCPHRAYPHRRRADVQGLGHSRHFRSCPTTAQSSRLTPFLPDLLLMYPNYHWSFGEHSSVQVEHWAPSE

SEQ ID NO: 145283 - protein, 47 aa, Triticum aestivum
  Clone ID: PAT_TA_39701.pep
SCCQTISHGAGKCRSRKLNFGQISDISPWLGNVIVGREYQMKLCKLY

SEQ ID NO: 145284 - protein, 74 aa, Triticum aestivum
  Clone ID: PAT_TA_39702.pep
MEKRMRIANDLCIFHDQNRICLFLRDGRGLTCMVASSMVRTGSVYFCMMVVVRLVWLVGSLCLHGYMVEYCTMD

SEQ ID NO: 145285 - protein, 42 aa, Triticum aestivum
  Clone ID: PAT_TA_39703.pep
FDVSDLGHITLVLEDSNYDVCHVSVRMHDGHVDLTVYGTYLC

SEQ ID NO: 145286 - protein, 71 aa, Triticum aestivum
  Clone ID: PAT_TA_39704.pep
WLLLPTNLLCDLTAPLVAPTRTPPTCMQQSHVHIDEKKRTRRPNACMSEHTRNTHGHAQVLNLHVHAHTYS

SEQ ID NO: 145287 - protein, 138 aa, Triticum aestivum
  Clone ID: PAT_TA_39705.pep
EPAHHLFTIQFSPFFLPHRFIRFTGDDDMPADLPPEWDAMPANEQLLWYHKRLCAKAEEMSALLGVASAGDPHVVTSLVDPAASTMTHTSSMLVPNVSCSTTKALEIPKVAHDATPVCIAMLPITCSTECSTQVDPGV

SEQ ID NO: 145288 - protein, 68 aa, Triticum aestivum
  Clone ID: PAT_TA_39706.pep
NSQVLKGKKLCSNFNFFFIFVKSGQTMVKLLIQKVLVLLNNYSRILMLLNNYVSFFEFWSNLVCHVCR

SEQ ID NO: 145289 - protein, 69 aa, Triticum aestivum
  Clone ID: PAT_TA_39707.pep
PTENDIYLIETSGHLRLYFPPDSSPPPFLVRVQYFVTLFWISRSCDTPSRDSVGLPNFRATRRRKIVPN

SEQ ID NO: 145290 - protein, 91 aa, Triticum aestivum
  Clone ID: PAT_TA_39708.pep
VRMHLILGRYLLSFKPDECFKLTTVHNTQQKRVVLQQQNTWLSLDISTNQVVHICCWHEPHSCMSGLQKPSIAWKLDAFHTEDYLATSCVD

SEQ ID NO: 145291 - protein, 117 aa, Triticum aestivum
  Clone ID: PAT_TA_39709.pep
LGALLAIRHVSRSGRSLQILFLFYFFTRVFDFLNGFFSIFLMVGKKMREKCVLFFSFRESHGFTSARGTVFVSRESRSCLSETEKMGFLFFPFRESHGRASQKRKKCVFLFFSFCER

SEQ ID NO: 145292 - protein, 72 aa, Triticum aestivum
  unsure (1)..(72): unsure at all Xaa locations
  Clone ID: PAT_TA_39710.pep
XESPTEYSHDESLTLPLQESNDQIRRRLINGRSTEGQQRTRPIKFSFRNSIFSIPGTDHPKAKRTAGGSTKE

SEQ ID NO: 145293 - protein, 103 aa, Triticum aestivum
  Clone ID: PAT_TA_39711.pep
CSICIFILMLDFFLNLIGDAYIFNLIDKLKNAFISKPFCKGWLAEITILLHVIPRHTFPSLCILDWGVIYFLPLQRTGLFASLSQISLKKTCPSQIESIDSKT

SEQ ID NO: 145294 - protein, 134 aa, Triticum aestivum
  Clone ID: PAT_TA_39712.pep
GGQHHRRGEWACRCWSQTSADASVVAEGRTTAAAEVKAADEKYGKKGLSGRKWDREGGLGGPGCRSLTCLLSELPQSSPHFVFNLREIVRTARRSDIGPCWITSAAFTVRPGRLEGRRRRFRSNLLPPSHNISG

SEQ ID NO: 145295 - protein, 82 aa, Triticum aestivum
  unsure (1)..(82): unsure at all Xaa locations
  Clone ID: PAT_TA_39713.pep
SAGCSRADETERKVVRRAHTMGFPCAGRGRXLDMVHTCSSVALEYLPGACCDSDDILVKDQVMSELRSRDLRFTGGNHLHIR

SEQ ID NO: 145296 - protein, 89 aa, Triticum aestivum
  Clone ID: PAT_TA_39714.pep
VQLIDRCLGHLQREPLNRPQSWTERSGCPFFHKPNANQGGFRASRPLPHKHWTPKSNPKTSHGPAPSPARIGCHAFILARAAFMPAKSG

SEQ ID NO: 145297 - protein, 25 aa, Triticum aestivum
  Clone ID: PAT_TA_39715.pep
LAIIDRERCPLLCPCLVDPRISDGY

SEQ ID NO: 145298 - protein, 71 aa, Triticum aestivum
  Clone ID: PAT_TA_39716.pep
SVPSKTYQMPPTRHPGFVFPPKLTQFIQQHNALMQLLVHNQRNNSNNHNHHNPPPSLPVDHFTRFLRVNPP

SEQ ID NO: 145299 - protein, 59 aa, Triticum aestivum
  Clone ID: PAT_TA_39717.pep
APTNCHCHARSETTGGNKQGKTFWLAHSATESPVFHQQSWVTGFKEKSHGILWCQLQGK

SEQ ID NO: 145300 - protein, 78 aa, Triticum aestivum
  Clone ID: PAT_TA_39718.pep
IVPFFFNNVFHLSTMFIHSSTLPLHQPFESIMGKSGVKTRSSEQSVHLSMQISCWLKIAPQGRIQRQMTSHIPPRCMI

SEQ ID NO: 145301 - protein, 84 aa, Triticum aestivum
  unsure (1)..(84): unsure at all Xaa locations
  Clone ID: PAT_TA_39719.pep
FXYSSCASAIKSVMGKSGVKTRSSEQSVLPVDADFLLVTNSSPEEDSETDDQSYPPPPEVHALTWQGYIAHIMHIVSCIAMPSA

SEQ ID NO: 145302 - protein, 52 aa, Triticum aestivum
  Clone ID: PAT_TA_39720.pep
LKSDSKERRFSFDLCYGLLQCGIRASVRCAKLAVHTPPLHLHPQCQIPPHPS

SEQ ID NO: 145303 - protein, 113 aa, Triticum aestivum
  Clone ID: PAT_TA_39721.pep
RLSQFPQFNFFNLSIFFLVLSCVYVFCTLCLSSFHHDDYAYVLLCLLVSTYSVESSSSRRNFLTSKFLSEEFMKIAYSPPSSRYNTLSIGIRARYSLALCDFGLTAWSFSYVD

SEQ ID NO: 145304 - protein, 149 aa, Triticum aestivum
  Clone ID: PAT_TA_39722.pep
GPNKRQPFLAYEFHRDASSSWRTSSIHTRAHAAKTETRAVGAAASADRLARWLFLRHLLSPQSIKKQLRNPRTRTRSNERQFFLAYELHRDASSSWRTSSIHTRAHAAKTETRVVGAAASADRLARRLFLRHLLSPQSLPVCRHVAAWT

SEQ ID NO: 145305 - protein, 50 aa, Triticum aestivum
  Clone ID: PAT_TA_39723.pep
RPPVEDWKAEYMFQLLFNPSNMLCYEDMPLELRDMIADLGLTSMMQSQTQ

SEQ ID NO: 145306 - protein, 105 aa, Triticum aestivum
  Clone ID: PAT_TA_39724.pep
ISPHFQAMEPTYTMVVDDTECAYFDEVHQLRDFGAENKETIAELLWAFFHYWAFQHDYRKDVISIRMGKIISKKEKNWTTRIGNDRHLICIEDPFETGHDLGRIV

SEQ ID NO: 145307 - protein, 90 aa, Triticum aestivum
  Clone ID: PAT_TA_39725.pep
YTTRWWLTEERRDPADIAYLSFLPTTWPKVENAPKDFLCRFLARHLFTSHKSLLRVYVVNHFIILNFFIRSTCPPLLLKRCVEVLLQRRS

SEQ ID NO: 145308 - protein, 76 aa, Triticum aestivum
  Clone ID: PAT_TA_39726.pep
IPSDVASHPPSFFGDFPRFVCHQFFFLIFINKSCNLYKYNFRSKAPSAHYSYLSHLTVPLNMYSTVHLHHSIGHSG

SEQ ID NO: 145309 - protein, 140 aa, Triticum aestivum
  Clone ID: PAT_TA_39727.pep
PGRLCVDNRPVNKKTIKNKYPLPNINELFEQLKGAQVFSKLDLRMGYHQIRIREQDIPKTAFRTSFGSYEYTVMSFGLANAPPTFSRMMNFIFNPYTNEFVLVYLDDILVFSKNKKDHAKHLRLVLDKLREHQFYAKFSK

SEQ ID NO: 145310 - protein, 108 aa, Triticum aestivum
  Clone ID: PAT_TA_39728.pep
ATFHGVVCTKTGWPGMHACMQAGVGVGRRDQQASCSFVRTPALPTKIKHFTVDYVLFLFPGKPMHVTNYVRKHRHATKYLGDPESNVFLRSTCTLTLHMHVFGPARWT

SEQ ID NO: 145311 - protein, 60 aa, Triticum aestivum
  Clone ID: PAT_TA_39729.pep
WRFLKTQWFPSISSPVYRNSCTTDDWGCMTHGGDQAHLIAHPHMPIMSTYQCSTSSDNFV

SEQ ID NO: 145312 - protein, 70 aa, Triticum aestivum
  unsure (1)..(70): unsure at all Xaa locations
  Clone ID: PAT_TA_39730.pep
ARESMGQFSVRSAYRAFFAGLIESDGATQIWKSRVPNSWKFFIWLAVXNRCWTADRVQRRLLPHPSTCPF

SEQ ID NO: 145313 - protein, 81 aa, Triticum aestivum
  Clone ID: PAT_TA_39731.pep
PGPLHGCKGNSRLQAWYLGQHRFNIVPQYAYLKLKIPGPKGVIIVNGNIEPLLRTKEHTAALAAEVQAGKGARKPRNTSRC

SEQ ID NO: 145314 - protein, 96 aa, Triticum aestivum
  Clone ID: PAT_TA_39732.pep
YRQQLAVQIVQAFPVSCYAVPCVPAPRSHHCIWNVENMICTLAYVGTSGIDVQLSTSGHSHEPPGICGMVFGPRAGSCCVLLSFMTTHFGRFRGPA

SEQ ID NO: 145315 - protein, 83 aa, Triticum aestivum
  Clone ID: PAT_TA_39733.pep
HCDQISEMPDLAFTIANKTFTLTPEQYVVKLEQSGQTICISGFMAFNVPPPRGPLWILGDVFMGAYHTVFDFGESRIGFAKSA

SEQ ID NO: 145316 - protein, 56 aa, Triticum aestivum
  Clone ID: PAT_TA_39734.pep
LNYRLHRRVELLVLVSCSFRVSSSVHISHAAAASLSLSLSTTHSSISTTCYPSFIV

SEQ ID NO: 145317 - protein, 60 aa, Triticum aestivum
  Clone ID: PAT_TA_39735.pep
NPLQQQHTSKFLFLIYKAHPDVTLSSPKRHTTQSPHDLYRSNLNPQVIPLPLYSPKLYYI

SEQ ID NO: 145318 - protein, 138 aa, Triticum aestivum
  Clone ID: PAT_TA_39736.pep
HCADAKALAAFKHNVRDEWLTRHLGQEKPRTMAALTSLMTRFCAGEDSWLARCSTNDSSTSEVRDGNRKPRRSTDECRTKGSIPKSTAVNAGFKSSQHNHRKLPPKDNREELSNLNKILHKVCQIHSTPGKPANHTHK

SEQ ID NO: 145319 - protein, 71 aa, Triticum aestivum
  Clone ID: PAT_TA_39737.pep
HRLICCTSISRSRVCCITQIILIILQATILEVDGQGHMPSSPCHVGIFTCHQSTGYTFPIMPVHTLSVLVN

SEQ ID NO: 145320 - protein, 57 aa, Triticum aestivum
  Clone ID: PAT_TA_39738.pep
VHTSLQSSSSSTYSFAVKIPTGPDMPSDVSDDKQAEHASMNRGSRAHGSSLILFIPH

SEQ ID NO: 145321 - protein, 69 aa, Triticum aestivum
  Clone ID: PAT_TA_39739.pep
VARLGRVTSEWPSQGGSLVSRQVRLSHTSGRVILRGISPTLAPSLIWIYHVKLILQKKKKKKNKKAAST

SEQ ID NO: 145322 - protein, 94 aa, Triticum aestivum
  Clone ID: PAT_TA_39740.pep
IWHVLLYIRNLDTHALDALQSTSSLEPLRVCASLRYSLLYASSRSQKHSDMCCVKHVSFCPAIPAFCVCQAKGMKYLVQLLHMIKSFFHVSEKS

SEQ ID NO: 145323 - protein, 80 aa, Triticum aestivum
  Clone ID: PAT_TA_39741.pep
MIAIMSHHKCHSHTLPDWTQSSITLKCASSQVPMCVISVPTLKFMSPVFINDMVSMLLSMRQLFVFTCFQHFQIIESLHT

SEQ ID NO: 145324 - protein, 64 aa, Triticum aestivum
  Clone ID: PAT_TA_39742.pep
SARSHRPCGHSNHYATPHQRTPAVQLKHMLDLLPHTSPPHSYLDVANEILNNSVHHRYSLQHPS

SEQ ID NO: 145325 - protein, 129 aa, Triticum aestivum
  unsure (1)..(129): unsure at all Xaa locations
  Clone ID: PAT_TA_39743.pep
VHSVTWDQFQQAFHTAHVSAGVQVQRKKPSRRSASRSRSRSVSSHSRSPSKERSPSRSPAKSQSPXLHLPSSMVKQQAPRGTQARAHHVPGLLMPNQSKTDARLGAVRGGAMGFKFFIFCLRRLLHTLL

SEQ ID NO: 145326 - protein, 85 aa, Triticum aestivum
  unsure (1)..(85): unsure at all Xaa locations
  Clone ID: PAT_TA_39744.pep
MSMKESYGIGKFVLQLTFMVNEMRDIGXKMQVNIVVEKLLWVVPDKCLPIFGTIEXWSDVRKMSTMEVIGWLMTYELALKGRERG

SEQ ID NO: 145327 - protein, 70 aa, Triticum aestivum
  Clone ID: PAT_TA_39745.pep
KALCSHKTLHKLACAMLNTELQSQCYVTAPCVGYVCPMCCATTVLQLRGCAMLPGQLLAYTDKLQQNTLL

SEQ ID NO: 145328 - protein, 141 aa, Triticum aestivum
  Clone ID: PAT_TA_39746.pep
IYQICGSRDEQWEMINTRKDRSIAAFIQELNQHIRRQENQMCAGMIDLKKAMTKIMELEEELKSTRDGYEEEIATLVEKDDGLKKKLKVFMGFPATGGEDEDCTCLENYIIIDDTDSDPEDSDDDYVDEAGADIMESSSEH

SEQ ID NO: 145329 - protein, 140 aa, Triticum aestivum
  Clone ID: PAT_TA_39747.pep
PSVRSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEP

SEQ ID NO: 145330 - protein, 65 aa, Triticum aestivum
  Clone ID: PAT_TA_39748.pep
PRVDLHVRDLDQHNWIHDTFDSTIWYQNSKLRGENSHYINDFIKSALRDNCPITRDQIIRGRAPP

SEQ ID NO: 145331 - protein, 34 aa, Triticum aestivum
  Clone ID: PAT_TA_39749.pep
CVFHRFPVHRIFMIFFCCNFVYGFLMFLLFIVRI

SEQ ID NO: 145332 - protein, 75 aa, Triticum aestivum
  Clone ID: PAT_TA_39750.pep
TRTPSCSTKDNKFYYYPEMVGTVILILGRALGGLDGVTRGCLGAFSVGAGDEVRGRFDDCPTGIVALPRSRGGSF

SEQ ID NO: 145333 - protein, 139 aa, Triticum aestivum
  unsure (1)..(139): unsure at all Xaa locations
  Clone ID: PAT_TA_39751.pep
PWDSVVRTTVTIIGWLFYLDRLDTRKNRHKRKILDSSACPTCTHSVEDRQHLFLXCPAARMIWRATGICPLYTPITSLFSTKLPDPLPITVRPFMLLLILWKIWDARNTKVFQGLDVVASNSLRAILDDLSVWSHTLES

SEQ ID NO: 145334 - protein, 88 aa, Triticum aestivum
  Clone ID: PAT_TA_39752.pep
LDLPTSPRHQIGRILIPNHFVYASVVCIFILGQSIPTGNQHPLRHRSSYAAGWLVSNVRGMGRNFVAESALIWLYYSCVGWRYCRRRI

SEQ ID NO: 145335 - protein, 90 aa, Triticum aestivum
  unsure (1)..(90): unsure at all Xaa locations
  Clone ID: PAT_TA_39753.pep
STLCINVSHQHDESXATRMVELCLSLSYDQPDVLLAHIDPTCDALASAVRAVEACLHYYMHVIFRSRPGCTGYGRQDGVLIVSDSCVDPR

SEQ ID NO: 145336 - protein, 138 aa, Triticum aestivum
  Clone ID: PAT_TA_39754.pep
LFHEESHLTLLSIIDPLPMSFSHIDLFLVTFPLPLLRLLQKCYCYFCHRYRYFHTTLLLSTFLQILSLSGVVELKTQLLILENILWLPLCRINKFGLNTLPSKTVAIPYTCGLSRLFSGAVGGVHSSILMSPLCLVST

SEQ ID NO: 145337 - protein, 78 aa, Triticum aestivum
  Clone ID: PAT_TA_39755.pep
VTYLYYRDNDQVLVQTVEWYHNISLVHCSCCQLVGHTVRFTAHPFSCMRHHSLLTTMRYLYLFSIASRIISSEHTVSG

SEQ ID NO: 145338 - protein, 72 aa, Triticum aestivum
  Clone ID: PAT_TA_39756.pep
IIIFLQWHVRNMIGSYGEKRKPLHYIHSQDGPSYTVACWGCSLHTLSHKTTVATSLTSRWITSTWGRDGCLV

SEQ ID NO: 145339 - protein, 57 aa, Triticum aestivum
  Clone ID: PAT_TA_39757.pep
VSPDIALNTYNSADKYDIPASAVVHEESNVCITHLIDNITLDLTSVHAIEDDVGPPK

SEQ ID NO: 145340 - protein, 38 aa, Triticum aestivum
  Clone ID: PAT_TA_39758.pep
SCRIKRQCCPFLFSLMLRYHRLMIVCLYKIRPVVIILN

SEQ ID NO: 145341 - protein, 44 aa, Triticum aestivum
  Clone ID: PAT_TA_39759.pep
HTMCSSNIQEEHNLIVIRTCICYGESNSSKLNNHSDKLTVGSSQ

SEQ ID NO: 145342 - protein, 65 aa, Triticum aestivum
  Clone ID: PAT_TA_39760.pep
DSIQGTGWDGQVEFALLASCIRDYEGNDIFTVLKIPMDVSHCRALLHPPSWIFIERRVQLGRHGI

SEQ ID NO: 145343 - protein, 69 aa, Triticum aestivum
  Clone ID: PAT_TA_39761.pep
DSDAALLLDKMMIRTFIIFLADISCIFNIIHISITIHSVSPVMNSIIQRVVLSVGSILFRRMLFDTLTY

SEQ ID NO: 145344 - protein, 82 aa, Triticum aestivum
  Clone ID: PAT_TA_39762.pep
LMTFSISLVQFRQYVCLHRVLSYDYALCTLCLCPIHHDDYVCTVICLRIRTYSVTSSCSLRKFLTGKFLSDEFIKIAYSPPV

SEQ ID NO: 145345 - protein, 111 aa, Triticum aestivum
  unsure (1)..(111): unsure at all Xaa locations
  Clone ID: PAT_TA_39763.pep
GRRKRPNEICPSRGLADTMPAVTCVLVDSVISIKAGDLGXGHVLSGQIDPVHVLSADRMEVKNVSHCHTMFLTSREFHNAMNERELSSLTAVLKCVKEQILAEQYLVDPHQ

SEQ ID NO: 145346 - protein, 74 aa, Triticum aestivum
  Clone ID: PAT_TA_39764.pep
LRNVRQRTFGSTINQTRWGQSSSAWAEPWAAWTASLVGAWELFLSGLVMRSDRRFDLSSAWNSRLTTFSQWVIC

SEQ ID NO: 145347 - protein, 48 aa, Triticum aestivum
  Clone ID: PAT_TA_39765.pep
TLCYRPDTVSQLGQHRRHTLDEMYYVDPVPMMCMHLPRTKLESMFRNL

SEQ ID NO: 145348 - protein, 47 aa, Triticum aestivum
  Clone ID: PAT_TA_39766.pep
RSVPRRSSDGLAAVMIRRVVRKGSSHTLGVALAHWLALGSWRSCASL

SEQ ID NO: 145349 - protein, 89 aa, Triticum aestivum
  Clone ID: PAT_TA_39767.pep
LCLPRRRRQPTPSSVALGPWEQISALVGWTTLFLDMFSSFVMVCVLHGKVRRRRLPEDGIYVSPSSPCAVVASTIVCGRVDVCLQRICL

SEQ ID NO: 145350 - protein, 41 aa, Triticum aestivum
  Clone ID: PAT_TA_39768.pep
RGIDRAPELTVYQVLKLREMSPLYEMAKAGIDIKSIQWSQH

SEQ ID NO: 145351 - protein, 31 aa, Triticum aestivum
  Clone ID: PAT_TA_39769.pep
LQPNRMAISRAAPAPAAKDLTSSHESFGCQF

SEQ ID NO: 145352 - protein, 140 aa, Triticum aestivum
  unsure (1)..(140): unsure at all Xaa locations
  Clone ID: PAT_TA_39770.pep
RGDKLRYVFQIHSEALLYRLRMAISLGVRRLMVYGDSDLVVNQVIKEXDVRSTAMTGYCNAVRKLEKKFEGLELHHVPQLKNQAADELAKIGSKREAIPSNVFLEHIHTATVQEDHFTKEPSQPKSAMDLTEIEFPAVVD

SEQ ID NO: 145353 - protein, 37 aa, Triticum aestivum
  Clone ID: PAT_TA_39771.pep
SLCIRLSHILSARFMQSMQKKSYVLHLRITLVTLHRR

SEQ ID NO: 145354 - protein, 119 aa, Triticum aestivum
  Clone ID: PAT_TA_39772.pep
QISPPDAQKFKLVFPAAKKGQKFGDHHATSQRSSCHSSAIKHTQKFSDQKGRNHRHGTHQTASSSAVRLVGVGVGVVGLGVGVASVLGLVVSVGVAVGIGAMVAVSLCIWFKMRSRSTR

SEQ ID NO: 145355 - protein, 67 aa, Triticum aestivum
  Clone ID: PAT_TA_39773.pep
LSICSTWPSKLARSAKPPNTKICPGRKASPWTASLAMIEGDIKPYDDDTEELSMKAPMSVSKPADLG

SEQ ID NO: 145356 - protein, 78 aa, Triticum aestivum
  Clone ID: PAT_TA_39774.pep
AFNLALVTSKHSRSLNQIETLSWKKLQSCPRAKSNPNNINRWMNLILPITSGSMMYRKISRHDIVCFVVAYHIHHVKL

SEQ ID NO: 145357 - protein, 133 aa, Triticum aestivum
  unsure (1)..(133): unsure at all Xaa locations
  Clone ID: PAT_TA_39775.pep
MTSLKCGESGHYMSECPQTNPNQSAKAVVRGKPTGKVFHAKPVTASRGHVNCISAEEAQDDPNVVLGTLLVNXHPASVLFDTGASHSCISENYARMHNVAFCDLPSAMVIQTPGAKWQTYIVRLSIESHVDPR

SEQ ID NO: 145358 - protein, 148 aa, Triticum aestivum
  unsure (1)..(148): unsure at all Xaa locations
  Clone ID: PAT_TA_39776.pep
SWIDSTHYSKSNERTSTSKKVISVEEINTLSDKVDALMKMVASKSAHIDCNFVPFSTLIEQNNDLVDVNFVSQNNFNSNAYRGNFNPRPFPRNSSNIYGNCXGNYYNNNRMHSNLESNVKGFINTQKVFNTMVEEKLSKLDGMPRSMD

SEQ ID NO: 145359 - protein, 85 aa, Triticum aestivum
  Clone ID: PAT_TA_39777.pep
CASSPGLSKPLVQLRFSTVDQDGHVSAERLQLAAQHDRWSAARQARRVNVDWLRFTERRERWSTVEREAWRTAQQVLRLSLGPGV

SEQ ID NO: 145360 - protein, 73 aa, Triticum aestivum
  Clone ID: PAT_TA_39778.pep
LGATRSPKTRIQPCVADRWNLANPTATWLDTCRYSLGHPYIFRGLHRPVKERVICAATHGLSRTNVVKPYCPR

SEQ ID NO: 145361 - protein, 79 aa, Triticum aestivum
  Clone ID: PAT_TA_39779.pep
CLIIAGNVGCDCKEVVEVTKNGGNSLGVAVAIYEECTSFCRTFTSVILSDCPTKVNRAAHNLAQFTEGNQMWQESLDFL

SEQ ID NO: 145362 - protein, 81 aa, Triticum aestivum
  Clone ID: PAT_TA_39780.pep
LLGPLFHMLAQDHVLLCVSPVCRVLYFLRARVLWAFAHVCVLGNASAIFRWQSTVVCCVCLHCFLEDGPQGAPWLYVRTTN

SEQ ID NO: 145363 - protein, 103 aa, Triticum aestivum
  Clone ID: PAT_TA_39781.pep
MHIHSEGRLAVAGLLLIVKLNDHNAFDLFLSESDVRSASVWIYTHMHATGIGDEVDSIFHSGGRCRKVADVDGGGNFGRRRTLANDHHMGFRCRNLDGYVGPR

SEQ ID NO: 145364 - protein, 83 aa, Triticum aestivum
  Clone ID: PAT_TA_39782.pep
PQTCLACMITQDVSTLPTFNPHGGPITHSSTGSKPDSPVHPRFPKLFPTLDFVCNLRVTFLMLNSGIRHNNYSVALKPLSPSD

SEQ ID NO: 145365 - protein, 76 aa, Triticum aestivum
  Clone ID: PAT_TA_39783.pep
SRGQLSLSMTRTCNQLGTEERGGHATNGDRSPQFTMFSSRNRYAQPDVYLATSPTKARVAHLLVRFWLIRKVKKTW

SEQ ID NO: 145366 - protein, 59 aa, Triticum aestivum
  Clone ID: PAT_TA_39784.pep
RTGLLRRPQPPDARCPAPGHRENANPRMHFDLVLEILLFYRVTHEVDHRLCTPRLDAAV

SEQ ID NO: 145367 - protein, 60 aa, Triticum aestivum
  Clone ID: PAT_TA_39785.pep
RVIGSKIRPDSLTAFLYGGCHVSVTLDNHFCDARFIVMEVDISVMIILVMSWNTSTTAHV

SEQ ID NO: 145368 - protein, 42 aa, Triticum aestivum
  Clone ID: PAT_TA_39786.pep
PVVRLQVVAFYLFMYPLHRMECNSSVGSNVVNCWLPCIYAGI

SEQ ID NO: 145369 - protein, 69 aa, Triticum aestivum
  Clone ID: PAT_TA_39787.pep
KSGAAIIGVAQKWQARCLHDHYLHILASVSNWIVTIIAVIVTTSLFPHLSILIILLHFLVVTISFFESL

SEQ ID NO: 145370 - protein, 75 aa, Triticum aestivum
  Clone ID: PAT_TA_39788.pep
RGARARLTPWEHPTYHKASMRRCPSSHGGTGRAHLPICYQGWWRCWSGKHLGPQDECVLASSLLPTGKRIPQSAF

SEQ ID NO: 145371 - protein, 58 aa, Triticum aestivum
  Clone ID: PAT_TA_39789.pep
RFKQCVHPSINASSKDQEVPNIHSLSPLVINKHYHPIWEETRSVSASVSQSDVYVSHP

SEQ ID NO: 145372 - protein, 48 aa, Triticum aestivum
  Clone ID: PAT_TA_39790.pep
LSNISLLQKPEATKETAKALDSTVVAAGEDTNEREEGLQPSEESLPQQ

SEQ ID NO: 145373 - protein, 130 aa, Triticum aestivum
  Clone ID: PAT_TA_39791.pep
KLSRNITLGGIYGPGRSALDTIAKRKSSSRRQKLRESKQYTARIHVADIYQAILASMSIKSTRKIYNVVDDDPAPRSEVFAFAQSLIEKRTLILQRILQDQTARTRIIAAEKRVSNGPLKLELGVRLSHP

SEQ ID NO: 145374 - protein, 135 aa, Triticum aestivum
  Clone ID: PAT_TA_39792.pep
TSPHIFQYNTAVAAIIEKVLSARNPEIPIRKLRVRFCLRPDECLSISQVVALAMVTQKLDVAEFVVLTETICLKCTEDHLLCYAKRFNSWLGDCPAMFAGLTRLWLRNMMFGELDIPNILSACKRLGSLRLSYCD

SEQ ID NO: 145375 - protein, 81 aa, Triticum aestivum
  Clone ID: PAT_TA_39793.pep
MGGGMDAFWGTRVMELVKKHDSGGLLWKRIKLTPTRKANAKTPLRRVWQNEAVLRACGESDAPNPPGASNTKSSSNAVKNA

SEQ ID NO: 145376 - protein, 50 aa, Triticum aestivum
  unsure (1)..(50): unsure at all Xaa locations
  Clone ID: PAT_TA_39794.pep
DRSLLTCLADRWRSRTRRFHFPWGEMARTLHDVSYLLGXLAGTAIGPLEA

SEQ ID NO: 145377 - protein, 49 aa, Triticum aestivum
  Clone ID: PAT_TA_39795.pep
HGHRILPIFGLSQRDNTLRPTFDCIDMGVVHGTFIYHEIVLMNIRSCID

SEQ ID NO: 145378 - protein, 69 aa, Triticum aestivum
  Clone ID: PAT_TA_39796.pep
QGKKYITTQNIDSTTCKQQIYRIQWTISLLIQFIILVSEFKIPNKVRTLQVSRPRVASLSSHYRSISII

SEQ ID NO: 145379 - protein, 64 aa, Triticum aestivum
  Clone ID: PAT_TA_39797.pep
APVACIPLIAHYLGHLFQIHRGRNNLVFPHHENELAQSRAAYPDGRVKCWMHTCLTSNDDHLLS

SEQ ID NO: 145380 - protein, 83 aa, Triticum aestivum
  Clone ID: PAT_TA_39798.pep
RKGTVQNKLHNTPIIHKCTYKKYCTSLAHTHISPNMSRACTKLFCTEPMFCSFLGRRPGQHHHAILCLPASYKEQSFFSADAF

SEQ ID NO: 145381 - protein, 46 aa, Triticum aestivum
  Clone ID: PAT_TA_39799.pep
HFRLVKLKTQVSQENKFILLHHRKYNFYKSFEWVLNFVTDAVQINS

SEQ ID NO: 145382 - protein, 44 aa, Triticum aestivum
  Clone ID: PAT_TA_39800.pep
VRSLIPTCGGIIVSIILSSLGQCFNNDDHHTFIFLTTQQLQLDT

SEQ ID NO: 145383 - protein, 95 aa, Triticum aestivum
  Clone ID: PAT_TA_39801.pep
LIAIVPSASCCFVHVFRHRTKSLPNGVQTQRNFLENFLGPDDNQWAKEAPGGAPRGAQPTKAHQEAQARPGGLCPPRIPPGPPLNTIHTPIFQKP

SEQ ID NO: 145384 - protein, 144 aa, Triticum aestivum
  unsure (1)..(144): unsure at all Xaa locations
  Clone ID: PAT_TA_39802.pep
RNRAHRDGHDRDYPTDSRVHVSGPECFSRAIRAAVIPPNFRLATGVSKFTGESKPDTWLEDYRVVVXIGGGNDEVAMKHLPLMLEGSARAWLNQLAPGSIYSWEELARVXVRTFEGTCKRLAGLTKLQSCVQKPNETLKDYIQR

SEQ ID NO: 145385 - protein, 99 aa, Triticum aestivum
  Clone ID: PAT_TA_39803.pep
QNFSPPSSFAKMSLFVLPYIYVKKIDGSKFLLKISSNKNMGEGHICVPGKCLRKNAEDFTIHEFVYMLLFCGCCRLQDLSSSSPLSPCHEASLPYYCYT

SEQ ID NO: 145386 - protein, 76 aa, Triticum aestivum
  Clone ID: PAT_TA_39804.pep
IRLGLYFALATVYSQFSCAITRYHKRFRRTYAHIIALGIVCDLLCITDGSNRIDICFPMWITHTHLVEPCAEQLPG

SEQ ID NO: 145387 - protein, 72 aa, Triticum aestivum
  Clone ID: PAT_TA_39805.pep
RRQKGAVVFDSFRFDRERARRRAVEKRRRFRPLSPCWSLIFSLIHGCHGSRVLLWKALVDAAICSASRGTSW

SEQ ID NO: 145388 - protein, 46 aa, Triticum aestivum
  Clone ID: PAT_TA_39806.pep
NYVMLSVLVKQYTRQLFHAIFFHTIYCICLSYNVCTFNYVSCLSAI

SEQ ID NO: 145389 - protein, 54 aa, Triticum aestivum
  Clone ID: PAT_TA_39807.pep
LTQTRRYDKQHDTTMHPQIEQSNNPPKIMLGLRPIRLCCINRHIPYGQMIGMYA

SEQ ID NO: 145390 - protein, 77 aa, Triticum aestivum
  Clone ID: PAT_TA_39808.pep
PKVRSLSLNDSNRGHHPGHAIELKICHPTTTKTPREESTLAIHSAVNVAHIPSFRCHRCRRQSASVLRLPFKLRAGP

SEQ ID NO: 145391 - protein, 57 aa, Triticum aestivum
  Clone ID: PAT_TA_39809.pep
SIHENQELKEIENLKRYVSIEKKFTKREKVCEFGKSSSKFQKNLIEFGKSLSNLKNI

SEQ ID NO: 145392 - protein, 106 aa, Triticum aestivum
  Clone ID: PAT_TA_39810.pep
YLTTLDFIVLEGSGAGDVHRHRPPFDLKQLWWYGRASCKYIWIGNSCTPPAHRLCNFQRFLRLTRSCTCIHTLVPISPCIYILISIFERLNRYIILRSMKPPHASC

SEQ ID NO: 145393 - protein, 42 aa, Triticum aestivum
  Clone ID: PAT_TA_39811.pep
MLLMRFCMHRMEVNPCEQHYRSCMDGLSRSTHTSLCRPSIPT

SEQ ID NO: 145394 - protein, 80 aa, Triticum aestivum
  Clone ID: PAT_TA_39812.pep
EFLPQRCCGLLYLHFLCNTGVVAEGISATHVMLQKVCNENHVAETPRCRRSPRLFQLCHCNCNRGWSVLYDSVWRIAWTR

SEQ ID NO: 145395 - protein, 114 aa, Triticum aestivum
  Clone ID: PAT_TA_39813.pep
PVYTVSTIGLGRRLCGGRVGDLCGSVAPAVGVCGLWKEEEDGCHGIVTLDVLVEGLSEGAIAIRKLKGVNRDKGHGIYTGRPLKVKVKAYDPVLSGIAYVSITRERNRLTWLSV

SEQ ID NO: 145396 - protein, 48 aa, Triticum aestivum
  Clone ID: PAT_TA_39814.pep
GSTRRVEPKFLAAAEGGGRGENFGQATIPHQGNWFLKSLCFKFFCLEF

SEQ ID NO: 145397 - protein, 35 aa, Triticum aestivum
  Clone ID: PAT_TA_39815.pep
MKTVLSFVADRSVAKLDISCCFNLSPACYNYGSMG

SEQ ID NO: 145398 - protein, 63 aa, Triticum aestivum
  Clone ID: PAT_TA_39816.pep
VRPIYRTAHTSYTELDHQRPIRDVDNFEPIISLSPLTNRYVLWPNCGPSFFWPVSSPSSVPAR

SEQ ID NO: 145399 - protein, 55 aa, Triticum aestivum
  Clone ID: PAT_TA_39817.pep
QHCNLILHRTLRRTLITDLQKKAKISESSVLEPSPMSTCTPVSECFESIVPKSDN

SEQ ID NO: 145400 - protein, 86 aa, Triticum aestivum
  Clone ID: PAT_TA_39818.pep
HLAINICSVDSHTMLIIKQLLMDKPQEEKYGVFAFCAKKRHKRKKRKNKQSKKEKTQLCGRQVQIHLTCSWLLLSYVYNKMRLGTD

SEQ ID NO: 145401 - protein, 93 aa, Triticum aestivum
  Clone ID: PAT_TA_39819.pep
RVHTIHESESYDPLGDISLASPSTPFTNNQGEKSSSVSSGHGVEHFLNLRTLFEFMDIFSIHKHLNLQRSFEIHNNFLDSQTIFELKNIFLNS

SEQ ID NO: 145402 - protein, 70 aa, Triticum aestivum
  Clone ID: PAT_TA_39820.pep
FIQTGPLLFYYGIFFFIRSLIPTCGGIIVSSILSSLGQCSNNDDCHTFIFLQLKNYNSILRTRYDSICMQ

SEQ ID NO: 145403 - protein, 138 aa, Triticum aestivum
  Clone ID: PAT_TA_39821.pep
RQYLKSLYLGKSINGVYCALIFNSEERLRIWLLNDDEVRGQTKWVLKNDVSIQPLVGITHQHFGLQNNGLWTLQNTSYEPMAEQKFEWDPDSDITLEAEAKAPIDHLHDDIRTLRFHPYKEILFLWTNCKRVVAYHLN

SEQ ID NO: 145404 - protein, 136 aa, Triticum aestivum
  unsure (1)..(136): unsure at all Xaa locations
  Clone ID: PAT_TA_39822.pep
RGSTRHGKIVLEISPSPAEATPNHVRSIDKSRAEDWIEGARMASPPLSPGFASRLLESHPSPPRVSSTVAARNLVPGKVISSESLLSLTPLSCCPTCCVCAVCCVRLAMISARKLKXLDFYRYHPPPFRSSDLHMW

SEQ ID NO: 145405 - protein, 117 aa, Triticum aestivum
  Clone ID: PAT_TA_39823.pep
TFQCLCGVREAYSTRRIKVGFASIRLTRNFDAVQITPPHSSQLTTSSILSALAASTPHHAEILVLRTGKQWLLIRIIAPPHRSPKPLTPTVANEQSPYQQLCIFSEAAVTDVEYWQH

SEQ ID NO: 145406 - protein, 96 aa, Triticum aestivum
  unsure (1)..(96): unsure at all Xaa locations
  Clone ID: PAT_TA_39824.pep
HIEPDMDVKRAMNEINAASRMMSATMDGTEAQVILKIREPQGKTHSKYVTGVDIAXSVQATVNGLRXQVLTFSANVTGTTAKDIKDIVLVSHVFRH

SEQ ID NO: 145407 - protein, 60 aa, Triticum aestivum
  unsure (1)..(60): unsure at all Xaa locations
  Clone ID: PAT_TA_39825.pep
RSENXGSTVCTRTMSHKEPTPSAVRTLYRKALPSVAKTFFLEIKLSMIIKQPRPYHRYIC

SEQ ID NO: 145408 - protein, 73 aa, Triticum aestivum
  Clone ID: PAT_TA_39826.pep
TLPSSGTRCLSSPVFECFTSLDYICKRRFLFGCLQMPMKSSISSLGLNTTSVTAHAQTRKLIQRCPDLVCIHM

SEQ ID NO: 145409 - protein, 82 aa, Triticum aestivum
  Clone ID: PAT_TA_39827.pep
GYLTRDRGLGKRNNNTVTFMVMTSVPISVVRTMGIAAYVTHIMEYRLCVFVNSWCMLNHGTCVLSNRTCRFIEVDGSMAELI

SEQ ID NO: 145410 - protein, 142 aa, Triticum aestivum
  Clone ID: PAT_TA_39828.pep
NSRVDTYVHVHVANDLWEALESKFEAADYKMYIIEQFHDYKMVENRPVLEQAHEIICIVKELELLKCELRGKFVAGCIIAKFPNSRRNFATTLKHQRREFFVEDVIGHLSVGQNSRAKDSHGKWAERTSVANMGKHGNFNSH

SEQ ID NO: 145411 - protein, 118 aa, Triticum aestivum
  Clone ID: PAT_TA_39829.pep
DIDIPADVKRHYKLLHKLMSGSANKEGNAAEEVLSLESLRMAYPTLSITDGDDIVYLLAKGTGMRAMPTVFSVDLSMRTLRGVAKLPKRHLGFMRYFLASGISKHIRTPGRSDSLGQT

SEQ ID NO: 145412 - protein, 90 aa, Triticum aestivum
  Clone ID: PAT_TA_39830.pep
VLNPIVFLSGLPLHYSMITNSSYKPMGKGGSRGRREKHTHTLSLPATSHLPPPTPEGEHSVYIVTRPRAHSRPASRDGSRGLRLGLGLGL

SEQ ID NO: 145413 - protein, 139 aa, Triticum aestivum
  Clone ID: PAT_TA_39831.pep
SRVDERSEMHPQNPITCEQIALPSVTTIEHVKPIFDEHGDVCKYEMSWHTGTHRGHNPPSIFALAELRGRLYWKAFVFPDTSSGSYIVVLIHNPQCQLSFAKAGGDKWTWLPPDYLYDDCTYKDGILYTVNVKGEFHAF

SEQ ID NO: 145414 - protein, 58 aa, Triticum aestivum
  Clone ID: PAT_TA_39832.pep
FCYESRMLSLFSKFVHQFKKCSCFQIMFWNFKKCSRFQKCIDNFKNVLVLNKLYIISN

SEQ ID NO: 145415 - protein, 49 aa, Triticum aestivum
  Clone ID: PAT_TA_39833.pep
HFHSLAALPLPILLFSFSSYFSLESMFCLTFFVLLSICFSYNFTLNLQL

SEQ ID NO: 145416 - protein, 75 aa, Triticum aestivum
  Clone ID: PAT_TA_39834.pep
SLVMLAMRFGARAHAVRQVLSVPLQSVNHAMQLRDTSHAVQSSCVCNLASVCACTVQRASVHSSASATTFSRGFP

SEQ ID NO: 145417 - protein, 69 aa, Triticum aestivum
  Clone ID: PAT_TA_39835.pep
INKSGEISQKIGYSESKPPCQGRPSCMGCALHSGARCGTGPPRQYWAGRQALHSDTGASCVRPKKTMCI

SEQ ID NO: 145418 - protein, 62 aa, Triticum aestivum
  Clone ID: PAT_TA_39836.pep
EGEIIPVVITNAPLIRRGPISINIFTSTISSQTLVHLLYPIFVSKSRIGTYRLLVVLITPCS

SEQ ID NO: 145419 - protein, 78 aa, Triticum aestivum
  Clone ID: PAT_TA_39837.pep
ALRSGTRRETFNHLASWLRDVRQFAKGNMTIMLVGNKCDLSHRHAVSYEEGRKFANEHGLIFVEAYAKAAQNVEEVTD

SEQ ID NO: 145420 - protein, 75 aa, Triticum aestivum
  Clone ID: PAT_TA_39838.pep
TVLAGTTLFWSGQILCLSFACFAGPTELTVPSMCMLFFSRFVPVLPGNRKISCVNNHPLSMICPCASRFRNNDPA

SEQ ID NO: 145421 - protein, 135 aa, Triticum aestivum
  Clone ID: PAT_TA_39839.pep
PLDQVRKLELHGGYPRRLDVRRIRAYARSVGQPRQARPRPAIGQCPGHHPRSSLGTKSRAGCVAYGRRAGPHAAGRTLIGGRAEHGSHRCGGLYSRTPGLISGCWSWSAHSRASRARLGSRNGVYRCGHLSTLTL

SEQ ID NO: 145422 - protein, 41 aa, Triticum aestivum
  Clone ID: PAT_TA_39840.pep
RQLGWSHVGNHHSLEETRGAAPVATDVTHEMELRLPWYVDP

SEQ ID NO: 145423 - protein, 63 aa, Triticum aestivum
  Clone ID: PAT_TA_39841.pep
PVPILSLNKLCGCFHFSLFFFPPISWTSCSLPYGCGYYYLHDLWPFACNQMGEPLLIKNCVAP

SEQ ID NO: 145424 - protein, 64 aa, Triticum aestivum
  Clone ID: PAT_TA_39842.pep
IMVDHTTKPNLAGHKPGPKACLTIFWPENCRGLVKPNCDDWTQILSNFRQRVEITHLSDNFFSH

SEQ ID NO: 145425 - protein, 72 aa, Triticum aestivum
  Clone ID: PAT_TA_39843.pep
IRFQCTRSSFYKRKKRQVKKIEEAHAHALPLSPLFCHLVLGPGTQLAAWLHATLMVNPRSAPHPRKALACPA

SEQ ID NO: 145426 - protein, 126 aa, Triticum aestivum
  Clone ID: PAT_TA_39844.pep
LTHVLHEKPMDKTFKYNSRQPLDHRDCHQLPKPNMGAPHVLSVCHHHPSVRHYYIMTRVLHGLNNYSDYENIMCDVHDIWPFTTMHIYPFTMFTPAFISQHESPRDQMCLDLCSAFHTLQILTLQT

SEQ ID NO: 145427 - protein, 47 aa, Triticum aestivum
  Clone ID: PAT_TA_39845.pep
NSGSTPLSNCKTESLEVCRSSFMFTCDSISRNIQWPHYARTHYHHST

SEQ ID NO: 145428 - protein, 79 aa, Triticum aestivum
  Clone ID: PAT_TA_39846.pep
RAHLLVLYTDHYGCLICVSRALDSHSILIFLLIMIVLFPFVDMVLLGARDIGAQGGASYWLVTMILLRTTVLAYIGVSR

SEQ ID NO: 145429 - protein, 126 aa, Triticum aestivum
  Clone ID: PAT_TA_39847.pep
TRQHLHIFLLPSIPYLIERHLLSRSNTTRHIRATHLYHMMNSLELLDHERKCKAQFPFPSALHSQFSSVSDASQVQQTTHTTEFLNAPYKNSYAHLDDGLQICRPHLALPGDDLDDFLGVATSASP

SEQ ID NO: 145430 - protein, 61 aa, Triticum aestivum
  Clone ID: PAT_TA_39848.pep
GDLNKQIHVQCPSVYMNCPYFTHHDRYDHETGTERTKQQQLHQCFPTLVYQRDILEMNVDP

SEQ ID NO: 145431 - protein, 136 aa, Triticum aestivum
  Clone ID: PAT_TA_39849.pep
SRGRALAILHRCSPSSPPVLVHCPRCRLACPRPPRRRRDPPRPSASLRRFCLARRRTSPEVAATPTAREGGGNGDAGRFRHGEAVVSPAVPGSTRPFHPSADTDYPARPRWDIGGFDDWLGHSGELTTHAGRRRST

SEQ ID NO: 145432 - protein, 83 aa, Triticum aestivum
  Clone ID: PAT_TA_39850.pep
EYHQDHYAVAEAACSLFLLRGCSTQNRLQNLMERGDSNHVEDEKDPWGKVILCCSSRRRGPDQTVPAMVRSDLDGEGRCSDAM

SEQ ID NO: 145433 - protein, 82 aa, Triticum aestivum
  Clone ID: PAT_TA_39851.pep
VIELDVKLGADLDFWWALTDLQFDPYPLLSLVKEAATTPVLATVRPRSIAQAYLVGRGVLLPFDVLILELNSFALPELAWSA

SEQ ID NO: 145434 - protein, 75 aa, Triticum aestivum
  Clone ID: PAT_TA_39852.pep
PPSGYASHRCLHPVSAAHTTSYSGHGVRPQLQPHPTDPQLSGRLLRALPGPQAQEHQYMSRVTRCTRTEQMEHVR

SEQ ID NO: 145435 - protein, 64 aa, Triticum aestivum
  Clone ID: PAT_TA_39853.pep
KIFRVQVSDLEKLTLTSDFEHHRWCSCIPCQGRLFSCGVCDDKCCSLQNLIRCFRLTIGWPVDP

SEQ ID NO: 145436 - protein, 131 aa, Triticum aestivum
  Clone ID: PAT_TA_39854.pep
GHIPRRIIFYRDVVSKGRLNMVIEHELSAIKKACASLDPIYNPQVTIIMVQKQHHTRLFAGNYGVGSTIFESGNVLPGTVVDKEICHPTDFDFYLCSHAGTKGVSRPVRYHVLWDENNFTGNALLILTNHL

SEQ ID NO: 145437 - protein, 112 aa, Triticum aestivum
  Clone ID: PAT_TA_39855.pep
KGKTVTEMTNKEFWEKRRRNPYAADQEPTLVNRPFWNRFQFAIYFDVIKPRRNLFVDVRSIDTDVLGKDPEYFGEALQMCTQLNILRIMQFNKDFDADLVAQFYATVHLGTD

SEQ ID NO: 145438 - protein, 116 aa, Triticum aestivum
  unsure (1)..(116): unsure at all Xaa locations
  Clone ID: PAT_TA_39856.pep
DSSELDDNLGSIARSGRAEFKDGLTAGAYVSISRQCGVGFKSSXSSGKRLSVPSHATISXVYVWESQAGVSVSESRDMSGELHYRGNKTVHYHNDDXMEYLEDRSSWDLVCSRSEF

SEQ ID NO: 145439 - protein, 72 aa, Triticum aestivum
  Clone ID: PAT_TA_39857.pep
LYRVSSSDVAKVAPTEVLVLPQFSVKFPLDYLQPYEYRHVLLTQLHWEHCHRCDIDGADHLQDGCQQQDLHY

SEQ ID NO: 145440 - protein, 94 aa, Triticum aestivum
  Clone ID: PAT_TA_39858.pep
VTGSSGCCRRCRTPSERCQLSVCDRRPERERGDMTVRCGERSSHAWSTQVQRATYGCPHKSHMAGAKKRVDTRQWHTITENVSNGPLLKCITTK

SEQ ID NO: 145441 - protein, 74 aa, Triticum aestivum
  unsure (1)..(74): unsure at all Xaa locations
  Clone ID: PAT_TA_39859.pep
EFYDIVAGIKLLHLSAYYSGEESVALFPTRARYDDDRHLTXPWVXHDWQMTDSRLNVRLACRSTVVGGAVLNYA

SEQ ID NO: 145442 - protein, 127 aa, Triticum aestivum
  Clone ID: PAT_TA_39860.pep
EDYHRSAHGVSLGYASTDFGWKARSWSRTLSSEDWHDCFEVDTDDIPMTDEVCSALFPGPRDDEKVEEPSLSELICYAPTLSIEDDVLYMMSKLTLDPRNPVAWLAAVDMEKKTLELISVNDEIASR

SEQ ID NO: 145443 - protein, 149 aa, Triticum aestivum
  Clone ID: PAT_TA_39861.pep
LPVRCRYSGTTTTGHLIYKLGGIDKRVIETFQNEPAEMNKRSFRYPWVRDKLNADRDTGITIDIALWKFQTTKYYCTVIDAPGHRYFIKNMITGTSQVDCAVLIIDSTTGGFEAGISKDGHTRDHALLASTLGVKHIICCCNNMDVTTP

SEQ ID NO: 145444 - protein, 149 aa, Triticum aestivum
  unsure (1)..(149): unsure at all Xaa locations
  Clone ID: PAT_TA_39862.pep
ILGRPAYSHFTARPCYVYLKLKMAGARGVITVTGNRQRAEECLQKGSKIADEQMAAFEIEEYKKNADPSDFLRAKKHASESAFQSARATKPVHIHPEDPTAAPTHISTTLASKXEVALIQFLRENWDIFAWKPSDMQGLPMGLVVHRLR

SEQ ID NO: 145445 - protein, 92 aa, Triticum aestivum
  Clone ID: PAT_TA_39863.pep
KQIAREISVVTTRRVFERIAVRRVSQRTAWKLLKDAAKSSKRKAMRGMSIPEYTYCVARTTFRGKIYLQYHFSFCKLLFNYFSLFKQRMHWE

SEQ ID NO: 145446 - protein, 78 aa, Triticum aestivum
  Clone ID: PAT_TA_39864.pep
LPVASMIIRCSSQPGFTSYIPALHGGSWVFTLTTNKLVNRQHNFISHVLFIFCYFYNLGYLPSCVMGIMTHPVVNRPD

SEQ ID NO: 145447 - protein, 147 aa, Triticum aestivum
  Clone ID: PAT_TA_39865.pep
NGNRPNITGEKTSRQWSYPYGSYLNSHYSTSPVLTGRFSNYRMQSDFIARMLGLHEAPPAYELTEDQSCDSSGMTFASGGAGVFKVKTKKVPTLAAQVQTFKRLVKDGVISTHQLHHSVALIAISGNDYMSDSDIETGFYTSFDDLD

SEQ ID NO: 145448 - protein, 146 aa, Triticum aestivum
  unsure (1)..(146): unsure at all Xaa locations
  Clone ID: PAT_TA_39866.pep
TGSNLTWLECDHPVHGCKGCHLRPPHPYYKPAADKLKVXVVARYVLQCGGPLCAAMRRDVPGIPECSRKDPHGCHYEIKYVTGKSEGDLATDIISVIGKDKKNIAFGCGYNQEEPADAPPSSVDGILGLASFIEVTQQIKSLFIER

SEQ ID NO: 145449 - protein, 62 aa, Triticum aestivum
  Clone ID: PAT_TA_39867.pep
CPHRRCTVRSGSLARSTGRDFSSHVESLGAIPQKEASSIPMSRNRLTHPHGHPRTMLWSIAQ

SEQ ID NO: 145450 - protein, 119 aa, Triticum aestivum
  Clone ID: PAT_TA_39868.pep
NFVQNFKKNTAVFANCGHEFKKRFLLFQNSLLFGKKNRKLQKMYVFIIFFNFFKNVHLFNFVHKFNKCQEHFKMYAHFKSVQKLKKFQVFYCQSQIRKCFMISKILEFSICICFFKNYL

SEQ ID NO: 145451 - protein, 121 aa, Triticum aestivum
  Clone ID: PAT_TA_39869.pep
SCSLTITKFLTKLCSYLERNMASNDEAGGSGVKAFWKLSQEMEEQPHLYEDAAFPTDPETTDGTAEDDPTDATTDGAAEDATTDDGGARTDGSQPKRQPKDRRPTVLSGNSYKGYTTTAEA

SEQ ID NO: 145452 - protein, 53 aa, Triticum aestivum
  Clone ID: PAT_TA_39870.pep
APKPDTRKGVKSPEAAAARGDAEGAVPLPPFARCAGVVRLIIPCCVDPRVSDL

SEQ ID NO: 145453 - protein, 47 aa, Triticum aestivum
  Clone ID: PAT_TA_39871.pep
IMIYEKSTSLHMSWELYQCSLHERLFTQIKIRTVVFFGGNKYAEINI

SEQ ID NO: 145454 - protein, 53 aa, Triticum aestivum
  Clone ID: PAT_TA_39872.pep
KNRAKSINSPTERHRPGNRHITLQRRHVEVAHWCHRVIAITSLQARAITIPSP

SEQ ID NO: 145455 - protein, 61 aa, Triticum aestivum
  Clone ID: PAT_TA_39873.pep
DLCFLGSTYNVSIRVLSLFVGLVSDELTCVLASSRSNLNKSLVQISSHACMIVLYVPANCS

SEQ ID NO: 145456 - protein, 116 aa, Triticum aestivum
  Clone ID: PAT_TA_39874.pep
RNPSRACHHRSLFSRPPATPRRATGSKSTAASSSSSPPSHGVKDAPQLRQHRRSHRQPPWILAADLGATGHPRPLPHACWTHCELTERTPLSSASIACRSHLFIRDRNAPPPELNV

SEQ ID NO: 145457 - protein, 99 aa, Triticum aestivum
  Clone ID: PAT_TA_39875.pep
EEDKLKGGFGGSLAVCSARNSPPVRSPPPHVRHVYWDTGDVLVHGKRRQAPSCGRFEPFLGSSTRGTSHLAERAEYIAEEAPGQRPLPLFDVRISLNIS

SEQ ID NO: 145458 - protein, 49 aa, Triticum aestivum
  Clone ID: PAT_TA_39876.pep
LLLVSTKCLNIKFFSLPSIYLSSLTCATTIIAILTRKERKQHSPVPFLP

SEQ ID NO: 145459 - protein, 71 aa, Triticum aestivum
  Clone ID: PAT_TA_39877.pep
AVGEEAEVNGGDDDATTARRRGGDRAEPHRRWRQCNRTWDKKPRGIIKECLKSDHAYAYVHSRGWCRSTLL

SEQ ID NO: 145460 - protein, 118 aa, Triticum aestivum
  Clone ID: PAT_TA_39878.pep
RTTKLSLCQLSKILYILWVKTLSQECIHPPTGCYSVVTNLKKNILYTSTHPPPMDGVRYASRIINDHDYDYIHMWPGTYPTFLEFSAVGSCPAQPTDCTYVRAQLAARTTYTGIRTTQ

SEQ ID NO: 145461 - protein, 67 aa, Triticum aestivum
  Clone ID: PAT_TA_39879.pep
LADGDSNLCLHLHAVLWYFISPGVATPSDGALRWHPHTLTALRTESARRLGCNRRERIVCVCGEDGG

SEQ ID NO: 145462 - protein, 60 aa, Triticum aestivum
  Clone ID: PAT_TA_39880.pep
KKNTTMDECNTTEQKPMWSPAKQKPMWSVANTEQETESHSINFYMMTSCDLDFTTSKWFR

SEQ ID NO: 145463 - protein, 91 aa, Triticum aestivum
  unsure (1)..(91): unsure at all Xaa locations
  Clone ID: PAT_TA_39881.pep
DMCSAEILRQWQQNICSLIFRRLEARRRTALTCKQAXRLEILCFGETAVHGRSLSACSCFSCLISTMITRCSLLSMPHIVSQRKEALHSKS

SEQ ID NO: 145464 - protein, 145 aa, Triticum aestivum
  Clone ID: PAT_TA_39882.pep
RGSTIYPTCHSFYSEDINGMDADEGDDQEPAPIGHWKATPSYDVYMVDTPKRNNDEDQKGATRNRSLEKQSKRQRKRRAKPHLDKDPAIEHGESTEDEHAIEQPSKQGGQTKQSVPGKDNSPDDLTPDKLPEHQNLHQRLVATTR

SEQ ID NO: 145465 - protein, 88 aa, Triticum aestivum
  Clone ID: PAT_TA_39883.pep
ANSCLENNCFPSFDAPSIARSIALRYASIGARKELLVLFLKNDAELQIPVLRCLPVLSHPSIVSRHRRGGIAGLLSFSSSTRSTAIDG

SEQ ID NO: 145466 - protein, 72 aa, Triticum aestivum
  Clone ID: PAT_TA_39884.pep
SDHVGETYETEDGMHRSICSGAQPFFQREPFTIRMSFLSSIARYRPVAQNLGCLWCPQNICASLRLEGTRFR

SEQ ID NO: 145467 - protein, 62 aa, Triticum aestivum
  Clone ID: PAT_TA_39885.pep
RGRSFENGSIQFHHGNHIMMTAALFYVNVLYMIDIDMSCDHIIATHGLETCYTLFYLCSVFS

SEQ ID NO: 145468 - protein, 74 aa, Triticum aestivum
  Clone ID: PAT_TA_39886.pep
RTRHDIYIYGGDELMTAVPVNGPFGRCRALHSSVIYPDKVLSAIISRLPSTDGDCQAHDLSRWRRLPTHSIQLR

SEQ ID NO: 145469 - protein, 54 aa, Triticum aestivum
  Clone ID: PAT_TA_39887.pep
KDRSMIENILKSLETGSSEYVFTLQDDIDNLKYRDLEERCADNDVQKNDENRIH

SEQ ID NO: 145470 - protein, 91 aa, Triticum aestivum
  Clone ID: PAT_TA_39888.pep
PPCSIGLYSLFRHLLFLLRRDFPFPSLTSDVLGSLVLHRDSQLSSPAQKWVMRPVNAAIVVGFSWPRCMASHSSWTLCVNYYESSSSVVST

SEQ ID NO: 145471 - protein, 47 aa, Triticum aestivum
  Clone ID: PAT_TA_39889.pep
VRITSKDGTPLPLPGGITFPGCLVRFYSFFCSFDRICSSCVESSRKP

SEQ ID NO: 145472 - protein, 95 aa, Triticum aestivum
  Clone ID: PAT_TA_39890.pep
RVDEHSIAVKVHTSDTMMRGPVTSEEISRVVTELMLGEAGTGAANNVAELSVLAMESVLEMGSSCKAMDEIIRELCAPNIMQAHVDASKEESLDV

SEQ ID NO: 145473 - protein, 129 aa, Triticum aestivum
  Clone ID: PAT_TA_39891.pep
YWTSSQGHNRLTNRLGWTLAGRWLLSLCSCFTRHSASRTSAASHDNSISPCTFLGRRLAVYVRITRTSCRCTADDMTTLATCKTKKHMQIHMPRLVLTITSLILSCQLAKSSCGSPATPCHGRDAVSAP

SEQ ID NO: 145474 - protein, 71 aa, Triticum aestivum
  unsure (1)..(71): unsure at all Xaa locations
  Clone ID: PAT_TA_39892.pep
TDHQRVSLQIITKPXVGDTPTLFLDIIQTIGCMDNDHIREEYQKGGCCGFGKGNFSELFKSIXDYDKSLEP

SEQ ID NO: 145475 - protein, 96 aa, Triticum aestivum
  Clone ID: PAT_TA_39893.pep
IPVRSGHLSRGTTARHDVVSRGNPEDSWIHSRDTPGRSVVTFCVLLFLGRGGLAWITPARSVMFVGTGCCMLHSPTTYVLHSESRVRNMYRTGGYA

SEQ ID NO: 145476 - protein, 130 aa, Triticum aestivum
  Clone ID: PAT_TA_39894.pep
SRTTRVDGSSNAGSQEREVLPASCPLRRCRFSFWFSRLVLIKLSYRMQLKLEFVAKQETWLSIILYTECLGLDLVMKAGAEEVQDGKFGFHGNADVLPSGSCSSRTDSPGSQAAKLAHKVELCCCTIVNK

SEQ ID NO: 145477 - protein, 57 aa, Triticum aestivum
  Clone ID: PAT_TA_39895.pep
GFSVLKEIALKGFHGFQPGGPWLFWKDIVASEGWIAGSVNGLRQMRASTDVLHLDLV

SEQ ID NO: 145478 - protein, 72 aa, Triticum aestivum
  Clone ID: PAT_TA_39896.pep
LGYYTTTVAQTSINLVSFYVASSSSPSARSYRAMASIGRRERLRAHPIVPSLRVCQNPTCGNDRESLQGSYR

SEQ ID NO: 145479 - protein, 94 aa, Triticum aestivum
  Clone ID: PAT_TA_39897.pep
HSAQCQFVYLPCFLHRRKSIANGVQVARNLMMIFYGPKGSRWAVVAPGGSAEEETTHRGAPGGPGAPCWVVPTSSAPRPPLCSINTQMFPNSAG

SEQ ID NO: 145480 - protein, 95 aa, Triticum aestivum
  Clone ID: PAT_TA_39898.pep
CLIPLCRWRRVTPRMNMLLNSPMTGNNLFLASLTVMCKKPDFFVSALFIRNLAWPIFVPVVTPSSTRNCGPDHFYPSCKPTLDMQVHPYKPIFDS

SEQ ID NO: 145481 - protein, 50 aa, Triticum aestivum
  Clone ID: PAT_TA_39899.pep
SVGSIATYVGFIIYGLSMLRRISKLGLITWLYCHLWFNAAGIKGHLILLN

SEQ ID NO: 145482 - protein, 53 aa, Triticum aestivum
  Clone ID: PAT_TA_39900.pep
NRLICGAVSDLLQLCPGQLQIKVQLNLLLLQVSKASSKIARFLKSKGRSYRYS

SEQ ID NO: 145483 - protein, 69 aa, Triticum aestivum
  Clone ID: PAT_TA_39901.pep
PSVSTACLNKTIVIKPTGRLQQAFQSTPWKPGPTGQHRRGSRPEEFNLTTGAGYINWSSSPSIDEVGLN

SEQ ID NO: 145484 - protein, 63 aa, Triticum aestivum
  Clone ID: PAT_TA_39902.pep
RVGLFLLVLCRLRGIIERVSGEHFFSRYFLFATLYTHFILFFSIFLLVLFTFFVVKSLIFTIS

SEQ ID NO: 145485 - protein, 75 aa, Triticum aestivum
  Clone ID: PAT_TA_39903.pep
CSALRSGTRGGYLNVDPNLLQLALRYSEKKMVCRKCYARLPLRSSKCRKKKCGHSIQMMPNRRFINKLSNLTSNR

SEQ ID NO: 145486 - protein, 95 aa, Triticum aestivum
  Clone ID: PAT_TA_39904.pep
KTNCCRRLHIRSLEETPTEIRRVSLLDMDFSKEIPFECVVQSYGCTKLNVMYTNDTDSVKLYLTSVLWPHQVLEHSPISWAAPTAPLLQWREGRT

SEQ ID NO: 145487 - protein, 132 aa, Triticum aestivum
  Clone ID: PAT_TA_39905.pep
VILGSRVDNTVLKASGRVSAGCRHLAMPLWRPEMYNDDNGGRGCGCKVRGGVVEWKEMSPGRGFNGPRMSESYVTVTRIPAAPPPHVVSTLREKVRPDRLVDRHRPMLDGTTRPNRVVQTVAESRRLEMPLV

SEQ ID NO: 145488 - protein, 83 aa, Triticum aestivum
  Clone ID: PAT_TA_39906.pep
RCSFSGGLRVKRKCLHTQDSKQSTCYNTTTYLFMTLKKSPSKVSCVCFVDSKVFRRIEASILENQMLVYSCILISLCAFLGSN

SEQ ID NO: 145489 - protein, 60 aa, Triticum aestivum
  Clone ID: PAT_TA_39907.pep
SRPAHKITSIALSYLGSIVAPMVKVPLVPSSLAETLVVSGGAASVFLDLSVELYGSSSTV

SEQ ID NO: 145490 - protein, 118 aa, Triticum aestivum
  Clone ID: PAT_TA_39908.pep
DAAISTMSVHIQHSCLAIYKYVVCSCGQCSKRHTHTLNSSHGPTITPQIMASNFHITPQTTFSNPKDSYWRVENPYSSIAKCNSLSACVQRLTMLADREVMSSEHLLRFIFVCAVDPR

SEQ ID NO: 145491 - protein, 80 aa, Triticum aestivum
  Clone ID: PAT_TA_39909.pep
YFLFILRKRVTTSVLFHKLVPRRLLYRVCNMYTYILEKNHLFRYIKIQDSKNANLIHRTILGFRSHVYDAAVEKLHVRRP

SEQ ID NO: 145492 - protein, 55 aa, Triticum aestivum
  Clone ID: PAT_TA_39910.pep
ADSDIPAVLQRSMKLSIWDLHTSISSTVDDRVLIHEDCQWGSTKRCLPIKYVYLC

SEQ ID NO: 145493 - protein, 54 aa, Triticum aestivum
  Clone ID: PAT_TA_39911.pep
LMSYERHITRLSHASKCTCVLGSAPAMWISVHSVLVYPKVMQHYDDRDCGIFTK

SEQ ID NO: 145494 - protein, 56 aa, Triticum aestivum
  Clone ID: PAT_TA_39912.pep
YGWGTPSHILPFTYADYMAVVVLGAPPMPKKGTRVMTQCVEEKYLNEFKDEMKGFF

SEQ ID NO: 145495 - protein, 129 aa, Triticum aestivum
  Clone ID: PAT_TA_39913.pep
SGTSGSTSRRYDDLPTLSIDGTPHPLASGIRFPGCSVRFYSFSYLRFSLLMVPIFQEQAIYRMTVSSSHPNQAEPCIVFSVHAVLNSRLHRHVHLLVLPSILFKFRVLCRSSHAVAAPSVSPLLATTIA

SEQ ID NO: 145496 - protein, 85 aa, Triticum aestivum
  Clone ID: PAT_TA_39914.pep
LLRKKGGILTGASPRFDACDLVKYYLGATWDSPSLSLCVSIIRVISWVLYFSKASFTTNSSRTREIGQYKPMQNVVMLYCNKSLK

SEQ ID NO: 145497 - protein, 45 aa, Triticum aestivum
  Clone ID: PAT_TA_39915.pep
FIGLKGRTCVLSIRTRMNTLMKSSRLSYTLSSLGITAHHVLPSNR

SEQ ID NO: 145498 - protein, 63 aa, Triticum aestivum
  Clone ID: PAT_TA_39916.pep
LAGRHETLKWVIVHRSIHHRAVCHDGHPVWIVCEPLHRTIVCVKNHAQNRCEIRHMGISSEQF

SEQ ID NO: 145499 - protein, 84 aa, Triticum aestivum
  unsure (1)..(84): unsure at all Xaa locations
  Clone ID: PAT_TA_39917.pep
TDDALRCRLECTGHLDVRDPNEQRICLAVRKVGVDTLLNXLSQRLTLVSENYFTAVRLSLGERIWTXSNSPHVHLLRPERSTST

SEQ ID NO: 145500 - protein, 37 aa, Triticum aestivum
  Clone ID: PAT_TA_39918.pep
IGRRYALKSVVLIILRNTEPSRTLYGYKRMIINGVIH

SEQ ID NO: 145501 - protein, 46 aa, Triticum aestivum
  Clone ID: PAT_TA_39919.pep
YHDNRDVNFTYTTQKEKIKEINRKDDIFYSSMFSRMTKPSSEESKA

SEQ ID NO: 145502 - protein, 143 aa, Triticum aestivum
  Clone ID: PAT_TA_39920.pep
RGSTLNLCAHAHGPDDRLIMEAAHKNIYFFGISSSCIYELVLCNRGSDHDCSHLIPFLGQVKALVFYRTMHLLNLYFDIPSSITPGISRISCHCTTSYELLMKHYLSLSLSLHGFCLVYQSRAPISESIPQSDSITPSKFCCL

SEQ ID NO: 145503 - protein, 60 aa, Triticum aestivum
  Clone ID: PAT_TA_39921.pep
VLYGNHEITVGSELRPSQVANQPTVHITGRAGSFYTLVNPDVPRPSDPCEREYLHWYVLN

SEQ ID NO: 145504 - protein, 127 aa, Triticum aestivum
  unsure (1)..(127): unsure at all Xaa locations
  Clone ID: PAT_TA_39922.pep
HHYGVPHSIITDNGSNFTADEVKTWCANLGIKLDYAPVYHPQTNGQVEWDNSLIMSSIKPRLVRSLKDSDKHWVEELDSVLXGLRTMPNRTTGYTLFFMVYDVEAILPCDIIHDSPRVRMYTHTHIE

SEQ ID NO: 145505 - protein, 128 aa, Triticum aestivum
  unsure (1)..(128): unsure at all Xaa locations
  Clone ID: PAT_TA_39923.pep
LTAHLRTEFAIKDLGPLHYFLGVEVVRRLHGFFLHQRKYAHELLEHAGMLNCKPAATPVDMKAKLSATNGSPASDAVFYRSIIGALQYLTLTRLEIXYAVKHVCLHMHAPRDVHWAAVKRVLRYICGT

SEQ ID NO: 145506 - protein, 125 aa, Triticum aestivum
  Clone ID: PAT_TA_39924.pep
RGSTQITKGSRSKKTTEGGTACKEGTHVWTIPRAMAALFDKIEKLKNQVDFQLRVSFIEILKEEVRDLLDPATVTAGKVENGNGHTGKLSVPGKPPVQIREGSNGVITLSGSTMKASVATLSIFG

SEQ ID NO: 145507 - protein, 75 aa, Triticum aestivum
  Clone ID: PAT_TA_39925.pep
SYMMPACVNIVEASLKTPTDRPAHLMVIQLHIFFFFSILFSDLGFSSSLFAHFFIRFAISGKQFFSHTLNSFIIQ

SEQ ID NO: 145508 - protein, 68 aa, Triticum aestivum
  Clone ID: PAT_TA_39926.pep
EHDHSGSQLPTVYHVTATVCYVITHLARSRVDGSADSVMDDSPYSNCNDDFSNLRAGNYADNTSQVTT

SEQ ID NO: 145509 - protein, 108 aa, Triticum aestivum
  Clone ID: PAT_TA_39927.pep
TNSERLLTTPEHDQPDHEGLFPASKRRTSKKLRLQSRYCEYKMKALLIKVWFCDAFVWSLNTNEVREIYEVASCIFCPRLHAPIMVASKPLLLHIRDQLLESSNCCIV

SEQ ID NO: 145510 - protein, 59 aa, Triticum aestivum
  Clone ID: PAT_TA_39928.pep
FFGSLRKIYKKMLSHLVCEHAIRYSGRSTHDLSTLSSISSNKVLHSLIIIITPKKIQIV

SEQ ID NO: 145511 - protein, 71 aa, Triticum aestivum
  Clone ID: PAT_TA_39929.pep
TCITNIFQPTKSPLNIPYHAIPDVTVPTVTGDKLTPTQGRGFSRISFRYACKAHDDDYHHQYTHFQQQGNH

SEQ ID NO: 145512 - protein, 49 aa, Triticum aestivum
  Clone ID: PAT_TA_39930.pep
RSEIHGSTTVLEASNSSVVQCKSQSTRYTLSKYLTCIRMQTQKNAKNEN

SEQ ID NO: 145513 - protein, 135 aa, Triticum aestivum
  Clone ID: PAT_TA_39931.pep
PGNLSTSKVRPVDLEPAMVGSCTFTISSFSKLKATLRSFECAYSKPFSIGGIAWFLKLYPNGYQRDEERVSLSLVRERYNQPATTAQFNFEFEGIANYESSKITHIFNRGNYEVEYKLPPLSTSAKHDPLIIQCC

SEQ ID NO: 145514 - protein, 83 aa, Triticum aestivum
  Clone ID: PAT_TA_39932.pep
EEISVSFPIIRLPINTYQNSHVIESTSQHVHFQIISSPKTQQPMFSATKQVQLNVIHYSLRDSSRYINHSYSPLRLLTGTTFT

SEQ ID NO: 145515 - protein, 104 aa, Triticum aestivum
  Clone ID: PAT_TA_39933.pep
VEAIRELSLENVPRGFVVAMEVQSTLLGKIREAQKDDKEIAEIKEKMSEGKAKGFREDEHNTLWFEDRVYVPNNAEIRKLILQEAHDSPYLIHPRNTKMYLPQP

SEQ ID NO: 145516 - protein, 102 aa, Triticum aestivum
  Clone ID: PAT_TA_39934.pep
GSTRRAFHVKSCLCALMHRSDLFYVHQGQVNYLVQHAFSRTTSILLSFVIGDTNFFLHLGRSRSKDSMEWLSQLARDMEITSQTTTVLPSTPKTVCLIKADS

SEQ ID NO: 145517 - protein, 60 aa, Triticum aestivum
  Clone ID: PAT_TA_39935.pep
RGHLLVLMSSSFRVSSSFHISHAAAASLALPLSTIHPSVSTTCYPPFIVIIIVEIIHIFA

SEQ ID NO: 145518 - protein, 57 aa, Triticum aestivum
  Clone ID: PAT_TA_39936.pep
VDWEAILSPDHGTFVDAVKPWLYPSVKMSKSLKDYADVSVAFGTTGSVVAALTSADT

SEQ ID NO: 145519 - protein, 141 aa, Triticum aestivum
  unsure (1)..(141): unsure at all Xaa locations
  Clone ID: PAT_TA_39937.pep
TKAKDGDDAEATKGGEDSDDSDGMDDDAMFRIDPYIARIFKERNNLPGSETQQSQLMRFKLRVLTLLEIYLQRNPGKKLVLEVYAFLMQAFVKSHSADGNEQFRQRIGGILQKRIFKAKECPKGFDVELSKLESLLXKALH

SEQ ID NO: 145520 - protein, 57 aa, Triticum aestivum
  Clone ID: PAT_TA_39938.pep
ETPPWRHEQSPRRDEEAELSYKVSYILPNSTYVYCHSCFRSSPHVHLIVNRVSVVSF

SEQ ID NO: 145521 - protein, 66 aa, Triticum aestivum
  Clone ID: PAT_TA_39939.pep
HRMIDLPMSLRQLSTSVSPSIIHACLLIQSFTDLCTDRQLSPHDLILQACAPVVHQAYHTICWQQC

SEQ ID NO: 145522 - protein, 104 aa, Triticum aestivum
  unsure (1)..(104): unsure at all Xaa locations
  Clone ID: PAT_TA_39940.pep
FSLPRSVWRRFVDTKVGEFKKELEFKRAKAKNGEDIQPAGTNLCAYYVCEMIRRYTSERVPSDTNAQRNNLRMMLSPEARFRPLQEELXGWFKREVLHPKGEHH

SEQ ID NO: 145523 - protein, 38 aa, Triticum aestivum
  Clone ID: PAT_TA_39941.pep
TRCVVINFVHRILMIFLFKVFRKRKKIRSSSSIVDLAS

SEQ ID NO: 145524 - protein, 80 aa, Triticum aestivum
  Clone ID: PAT_TA_39942.pep
RSSKQKDLKLHLHILHKDLQLWETKRYAKTHINVITGFNHNNISINFPPKKKKKKRKKKTGPPKDSNLTSPSMQLKTPPK

SEQ ID NO: 145525 - protein, 126 aa, Triticum aestivum
  unsure (1)..(126): unsure at all Xaa locations
  Clone ID: PAT_TA_39943.pep
SGSYYTCILLPLPKPPILELDKLMWHPGRRPRHGAQASQPHRQLPPKLIMLADQDEDNPYRTQGSNFSHAYQQVFFYENKTFVSGQHVPPGHQHCATLNQRVRXLAPLLLFYLIFLRHYIHNCNPA

SEQ ID NO: 145526 - protein, 83 aa, Triticum aestivum
  Clone ID: PAT_TA_39944.pep
QSSHHIQKFFHTYNTCTRITYTPHRMHIFIHELTYRPHRLHIFLLLEASSDLKVCTGHNKLTKNRITKVKVLELQTKRQANKG

SEQ ID NO: 145527 - protein, 88 aa, Triticum aestivum
  Clone ID: PAT_TA_39945.pep
SRMYERLHLYCVKKTPTIIHARSQFILGDHAQLRTCTIHQQNRRSSAARHNPPIIQHGYTHYLILACKKKCRSPDSMEASIFFTEDTK

SEQ ID NO: 145528 - protein, 79 aa, Triticum aestivum
  Clone ID: PAT_TA_39946.pep
STTLLKHDVNVTLLKRMVNLVTHVRNINSIAHNCAHQVLNSRIEPVFSCTNSAHSPCPSMLSLQDFQVEGFVIHAVLCK

SEQ ID NO: 145529 - protein, 65 aa, Triticum aestivum
  Clone ID: PAT_TA_39947.pep
MLCFMCGLEKSHKIMIIVMQGLLVVHVLTRPRGLRVRFSFVAVKLKLRCRQDHGPTHCSETRRPV

SEQ ID NO: 145530 - protein, 126 aa, Triticum aestivum
  Clone ID: PAT_TA_39948.pep
LEDPTIPVGMIVLFIRGAMNFARAVEYAVQAGRSFVISFVGFLSLAGLGATESGVDCGVFDVVAIASAFVSIAPELASAVPGLCRACLTGCVFATSRLAVLACAKAGHECRKGYHWLWLFLSEMAC

SEQ ID NO: 145531 - protein, 85 aa, Triticum aestivum
  Clone ID: PAT_TA_39949.pep
GNQPDLVFLLDRNAYFGLRVMIIHCFVYPFPLYIYGLAYLQLVLDCTSYGAENNELNVKSVARDFKSYVKDNEDLLSADLVRSTS

SEQ ID NO: 145532 - protein, 80 aa, Triticum aestivum
  unsure (1)..(80): unsure at all Xaa locations
  Clone ID: PAT_TA_39950.pep
SXGWHLNALQRPNSLHICVTLQHTAIYEEFLKDLEDSVDTVKANPGPISGGMAPIYGAAGKMPDRGTVKELLVEFMDSSC

SEQ ID NO: 145533 - protein, 89 aa, Triticum aestivum
  Clone ID: PAT_TA_39951.pep
LPATSLHFSHVHVTPCRSALDLMLTATVDQTIEWEPDRTTEDLVTWQTGCKPDVTERAVWRDRELAMKEAAEHATRDEEALAYARDRAA

SEQ ID NO: 145534 - protein, 91 aa, Triticum aestivum
  unsure (1)..(91): unsure at all Xaa locations
  Clone ID: PAT_TA_39952.pep
SISSPTRDFFEFARIATHDRSDXSLAANFSSPLVAARPRPCGSCKGKEDLSTKEFDAAGLAGYGGSWLLATTNVWLGGGSSGVVVRFSLGT

SEQ ID NO: 145535 - protein, 58 aa, Triticum aestivum
  Clone ID: PAT_TA_39953.pep
IKSQRSSSPNYVMRRLKQSVSSSIAMATQQSYQVRVQSWIKEKKHFELDRNLATKSDC

SEQ ID NO: 145536 - protein, 79 aa, Triticum aestivum
  Clone ID: PAT_TA_39954.pep
GTRTTFVGLGGSRRSTSLSIQTRYEHLSSVVILFHSFYFTANRLIDSCLVLLSSRLPLSCIRCPTRRRHRLRRRKEVEV

SEQ ID NO: 145537 - protein, 84 aa, Triticum aestivum
  Clone ID: PAT_TA_39955.pep
QFHQNEQNNASKTESVLNRIVCSNLNIHHTYGTPTILKKLGKIKILYINTVQKISKPFDIRVENLKSSTTAKVSVLHRTNQQAI

SEQ ID NO: 145538 - protein, 67 aa, Triticum aestivum
  Clone ID: PAT_TA_39956.pep
KFVYSDTNCFLHNLQTAVSTTSASCRQHLVKHDVMIAQVFPPVPNQPPPEFVQVCMTQSRVSCRPAS

SEQ ID NO: 145539 - protein, 54 aa, Triticum aestivum
  Clone ID: PAT_TA_39957.pep
AHGRISPYMSNPCHIELIVSEKEKPVNKEAESVVAPRKATQTTGMDAIIQQSEL

SEQ ID NO: 145540 - protein, 108 aa, Triticum aestivum
  Clone ID: PAT_TA_39958.pep
IMFSLLLLPLVQTKILGCASMVKASGLSGALCMPITWMVVKMSVWASLRSSALYGQTRYTDGMLTIVIDSNRQPGNSVYPRRLAQDFWSAMQQLRYSGQGRQNQSLSN

SEQ ID NO: 145541 - protein, 61 aa, Triticum aestivum
  Clone ID: PAT_TA_39959.pep
GRLKVINRDVKMVAPAKANYLKWSQIPITFDQSDHPTHIATPGRQALVVDPVVEGTRLTKC

SEQ ID NO: 145542 - protein, 82 aa, Triticum aestivum
  Clone ID: PAT_TA_39960.pep
WSGHRGSTSIQVIHSDTPRGRRSLAQTSCSLGINGTVTTETFSTFIYLQCIKRKIDDNLTCKSMHEDSMCVPSLSLWFAAQS

SEQ ID NO: 145543 - protein, 132 aa, Triticum aestivum
  Clone ID: PAT_TA_39961.pep
LILIMEGITNLLFKRSKKEPPKMNKRSFNYPWVLDKPKADRERGITIDIALWKFGTTKYYCTVIDAPGHRDFIKNMITGTSQADCAVLIIDSTTGGFEAGISKDGQTREHALLAFTLGVKQMICCCNKMDAT

SEQ ID NO: 145544 - protein, 61 aa, Triticum aestivum
  Clone ID: PAT_TA_39962.pep
MRIASNSPPVQPRMVMHVRGISISRLIWTQPCNVKNKESWCLLRQWTPFAPNWKWNKRWDA

SEQ ID NO: 145545 - protein, 99 aa, Triticum aestivum
  Clone ID: PAT_TA_39963.pep
QRRGVYTDRNTGRLLLCFDKRKSKENISFFLAWVLPVDVWQICPCLFVVCRLTRVFDGRRVIVEKVTDSGYSEDVSFFAKKKIIRLNLKRPLDPRVLDL

SEQ ID NO: 145546 - protein, 133 aa, Triticum aestivum
  Clone ID: PAT_TA_39964.pep
DGEIIRTIDDDSVRSYVQDLEAHIRALEIQMRKSLKTVQKLHLREIELEDATREAHYEHQDEVKDFMERLEDRKKYIATLEEKMDLGEDLFPSGDDGPLVSNDQDYEESSTEGSRKRRCRTRGRRARGRRDNC

SEQ ID NO: 145547 - protein, 124 aa, Triticum aestivum
  unsure (1)..(124): unsure at all Xaa locations
  Clone ID: PAT_TA_39965.pep
KGDNLNPGVPETLDLLQKLGKNSXLVYQTNSYRQSTMACIHLEFTRLGLEVPEEEMFTSSFASARFLKXKEFVSXKSVYVVGDDGILDELKLDGLDCHGGPEDGMTNIRLEANIYFHQDTSVRT

SEQ ID NO: 145548 - protein, 125 aa, Triticum aestivum
  Clone ID: PAT_TA_39966.pep
LNNSFARASLHWYSLSLVHDLRHRREGHVAMSSLVMAIAYEKNGIYALADCPVVSKSLLPPPLPKLPRLAVGVCCFCSSCRPPLRLGFAANMKFPFPRQGRFVLTGRQHIALGATFCYACQFMPR

SEQ ID NO: 145549 - protein, 50 aa, Triticum aestivum
  Clone ID: PAT_TA_39967.pep
HGSATTLPAASTELSVKQHRVHQNRLIDYRNCCTQPLNIGHEWYQASHVS

SEQ ID NO: 145550 - protein, 88 aa, Triticum aestivum
  Clone ID: PAT_TA_39968.pep
VFVTRLQLHGPNEAAIRPIGGVIMSTIGLATTSVATQLQLHVPQCDCNKGRYNFYRPVACPYLQLQLQALLLDCNCVQLLNFYIIGTC

SEQ ID NO: 145551 - protein, 117 aa, Triticum aestivum
  Clone ID: PAT_TA_39969.pep
IRAMGRAKAIDNAALEKIPALWDEFGVLKKDSAQMQNQVSKLQEDVQAISSKQGEIPATVGIVEQVVLDLGKQLSGINNVLLTLVKSTQQGLQADHPSSSREVARSPTLHQEQTQEQ

SEQ ID NO: 145552 - protein, 53 aa, Triticum aestivum
  Clone ID: PAT_TA_39970.pep
LCWQLPSRYVGSCHSSYVGSFHNVTIMVAMDAQGARSVCKRVVQKYRIKWSGP

SEQ ID NO: 145553 - protein, 147 aa, Triticum aestivum
  Clone ID: PAT_TA_39971.pep
RTTKSAGFCMPPEELPSTRTPAGFGSSEDLRRNTSILVPIRKKYHDLFTASKILSLSLVLLPLYASHLRSSRPVSWRWITGWADVASRNWCERRLMKPMRDSTSSMASPPAEFLKVNLGPFGVYNLVTVNFVGCVANVAKNCSLTIA

SEQ ID NO: 145554 - protein, 92 aa, Triticum aestivum
  Clone ID: PAT_TA_39972.pep
TGPARRKLGQGEGSSDGEGALAACVCVCVCVLCLCACPEWLRAFVPCPILKSKSSGCLLQTKRQSIYGSISSWGTLPPGGTVTTYYYVRTSL

SEQ ID NO: 145555 - protein, 43 aa, Triticum aestivum
  Clone ID: PAT_TA_39973.pep
GEIISPYLSMCLADTLAIFVYVSVSNHRRLNDSRVCGPVEQKL

SEQ ID NO: 145556 - protein, 81 aa, Triticum aestivum
  Clone ID: PAT_TA_39974.pep
AGYIIPELFDKWHKVWAIFHIYRIILPMQIFIEFVQMAKVNVHELLKILHGFLSLSNMVRGQHEHLLGPFWRNFYLGHFQK

SEQ ID NO: 145557 - protein, 68 aa, Triticum aestivum
  Clone ID: PAT_TA_39975.pep
GWFSAGGALRVLRWTRSVRGVQLSHVKLFSKIGAVKSSTLRSIVWRLWPGRLCVPRGGCNLGFHPVFR

SEQ ID NO: 145558 - protein, 75 aa, Triticum aestivum
  Clone ID: PAT_TA_39976.pep
NMLKNIFEKMSVKQLKNIKMLLKMLFFYLKKINEAFQNIKNIYRKKVDHALTFFILYMRNVDKTFEKCLNVYEKC

SEQ ID NO: 145559 - protein, 73 aa, Triticum aestivum
  Clone ID: PAT_TA_39977.pep
LKRVTVPHYIGVLHLHNLIRRQQHCSINPSSPLTPSLPLPWHGRTTLLFVKWNFSPFVISRRHWTRACQWDGF

SEQ ID NO: 145560 - protein, 88 aa, Triticum aestivum
  Clone ID: PAT_TA_39978.pep
NEDEDGQRRYKRQILRELYAGMNNRRIRTRNWGYPCPFCNQKLHHTYKSVLAHARGRAVGSFKQMYSPRVAHIAYTEYLEKLQDHADK

SEQ ID NO: 145561 - protein, 99 aa, Triticum aestivum
  Clone ID: PAT_TA_39979.pep
ASMSEEYLISFLISCLHVFVVFNHMDLDLGAHLMQVIRDYLFPILCQLHCFHLKIIYLSCKQSYSIYVLPCAYDQEFPQQCVRYHLVFIILMPKDAKST

SEQ ID NO: 145562 - protein, 74 aa, Triticum aestivum
  unsure (1)..(74): unsure at all Xaa locations
  Clone ID: PAT_TA_39980.pep
FIQGFTGPLVHNNKRTVSLTLFASAAATPASNGVPRRRGRCQTRRRSPHHHLRPWXVDHLHLAARLILSSCVDP

SEQ ID NO: 145563 - protein, 81 aa, Triticum aestivum
  Clone ID: PAT_TA_39981.pep
ICSSFIQASPSLCNFLFIACIVELSVASSCQLLVLVSSSFRVLSSVHISHAAAVSLCLPLSTIPSINFHHVLRTVHCHNHS

SEQ ID NO: 145564 - protein, 115 aa, Triticum aestivum
  unsure (1)..(115): unsure at all Xaa locations
  Clone ID: PAT_TA_39982.pep
DATLLSDSIXEIASEDTPSIDPEQVAPSESEGMDPVMEAVLSVAMEPDADFTPYESRIAKPLYSSTATDSEPLISVLVESDWAPIMEFTSADIFQHSPFGDVLNSLRSLSLSGEP

SEQ ID NO: 145565 - protein, 75 aa, Triticum aestivum
  Clone ID: PAT_TA_39983.pep
PSCLVGLESENKPFSSGATKAKLKRIRRTIFFCLSRLEALRLSKNKEKNSTTYELICMPNKLKARNYKQCLVGRD

SEQ ID NO: 145566 - protein, 58 aa, Triticum aestivum
  Clone ID: PAT_TA_39984.pep
ESSQVVNRGWWRWIVVLVVLVLDEHLHEGILLLDQLGELRREVETGVTSRRHLVFWSG

SEQ ID NO: 145567 - protein, 142 aa, Triticum aestivum
  unsure (1)..(142): unsure at all Xaa locations
  Clone ID: PAT_TA_39985.pep
IRTHVQCLICVPGPEDIKHCLFDCARAKDVXKALGLYEEVRKAIVKARXSNNHPRILCKLELVSRDISSVELALVVVWFLWWQQKQWMKGEAVQLLERSAISIKVLATNFIRASKLKIQKRKWDHIWKKPIKGFRKINVDSP

SEQ ID NO: 145568 - protein, 141 aa, Triticum aestivum
  Clone ID: PAT_TA_39986.pep
TLLPEDAWLLLKRQVLSSEIDEDYTDTLKDIGLKIIEKCGYLPLAVKVMGGLLRERGGLRRDWEHVLDDSKWSVTKMPPEINYTVYLSYEYMPSYLKQCFLYYTLLPKSKPYNMDQVVAMWMSEGFLHGNSSDLEELGRNY

SEQ ID NO: 145569 - protein, 59 aa, Triticum aestivum
  Clone ID: PAT_TA_39987.pep
RRFMRNRPSDVFAKNNAPVMLKICFLSNSDDRFTTSYKTTELVMMVCLPSCNICRLIYI

SEQ ID NO: 145570 - protein, 116 aa, Triticum aestivum
  Clone ID: PAT_TA_39988.pep
ARVTVLLSREARLCFRESHGRTSRKRKKTCFLFFFFHESHGFAFTRGTVVMSREARVCLIRKEKKTCYWFNFFGFLWKKSSLKSINMGSSFEDLDARNPMVKTVQDLEHDLRDNFF

SEQ ID NO: 145571 - protein, 90 aa, Triticum aestivum
  Clone ID: PAT_TA_39989.pep
MKVAVPSIFFISSNCITRGGVVVLDFFFCFSLKILDFVVVLNFGKFIFTRASHSHFIFYSHLSFFLAVFYSSSIKMYFLFRTICRGSPVA

SEQ ID NO: 145572 - protein, 118 aa, Triticum aestivum
  Clone ID: PAT_TA_39990.pep
RAPIPDPRKTKLKALMRRDGSLSEDNDEMENMVNSFYKTIYTSEGMQDVDRVIEIVPHKVTSDMNAQLNAPYTQQEVKDALFKMFPIKSPGPDDFPTHFFQHPWGLWGRSNKDGAEYS

SEQ ID NO: 145573 - protein, 105 aa, Triticum aestivum
  Clone ID: PAT_TA_39991.pep
CTYGSHRVLRAFTTADSKSNSSNFCGRVRTCPLALTGHTLNFSLHICVYHIWHPISILRMQRDELLYVIKQRTEKSTSNGQRNAHKPILYHPIDHPSSSLDKFNN

SEQ ID NO: 145574 - protein, 70 aa, Triticum aestivum
  Clone ID: PAT_TA_39992.pep
MLDAPRERGLGKENVIPSSESRRCLVFLSRTQTLTDFEDTSKNGALTPARVGIHCVLMTVRPPETRRNPN

SEQ ID NO: 145575 - protein, 87 aa, Triticum aestivum
  Clone ID: PAT_TA_39993.pep
LLYDNISPDGELKQKGVSNCCRTKMCMIITTPPGSQNIVYPQLLCVVSGAESTWQLDLQQLELFTPLGADLGEGCREAWHHVFECKP

SEQ ID NO: 145576 - protein, 62 aa, Triticum aestivum
  Clone ID: PAT_TA_39994.pep
NHRPFHESVCDALVTNGDVIKPLKKMQNVCDGGSIKHGSNFNNRNGQPDEGVCDMRHTIHSD

SEQ ID NO: 145577 - protein, 121 aa, Triticum aestivum
  Clone ID: PAT_TA_39995.pep
EQVGDAFGAEVNAMAQGVALAAELGLLRVSFETDSQLLADTMDLHKADSSAYSPVIEDTKLQLKLWFSRHVIVSCRREANSVAHELASLGRLCEINHSMQWDDDVPAAVAACVQADLPGHR

SEQ ID NO: 145578 - protein, 50 aa, Triticum aestivum
  Clone ID: PAT_TA_39996.pep
PRALLYRNLLDLQLLWGGGGLFVSSHRSIHCQVRKCVHFVISDPYRESLT

SEQ ID NO: 145579 - protein, 113 aa, Triticum aestivum
  Clone ID: PAT_TA_39997.pep
SRVDSRTTLTYLANELVDPLVEELTRRVKLAPANSLGDLLLLCFDVSGVQNGQVVAMIPDVTLVLGGGATVTLKAENTFLDVHDGTLCLAVAAASEHDTPVSIIRNSAQQNMH

SEQ ID NO: 145580 - protein, 71 aa, Triticum aestivum
  Clone ID: PAT_TA_39998.pep
LVICGKVLLATGRANASLTARRRAASPGLAQPAGGHMPQPLFLQFFTFFKFTLPMLPSNNWKILIVHLKSW

SEQ ID NO: 145581 - protein, 58 aa, Triticum aestivum
  Clone ID: PAT_TA_39999.pep
FPGPSSGYENMGGYFTAKRAEVGNLGWLKLLHSEDGATPDITPLDHLSRVIHTSIRGK

SEQ ID NO: 145582 - protein, 79 aa, Triticum aestivum
  Clone ID: PAT_TA_40000.pep
NLNSFAWLNRAPVMYTSLSMYAHYTWGLPRQKLILRGSSSSHMCFCSYIPFLRHYMHQYDLSFGQVGLPGSCYYALHSR

SEQ ID NO: 145583 - protein, 83 aa, Triticum aestivum
  unsure (1)..(83): unsure at all Xaa locations
  Clone ID: PAT_TA_40001.pep
SVVEPLREFAKDIVSLVKRCHWPDRKXEFTISGRRAIAIGFVVMGFVSIFVQLIFIYTSNISVGSSNVGRQDYQMRGHRDPGN

SEQ ID NO: 145584 - protein, 63 aa, Triticum aestivum
  Clone ID: PAT_TA_40002.pep
CITGACHQYIHCHEVTETGSDCVRCEPRYDAVHDTEDAPVNVSYSIRAHNRFADARPGGFYET

SEQ ID NO: 145585 - protein, 66 aa, Triticum aestivum
  Clone ID: PAT_TA_40003.pep
LVITAMNNHKFSVIWRALYRAATLGSPLNQATSCDVLVEIHLFILGFLHMNDATDLVPSYHLYGVS

SEQ ID NO: 145586 - protein, 72 aa, Triticum aestivum
  Clone ID: PAT_TA_40004.pep
NIFTFVTYANFTSPIILTVCHMPMHLNKGFFIESISITDIITSIKSCCNDIFVPLPVMSALSTVNDSIVVAT

SEQ ID NO: 145587 - protein, 88 aa, Triticum aestivum
  Clone ID: PAT_TA_40005.pep
DSGRNMFEGNDVSDGMGFGMLTEGERSLVERVRQELKHELKQGYREKLVDIREEILRKRRAGKLPGDTASTLKAWWQAHAKWPYATVV

SEQ ID NO: 145588 - protein, 72 aa, Triticum aestivum
  Clone ID: PAT_TA_40006.pep
CLFLAVTEKSELHAFKAPVHAAVQVIAVISSGLGEVRDGTRLGIAGAFSTFLYGSILSGANHQDFSKRVANH

SEQ ID NO: 145589 - protein, 64 aa, Triticum aestivum
  Clone ID: PAT_TA_40007.pep
YTWNIFKVLSELSCEYMLEHCFQGKLNYFITCYLKLQGKFIWKLHENFLIYFNDRRKYLENRAV

SEQ ID NO: 145590 - protein, 50 aa, Triticum aestivum
  Clone ID: PAT_TA_40008.pep
HGSINTSRNSLAALNDRSCHPLAYSVISLPYCFSRSLHRLSDYTFMSAKL

SEQ ID NO: 145591 - protein, 140 aa, Triticum aestivum
  Clone ID: PAT_TA_40009.pep
DYGPLNRTTFKNKYQLPNINELFEQLKGAKVFLKLDLRMGYHQIRIREEDIPKTTFRTSFGSYEYTVVSFGLVNAPPTFSRMTNFIFNPYTNEFVLVYLDDILVFSKNKKDHAKHLRLVLDKLREYKFYAKFSKCEFWLD

SEQ ID NO: 145592 - protein, 133 aa, Triticum aestivum
  Clone ID: PAT_TA_40010.pep
DEDKHGDESNIFGGRVEMCLRRICLWWICSDLFIVRLRLCVFRLDPSNLHYSSSATFAVLVRWFYGALARRLSDCLLQQALPGSGEGGLMTAARFRPASMLVIIGRWSMNLNVIFIISGVRCTAMIKDEYIQC

SEQ ID NO: 145593 - protein, 112 aa, Triticum aestivum
  Clone ID: PAT_TA_40011.pep
ERRRAWRGLRWVIGLFWRVLGYTTQEAFVVTRLTVGASSSLQKERNLTGGLPVVYQGHIANLGPFGERLTPAHEKRQEGVRRCMWECRIAKRATGKMLGCMRRTRMQMRCTW

SEQ ID NO: 145594 - protein, 73 aa, Triticum aestivum
  Clone ID: PAT_TA_40012.pep
SFWAAGFFFFFFFFFLFFFFFFFFFFFFFFFFFFFFFFFFKVAVTAKHHAEHVHPQVNTQPLVRLLIGFYVVL

SEQ ID NO: 145595 - protein, 98 aa, Triticum aestivum
  Clone ID: PAT_TA_40013.pep
STSSTKSVPTKHRILVTAPHCQQLISVSGTQWVRVGCNWPARKLKGGRTKQCINASSLHFASGVVIPFSNRRSMHYYTPGDKRHILARTRRGSRPQSG

SEQ ID NO: 145596 - protein, 66 aa, Triticum aestivum
  Clone ID: PAT_TA_40014.pep
MFSWEYVAVRTLLRHKAGPLQDAIKIEFASIIIIAIRRPLGQILGIQFCLMRLDAGKGHMRTFNTD

SEQ ID NO: 145597 - protein, 92 aa, Triticum aestivum
  Clone ID: PAT_TA_40015.pep
GSVIDFGSRSERFDIGTCLEAIEHVDEDHSSLFGITVMSSFCPAVLIVSTPSYYYNPIIQMSALPINEQKREHDAGSCKFRIHDHKFEWTRS

SEQ ID NO: 145598 - protein, 110 aa, Triticum aestivum
  unsure (1)..(110): unsure at all Xaa locations
  Clone ID: PAT_TA_40016.pep
CVFCQHDESIXHIFFECKFARAVWAIVQESXKSVTPHSVHNMFSNXLWGIDEQFSAHILVGAAALCWXLWLTRNDVVFNRKCGSSPEKIIHECTRWLHTWSVGLRVLANP

SEQ ID NO: 145599 - protein, 68 aa, Triticum aestivum
  Clone ID: PAT_TA_40017.pep
KFTSCMTGSEQRGHSRHLGRLVVRSTATATMTHGMGMAMMLSRLGCHYTQPSPWPWSRAWRIASVTED

SEQ ID NO: 145600 - protein, 87 aa, Triticum aestivum
  Clone ID: PAT_TA_40018.pep
PLDLRLPPLAHLTGKKGNFQRTSLKQCVIPASHRGAILTPRSRITPSSWPWGDELCSRGVAKVVKALPGPWSSSFATGALSCRSSTW

SEQ ID NO: 145601 - protein, 58 aa, Triticum aestivum
  Clone ID: PAT_TA_40019.pep
MPPKPPKKPKAQKKEYDETDLENLKKKKEDEKAVKELKAKAAQKGPLGGAGLKKSGKK

SEQ ID NO: 145602 - protein, 49 aa, Triticum aestivum
  Clone ID: PAT_TA_40020.pep
IGGMSTVFTAMSSEADECFILSGKWSIIPFQHSLIRCNHSHGARGNPYL

SEQ ID NO: 145603 - protein, 123 aa, Triticum aestivum
  unsure (1)..(123): unsure at all Xaa locations
  Clone ID: PAT_TA_40021.pep
MVHVSGPECFSRAIRAVVIPPNFRLATGVSKFTGESKPDTWLEDYRVAVQIGGDNDEVAMKHLPLMLECSARAWLNQLAPGSIYTWEDHAXVFVRTFEGTCKRLAGLTELQCCVQKPNETLRY

SEQ ID NO: 145604 - protein, 99 aa, Triticum aestivum
  Clone ID: PAT_TA_40022.pep
HSVAWFTYWIDNRGFITEGNTYRRCAASSSPFRGNTNAVTRNQGSSIGLLLLDIDGSAAWEHHPRVDATELVEVVHGEERLDLTVRQVDLDAAISRTKI

SEQ ID NO: 145605 - protein, 79 aa, Triticum aestivum
  Clone ID: PAT_TA_40023.pep
DEVVVQVFKMRGPKGHNLSALSTCVAKISQKQESNFSECTKKAFSELHYPATSNCSPLGSTPSTSERRTPYAAIVDLGN

SEQ ID NO: 145606 - protein, 71 aa, Triticum aestivum
  Clone ID: PAT_TA_40024.pep
GESRLLGQTIEKQYILVEKTVNMYPIRNLMSISCFSISTRGLNARTPKYHHGSSSCHHINVSIQHCCRCTH

SEQ ID NO: 145607 - protein, 116 aa, Triticum aestivum
  unsure (1)..(116): unsure at all Xaa locations
  Clone ID: PAT_TA_40025.pep
PSSWTPSASSTSTAPAPPSGATSSRVTRKQAQPPLSAKSAPAGPAQSSSSSMASTGHTSDIICCHCKGRGHYARECKSXCVMIATKDGRYESTSDYDEQTLALTTREQHGGDYSDY

SEQ ID NO: 145608 - protein, 76 aa, Triticum aestivum
  Clone ID: PAT_TA_40026.pep
KVCMIVKKQLAVPDGTPVTAESKFSELGADSLDTVEIVMGLEEEFNITVDETSAQDIATVQDAADLIEKLVTEKTA

SEQ ID NO: 145609 - protein, 54 aa, Triticum aestivum
  Clone ID: PAT_TA_40027.pep
VTRDNLRSTHYRDFPGFLSAYDITILMILPASALSIAMESLLCIHTSDYITTFR

SEQ ID NO: 145610 - protein, 133 aa, Triticum aestivum
  unsure (1)..(133): unsure at all Xaa locations
  Clone ID: PAT_TA_40028.pep
EDTVCSGNASPTWQAIQYGLELLEKGILWRVGDGRNIRIWRDRWLPTKPTGXPITRHGTCRLRRVSELLDESDAWRTNVLRQYFLPADVATITSIRTSPRITDDVIAWAPKKNGIFTVRSAYRLAMDERQRPL

SEQ ID NO: 145611 - protein, 51 aa, Triticum aestivum
  Clone ID: PAT_TA_40029.pep
SLSMMVRCMIEKLRIYKAKSRRRRNRRKIRQSRTMHISIDPSKCLLQGCVL

SEQ ID NO: 145612 - protein, 98 aa, Triticum aestivum
  Clone ID: PAT_TA_40030.pep
TCMHGTNGLAIGGWSRSHGWSSHDGAPEKLSGPTALLVQRSPTTCSCYSYIWAVCMPFFYFFWRKQKGTGLPNAKSTSLTSKVVQFQFSGKEDSNCDF

SEQ ID NO: 145613 - protein, 95 aa, Triticum aestivum
  Clone ID: PAT_TA_40031.pep
GPTSRVHSDDQRVLLQIFTKPVWDRPTLFLEMIQMIGCMDKDERREEYQNGGCCGFGKGNFSELFKSIEHYEKSLEAKQSAAVQGSYDRSWSWMS

SEQ ID NO: 145614 - protein, 69 aa, Triticum aestivum
  Clone ID: PAT_TA_40032.pep
ESGNSSASMACSDGSQWRSQPAQGVGQTLCTLTWSAFVQGINNTNHGCFVLVSEEWQKQPGQLPRVARS

SEQ ID NO: 145615 - protein, 36 aa, Triticum aestivum
  Clone ID: PAT_TA_40033.pep
KPSAATVTGSGSGSVHEKKGFFKKIKEKLSGHHNDL

SEQ ID NO: 145616 - protein, 59 aa, Triticum aestivum
  Clone ID: PAT_TA_40034.pep
IAPDGRFCFCNFPYVCFGFLSFSFNVIFRFYTFTHFKSKFLHLLFSFDLPESYIVFFNI

SEQ ID NO: 145617 - protein, 46 aa, Triticum aestivum
  Clone ID: PAT_TA_40035.pep
PTAPKPHFCLSCHTNILIRQPDHANHGWLLFLCRRPAKSRVANAGV

SEQ ID NO: 145618 - protein, 61 aa, Triticum aestivum
  Clone ID: PAT_TA_40036.pep
VLKININSSMLLIDDSSTPKKKQSFSQEDKKLDEQEALHLEATVVCHQDINVDAIFNGNSC

SEQ ID NO: 145619 - protein, 131 aa, Triticum aestivum
  Clone ID: PAT_TA_40037.pep
RSEIPGSTPWAQKKMLGHLQLKYKNPVVMIHENGAAGKNTPDDDEFRSQYLQDYIEATLESSRNGSNVQGYFVWSFLDMFEYIFGYRMGFGLYGVDFNSEERTRYQRHSAKWFTGFLHGGELRPVALPGKV

SEQ ID NO: 145620 - protein, 52 aa, Triticum aestivum
  Clone ID: PAT_TA_40038.pep
AFMTIGMGWTFQRKGCRLVMLLSRIKRDVSPNKCSWIRKNVQEFQNMFSDFK

SEQ ID NO: 145621 - protein, 65 aa, Triticum aestivum
  Clone ID: PAT_TA_40039.pep
SESILPKIEDTHAMIFQLTWETSLQPISEKAELPLEHLLIHEIPEWDLEMRVPAEMTICVSLRSS

SEQ ID NO: 145622 - protein, 89 aa, Triticum aestivum
  Clone ID: PAT_TA_40040.pep
TLVQKLLIPIKHFLKYLFHIFNTCTPFSNTYSKNLKYLFNIFRTYSTNFQYSFTIFNAYSTFSAFVNRNYFGKSMRKPSKKRHRRSMLN

SEQ ID NO: 145623 - protein, 110 aa, Triticum aestivum
  unsure (1)..(110): unsure at all Xaa locations
  Clone ID: PAT_TA_40041.pep
HIDKRTQIRELHADCFNDDFVGVPFPDTDMDLRYIPRKDPKWQSRHDNDHESESASRXSSLAELDSDTTYIVXLSDAYRAEXMLCIMLSETFKRSVKPMPIELNSSLIVT

SEQ ID NO: 145624 - protein, 44 aa, Triticum aestivum
  Clone ID: PAT_TA_40042.pep
VRGKPTTLSFHRPRPISPYVLLIFHLVESTVPHKKNSLNLHWCG

SEQ ID NO: 145625 - protein, 132 aa, Triticum aestivum
  Clone ID: PAT_TA_40043.pep
PWTYTASCIARHVLRTAQQNDLDSHAVHAADSQRRAKGSRAPDRPVNLPLRPRLLSPSLLQVQAMTDGSIRMTRVGNVAGGAHERPRHGYVEITLSRFIYVHRALMVVVPSYTVQVNADGMDRCIYYPYKKK

SEQ ID NO: 145626 - protein, 130 aa, Triticum aestivum
  Clone ID: PAT_TA_40044.pep
PVGRRSCGPAVGLTSHICRVSSTSCLIFPPAAQTKPPHRLRLRTPPMAGCASAGPPYILSNVGQSLTLFPHTSCYSSVMSTPARTRARTSQPSYSPPLATGPADLQRLLFVPSDASPSSSALQPWFAHRG

SEQ ID NO: 145627 - protein, 71 aa, Triticum aestivum
  Clone ID: PAT_TA_40045.pep
AFAILFSLFALLNYRLHRHVELLVLVSSSFRVSSSVHISHIAAVSLSFPLPTSPSINFHHVLPIIHWHNHS

SEQ ID NO: 145628 - protein, 125 aa, Triticum aestivum
  unsure (1)..(125): unsure at all Xaa locations
  Clone ID: PAT_TA_40046.pep
KFTKWIEAKPIKNLDSSTTISFIRELIFRYGVPHSIITDNGSNFDSXEFRAFCASQGTRVDYASVAHPQSNGQAEKANGLILQGLKPRLMRDLKHATGSWVTELPSVLWGLRTTPNRSTDRTPFF

SEQ ID NO: 145629 - protein, 114 aa, Triticum aestivum
  Clone ID: PAT_TA_40047.pep
ICLVNSVALAVHVYSLMKCMEICSTILLLFFFLLHVFCLYVLFSLMSRLQKVSHPDVWLVSSLENADSVGEPIVPNDFAEDGSYPMSTVVISFFLSSFILLFLVTEVVLFNFSL

SEQ ID NO: 145630 - protein, 65 aa, Triticum aestivum
  Clone ID: PAT_TA_40048.pep
TILLLWAHMMHKPKLLEGKDPMCCLFYKYHVFMLVILHCLVIKLRMTVTWYCSKLGVGDFNIFSS

SEQ ID NO: 145631 - protein, 109 aa, Triticum aestivum
  Clone ID: PAT_TA_40049.pep
KNELYPFFHKRVCYMRDCNNFFPPTRFSTTFLAPVLRFAARPRAFFIAYIQAPSLIKLAGRQFHSQALAGRRRRWFSAASSSGGSHHLPIFNQVARPSIKTNGKPTVDH

SEQ ID NO: 145632 - protein, 53 aa, Triticum aestivum
  Clone ID: PAT_TA_40050.pep
YCRRALRLSSKPIPPFVRSNSTTTPSNNLALYLSQPYSSPTHMHGCRSISLNT

SEQ ID NO: 145633 - protein, 62 aa, Triticum aestivum
  Clone ID: PAT_TA_40051.pep
PGQLTWLHLIWINERKRTPQNKLYAHLLRAINCVEDKFAHPCSDHSLTPQRIRRSTNKHDDL

SEQ ID NO: 145634 - protein, 53 aa, Triticum aestivum
  Clone ID: PAT_TA_40052.pep
SVTEIRSHSFYLPTRYQKCCHHNHTRWKRDDLRSSTSLTIYMRSSQLPRLSCE

SEQ ID NO: 145635 - protein, 45 aa, Triticum aestivum
  Clone ID: PAT_TA_40053.pep
VKTPNISHAYDDDSRKGQANIQERRLTTYAIITHQVSRSSRYQSQ

SEQ ID NO: 145636 - protein, 118 aa, Triticum aestivum
  unsure (1)..(118): unsure at all Xaa locations
  Clone ID: PAT_TA_40054.pep
SKGKLEASNVTNDDIEDLKCAGYLSANIAHRAPEEGLAIPTPXPGERVVFVPQFIRGLGFPLHPFIRGLMFFYGMDFHDLAPNSFLHISTFIVICEALLRVKPHFGLWLKVFNVKAKI

SEQ ID NO: 145637 - protein, 54 aa, Triticum aestivum
  Clone ID: PAT_TA_40055.pep
ASPSVLFQKKTETSVTITSSLYFGTKVVPSLAQLCKKKNRVIKYTPFILASPET

SEQ ID NO: 145638 - protein, 59 aa, Triticum aestivum
  Clone ID: PAT_TA_40056.pep
GRYMVGVWYRRKLRGTREVSNGGRLRVRIIHGLNISLKELTYLLKKSISHQNKVLRTCS

SEQ ID NO: 145639 - protein, 71 aa, Triticum aestivum
  Clone ID: PAT_TA_40057.pep
PKTTALAAHARSPTPPGRLKKKQVPPPASPKSVRKQMIATPASKAYYRSTRAVGSIAMGHMYIRVDRHAQT

SEQ ID NO: 145640 - protein, 122 aa, Triticum aestivum
  Clone ID: PAT_TA_40058.pep
SKILSKVIEYCKKHVQASPKPADSGAVTDANSSTSTAAAAPVEDLKSFDAEFVKVDRATLFDLILAANYLNIKGLLDLTCQTVADMIKDKTPEEIRKIFNIKNDFTPEEEAEVRKENQWAFE

SEQ ID NO: 145641 - protein, 125 aa, Triticum aestivum
  unsure (1)..(125): unsure at all Xaa locations
  Clone ID: PAT_TA_40059.pep
PGTTSRSALPPGWIQGDWITSSVSVEDLERLVVDGLIADGSWRLPEGESEPAPRDGEPVLLTTHEERRFSLPPHPFFHGFVNFFGAQIHHFXPNTTLYLATFVSMCEKFLGCHPHWGLFKHIFTC

SEQ ID NO: 145642 - protein, 32 aa, Triticum aestivum
  unsure (1)..(32): unsure at all Xaa locations
  Clone ID: PAT_TA_40060.pep
CATEQXYIAQSRGIDEVNNCNNNRAALAWTGG

SEQ ID NO: 145643 - protein, 132 aa, Triticum aestivum
  Clone ID: PAT_TA_40061.pep
PNWLQSPAATTFKSLKHIGLEHITHCTRLPDGLCRIRSLERLGIEHAPAIEHVGPDFQTHEDAAREVAFPSLRRLVLDGLSGWKEWEWEAEEEQSKVIAMPALEHLGIGDCKLTHLPRGLASGRRHNLRILE

SEQ ID NO: 145644 - protein, 90 aa, Triticum aestivum
  Clone ID: PAT_TA_40062.pep
WIFCLFVCCLFFFLKKIVSFMYYPGIYFRNVDMPYVSYIRLTEKLLTFLFICHKNSCSPYVQLELSEFMQLRGCNTYAIACISNYVRLKG

SEQ ID NO: 145645 - protein, 74 aa, Triticum aestivum
  Clone ID: PAT_TA_40063.pep
TRSGTCDRKEKQTQAPARPFLSIPSGPLVFSGIYLIMKMFRNALEPTTFWTARCLIPMILRFWVLAVGWSYQYD

SEQ ID NO: 145646 - protein, 127 aa, Triticum aestivum
  Clone ID: PAT_TA_40064.pep
AWQRRGTTIVHGRIQHPNMHLIQLMHSSTGVRSRRLYLRRVRFKEDQFVEEVVVHEPLREVVVHDDDSGTRFRRCSGSAVEVLVALPGIFIPVSERNLAYPCTWHFAIPCPGSSCSRSGVMEELDIH

SEQ ID NO: 145647 - protein, 87 aa, Triticum aestivum
  Clone ID: PAT_TA_40065.pep
IWGANAEEFDPSRFADGKSYHLGAYFPFGIGPAICVGQNLAMVEAKLALAMVLQRFALDVSTSYVHAPMKVMTLQPQYGAQLLVHKI

SEQ ID NO: 145648 - protein, 77 aa, Triticum aestivum
  Clone ID: PAT_TA_40066.pep
YPYTNLILNNTAVQMIIHATKRVTSRISTRRGARTSELRIIERAISIEILCFEPKIYDRLMTTRPRSRLLSTAKSSR

SEQ ID NO: 145649 - protein, 57 aa, Triticum aestivum
  Clone ID: PAT_TA_40067.pep
VPRIIHRNTSRILHLTMARTWENLCVVCWICYLCIMISTAESSRGLYWSQRLSYLDR

SEQ ID NO: 145650 - protein, 90 aa, Triticum aestivum
  unsure (1)..(90): unsure at all Xaa locations
  Clone ID: PAT_TA_40068.pep
RWWRQQNDIIKGXXVRGLVSPGRLEFINRGMCMHDEATVCYIDMIDQTTLGHRFINEEFSQIPRIGWQIDPFGHSTVQAYPLGAEVQDSE

SEQ ID NO: 145651 - protein, 121 aa, Triticum aestivum
  unsure (1)..(121): unsure at all Xaa locations
  Clone ID: PAT_TA_40069.pep
MLSRLWGFPARRTRGERIESARPPARPRRSAAMNCETCHLNELELEPLEILDALPCILHTIFFHRTLTLVRPLDVDCDLFAITYVHCGLVXLDQEVDERINRFIAWADMHSNRNSHGVCCG

SEQ ID NO: 145652 - protein, 133 aa, Triticum aestivum
  Clone ID: PAT_TA_40070.pep
QDLFAELRPNMTRYSSIDELNSALAELEEHERAASVEKPESERHSDNESQKRQPHDDGRGSANGAEGNGKDHGEGADSESYSDSGSIGGHEDEEDLLSEEKSNDASENEGDDEDDGMPVGSDEDEGVEVRQKV

SEQ ID NO: 145653 - protein, 91 aa, Triticum aestivum
  Clone ID: PAT_TA_40071.pep
AFFLSTEATTIFFCLATDLRASRTQSLANPTLDPSSPAYSRDMGVDNPPPITEFQPRRQRVRLDLPGLARGAGLGDRAPADDAHYGPIGNW

SEQ ID NO: 145654 - protein, 115 aa, Triticum aestivum
  Clone ID: PAT_TA_40072.pep
ARRSLLSSASRRLLTRQPYIGFSGRGVQVQDSVRTLLQGVELQGGVLAGGQALPRPSTGAQVHQGRHQGRLLLPLLREAPPMKYIHHPSIICSLARPVGITTSYLSQTFLIHVRL

SEQ ID NO: 145655 - protein, 51 aa, Triticum aestivum
  Clone ID: PAT_TA_40073.pep
AIVHYVLNYSLLRERRWASLPLCLDHTSNLLIFHLIQAKYHLRELVEWRPR

SEQ ID NO: 145656 - protein, 82 aa, Triticum aestivum
  Clone ID: PAT_TA_40074.pep
NMAVGSKPAVGELRSRPGSGALEEKAGRRRAQGQADRRHAGRRPAGGALVSEDGAAARGRDARSAWFAGCRVHGVGLLFLFF

SEQ ID NO: 145657 - protein, 77 aa, Triticum aestivum
  Clone ID: PAT_TA_40075.pep
RRRLPRICTWSQSWGMKDMQSCATVGDGTLGCLLRCMLKKKRGIMTLKYWDQSDSVFKESLPGKITIIKREVALKLD

SEQ ID NO: 145658 - protein, 131 aa, Triticum aestivum
  Clone ID: PAT_TA_40076.pep
FLNLPNLVSIGRMASGPLIGWMIMNEWYLPAFGTLALSGASDWLDGFLARKMGINSVIGSYLDPLADKVLICCVAVAMVEKELLHPGLVGLVVARDFLLVGGAFYKRASSLGWKWNSWSNFCNLDAIQREK

SEQ ID NO: 145659 - protein, 62 aa, Triticum aestivum
  Clone ID: PAT_TA_40077.pep
LEETTAKLRLTSDLTALRLYARDACEPTGWQRSSHCLLQAAARPKRLQRDAPAICDMIQKLN

SEQ ID NO: 145660 - protein, 133 aa, Triticum aestivum
  Clone ID: PAT_TA_40078.pep
PTRPDNISVTKGVVSRVEPTQYAHGATQLMAIQIDAAINPGNSGGPAIMGDKVAGVAFQNLSGAENIGYIIPVPVIKRFISGVEESGKYSGFCSLGISCQATENIQIRECFGMRPEMTGVLVSRINPLSGAYE

SEQ ID NO: 145661 - protein, 62 aa, Triticum aestivum
  unsure (1)..(62): unsure at all Xaa locations
  Clone ID: PAT_TA_40079.pep
QLLLLRKSKIEYYDMLVKIIVQXYHENNVNLGSACGKNFRVXCLRIIAPDNLEIINATPVGQ

SEQ ID NO: 145662 - protein, 73 aa, Triticum aestivum
  Clone ID: PAT_TA_40080.pep
HRVLPGLYYRNVENGKVQQGEEVGEHQGFRSKKDVNPWPMNLTRAALPFPYLMVLCGCVAATVIKCWLPPRVR

SEQ ID NO: 145663 - protein, 102 aa, Triticum aestivum
  Clone ID: PAT_TA_40081.pep
RWLATTEHADDAPIVAADNADRQVNALAHAQAVEGTAQNSRRAPDQAMHRSVQLLIRHAYRRRRRRQEDLRGVNGSRGDFGGLQISPDRQGHKEEEEEGVAS

SEQ ID NO: 145664 - protein, 76 aa, Triticum aestivum
  Clone ID: PAT_TA_40082.pep
ISPPRRSCRNLGFGSQISPPTASDLPLKALPVRQAPVWSTLNFLTAKIELEWARFGRSSLPPRQGREKRTRGRTRG

SEQ ID NO: 145665 - protein, 71 aa, Triticum aestivum
  Clone ID: PAT_TA_40083.pep
FDQRALIFQIHILEKFYNKMDDVGFAVSHLGKVVDRGVHPLLSGPRPPPGHCWTPIEGADVGRTARLFEFR

SEQ ID NO: 145666 - protein, 70 aa, Triticum aestivum
  Clone ID: PAT_TA_40084.pep
MDVPAAPAMAFKAYKFKEVFVRDYLLADSYAPYTAVLGGILMCKLAYDFTRIIRLFNYKGYAFFYNFHFI

SEQ ID NO: 145667 - protein, 66 aa, Triticum aestivum
  Clone ID: PAT_TA_40085.pep
GFTPSSAVLLLLHSFYEPHPTIKKITLPLWGRDNPMGQKMITLEVQNCKKEKTAIAEAFLCLLLGL

SEQ ID NO: 145668 - protein, 65 aa, Triticum aestivum
  Clone ID: PAT_TA_40086.pep
AHEGSFLPYSATHFYAFREISVARHVTFLHEAKTSFAHHGVKISNLEGDLPAMMAQKDKAVVRLT

SEQ ID NO: 145669 - protein, 134 aa, Triticum aestivum
  Clone ID: PAT_TA_40087.pep
VHLGRRSPCRRACRRWRSSLAAARCSGPCVGLWRCAVRRGGRGGCGGTVRRPRRTCVVAASTTHSGMAAWRCCAAVEAAAVQGNKPWRRAGRNRCVLWVHTERVGRVGTAGARTSVRLTLGGGVCRRCARVNAR

SEQ ID NO: 145670 - protein, 56 aa, Triticum aestivum
  Clone ID: PAT_TA_40088.pep
MAGVNTSVVGLKPAAAVPQSVSPATEKRVQVAPPKDRRAALLGLADGFTVTVIRLG

SEQ ID NO: 145671 - protein, 80 aa, Triticum aestivum
  Clone ID: PAT_TA_40089.pep
NEKYQSSSKLYTAKDNFTKKQSLQCNLQRELSSVLLYGLYHSCSFLARSKYQKIASFKITVVKNFHVIQRITNLIDTLLH

SEQ ID NO: 145672 - protein, 98 aa, Triticum aestivum
  Clone ID: PAT_TA_40090.pep
EYIEKHSDWVAHWSESFILAGTLGVVVHVVCDTTYESINTFNNTGLYNRLGILHAMHLGMDVRMHAATTAITGCIHGVLDEVLDEFIEATSEPTWRAC

SEQ ID NO: 145673 - protein, 93 aa, Triticum aestivum
  Clone ID: PAT_TA_40091.pep
KNLCSHMQVPGKIPFPPILSQFSHFITLLAPLLYSQQLLEIYNMTENCQEEEKPRRSRAAVNKLILSTLASSYTLQASSCTLAPSSVALSSAL

SEQ ID NO: 145674 - protein, 69 aa, Triticum aestivum
  Clone ID: PAT_TA_40092.pep
DGPNKIFYLFYPHQTLKSTPFLNLLDLLLTLLHKIFFKNTDENTSKLVENKNPLNTYFFFVFKNKLLFF

SEQ ID NO: 145675 - protein, 79 aa, Triticum aestivum
  Clone ID: PAT_TA_40093.pep
LAIAGKVIVGKTKKNRSRRATGFYGACHPFEFASISCKLTLFQPYLLVALYHRVVQLYPLNLINPDFVLALTKHKKKTT

SEQ ID NO: 145676 - protein, 75 aa, Triticum aestivum
  Clone ID: PAT_TA_40094.pep
RNGLWWAEGSGYGLGRSINSGRSESKERLRYSGASRNYGGVTALTLPLVVLLPMSYVWLATCKEMAGFLLIEVQR

SEQ ID NO: 145677 - protein, 50 aa, Triticum aestivum
  Clone ID: PAT_TA_40095.pep
TIICLGISFFYNNSGRRVQNTLHLWNSQLISPRHLWISGLIHLKTASKLT

SEQ ID NO: 145678 - protein, 106 aa, Triticum aestivum
  Clone ID: PAT_TA_40096.pep
PRVRPRVRPRVRPQHHRRLEGKVAIVTGGARGIGEAIVRAFVLQGARVVIADIDDAAGEALAAALGGACCSYVHCDVSVEADVERAVRCCVARYGRLDLLCNNSGV

SEQ ID NO: 145679 - protein, 50 aa, Triticum aestivum
  Clone ID: PAT_TA_40097.pep
LATYLAPPSPAPSALSPSAASTAGGCARFPSPAWRSSASPPTPRAPASTT

SEQ ID NO: 145680 - protein, 53 aa, Triticum aestivum
  Clone ID: PAT_TA_40098.pep
MIRCTALQVTVGGIMWVQVKDNNNPSHSWALAIVVLICVYVSSFPWSWGPMGW

SEQ ID NO: 145681 - protein, 66 aa, Triticum aestivum
  Clone ID: PAT_TA_40099.pep
NNSRCVGFPPLAQTWTLAGAPVEYNNCLLQSKRLSKLKMLLGLLQLMWCECENYFSEEFKHFKSTI

SEQ ID NO: 145682 - protein, 69 aa, Triticum aestivum
  Clone ID: PAT_TA_40100.pep
TTIGSNINSAAHPTTHGLGDATRHIHQLLLHLHMDQLLQLPYLYIRVYILALIITYTLPLVLGPHTLTH

SEQ ID NO: 145683 - protein, 47 aa, Triticum aestivum
  Clone ID: PAT_TA_40101.pep
KDWPGHPASFFFLFPIFFSQAKNGRGVKRFFLRGLIYMPRVGEINLS

SEQ ID NO: 145684 - protein, 54 aa, Triticum aestivum
  Clone ID: PAT_TA_40102.pep
PFLFYYRSNNHHFCRPCYCGSCRRKKCHCALLHLRFCLKRVKCHVLSVIMKKLH

SEQ ID NO: 145685 - protein, 77 aa, Triticum aestivum
  Clone ID: PAT_TA_40103.pep
KIHSGTASLATAPPPNPLMVPQPAASPSSVAAPHLCQLLLFPTPLLLVLASLLNLKLSLSLSLSLSLSLSLSNCCKL

SEQ ID NO: 145686 - protein, 44 aa, Triticum aestivum
  Clone ID: PAT_TA_40104.pep
TRAVDHSGSKHNKSQVYSSWQQPIFHNFQPYKILNTTLFIVTIT

SEQ ID NO: 145687 - protein, 52 aa, Triticum aestivum
  Clone ID: PAT_TA_40105.pep
AYRSRAAAPSFFARFKYGHGEKLERGSFPHDPPPQQITPPDFFLLNIQYELM

SEQ ID NO: 145688 - protein, 49 aa, Triticum aestivum
  Clone ID: PAT_TA_40106.pep
TISFSIFVMVILPNKLCQVYYVHERSMYSIFVLELPQAACTVCVIDSVF

SEQ ID NO: 145689 - protein, 38 aa, Triticum aestivum
  Clone ID: PAT_TA_40107.pep
VIQRKSSQTPRGVLKIPPTYHSPRFMIQGHKSQTPRLL

SEQ ID NO: 145690 - protein, 87 aa, Triticum aestivum
  unsure (1)..(87): unsure at all Xaa locations
  Clone ID: PAT_TA_40108.pep
MRVILHIQGGQSGNHIDSKFWEVECDEHGINPTGRYVSTYDHQLERVNVYYNVAYSGLFVPXAVLMDLEPVYLDSVRTGPCCLILMY

SEQ ID NO: 145691 - protein, 124 aa, Triticum aestivum
  Clone ID: PAT_TA_40109.pep
TFKADFLDGVPVALPFDEQNLSFFILEVITDDYAVFQFPMRLDSLYCCGFRCLDLCDNPLEKLWYSFGKVSILPKRLFKNRKKSGLSLAYNNFRKIQIFAGVIAKFCDHFRGFRPVDSADDDLV

SEQ ID NO: 145692 - protein, 93 aa, Triticum aestivum
  Clone ID: PAT_TA_40110.pep
SDLFLAPPRRSCLNEHDCPLFFRSESNGPPNFGSLGIVHRPCTFFLIIFLLSLTGPLGFVCNAPIIIGLKGCRTKTLVHVTIYSFINKSHHGS

SEQ ID NO: 145693 - protein, 113 aa, Triticum aestivum
  Clone ID: PAT_TA_40111.pep
NAQLRTVDLTGRRQPHLDRNYRRTAGGTVSSSGGSRTLKQPAGGPDGAGRATVRGGAGDGTGRRRTRRVAGDGTGQRRTGRGVVTGARDVAGSPAGGANPRSAGSSGWTGRGR

SEQ ID NO: 145694 - protein, 73 aa, Triticum aestivum
  Clone ID: PAT_TA_40112.pep
LNVSFFIFFVIYFYFFFFGRNISKMAFDKKNPGVTGAKTINWGSAHTHTEWFVFLGGDCQTKEIKFHQTGALK

SEQ ID NO: 145695 - protein, 111 aa, Triticum aestivum
  unsure (1)..(111): unsure at all Xaa locations
  Clone ID: PAT_TA_40113.pep
RSRTRPRNPPTLRPSPSGLPPXPGAGPGPPPFPWPTATNRPPTPPTIGPPTPWASGRHPRLEPPTGRQPGXPRMTRPPATTSSSPRRSSTPSNHPRAPPSHFRRTRGHRAP

SEQ ID NO: 145696 - protein, 73 aa, Triticum aestivum
  Clone ID: PAT_TA_40114.pep
TKVQRSELTISVRLTLEPQGKRRATCPGELRAVLPMTHTSVCVMKDAPRAIPYPRQGFGVHRKCKSGAAHASA

SEQ ID NO: 145697 - protein, 61 aa, Triticum aestivum
  Clone ID: PAT_TA_40115.pep
INCPRPPPCAYSWCILGLPNLMKKINCKEQCPGPALPSIPTQFFKIYLAKIYGAPGHGFFC

SEQ ID NO: 145698 - protein, 66 aa, Triticum aestivum
  Clone ID: PAT_TA_40116.pep
PSPWPPPPPWPAGCSPAPPPATRPPPAYSYPVASTPTRATRAPRQAAANEMLKPAGEPLSENYFLR

SEQ ID NO: 145699 - protein, 60 aa, Triticum aestivum
  unsure (1)..(60): unsure at all Xaa locations
  Clone ID: PAT_TA_40117.pep
ERVRRWAPDRQDRFVRRFADALAHPKVSHXLRVIWIDFLSKCDKSCGLKVVNLLYVEPFM

SEQ ID NO: 145700 - protein, 62 aa, Triticum aestivum
  Clone ID: PAT_TA_40118.pep
DAWVLLRFTRCLVPNVHKSARRASKMSLVTHVQVYVTHTLSDIDRARGLDLITVWRACTNGQ

SEQ ID NO: 145701 - protein, 53 aa, Triticum aestivum
  Clone ID: PAT_TA_40119.pep
MPEPNPAVDDVLMDASKTAVHTAVTTALCNAISDVPYGPPTSAGTTALNATFD

SEQ ID NO: 145702 - protein, 55 aa, Triticum aestivum
  Clone ID: PAT_TA_40120.pep
NPEISTHAYDHAKNQRKNLICYRCDSRSDSLRKYWPNLWPHDTFHDSDYCKVSYE

SEQ ID NO: 145703 - protein, 46 aa, Triticum aestivum
  unsure (1)..(46): unsure at all Xaa locations
  Clone ID: PAT_TA_40121.pep
STCGPYXNLNKACLLLYYPYFYFIYTLLYLPFIIQFPQNSSTFKRF

SEQ ID NO: 145704 - protein, 146 aa, Triticum aestivum
  Clone ID: PAT_TA_40122.pep
SSSLVKTYPDIGELAFGRKGRIIVAIFMYLELYLVAIDFMILEGDNLEKLFPSVDFHVAGLKIGGKQGFVLIFSLLVLPTTWFRSLSALAYVSVGGIMASVILIAAVIWVGAFDGVGFHERGVLVHWAGIPTAMSLYSFCFSGHAV

SEQ ID NO: 145705 - protein, 108 aa, Triticum aestivum
  unsure (1)..(108): unsure at all Xaa locations
  Clone ID: PAT_TA_40123.pep
VFCYKDIYLFLKPPHSWCVYERGMTDHYHPNNATHTRIKDKIQLVNGLPYIIITRLCHQATKDADFHVPHVNDLALNFSXPCYLPFYPSHFSFTXFRLTTVALIITHN

SEQ ID NO: 145706 - protein, 42 aa, Triticum aestivum
  Clone ID: PAT_TA_40124.pep
LFLYFWYSLILCGFQWVDRQGPREKTFFLNPLISSTASPGIF

SEQ ID NO: 145707 - protein, 109 aa, Triticum aestivum
  Clone ID: PAT_TA_40125.pep
MGEASEYDGVDVAAVSARLLELVADDDVTALVDLLAAHPLLADEPAPWYSPARGAEPMTPLMVAAAYGSVACLDALLSPAHLADPNRSSASSLSTPLHLAAVGGAPSAP

SEQ ID NO: 145708 - protein, 99 aa, Triticum aestivum
  Clone ID: PAT_TA_40126.pep
TPYPTLPLPYHTPHLLQLVPPTGWRLRQFLLPFRPTPPAYPPFITLAMDEEAEPLPATNHGLPLLFLGRLFLIKALRADGMSVQKNKSCPLCPSTTEKR

SEQ ID NO: 145709 - protein, 83 aa, Triticum aestivum
  Clone ID: PAT_TA_40127.pep
WGIEWAATSTGGTDLLFFSHHIPVQQIRCISGRVPTNAVIRYWKEGRHRSFLAVSGVHYAHDNMVVETDEKNQPISVSRILMA

SEQ ID NO: 145710 - protein, 131 aa, Triticum aestivum
  Clone ID: PAT_TA_40128.pep
LKVRWDEPSTIPRPDRVCPWKIEPASSPPVNPLPLSRVKRPRPNVPPVSPESSVLTKEGATKIDMDSAQAQQRNQNSMVLQGQEHMTLRTNNLTGSNESDATVQKPMMWSPSPNIGKNHASAFQQRPSLVI

SEQ ID NO: 145711 - protein, 72 aa, Triticum aestivum
  Clone ID: PAT_TA_40129.pep
AGSRWSARLITLPTPPKGLSRRPPSPFATNQLWMDTYIRTYVRTVMIQGVSRTKVGRKRRGIHRSIDWVTWE

SEQ ID NO: 145712 - protein, 137 aa, Triticum aestivum
  unsure (1)..(137): unsure at all Xaa locations
  Clone ID: PAT_TA_40130.pep
DGTPRCCSCERMEPRESRDVLLDDGRKLCLECLDSAVMDTNECQPLYLEIQEFYEGLNMKVEQQVPLLLVERQALNEAMEGEKTGHHHLPETRGLCLSEEQTVSTILXKPRLTGNKIMEMITEPYRLTRRCEVTANS

SEQ ID NO: 145713 - protein, 94 aa, Triticum aestivum
  Clone ID: PAT_TA_40131.pep
VVSWRNGNDCPALCSGRIKCAGTPSVDWVSPLYVSSLHLDWSSVHACLRVSSWSFYSDRLYWLLLLQTCTIQSGHALVSSPQGGICISILECFK

SEQ ID NO: 145714 - protein, 59 aa, Triticum aestivum
  Clone ID: PAT_TA_40132.pep
PRTFSFFLPKKNPFFFNRYQFSPTFPYNILLFYNRVKLKYFNQNDIFFKLYHFLTSHIS

SEQ ID NO: 145715 - protein, 122 aa, Triticum aestivum
  unsure (1)..(122): unsure at all Xaa locations
  Clone ID: PAT_TA_40133.pep
ASLTVVNVGPGFRDQYHSFPPNSPFRFLKINPXAGAPQTNHSYNIGKQKAGDSIVDWFGLGRLQRLVFPLTRQAAGIDXMYAGMLPRXEKLSREVEKSNHRVLDQEKRNPLMRCKTPGLQLQ

SEQ ID NO: 145716 - protein, 77 aa, Triticum aestivum
  Clone ID: PAT_TA_40134.pep
KKMGGLNPKKDRKLRPHKKGTNLTKFKRRLNRNLFGTSICGKKRLLPNKLKKKIKKFQHRVWEEPEKRNLGTLSGAN

SEQ ID NO: 145717 - protein, 98 aa, Triticum aestivum
  unsure (1)..(98): unsure at all Xaa locations
  Clone ID: PAT_TA_40135.pep
SSXLLLHQLFLHTPLNITNPNLHILILSTNKQNHITTSTTSFKTFFSLLLQISHITNTLLYYPYSSYPLTLLYNFFLMYLSSSITPFFQHHFILIILL

SEQ ID NO: 145718 - protein, 115 aa, Triticum aestivum
  unsure (1)..(115): unsure at all Xaa locations
  Clone ID: PAT_TA_40136.pep
RISLVGLGVRPLVRSVAAITLYTVTVXCCGEHHLEGDVKFSYLLEMMRSNFTFTDTIVTVTVPPLHPFXIKHLNAFDFNMNKMPYFSMTLAVFALFSDVPTAIIDVASWRVKETD

SEQ ID NO: 145719 - protein, 68 aa, Triticum aestivum
  Clone ID: PAT_TA_40137.pep
PRSLFRVHSTLFGNPVLNTSPQKVCFFSRRDTKNSPPVHFLHTQTRHPTFNHTTTGKAFVCFSSLYSI

SEQ ID NO: 145720 - protein, 105 aa, Triticum aestivum
  unsure (1)..(105): unsure at all Xaa locations
  Clone ID: PAT_TA_40138.pep
MARGLKKHLKRLNAPSHWMLDKLGGSFSPNPSFCPHMXEECLPLILILRNRLKYALTYREEQSFLIPADIIVDGKVHTDKTYPAGFMDIIFIPKTGENYMLLYYT

SEQ ID NO: 145721 - protein, 109 aa, Triticum aestivum
  Clone ID: PAT_TA_40139.pep
IKNQSFVSMSGGGSGAAPGAESGGAGDSIRRLHDRLESMLPRVEALAADRARVEETNRAQHELLGALYAHLLQAEASRDRWKALYCDLYRCSNPTLPTLKERRGGFPSL

SEQ ID NO: 145722 - protein, 78 aa, Triticum aestivum
  Clone ID: PAT_TA_40140.pep
TTTIHIKPGQAYSFARKKPATGFGFTTNKTSCWPIFGLITWPIPNPYLHATYKFYKPPRALGKRGAVFSFNTRPAGCR

SEQ ID NO: 145723 - protein, 76 aa, Triticum aestivum
  Clone ID: PAT_TA_40141.pep
DVDSPEQVSRHETLRMKRRHIQQDSDGKSVSTWKTTLGCVWGSKLQNSTTRQGTKQMFQHLAILLQFVDGTEGNPR

SEQ ID NO: 145724 - protein, 60 aa, Triticum aestivum
  Clone ID: PAT_TA_40142.pep
GARQGTGGRWVGGQIFQYVVLDKNKGGEGRGGGGRHKWRSFQMSKKTAVPVIKQLPPSSF

SEQ ID NO: 145725 - protein, 38 aa, Triticum aestivum
  Clone ID: PAT_TA_40143.pep
SSHNPILSHLASILYKTSITSPFHFIHYTYYNILTLLT

SEQ ID NO: 145726 - protein, 142 aa, Triticum aestivum
  Clone ID: PAT_TA_40144.pep
EVLLLASCADRLLPSKSEANRLQKKLPKCRVFFFEKHGHSLLLVSFFKQTLSPLLNLQLLWTYDDIRSVPFGGKLLRAYSNHLKLRDTQEVILPGAVPKIPGRFYYRFGKPIPTRGRQDVLTDRRAATELYFDVKSEVEEII

SEQ ID NO: 145727 - protein, 138 aa, Triticum aestivum
  Clone ID: PAT_TA_40145.pep
PAQHCAPCFDHNHRRTRPCSPAAAATTDAGEFSPPPPLPLWIRRPRSSSAAATTSAHSSAAPSSMPRPPRHLVLLTRSRRRSWSWSGSARPSAAPSSSSTPRPPSLLLPLTRRPGNWSGSRALRTRTSLRPKRWWRRK

SEQ ID NO: 145728 - protein, 56 aa, Triticum aestivum
  Clone ID: PAT_TA_40146.pep
VKAGIIDPLKVIRTALVDAASVSSLMTTTEAIIVEIPKEDKAAPAMGGGGMGGMDF

SEQ ID NO: 145729 - protein, 79 aa, Triticum aestivum
  Clone ID: PAT_TA_40147.pep
PQKLEHGPEQDHRRRAAPDRRPGGGRVGAESDRLRLLRRLLLALRQRRQGGPSLHQNVRRGMRGHRQSRGRGRRVCQPI

SEQ ID NO: 145730 - protein, 42 aa, Triticum aestivum
  Clone ID: PAT_TA_40148.pep
MNSGFALHSLIFISTCHTHTYGSVIYVRRSGFIIISNGIVKT

SEQ ID NO: 145731 - protein, 115 aa, Triticum aestivum
  Clone ID: PAT_TA_40149.pep
MSRGGVFLGVDVGTGSARAGIFDEKGKLLGSASSPIQIWKEKDCIEQSSTDIWLAVCTAVKSACSLANVAAEDVVGLGFAATCSLVAVDTDGSPVSVSWSGDARRNIIVWMDHRA

SEQ ID NO: 145732 - protein, 94 aa, Triticum aestivum
  Clone ID: PAT_TA_40150.pep
HTTKKPYSRAIVGATMKAIQKKRAETPEVRDANKKAAMPEIKDRIKKTNVEKNAEKVKVTKDEKSHGGKGATQNDSTDPNIGAGHKKRKKLITP

SEQ ID NO: 145733 - protein, 62 aa, Triticum aestivum
  Clone ID: PAT_TA_40151.pep
KKHARFFTAGTIDKRWGRPSHIYMEPGIMKSIKNINFQHWRERDSVPMMHPPTGLQIKDKSK

SEQ ID NO: 145734 - protein, 48 aa, Triticum aestivum
  Clone ID: PAT_TA_40152.pep
ISYHIEGGGLLCEKAKNENRSVLPRRARPFCKHYVKPNAGATRCASTP

SEQ ID NO: 145735 - protein, 108 aa, Triticum aestivum
  Clone ID: PAT_TA_40153.pep
QARMHCSCSLSHRPLSATTLPSSSASPARPTTYTGFGCNHGASFCQPLACFLFLDNSLLLMLMICLFYGYEGYATDSSNPLSINSCKLSHLTPENYSPQDMKNPAGAS

SEQ ID NO: 145736 - protein, 45 aa, Triticum aestivum
  Clone ID: PAT_TA_40154.pep
KLPSQREVGRTRSRFFLYRPGIVKVKIALFPGALCVQANSPRGLV

SEQ ID NO: 145737 - protein, 115 aa, Triticum aestivum
  Clone ID: PAT_TA_40155.pep
MSSSSDLSSGGSDSDEEFGPPVATQSLPTLQIQSLRIRDHVMVTLDFEKENYGLWRRQFLDALAKFGLTHHVDGSPAQATSDWVLADFAILSWYNATVTPSTLEIVADRKDKAYT

SEQ ID NO: 145738 - protein, 90 aa, Triticum aestivum
  Clone ID: PAT_TA_40156.pep
MAQAVEEWYRQMPIITRSYLTAAVLTTVGCTLEIISPYHLYLNPKLVVQHYEIWRLVTNFLYFRKMDLDFLFHMFFLARYCKLLEENSFR

SEQ ID NO: 145739 - protein, 50 aa, Triticum aestivum
  Clone ID: PAT_TA_40157.pep
QVDELYPDQNLCSRVSILNTAVSPKFSSDPTIHESAEDIWLYRERSTSPE

SEQ ID NO: 145740 - protein, 58 aa, Triticum aestivum
  Clone ID: PAT_TA_40158.pep
PRISTMIRTYAQESLSQTHRSLQSSRIDPHDPCVHQRQYSNRNPQHALNSSRSLQKPC

SEQ ID NO: 145741 - protein, 58 aa, Triticum aestivum
  Clone ID: PAT_TA_40159.pep
PNRNSGGDARVRAHPRARASLLPPEEEKTGGGDKERELYIITRILTAKRKTSSSSVTE

SEQ ID NO: 145742 - protein, 148 aa, Triticum aestivum
  Clone ID: PAT_TA_40160.pep
SRKMTVIGTVDPVDVVSKLRKGWAAYIESVGPAKEPEKKEEKKEEAKKEGGDGAKKEGGDGGDAKKEGDGKKDGDGKKDGDGKKEEGDGKKDGDGKKDGDKKEEGDGKKDDQKKPCAGAPLPYPHHMPMPHHMPPSYMFNADYMMNQY

SEQ ID NO: 145743 - protein, 59 aa, Triticum aestivum
  Clone ID: PAT_TA_40161.pep
NSIGPTIPSLFHYAELRTPVAHLCHSYPVKKRADKFLSRKPDVPALVQSCTNTMNGHIL

SEQ ID NO: 145744 - protein, 51 aa, Triticum aestivum
  Clone ID: PAT_TA_40162.pep
HTCDDAWSLLCNLFSMGGGRSMWEYNIYNLPIMLMLPPKPLSPVQDITART

SEQ ID NO: 145745 - protein, 118 aa, Triticum aestivum
  Clone ID: PAT_TA_40163.pep
RPFPARPRCRHRPSPAPPRRRRPSPPAPRRRSWSLPPLRRRRDPCPLRPPPVLLQWHDRHRAVLPCPSGTAVVGSTTAGSLLRIRRHWLPPKWGTTFPFAPPHAVGRKLELAGESTDT

SEQ ID NO: 145746 - protein, 86 aa, Triticum aestivum
  Clone ID: PAT_TA_40164.pep
VFGFFFFFFFFFFFFFFLGQKSGLFSVSFLKGHSEKIKEGFVLAGKLASWAIFGMTSGRRGLVSAYQAPMSASSLGGTGACTLLNL

SEQ ID NO: 145747 - protein, 89 aa, Triticum aestivum
  Clone ID: PAT_TA_40165.pep
DQYYFQPIYTEDSNGAANVGNLLVPCSYQCPACLHGESVSTKVTSFAVVGHGRHWDQFKKNKHKLKDSDSSEIKLCRVMVQLILTILCT

SEQ ID NO: 145748 - protein, 63 aa, Triticum aestivum
  Clone ID: PAT_TA_40166.pep
AITKTDAHLSYCCGTKTGPAQVCGVNAISKPLLNRADCDYGRLHMSSMLHDTVFNCKALNRTV

SEQ ID NO: 145749 - protein, 53 aa, Triticum aestivum
  Clone ID: PAT_TA_40167.pep
AHAYAYTFILSTIQFIILLCETKGRAQSIVDQTYNWNSYRLARAPYFGKQLKD

SEQ ID NO: 145750 - protein, 51 aa, Triticum aestivum
  Clone ID: PAT_TA_40168.pep
LRQIIKMVMIIRVDQLSRGCKIMSVVAKCFDLHLVIPSPFETNVNDKNFYI

SEQ ID NO: 145751 - protein, 138 aa, Triticum aestivum
  Clone ID: PAT_TA_40169.pep
MGDASTSAAPATPTSTLICLEDGNDLFLDDDSPDGGLADSRLAADDGLLLLDRDDEYVALMLSKEGAGGGGTWGEELDEWTKAARAVCVDWIVKTNARFLFSGKTAYVAVTYLDRFLAQRRVDRGKEWALQLLSVACL

SEQ ID NO: 145752 - protein, 44 aa, Triticum aestivum
  Clone ID: PAT_TA_40170.pep
FFNIKTRELLQFEMAGNAYETCFASKGKIKYTLRGRRPPMVPGE

SEQ ID NO: 145753 - protein, 49 aa, Triticum aestivum
  Clone ID: PAT_TA_40171.pep
FHYWSHNLWNISTESVICTWLIFQHKDFWIATILDGCQCLLDSLCFLRG

SEQ ID NO: 145754 - protein, 79 aa, Triticum aestivum
  Clone ID: PAT_TA_40172.pep
ARRVRKNLLNLPPIIYFFATTATWEGVLAVRLISYLGLASLTLGFACRAMCRPSREGRLALLLTYAKATTILSRRSLMV

SEQ ID NO: 145755 - protein, 50 aa, Triticum aestivum
  Clone ID: PAT_TA_40173.pep
GKQSHYYSSPTLIECPMLRLEILGLTQQSLTSRRKTCIMCRTKSRCANRR

SEQ ID NO: 145756 - protein, 96 aa, Triticum aestivum
  Clone ID: PAT_TA_40174.pep
RRRVGLCFRIRVRQPITRRKTDMGRIGITLLALLEDAEAVARLSAPVSEGEQDYMLLKRAGTFNGAGWRVQGGLRTKRWARAPTAPARPCAGCWRA

SEQ ID NO: 145757 - protein, 83 aa, Triticum aestivum
  unsure (1)..(83): unsure at all Xaa locations
  Clone ID: PAT_TA_40175.pep
KKLINPRAAPIFFSGDGGGGGGGGSLAXLFLGLRISTRRIWLPGGVRPLGKPGGPFSWLSQNQVQSHPAGASSFASSGGTGLG

SEQ ID NO: 145758 - protein, 149 aa, Triticum aestivum
  Clone ID: PAT_TA_40176.pep
QPPPSLTRSSSGNGDGGSRARVLPPATRLLSPPIPNPDVSAHTPVAPTNHSDGGSGHRGGQRISCTGDGVRGGGGGRGCDASVMSRVQQVATRSGRAQESMRVVAVSKTKPVGVICGVYDADHRCFGENYVQELIGKAPQHFPLIMFRR

SEQ ID NO: 145759 - protein, 140 aa, Triticum aestivum
  Clone ID: PAT_TA_40177.pep
LVNSPPATMSRTTVCARPPACLPLVMTKYKGRRPCTVVGAPSAVQPAGNTIVSGLVDTHRSTRRHLGRHPFYLHPRRRLGEAPPHHEVSFAVVLPVHGGAMGWPGLGDMVRSTRRRRSGARQVTSPHRNHGGRAALDESP

SEQ ID NO: 145760 - protein, 72 aa, Triticum aestivum
  Clone ID: PAT_TA_40178.pep
IGWRPYMVPSQTDACRIVHTRCCWGQAEHRTVLPITVHGGRPLNLVIPSDRYPGPRAHTVVWLIVTGGEFNK

SEQ ID NO: 145761 - protein, 61 aa, Triticum aestivum
  Clone ID: PAT_TA_40179.pep
CENVTSVSHVSVGRLPLRALNTPTFYKYKVIDKISTFLFLVTTGVRAATCLLLVISVHLSW

SEQ ID NO: 145762 - protein, 49 aa, Triticum aestivum
  Clone ID: PAT_TA_40180.pep
FHLKKREGIHFQLNKQRPFFLSPRCAHNMSIELKLITTHLNKFPPRKRK

SEQ ID NO: 145763 - protein, 50 aa, Triticum aestivum
  Clone ID: PAT_TA_40181.pep
GSSKARLAPRARARSGRPRKGAPCSAHIYVWSGDYLPPLSISLFPQKLDS

SEQ ID NO: 145764 - protein, 93 aa, Triticum aestivum
  unsure (1)..(93): unsure at all Xaa locations
  Clone ID: PAT_TA_40182.pep
MAKEVSEEPEHAAPAHKDYSDPPSAPLFDMGELRMWSFYRAIIAEFVATLLFLYITGATVIGYKVQSAADPCGGVGVLGIGXAFCGMIFXLVY

SEQ ID NO: 145765 - protein, 102 aa, Triticum aestivum
  Clone ID: PAT_TA_40183.pep
MAFHRQRTLCFTTIATLFLLHHIAAASSSLVQEHDRWALLQLMNGLSSGCGDVPGYWSPDSGVQHCSWKEVRCDMRSRVVAISLPSQPSRRLAGVLSPAVAG

SEQ ID NO: 145766 - protein, 94 aa, Triticum aestivum
  Clone ID: PAT_TA_40184.pep
GTKAARNMCTGRSARSRASSSSGPSSAPLTRAKAPKGTAAMATMLLTASWYSRLSCTDELMLTARSVSLASALGAALALWPRGGVAPTRPPTRP

SEQ ID NO: 145767 - protein, 70 aa, Triticum aestivum
  Clone ID: PAT_TA_40185.pep
MQGPPGLRPPAPFYPGGYPPPPGWPGYPMPFVPVQGYGAPPGAYPQPGGYPPAGYPQQHGHSAASWLCRP

SEQ ID NO: 145768 - protein, 126 aa, Triticum aestivum
  unsure (1)..(126): unsure at all Xaa locations
  Clone ID: PAT_TA_40186.pep
MRAQMLGPPPPPPPLRSGPPPXAGSKPPSPKPSKSETKPAPTKATPSXPVQRKPLRQRWPFWPPWPMRPKPTRPKPLLRRPSHLIARKPRLPCPSKINSNPKAKSKPKPPCPWSAIVFVSTTISTN

SEQ ID NO: 145769 - protein, 90 aa, Triticum aestivum
  Clone ID: PAT_TA_40187.pep
FSNGLELLSEQASLEPITLHYKILSISCPKVLQNPTAYLFRAGGLLKWLGRAKLPGTTASSSAIALSRLCSSPASSLSSFFSNSSLSLVS

SEQ ID NO: 145770 - protein, 101 aa, Triticum aestivum
  Clone ID: PAT_TA_40188.pep
MCFLVTWPSHHSIVRLMCSKYRRPISCNFNIISIDLARYLNGSLLPEYLIFFMSALHFIIKIYVSKLVRARPKRIKHTTAFLINFIAVMFSCHRRGALAQR

SEQ ID NO: 145771 - protein, 33 aa, Triticum aestivum
  Clone ID: PAT_TA_40189.pep
LFLEKSYISGVHTFDHPPFIPNQYFLFHPKENC

SEQ ID NO: 145772 - protein, 130 aa, Triticum aestivum
  unsure (1)..(130): unsure at all Xaa locations
  Clone ID: PAT_TA_40190.pep
GMTGCEEYILITNLHTRFRINQCGLPMTYYTAVLGMPGLTDYSGLWDPDTPHRVDCVFISATLGAVHKLVVQLVPICLCQLLXSLGFXDNVILIKTNLGFDYSFNYMMEXDLNATLLWCFPXGIDIYYDN

SEQ ID NO: 145773 - protein, 85 aa, Triticum aestivum
  Clone ID: PAT_TA_40191.pep
TGLTLEGMKVIHVVSQGEPSGTRPSGWREWCMLTSMYRPICFTRTRIPRTLMWPLSFRSLGLDAATIGSKTIFCGGATSPPAGSA

SEQ ID NO: 145774 - protein, 82 aa, Triticum aestivum
  Clone ID: PAT_TA_40192.pep
VLRSCAGGDGETTTTTTTPPGHLLRDACWQEAGLEEAVLDGCKPVHVSCGIVSPGAEEGIVVVMQAGGGAELLISATVPSGK

SEQ ID NO: 145775 - protein, 39 aa, Triticum aestivum
  Clone ID: PAT_TA_40193.pep
FLQPYDRMFTFFFFDITYELVMLNDELTVSHHCAKLLMA

SEQ ID NO: 145776 - protein, 89 aa, Triticum aestivum
  unsure (1)..(89): unsure at all Xaa locations
  Clone ID: PAT_TA_40194.pep
MAAPRPQPLLLLLLVALLVASGPGRADAWGKEGHIMVCKIAERYLSKEAVAAVQHLLPDSXAGEISTICPRADTICFCYHSGRALYYSN

SEQ ID NO: 145777 - protein, 58 aa, Triticum aestivum
  Clone ID: PAT_TA_40195.pep
NLYQAVPFPCEYTELLHPSVFIWCTFSFLKPHGRVGYRSTADCTIALSIPLTIHCTTT

SEQ ID NO: 145778 - protein, 46 aa, Triticum aestivum
  Clone ID: PAT_TA_40196.pep
LRLRYRTRNCDPRVRVRLWLVMNEQHLVIAIVTRADPFHTSKPSQE

SEQ ID NO: 145779 - protein, 58 aa, Triticum aestivum
  Clone ID: PAT_TA_40197.pep
KKNVGKNWNQITPPGGGPNYLKSSRNRDRKTSLAGGLLRTCGPLEPLGGFAFCFLRAL

SEQ ID NO: 145780 - protein, 75 aa, Triticum aestivum
  unsure (1)..(75): unsure at all Xaa locations
  Clone ID: PAT_TA_40198.pep
WLHLLPQPLLLLLLVALVAASAPRRADACGMEGHIMVCKIAXRYLSXEAVVAVHDLLPESVGGELSTMCPWADTM

SEQ ID NO: 145781 - protein, 68 aa, Triticum aestivum
  Clone ID: PAT_TA_40199.pep
KDNPQQDVHGLAPIQYGLLKTGLWPAPTPNQGPRGLIYTTDYTLYNNLNILLVDTTTRAIQGKNRKPQ

SEQ ID NO: 145782 - protein, 121 aa, Triticum aestivum
  Clone ID: PAT_TA_40200.pep
HASGKSPSLSPIFLSHITRARRAPPPRRAPTGPAPPRPTSPAPPRRLFFPFSTTSVTQSDHPAVGTMSSRGSDCRHCRRLHATSSCSLMQLSPTSTTPTRLSLTSYSPTATSSPTPGVLRR

SEQ ID NO: 145783 - protein, 91 aa, Triticum aestivum
  Clone ID: PAT_TA_40201.pep
ASRSSSRWQWRGQQWRQSDQSKDIVTTAGMERLGHPCGREGDKKPTRRSRAGRARWSRAGRGTKGWSRAPGPAPRGTARLGRERGIFRTRG

SEQ ID NO: 145784 - protein, 80 aa, Triticum aestivum
  unsure (1)..(80): unsure at all Xaa locations
  Clone ID: PAT_TA_40202.pep
TSSSFSKMSIMNSFINDIFELLEDVVXKLAGESAKLARYNKKPTITSREIQTSVRLVLPGELAKHAVSEGTKAVTKFTSS

SEQ ID NO: 145785 - protein, 126 aa, Triticum aestivum
  unsure (1)..(126): unsure at all Xaa locations
  Clone ID: PAT_TA_40203.pep
QRSPLQLRAAAPMPLAAAYCMGGYRCEEEXAPWPAPQPGPTRDVSPSCRRMDARDDAVATTSAANACAIVSLMPPSEHHPPPQPSPSALDTAIPEIQPPSGRRWNVVAGDVREISDPFFPDREVLS

SEQ ID NO: 145786 - protein, 41 aa, Triticum aestivum
  Clone ID: PAT_TA_40204.pep
SSGAYMARGGKAETTTVFFERGGGTRGQKAPITLPGGDCRR

SEQ ID NO: 145787 - protein, 81 aa, Triticum aestivum
  Clone ID: PAT_TA_40205.pep
MDAAWACAVDRAAGAADSTRRFFLSRRPPAGPNPIDILKRLQRQAFHDIMQLKDRQEKVEKGLTLFKAHKTGPFAEESTRV

SEQ ID NO: 145788 - protein, 79 aa, Triticum aestivum
  Clone ID: PAT_TA_40206.pep
DMEISHNLDCSSQRCWDALFCKQQLLPSSSIDQENQNLHKFMLRCRRVYKHEVKSMSVAHGTRVYTAVAACSARSSVNS

SEQ ID NO: 145789 - protein, 58 aa, Triticum aestivum
  unsure (1)..(58): unsure at all Xaa locations
  Clone ID: PAT_TA_40207.pep
KATEIFEEIARQSINNNLLKYNGRSHXLLNAGTCHLFKADAVAIQNSWERYQEIDPTF

SEQ ID NO: 145790 - protein, 50 aa, Triticum aestivum
  Clone ID: PAT_TA_40208.pep
SEIFYCAWNKKTRLVDSVGPGKYSVRGILLNAGEVATFKRSNFSYAKFRG

SEQ ID NO: 145791 - protein, 45 aa, Triticum aestivum
  Clone ID: PAT_TA_40209.pep
DAWAEVMVVPNQMSAALNEYYSAGFRPYLKRAIKRLWKGSCYGDI

SEQ ID NO: 145792 - protein, 51 aa, Triticum aestivum
  Clone ID: PAT_TA_40210.pep
YRCFEVCLACATDYHNLNEALQQYGPIFVANIINHRLTCMIQDLFFFTFEN

SEQ ID NO: 145793 - protein, 66 aa, Triticum aestivum
  Clone ID: PAT_TA_40211.pep
VLVGPQSPRCLFMQGRPDEAGSVLRKVCNTVGEAYLRLADIKSASVFVEGDAVFVLAPFSCGKGVL

SEQ ID NO: 145794 - protein, 63 aa, Triticum aestivum
  Clone ID: PAT_TA_40212.pep
MADRANHPSVMQKFGGQFHLSFSFFEGVRARNICPSLPFYLRRLPQACYMTYNSFHLCPNDVH

SEQ ID NO: 145795 - protein, 79 aa, Triticum aestivum
  Clone ID: PAT_TA_40213.pep
FGWWCKIFLRFSMIIFQIHSLKPEVIPIAHFYLRAMLFLNLNFWLWFGKRDGKFVFWQGIFKGPNGLNLKTWLLLPAEL

SEQ ID NO: 145796 - protein, 44 aa, Triticum aestivum
  Clone ID: PAT_TA_40214.pep
LDERRVENERGVTVCLMNHIIRVRQFPKKKRKTMFPGPSAALIS

SEQ ID NO: 145797 - protein, 67 aa, Triticum aestivum
  Clone ID: PAT_TA_40215.pep
KSSLPCFVLGCRLWAVSPAFCRRPTKSSKWLSVRAREGAAITTTRKDGSDGHGGLHPRFFLLAKLEK

SEQ ID NO: 145798 - protein, 50 aa, Triticum aestivum
  Clone ID: PAT_TA_40216.pep
VISLFLVCFVRNVRCFSFFYCSFVYFPSSQSRAPVSRRLVEKKPLSLLLC

SEQ ID NO: 145799 - protein, 49 aa, Triticum aestivum
  Clone ID: PAT_TA_40217.pep
ASTTAILVPCIFRKLYSLTCLFLVNPLIRHAQTMVFVPFSDNSPPLTSM

SEQ ID NO: 145800 - protein, 59 aa, Triticum aestivum
  Clone ID: PAT_TA_40218.pep
CDDLHADLLYRDYCTHQKVTLTTCTPGGVAITAAGTRKNESIFGELQTQLKNKNLAGDI

SEQ ID NO: 145801 - protein, 122 aa, Triticum aestivum
  unsure (1)..(122): unsure at all Xaa locations
  Clone ID: PAT_TA_40219.pep
LTRPATRAATRAVTGRVTFGVIRVGDNIHGLRMTDERIHKIDAGMVVMLIKNTGTSMAVIEAAGAADILTMAESSGPAVVHTVANPPATTAMTAGEXDPPTIAMTFAENDSPLAGQHVTHVT

SEQ ID NO: 145802 - protein, 99 aa, Triticum aestivum
  Clone ID: PAT_TA_40220.pep
AISVSARSTFLHSMASTTAAHLGVEGVPNNWFIIARKPNGLRERANRRHHLPLELNDPPEGTSAIGDLNADRHTHAYAVVPKHTQCYLLADRDHALRTS

SEQ ID NO: 145803 - protein, 136 aa, Triticum aestivum
  Clone ID: PAT_TA_40221.pep
MAALFTAKLGRQASGYLQDKYKQARLALGDVTPAELAVQEATNDDACVPDAKTLASIAEAAFDIDDYWRIANVLHRRLGCVHDWKEWRPVYKALVVLEFLLTHGPEELPGDFLPDMQALRDLRGFTYTDDKGFDWG

SEQ ID NO: 145804 - protein, 35 aa, Triticum aestivum
  Clone ID: PAT_TA_40222.pep
SFSFLFGGLPHTRIMRFIKQTVTSLSFSTRLSSSQ

SEQ ID NO: 145805 - protein, 69 aa, Triticum aestivum
  Clone ID: PAT_TA_40223.pep
TQAFGLVVKLKQPLPPGLERGVVFGTRKNQNRFYGGSTPPPIRVLGPNLFLGTQIKPTSRPQKACGIIL

SEQ ID NO: 145806 - protein, 24 aa, Triticum aestivum
  Clone ID: PAT_TA_40224.pep
FCSYGTTTTSKCSCGLGYLSFCVV

SEQ ID NO: 145807 - protein, 79 aa, Triticum aestivum
  Clone ID: PAT_TA_40225.pep
DYWKLGKRAVIIELDGAAPHLAFPFGHLAEGHALGRRQNLNLNAPAIEPDTYQGLDWAWGPPRPPFLLVEGHLVAPLYV

SEQ ID NO: 145808 - protein, 83 aa, Triticum aestivum
  Clone ID: PAT_TA_40226.pep
KTNPNFGTSSGVLMFAQKLCFYFKTPGIRNFVFAFGSSYAVSDARSDIGLKKLPLWFQHATSPMLYTCTMSYRTPGSRLLPRP

SEQ ID NO: 145809 - protein, 107 aa, Triticum aestivum
  Clone ID: PAT_TA_40227.pep
IYCSPVYVCIATSAKKMDRKSSDGETVQVDEAVALESHTIAHMVEDYCVDICFPLSNVTSELLGKVIEYCKRHVKAVASKVVAVMGAASFDDYLKAWDAVFMKIVQA

SEQ ID NO: 145810 - protein, 72 aa, Triticum aestivum
  Clone ID: PAT_TA_40228.pep
PTRPRSCISPCTTLKTSTTVAIRLHPEMRQVQLPSWERLPLAGVYRSLVPFRFFKATKFRYEMYPYHRRRPV

SEQ ID NO: 145811 - protein, 66 aa, Triticum aestivum
  unsure (1)..(66): unsure at all Xaa locations
  Clone ID: PAT_TA_40229.pep
AVVTVMVFVTVALLDANVVSCFXSVSSKVTAQVLAVLPIVIGVVGSMLFGTFSATRHGIGFALGQH

SEQ ID NO: 145812 - protein, 44 aa, Triticum aestivum
  Clone ID: PAT_TA_40230.pep
HFFQLQFYHITIHINLQWGVLNMLEQRLYINTFFIPSKYYIFYS

SEQ ID NO: 145813 - protein, 112 aa, Triticum aestivum
  unsure (1)..(112): unsure at all Xaa locations
  Clone ID: PAT_TA_40231.pep
MAIKGNSGEYKARSPLGMVITVLLCCFFYVLGAXXRSGYGMCDRIAVAVTRHTACSGASAGGLSFETHHTGGLANATTYGLGGEPPSPCAAALADHTPCHDQDRAMKFPRKN

SEQ ID NO: 145814 - protein, 60 aa, Triticum aestivum
  Clone ID: PAT_TA_40232.pep
SKASQSWSSTTTRPPGRCAFACAVSATVTRSRTTRRYLLRAARLGGPILLPDLAVFLLDY

SEQ ID NO: 145815 - protein, 73 aa, Triticum aestivum
  unsure (1)..(73): unsure at all Xaa locations
  Clone ID: PAT_TA_40233.pep
MAGGLSRGCNLTSACVGRDILFSVLTKINXPAGDKQPTGWKNPGLTXLNLLGRHPSFASWINKREGRTDLPYQ

SEQ ID NO: 145816 - protein, 44 aa, Triticum aestivum
  Clone ID: PAT_TA_40234.pep
RNDSLTATYLIFLKLADMNPNKMDGDIHTCYYKELYLTKYKLVC

SEQ ID NO: 145817 - protein, 68 aa, Triticum aestivum
  Clone ID: PAT_TA_40235.pep
CYDKTRTLVQKEKKRCSRRGSVRDRKGHAIQNRCVISYLILLSLYVKTRISNVCIKCRLELSQLQRHL

SEQ ID NO: 145818 - protein, 95 aa, Triticum aestivum
  Clone ID: PAT_TA_40236.pep
TVGRREELDPSTTAPPLLCYSPRATKLRRGLGFTPPPPPFPCLPLRRPQPPRSPPLVALHRRPRPSPRSPDRRPSSSRRWAQPTTPLSTKRWRPI

SEQ ID NO: 145819 - protein, 103 aa, Triticum aestivum
  unsure (1)..(103): unsure at all Xaa locations
  Clone ID: PAT_TA_40237.pep
VHHERGGSPEAMQGWLPSMVPKFLPAAKGPEPPPPEAVAAAATMRKARVSVRARSEAVMISDGCQWRMYGQKMXAKGNPCPFAYYRCTMACGCPVRMQVQRFV

SEQ ID NO: 145820 - protein, 59 aa, Triticum aestivum
  Clone ID: PAT_TA_40238.pep
NAHPSMYGSKAVLFTASSTQDCSHWCLPGVPDTWNELLLYHLVSSHENGFYKLVTGLPS

SEQ ID NO: 145821 - protein, 69 aa, Triticum aestivum
  Clone ID: PAT_TA_40239.pep
GVDWGAPPFFSAQGLGSLARGGAGRGLKKKVGGEPPSVGPPPPSEGPAKKSSLMFCFPRATKTRVSLFF

SEQ ID NO: 145822 - protein, 102 aa, Triticum aestivum
  Clone ID: PAT_TA_40240.pep
SLRNQQRVIYTSPIKALSNQKYREFKEEFSDVGLMTGDVTIEPNASCLVMTTEIWRSMQYKGSEVMREVAWVIFDEVHYMRDRERGVVWEESIVMAPKNSRF

SEQ ID NO: 145823 - protein, 105 aa, Triticum aestivum
  unsure (1)..(105): unsure at all Xaa locations
  Clone ID: PAT_TA_40241.pep
ASRTREADSKDLAYXKRKVVAGADVIATQLNYATDIYLKKANDWRAIGITXPIVAAITPIDNXYKAIGRMTGFLKNRIPAEITGALGPMKDKDEADPECRVHLGA

SEQ ID NO: 145824 - protein, 46 aa, Triticum aestivum
  Clone ID: PAT_TA_40242.pep
TIDPKCIVHLIVRRKTFLVDTIAKPSFHKILLFSLYICFTYFGVLV

SEQ ID NO: 145825 - protein, 76 aa, Triticum aestivum
  Clone ID: PAT_TA_40243.pep
MNLLYWLDPWEPSPTVVVAVLTAAVLFARGVKKAKVSPLRQFSFWFGLTALYIALHTRLDYFFEHEFFMHRAQHLV

SEQ ID NO: 145826 - protein, 57 aa, Triticum aestivum
  unsure (1)..(57): unsure at all Xaa locations
  Clone ID: PAT_TA_40244.pep
ERRQRKEMVAIKNTEIAKHLSLPPVXKLHCSMLAEDAIKAAVKDYEAKKTKAAEADE

SEQ ID NO: 145827 - protein, 119 aa, Triticum aestivum
  Clone ID: PAT_TA_40245.pep
RRFSLAKRFAEVSPTKRTEAAKFAQLWNEVICSFRDEDFISDKEMDLLVVPYSSDPSLKLMQWPLFLLASKIPIALDMAAQFRPRDSDLWKRICADEYMKCAVIECYESFKLVLNLVVV

SEQ ID NO: 145828 - protein, 117 aa, Triticum aestivum
  Clone ID: PAT_TA_40246.pep
RTRGPTALMSSVAMTSLGYLLPLMAATGAVDAPPEQWGNGFFADAAGTIAGDWLKYWIEVGAVLSSIGLYSATLSSAAFQLLGMADLGLLPRVFALRAPIFNTSWVSIVVTSLITLG

SEQ ID NO: 145829 - protein, 39 aa, Triticum aestivum
  Clone ID: PAT_TA_40247.pep
SFWALAGHWIRLNSNIPPPCYSQIKWLWNGMHYIGFFSI

SEQ ID NO: 145830 - protein, 76 aa, Triticum aestivum
  Clone ID: PAT_TA_40248.pep
LHPLLRLNPSHGVARRCVPHRPRRGPPPGTLRRARRPSRPSSLRGPAPPDPFPLRLLPLHLHVWGRTDTVFYYGFS

SEQ ID NO: 145831 - protein, 49 aa, Triticum aestivum
  Clone ID: PAT_TA_40249.pep
YGGLLERPQCNCSYGPAAMLGWGNRARRELVGEPGTAAWGVKRWSGSEC

SEQ ID NO: 145832 - protein, 53 aa, Triticum aestivum
  Clone ID: PAT_TA_40250.pep
WQLTSFSLSLPSCIKRRDRNSAIAFIIPFVNFHKHLCGGAMLGWINRCPPDKQ

SEQ ID NO: 145833 - protein, 90 aa, Triticum aestivum
  Clone ID: PAT_TA_40251.pep
KPWCVSEATRHAASTLTGVAHDSGASHSPSAAASRAAARRRTPTMHTAGRAVNHIAAPAPAGRRSSSDRGLMDQSTKKEEKRLLERGLGR

SEQ ID NO: 145834 - protein, 35 aa, Triticum aestivum
  Clone ID: PAT_TA_40252.pep
RKTCKQQISDHFCRGSKLIQLVTRFHILGARLAFN

SEQ ID NO: 145835 - protein, 67 aa, Triticum aestivum
  Clone ID: PAT_TA_40253.pep
MLLELPGSSPVVCTQELQAKCTDALMWDQKTGRSRGSGFVSFRNQQNAQTAINELMVHSLLLIASNV

SEQ ID NO: 145836 - protein, 37 aa, Triticum aestivum
  Clone ID: PAT_TA_40254.pep
RRQQFRVVHDLLVSRTEVSLSTYANQYKARKCVGTRG

SEQ ID NO: 145837 - protein, 76 aa, Triticum aestivum
  Clone ID: PAT_TA_40255.pep
DNNHSEFTISNLDSKAYISAYQPTPMIGSMACLQVLILLQVFIQPCSHRWIDRDSTNATTTATTGLFIIQLVSSMG

SEQ ID NO: 145838 - protein, 142 aa, Triticum aestivum
  Clone ID: PAT_TA_40256.pep
PTRPPTRPRIFNNISSLKAAYIQLQEAHTPYDPDKIQTADKLVIDELTRLSELKHTYREKNPKPVAASPQDSRLLSEIQEQQNLLKTYEVMVKKFQSQIQNRDTEITLLQQQIDEAKHRKSKLEKILKQRGLLNKESEESDE

SEQ ID NO: 145839 - protein, 59 aa, Triticum aestivum
  Clone ID: PAT_TA_40257.pep
TKQDFANLYMTQLLLGSLRWFYECFFRRSLHEFWRNSHITKECSFGFCTVPSWYLIKIN

SEQ ID NO: 145840 - protein, 91 aa, Triticum aestivum
  Clone ID: PAT_TA_40258.pep
LRRFSPFGCRAPPPCWSPVSCLSALSPFLRSARAFWSRVPSPIPCSVGIFSFLPPGLLSLRLFFPGGFGLVSVCVVLRVVGRVVGRVGRSG

SEQ ID NO: 145841 - protein, 46 aa, Triticum aestivum
  Clone ID: PAT_TA_40259.pep
MQRLQDLHARDSSQYVSLTAIVMEEVEEGTSKKTNSCSRAIIWLAR

SEQ ID NO: 145842 - protein, 54 aa, Triticum aestivum
  Clone ID: PAT_TA_40260.pep
KAQAYHQAHSFSRHGFVLISEQHLLPRPVWSIGHIGSSSGTGMVLSSDEPTYES

SEQ ID NO: 145843 - protein, 89 aa, Triticum aestivum
  Clone ID: PAT_TA_40261.pep
PTRPKIQDLVAQVDPLGKLDPEVEDLVLEIADDFIESVTAFACTLAKHRKSSVLEAKDVLLHLQRNWHLTVPGFSKEDKHPQRNYNCNR

SEQ ID NO: 145844 - protein, 144 aa, Triticum aestivum
  unsure (1)..(144): unsure at all Xaa locations
  Clone ID: PAT_TA_40262.pep
FVADKGIAQLMDHMNNLTRVKIWCESTTEASSITHLSKSIKGFIQRGSHASDHRSLSLNFNECSEDLLSFTLEKSCHLSKLKLQGNIFSLPPFVTALAGLTELCLSSLGKFTXDVLASLSMVHSLQYLKLIATHMEKFVIRKGQ

SEQ ID NO: 145845 - protein, 119 aa, Triticum aestivum
  unsure (1)..(119): unsure at all Xaa locations
  Clone ID: PAT_TA_40263.pep
VACGHSMTVALATSGHVFTMGSSSNGQLGNPKADGKLPCQVQDKLNSELVEEISCGSNHVAVLTSRSEVYTWGMGANGRLGHGGIEDKKKPTIVDALKDRHVKSIACGSNFTTXICIHK

SEQ ID NO: 145846 - protein, 60 aa, Triticum aestivum
  Clone ID: PAT_TA_40264.pep
PTPTRPGSSSTSVATTRPTPWKRSTGQGSCQPLSGAPETRARHIPWTCDGTCSNTRTGGS

SEQ ID NO: 145847 - protein, 141 aa, Triticum aestivum
  Clone ID: PAT_TA_40265.pep
PRVRENFVMLCPLHQSSKLPNEVSQPQKQPKRITAPKCPSQVRSSQACSNNWKWPSGSPQKWVLCCSALSAAEKGVVTEFAKLAGVPISKSWSPSVTHVIASTDPSGACKRTLKFLMAILNGKWIVSIDWVKACMDGMEPV

SEQ ID NO: 145848 - protein, 123 aa, Triticum aestivum
  Clone ID: PAT_TA_40266.pep
FNEWRDAISANPRVDNHKLGSNKFTTDQFQTVFFKMRPAIMLDGFTSHQLKLIQQVLRKNFRDLMYVCTFGGDETSERRVVYTDNTEDSILLMKDVQEDLFRRRNAICGISNRKSGWSLILFA

SEQ ID NO: 145849 - protein, 85 aa, Triticum aestivum
  Clone ID: PAT_TA_40267.pep
GTGWILGLKVTRLVEYNERLTELWGDNLGVRDDRAPPHVFLRPPGGVPLGQLPGFGVPVASPVVYGNRKCFFLNCGRELQGLWFH

SEQ ID NO: 145850 - protein, 113 aa, Triticum aestivum
  Clone ID: PAT_TA_40268.pep
SLLCVRPDGAVALPAAPHFWCKLSVEHPRGYKDEMVMMASAVSSSPLSAGPPVPGQGMFVAVPHELMSGDVLAMSVRIDQLQAPPTSAFGAVAARAPASPPPSHARTTYQRLQ

SEQ ID NO: 145851 - protein, 119 aa, Triticum aestivum
  Clone ID: PAT_TA_40269.pep
PRVREDESVQDIFMTCLGLATRTMKDKVVPLVMKFVHENINGPSRMMAIYPLGFILEGPSVNQLAPVVPLLVRMMEDPQEGEGVRGRAAWILGRVFELVGANRIISWEKRKKWCHPGII

SEQ ID NO: 145852 - protein, 68 aa, Triticum aestivum
  Clone ID: PAT_TA_40270.pep
KQCKILNLSELLSKIEPDKAFKVPGLKGATVKIEHDKAFKVPGLRGAIVSPQKNVGLDVQDGAVHEAL

SEQ ID NO: 145853 - protein, 75 aa, Triticum aestivum
  Clone ID: PAT_TA_40271.pep
ALDVDDGYDVAERRRAWSRVISREGSDGFSGQRKVDKHATLPSNDYVHGPCARNGHFVVHSNTKMISPARGRLET

SEQ ID NO: 145854 - protein, 37 aa, Triticum aestivum
  Clone ID: PAT_TA_40272.pep
MCIKITRERTIQSSACCNFTYDSYSMTRPRKWVSLKE

SEQ ID NO: 145855 - protein, 71 aa, Triticum aestivum
  Clone ID: PAT_TA_40273.pep
GWLAVANLSLFSSIIARYLQENYFRGLLITRSNLALLSDLAGTTMARTPRRPKILGTAVCSHARELLCLSK

SEQ ID NO: 145856 - protein, 66 aa, Triticum aestivum
  unsure (1)..(66): unsure at all Xaa locations
  Clone ID: PAT_TA_40274.pep
GLADHKDQLGAPLXPCRNYDGKNAEAAQEFRNCXCVPMRESICVYQSEGSLLLTSLEEYWRWWACS

SEQ ID NO: 145857 - protein, 66 aa, Triticum aestivum
  Clone ID: PAT_TA_40275.pep
YNVGHPHTYTYILPYHRSFRATSSRLSRIEMQTSLSVGAAYFFVYNIQPPIDERCHSKRYIWLVYV

SEQ ID NO: 145858 - protein, 39 aa, Triticum aestivum
  Clone ID: PAT_TA_40276.pep
RTGERRRKALDGVFIGRRGDGAGVAHPDQVRVVPSHGVL

SEQ ID NO: 145859 - protein, 44 aa, Triticum aestivum
  Clone ID: PAT_TA_40277.pep
VVDLFRPQKIVQFHSIHKKEGKHEVLLCPFGPLAFLIFEKMPTS

SEQ ID NO: 145860 - protein, 116 aa, Triticum aestivum
  Clone ID: PAT_TA_40278.pep
MLGNFLMHKRREDDELAIIEALYANDRSSANHTRIHTSILTGDRYVREVLEGHELRCKRDFRMEQYIFRNLVQCLRERCHLRDTNFVSVEEQVGIFLYAVSKNATNRTLQGQFQHS

SEQ ID NO: 145861 - protein, 49 aa, Triticum aestivum
  Clone ID: PAT_TA_40279.pep
MVTQAGSFRLAHLMCMYDFARCSDSAQWFQVAPHGALVAARIRRRRLQV

SEQ ID NO: 145862 - protein, 33 aa, Triticum aestivum
  Clone ID: PAT_TA_40280.pep
YLFLESRLWILTGMHSYGKSHLLYNEEFRPCLN

SEQ ID NO: 145863 - protein, 138 aa, Triticum aestivum
  Clone ID: PAT_TA_40281.pep
GSANAGAGLRLLVVGVGGYIRPQTPAGAPPRTTALCRSNGRHHTYTSNGQVGWSGLRNHLIRKKGIAPRCGLDPNLAGVRHDVSTPSPRHERLQQEASGGHRGRTRRQGDGLRSRVPAGDPPCGARHVAEIDPNEAVA

SEQ ID NO: 145864 - protein, 83 aa, Triticum aestivum
  Clone ID: PAT_TA_40282.pep
ARVGNNRLGDAIGIPCPVSPHALTMCKTEAVAYGYPCGDHKVTTEDGFILSFKRIPHGHDTGNSTVEENTRDPILAFHGLFVD

SEQ ID NO: 145865 - protein, 87 aa, Triticum aestivum
  unsure (1)..(87): unsure at all Xaa locations
  Clone ID: PAT_TA_40283.pep
PNDFHRTPMGGGVGIRAQHSQSYASYIAHVTXLKVLSAFSSEDATGSLKAAIWDPDPDVFLENELPYGEWCPVADEVLDNSYAMAIG

SEQ ID NO: 145866 - protein, 113 aa, Triticum aestivum
  Clone ID: PAT_TA_40284.pep
PNFQNKHKLHRTPLKWSGGKTRIFCSFEWAPASLGQQPLHLRHPSPVLTIVELPVKMAATVGGASKGLEGRDGRVRTLHSRLRPWPATEGAEADGRRRFGRSARMMRAAGAAE

SEQ ID NO: 145867 - protein, 37 aa, Triticum aestivum
  Clone ID: PAT_TA_40285.pep
HRTITTNLKCDPSDAIPQFHQYHIWFITRRMAWARRV

SEQ ID NO: 145868 - protein, 29 aa, Triticum aestivum
  Clone ID: PAT_TA_40286.pep
WIAYENSLLKIAQYQSRASFRLVAQYQCT

SEQ ID NO: 145869 - protein, 78 aa, Triticum aestivum
  Clone ID: PAT_TA_40287.pep
RLTLKQDYLSRNLLICRSTHPVTNVTDRSSTYISCYHIQYICPFMLDHPFMYYKKHSIGLLKIILMSTSLWSSSLIYI

SEQ ID NO: 145870 - protein, 82 aa, Triticum aestivum
  Clone ID: PAT_TA_40288.pep
NWSSSCRVDYHQIRSDDSILFPCARKLSAILQKNHGSRASRILGSVQNLVTRISMFYVTACHCGLTRTCPLWRAKPGLQCHR

SEQ ID NO: 145871 - protein, 41 aa, Triticum aestivum
  Clone ID: PAT_TA_40289.pep
GRNHYYVSIYIVASCVYSPLQHTGLGSKATGRLEPSTYNRS

SEQ ID NO: 145872 - protein, 62 aa, Triticum aestivum
  unsure (1)..(62): unsure at all Xaa locations
  Clone ID: PAT_TA_40290.pep
MSTTARPLVYVKALDGVMATDAAGVPMPDVMNAPIRPDIITLVHRVRFXNIRQPYAVFREGG

SEQ ID NO: 145873 - protein, 51 aa, Triticum aestivum
  Clone ID: PAT_TA_40291.pep
PCLCRHVPIRTVERLMADQGSYGMCERTRYSNNRIYGRANSCNNPTLVGGA

SEQ ID NO: 145874 - protein, 65 aa, Triticum aestivum
  Clone ID: PAT_TA_40292.pep
IRNMAQESVVRWLNELHIHGILLSFVYRVAYLSTTGTHPGSSTVQNYAKVILVRIQISRGFKSPQ

SEQ ID NO: 145875 - protein, 104 aa, Triticum aestivum
  unsure (1)..(104): unsure at all Xaa locations
  Clone ID: PAT_TA_40293.pep
MAGPLRGVLPSLGRALLSATPARMLSAEGFEALLEIXPGQNVMVSGIPEEHLQRKVLIETPGRTASQQGXAKXGRRKINYMVTQKWVNPLMAWTTTGDPDAKCR

SEQ ID NO: 145876 - protein, 136 aa, Triticum aestivum
  unsure (1)..(136): unsure at all Xaa locations
  Clone ID: PAT_TA_40294.pep
RLQDIDLEGDPFTSARVAEYCXCLPAICLLTERSISPXFSHNAEDQIVTLGQLTCIILASVLELKRSASGIXDCCRNGQPWDMGTGCAHIYDERQGLRNMVILLDTNSTVTSTAVADSNVSELYGSKXPSVLVPPT

SEQ ID NO: 145877 - protein, 102 aa, Triticum aestivum
  unsure (1)..(102): unsure at all Xaa locations
  Clone ID: PAT_TA_40295.pep
MDQLLLNPESCYSAQLSQMETETLLAQLVETDMNKRVQXGTYKGKKSNAIRHFFGYQARGALPSNFDCDYAYVVGHVCFHIIGSGLNGYMATVTNLKRPVYQ

SEQ ID NO: 145878 - protein, 90 aa, Triticum aestivum
  unsure (1)..(90): unsure at all Xaa locations
  Clone ID: PAT_TA_40296.pep
XXVGTPRVRRDFLCLFIVAPCREAILRTGALRGTKNLPWEAYLPYASTEDDASFIMGTNVVDAFDTEVASEIPILQSDQDVFGREVLNLL

SEQ ID NO: 145879 - protein, 51 aa, Triticum aestivum
  Clone ID: PAT_TA_40297.pep
GLKIFSHESAMAACSRGATEAVTSAGLHLKARNLSSALLIIIYNGPLFAIP

SEQ ID NO: 145880 - protein, 72 aa, Triticum aestivum
  Clone ID: PAT_TA_40298.pep
KAQPFLLYHLCDGTVTGWGHRYPPLTRSLNYPALVVLRNDEAVISSAPSTWVKFPLTFRRGKMRYFIFIYGP

SEQ ID NO: 145881 - protein, 65 aa, Triticum aestivum
  unsure (1)..(65): unsure at all Xaa locations
  Clone ID: PAT_TA_40299.pep
KKDPQFPSRGCPEEKXXSRWCGRCEGSSFLSAASAGDSAAXARGESTATTRKRKRKRADAWADAW

SEQ ID NO: 145882 - protein, 52 aa, Triticum aestivum
  Clone ID: PAT_TA_40300.pep
LGVQVCINKIFAYAQTSIYIISKYRSATSSECQTSHYTHSKLKARHPMYIST

SEQ ID NO: 145883 - protein, 78 aa, Triticum aestivum
  Clone ID: PAT_TA_40301.pep
ARYRSTAYALEACYESWWGADRTGLIFLEWELIHSAEGLDTINWWQLRCFKYCTLRCMAYDILAILLTTLGFESVLSS

SEQ ID NO: 145884 - protein, 63 aa, Triticum aestivum
  Clone ID: PAT_TA_40302.pep
RNGKGTSCAVPQNLLRPLLLPLAHECFLERILGLRELQGREESGATRGCSNNWHQSLVDPLLV

SEQ ID NO: 145885 - protein, 74 aa, Triticum aestivum
  unsure (1)..(74): unsure at all Xaa locations
  Clone ID: PAT_TA_40303.pep
FHWLLYIGIFLYSVLYFIFFLRFFYLIFVIXYLYLILYFIFFLSIFYFYNFFLFFILSYLFFFFFKFYVPLFFF

SEQ ID NO: 145886 - protein, 90 aa, Triticum aestivum
  Clone ID: PAT_TA_40304.pep
MTAWTYFRSSFLALPYHLLMTCLQTLLLSFIIYYHCSFLNYYYFYILFIFIIIIFFYFSLFLCYNFSFSLYTIYFIFFYFHFIFYFYFNY

SEQ ID NO: 145887 - protein, 84 aa, Triticum aestivum
  unsure (1)..(84): unsure at all Xaa locations
  Clone ID: PAT_TA_40305.pep
PRVREDAVKILLGLREXYGAYHKCKFTLEAINAAVYLSARYIPDRQLSDKAIDLIDESCSRARIESFQMKKAGQXSFFLKEPDE

SEQ ID NO: 145888 - protein, 46 aa, Triticum aestivum
  unsure (1)..(46): unsure at all Xaa locations
  Clone ID: PAT_TA_40306.pep
LSKGHHYIFTDDKXGLESVLLKHIEDIHVLITTSFHPAYVTAYRFK

SEQ ID NO: 145889 - protein, 69 aa, Triticum aestivum
  Clone ID: PAT_TA_40307.pep
KTGHPLAGWVVIKSEAMTANYSRVHENSVRFLQKNHGSRACRILGSLQKLFTRISMFYVTACHCWLTRT

SEQ ID NO: 145890 - protein, 60 aa, Triticum aestivum
  Clone ID: PAT_TA_40308.pep
KYKNNNKTIKIITTLVNKLVVITKNARQSFKLVLHTTSSLERLHISRCLALQLQCYFNIT

SEQ ID NO: 145891 - protein, 34 aa, Triticum aestivum
  Clone ID: PAT_TA_40309.pep
YDYHADVPSSLRPGREVSRVVDRFIVFMTFKFFT

SEQ ID NO: 145892 - protein, 45 aa, Triticum aestivum
  Clone ID: PAT_TA_40310.pep
TEEEMRLFVYFKTETLVDEGNKKLKTYCSCRYPWLHQLISGQSLR

SEQ ID NO: 145893 - protein, 47 aa, Triticum aestivum
  Clone ID: PAT_TA_40311.pep
HWSLREDALELRGGCAGASRWTPASSRRTWPEVLTMPACYSRRLGVS

SEQ ID NO: 145894 - protein, 54 aa, Triticum aestivum
  Clone ID: PAT_TA_40312.pep
DRDYGRSREAPARAAPQTARAATAQGARGRPRRDRPRRPRRGRATICAALSRET

SEQ ID NO: 145895 - protein, 49 aa, Triticum aestivum
  Clone ID: PAT_TA_40313.pep
SRYRDPVRLLCRLHLRDEGQWKKKRMRRLKRKLLKMRHLSKYANNEEKA

SEQ ID NO: 145896 - protein, 61 aa, Triticum aestivum
  Clone ID: PAT_TA_40314.pep
QVFDPALKPLVPREESSMTKVLEVAFRCTRLAPGERPTARQISDLLLHVTLDYYRAGEQKR

SEQ ID NO: 145897 - protein, 70 aa, Triticum aestivum
  Clone ID: PAT_TA_40315.pep
PGTPPPPQYPPPSTRSNRLPRRAPPRRTPRRPRPPRPASASSRRRPPPPPCTLPALPQQPTQRKGPAKWN

SEQ ID NO: 145898 - protein, 47 aa, Triticum aestivum
  Clone ID: PAT_TA_40316.pep
RAEAEDMRRRTFLPYRQALLLGCLGFGSGGYSAMHGFAAATTGKSKS

SEQ ID NO: 145899 - protein, 153 aa, Triticum aestivum
  Clone ID: PAT_TA_40317.pep
RKQKWTSEEEAALRAGIARYGVGSWRLILKDDDFRSILSCRSNVDLKDKWRNINVFFTESGSMDKGRTAMKKNRATPRRNDHPMAKSTVASDVDDEIVDEQPIASVSSELWNVSIPKKSRSRLNNIILESGKNLNEPTRSHSTTIAKYIEEEF

SEQ ID NO: 145900 - protein, 32 aa, Triticum aestivum
  Clone ID: PAT_TA_40318.pep
STPSCPRALTRNLASFKKEGVMVVTLFTALVN

SEQ ID NO: 145901 - protein, 149 aa, Triticum aestivum
  Clone ID: PAT_TA_40319.pep
MEMSTSFPLPCLAMVHGVSAEHQQPTATTLFSLAGARPLTGVALEEELKNKSVCPTPQGWVLVQHRDAVVVAVTYLLDPRSSQRIDLPHLAIQQGLIPYCSCLLAGDPTAPGCPVLVVEPMATLLWCCRVGDGEWTRHDYDIGTLGDEH

SEQ ID NO: 145902 - protein, 45 aa, Triticum aestivum
  Clone ID: PAT_TA_40320.pep
LLSSHVCEYRKHDVRLLTLICQSIFSCPVIMAEWGGRFPSFHLLL

SEQ ID NO: 145903 - protein, 83 aa, Triticum aestivum
  Clone ID: PAT_TA_40321.pep
ESSFWKIHSGRKRSSNKKKIQCRKSVQKSDLNRLGGTGRNKNWNRGVGAHYFHHRLKFFLTLSRFKLATWIILFTKFTVSASM

SEQ ID NO: 145904 - protein, 79 aa, Triticum aestivum
  Clone ID: PAT_TA_40322.pep
PKITWRGKRLVNGLKKKFAHKKKVKSQFDHAKKWTTLAKVQFHGTSLTVLAKPTVTLYLKGSHFGPNMDLLKKGVFFCR

SEQ ID NO: 145905 - protein, 45 aa, Triticum aestivum
  Clone ID: PAT_TA_40323.pep
TEEQKISLMNQRCGVNILKFQLIFFTLKKSDHACHFPFLLSHFQG

SEQ ID NO: 145906 - protein, 63 aa, Triticum aestivum
  Clone ID: PAT_TA_40324.pep
NQQVQSIHEEGAGSLKYGLEKSLRGYALAAQEQERVAFFVSGQTKPHAPSVGRRSLHWNPCAR

SEQ ID NO: 145907 - protein, 110 aa, Triticum aestivum
  Clone ID: PAT_TA_40325.pep
SKVNFVTFFVLNARMREFMTLQVETSYYNEEFLVEQRRKLQLQDRVSRGAQFHFTTGLCIRTNWDIKHVRDLDVEFPFVLWGLLNVFWFFVIFYFLIYIFHYLLKYFLLF

SEQ ID NO: 145908 - protein, 46 aa, Triticum aestivum
  Clone ID: PAT_TA_40326.pep
RTSNKPLAPRVNMSLEHRSVVKNALEPRWYRPAWHGGYRYAWCRTR

SEQ ID NO: 145909 - protein, 37 aa, Triticum aestivum
  Clone ID: PAT_TA_40327.pep
PGFNKFCKEKFKKVSLLRPKATRSSSREIYMICEGLL

SEQ ID NO: 145910 - protein, 65 aa, Triticum aestivum
  Clone ID: PAT_TA_40328.pep
RPNQQHLNPKQLEYILCRSRSDYHLARDHCGFSCHEPVVGVPGLLVLDHTPHFGYKLSITREHVC

SEQ ID NO: 145911 - protein, 43 aa, Triticum aestivum
  Clone ID: PAT_TA_40329.pep
TLFGLQGAPLAPHDHCGLNPRHAPPLLHPTLPNPLAHHDRSQT

SEQ ID NO: 145912 - protein, 31 aa, Triticum aestivum
  Clone ID: PAT_TA_40330.pep
ATKIVHNQCTTRNRVRLIPLINSRDTSIRES

SEQ ID NO: 145913 - protein, 61 aa, Triticum aestivum
  Clone ID: PAT_TA_40331.pep
ACPGPLIVKKPGCFDKNSSDHGEYSINHNVVSDQPSLRQEPLPRALRSQRILLVLTCYVGV

SEQ ID NO: 145914 - protein, 84 aa, Triticum aestivum
  Clone ID: PAT_TA_40332.pep
LAGELDDLLLKDYATVRSGLGSGAETGATRRSGCPPQDRENEGAGGGTGRGTARSTARQVTMRLSVLLNPCSNTYARRSTPDSA

SEQ ID NO: 145915 - protein, 43 aa, Triticum aestivum
  Clone ID: PAT_TA_40333.pep
DRERALLYFLFSAGKDKGIRDIQAFHGSLRKFTRHLFFMYNAS

SEQ ID NO: 145916 - protein, 137 aa, Triticum aestivum
  unsure (1)..(137): unsure at all Xaa locations
  Clone ID: PAT_TA_40334.pep
RQARDDRRVPRLLQICVQRALLNEWQGGAMGKEYVRAAKRVHCRTXKHSLVEALEQLVQTKERMDYILLETTGXLADPAPLEFILWLDDQLELLIRLDFIITDIDAKNFMRYIDEHTNFLXFPEAFYQNFIFWWFRY

SEQ ID NO: 145917 - protein, 31 aa, Triticum aestivum
  Clone ID: PAT_TA_40335.pep
SSSSRTANLVRFETTSSQIVTTNSSFKFSQI

SEQ ID NO: 145918 - protein, 79 aa, Triticum aestivum
  Clone ID: PAT_TA_40336.pep
MEINNIVFAGLLAGGLVTGVMGSEDSPATKNTFQVANSPGALIVSLGIYFLYSNTGHVREECITSIHWAVVCLHTNDAG

SEQ ID NO: 145919 - protein, 60 aa, Triticum aestivum
  Clone ID: PAT_TA_40337.pep
FILHSKPLFFFLYCSRRGTHQTLSVSSHLFLSSHAFYLLYSYVSEYVFTSTELKMRLQIS

SEQ ID NO: 145920 - protein, 48 aa, Triticum aestivum
  Clone ID: PAT_TA_40338.pep
SKLLIACRSSASYELKMSSKKHVFHVVGKFCPALLQNVKWDSINIYIR

SEQ ID NO: 145921 - protein, 88 aa, Triticum aestivum
  Clone ID: PAT_TA_40339.pep
RPVSIAHIKDRLARTERMEVFPKNKKRRTDVVPAQYFCGVLQVHPLELRFSFKPNKSSVCSFRLTNNTDEHVLFRLKKKGRELGRITL

SEQ ID NO: 145922 - protein, 48 aa, Triticum aestivum
  Clone ID: PAT_TA_40340.pep
VEDNMFRRKHASHFNSDDAEQRQAKINELRAALGPMSGRGEKVCSGTC

SEQ ID NO: 145923 - protein, 53 aa, Triticum aestivum
  Clone ID: PAT_TA_40341.pep
ELLLGLFLPVAKSILEKHAWQGFFNSPLACHEFFPIFEDIFLLGLYLPVHFLA

SEQ ID NO: 145924 - protein, 116 aa, Triticum aestivum
  Clone ID: PAT_TA_40342.pep
ASHSSVAAHPDRSPLRDCVSCGACAHSTSMAVAGGGGGMALSLRAPSASASPAVGRLRRASSSPAVRCGATRERWPTSAPYGVLEEDHYRTLRLQPGASRGEVKKAFHRLALQYHP

SEQ ID NO: 145925 - protein, 90 aa, Triticum aestivum
  Clone ID: PAT_TA_40343.pep
DAWADAWVVKGIVDSKELSLNIFRETLQQNKILKVIKKNLVKKCIELFFEIAENKEDYNKFYEAFFKNLKLGIHEDFYNRTKIAELLRYH

SEQ ID NO: 145926 - protein, 30 aa, Triticum aestivum
  Clone ID: PAT_TA_40344.pep
SDKVEKLNNHLDFTQARANRVGIVNHNTLT

SEQ ID NO: 145927 - protein, 110 aa, Triticum aestivum
  Clone ID: PAT_TA_40345.pep
MPAEKAPQAGTVALGATTNNAVAVQVQQQQHKRLEGKVAIVTGGARGIGEATVRAFVRHGARVVIADIDDAVGEALAAALGGACCTYVHCDVSGEADVERAVGYWVARHG

SEQ ID NO: 145928 - protein, 26 aa, Triticum aestivum
  Clone ID: PAT_TA_40346.pep
NTTYQTANGYTSLTSLPQMIPSKVFN

SEQ ID NO: 145929 - protein, 41 aa, Triticum aestivum
  Clone ID: PAT_TA_40347.pep
FIKFFRLFCKLMSTRVISVAAISSSPFRMAQTPTFRLLLLS

SEQ ID NO: 145930 - protein, 26 aa, Triticum aestivum
  Clone ID: PAT_TA_40348.pep
CYLYICNSYSVVTIIFSDLNFHAMLN

SEQ ID NO: 145931 - protein, 36 aa, Triticum aestivum
  Clone ID: PAT_TA_40349.pep
AEKGTGPTIYMTLTLDLLRFTWPYFDLSWGLYIINS

SEQ ID NO: 145932 - protein, 101 aa, Triticum aestivum
  Clone ID: PAT_TA_40350.pep
HHGLPGEVLGVLLTVALMHLALHLSEHILNDGDGVHLLLSFQSFSEAKAREHRSVEVRCQLQRVFNVKHSKRDALFFFFYLKDVVSNSNQTSMLIGTLTSL

SEQ ID NO: 145933 - protein, 29 aa, Triticum aestivum
  Clone ID: PAT_TA_40351.pep
VYCNKNKLESHGIKLQFKSQKAAKVDCQI

SEQ ID NO: 145934 - protein, 116 aa, Triticum aestivum
  Clone ID: PAT_TA_40352.pep
MAASLEDLRNESIDLESIPIAEVFQVLKCKPHGLTSDEAASRLQAFGPNKLEEKKESKFLKFLGFMWNPLSWVMEAAAIMAIVLANGGGKPPDWQDFVGIVTLLIINSTISFIEEN

SEQ ID NO: 145935 - protein, 39 aa, Triticum aestivum
  Clone ID: PAT_TA_40353.pep
ISSSSIEYLLGNKIYVFILALFYIYDKLCFKYVCIVYEW

SEQ ID NO: 145936 - protein, 77 aa, Triticum aestivum
  Clone ID: PAT_TA_40354.pep
MFYLLTHLHSAWATDQTILSEEEQLVIIRFSHYWDETRMHMDDVLSGGAETIKNYAVIYLVYITEGSEFNTMCELYD

SEQ ID NO: 145937 - protein, 67 aa, Triticum aestivum
  Clone ID: PAT_TA_40355.pep
ALLLSVLYGARANDCLAAGLGAGAADRGALRKLQSPPPPPERRPMERSIARRIRIRRECLSLLVCFE

SEQ ID NO: 145938 - protein, 35 aa, Triticum aestivum
  Clone ID: PAT_TA_40356.pep
FEEQVTLLIESRFFCKTIRETVVLQILLQNRPRVR

SEQ ID NO: 145939 - protein, 37 aa, Triticum aestivum
  Clone ID: PAT_TA_40357.pep
VDFVHCQICLLIAPICNIKCLYEKCGVFFCQMKLTVH

SEQ ID NO: 145940 - protein, 45 aa, Triticum aestivum
  Clone ID: PAT_TA_40358.pep
GSNTHFLLTTSYGSFADAMHSCIGEVKGGPISCACAGTVLVVVHC

SEQ ID NO: 145941 - protein, 68 aa, Triticum aestivum
  Clone ID: PAT_TA_40359.pep
GNYFVPLNKHNTKHFAHMLPPSKKSIWLYKMFRRPFTDHNWSACKLKTRQVPPKKLESVFPQKKKKKQ

SEQ ID NO: 145942 - protein, 66 aa, Triticum aestivum
  Clone ID: PAT_TA_40360.pep
LCSDHRPSCMFIAGSSNGPSFFFCPPFVQPLHAPEAVGYSLLRRECWLVSCRAAKLDRQYFFPRVR

SEQ ID NO: 145943 - protein, 92 aa, Triticum aestivum
  Clone ID: PAT_TA_40361.pep
MMQQQQQQQPLPPPPPQHPPAQPGGGGGDFYRGPLQPAMRQLSAASSTNLAPDYAGHPGPQQHHQQQQHQQQQQQQPFDAYGDNFGAKRMRK

SEQ ID NO: 145944 - protein, 46 aa, Triticum aestivum
  Clone ID: PAT_TA_40362.pep
EYPVELMLTNVLGTAQQMLCSVLNFTAPLIEKPFVHLMSVPDDIDN

SEQ ID NO: 145945 - protein, 75 aa, Triticum aestivum
  Clone ID: PAT_TA_40363.pep
IQIQHQIHLFLYSGFGSGSKKGPADLKERTQVWTTSLPSSWVLFINTCACAKTASFVIHRCPLPGVGTILLIHSS

SEQ ID NO: 145946 - protein, 94 aa, Triticum aestivum
  Clone ID: PAT_TA_40364.pep
QSLAMAAGRACALSAVLVVVVAPLLLAGVADADCFDYCFKDCIAKDKNMIDYCNYACDKTCYTGAPQRPLAAAAAPGDMGCQLSCARTSCHRLD

SEQ ID NO: 145947 - protein, 73 aa, Triticum aestivum
  Clone ID: PAT_TA_40365.pep
CVIFLNGHSMAACVLFASIAMRVFGFALELGRGVILYLQCWYVCVIIHYSFHWFCGKELCFQFDKIYFPGRKY

SEQ ID NO: 145948 - protein, 72 aa, Triticum aestivum
  Clone ID: PAT_TA_40366.pep
KPWHPVEDEDQAGKLCFRSELGYYSSAAAGGRQCAVALALWPVSWRAFRFSWVLFCAMIRDFVTRDGRGRVG

SEQ ID NO: 145949 - protein, 66 aa, Triticum aestivum
  Clone ID: PAT_TA_40367.pep
GYTGDVRQKVDHPHTDTKCEAWGGIGCGVCRVNNRSHYNLGLDTGDQNENPTKGFDRSIELDRNLA

SEQ ID NO: 145950 - protein, 84 aa, Triticum aestivum
  Clone ID: PAT_TA_40368.pep
CSERCSVQWPDEWAYVNGFDSSVAVTVTVNVPSKVPCQKSDHRCKISHEMSLVNFVLPVPQRDLSSHLCYAWCYSWRYGLGYIL

SEQ ID NO: 145951 - protein, 55 aa, Triticum aestivum
  Clone ID: PAT_TA_40369.pep
MSPAEMESDKVVEASGGAGDPKACDDCNTTKTPLWRGGPNGPKSLCNACGIPYRK

SEQ ID NO: 145952 - protein, 72 aa, Triticum aestivum
  Clone ID: PAT_TA_40370.pep
GRVGARPHVLSPRPDDLNLYLLLLPRRSPSSVPRRSFRAFRRSFIPSEPPATPFDGGAPSSREPSFRPFLEP

SEQ ID NO: 145953 - protein, 108 aa, Triticum aestivum
  Clone ID: PAT_TA_40371.pep
QVNRLRPKPNIRSMEPRRRLPSCWCTRLHNTGADVQLVLLLVLAASSLGSRCAGAGTAGAHALLACPRRLHRHHARTDGKAAWLQESVRQAAPGADDTRRPELVAPES

SEQ ID NO: 145954 - protein, 75 aa, Triticum aestivum
  Clone ID: PAT_TA_40372.pep
QRWWSQGVTAYLDAKARLAWGLVVVVAEGVSRRKSMVVAPEEETDAVSRGGAASVEERPNPGAGDGELDSPVRVG

SEQ ID NO: 145955 - protein, 76 aa, Triticum aestivum
  Clone ID: PAT_TA_40373.pep
NVVLVVEQGMVAYSNQEARGGEGLAVVAAEGGSWDRGLVRSPEQEAVGVNRGGPAAVEERPPPGAVDGELDLPYAW

SEQ ID NO: 145956 - protein, 122 aa, Triticum aestivum
  unsure (1)..(122): unsure at all Xaa locations
  Clone ID: PAT_TA_40374.pep
PRVREVKLSISGAALAALLHRCGAAAGDCDGLLFGRAHRPPPPAPTLSDYDDQAPAAPCLFISISGHSSLSHPCSLSDPLGRPNPPPPFXPCPLGFFSSRRRTPLRAFMREHALACSPAKTL

SEQ ID NO: 145957 - protein, 65 aa, Triticum aestivum
  Clone ID: PAT_TA_40375.pep
LGKQIFRDKGGFFTTLKNRLVFSPTGGQKKNSYNRFFLYLKGPRGECARRTDYKCGGGGGSPQMG

SEQ ID NO: 145958 - protein, 65 aa, Triticum aestivum
  Clone ID: PAT_TA_40376.pep
KSYCFPVQYVSTQCCLVFLMRKPCTKLYHSRSLHLQLQYHSKTNERLRTTRFSSMFCRTRGRTRG

SEQ ID NO: 145959 - protein, 125 aa, Triticum aestivum
  Clone ID: PAT_TA_40377.pep
HHALFECLNEYYVGWPTQGSQWVTKYPVVAEESFTRDETGGCVLHAIRHYDGSKLKIPLTKYNADKTKRQALHECLKLRGNSSKLVHDAFWTAVFATASYVNQNVMLPYCRNSRRSTTRVPKGLA

SEQ ID NO: 145960 - protein, 81 aa, Triticum aestivum
  Clone ID: PAT_TA_40378.pep
IAKMKKGVIFSLLNMPAVMDTQAVADACSSGHIAGYGGDVWFPQPAPKDHPWRYMPNHAMTPHISGTTIDAQVCFCVFISA

SEQ ID NO: 145961 - protein, 116 aa, Triticum aestivum
  Clone ID: PAT_TA_40379.pep
PTRPRTRGGLPQSPPAACLHPSPPASHPDRTPAAFKFRPVSETKRPIFRWRRGRRRSEQAEVARARWGKSYPLLLRPRHGRRRREGGAKAPPWPRSLPASAGGPLRQAAGLPSPPM

SEQ ID NO: 145962 - protein, 38 aa, Triticum aestivum
  Clone ID: PAT_TA_40380.pep
RGMTRFFLPVPTGAVILADISSITQIAYYMMTSITLSR

SEQ ID NO: 145963 - protein, 42 aa, Triticum aestivum
  Clone ID: PAT_TA_40381.pep
MPVTPTIIGALLLLDTQMCSNALRKLPYILDAREPVLGMGLG

SEQ ID NO: 145964 - protein, 73 aa, Triticum aestivum
  Clone ID: PAT_TA_40382.pep
RPRVRGYDIVSMNINRLGCGGNYHALMFLPGIEVTADLRATRMRNRTGSVNPYMAINPIFEKGMAGLSVMKFC

SEQ ID NO: 145965 - protein, 83 aa, Triticum aestivum
  Clone ID: PAT_TA_40383.pep
NGGFDLIYQLLALYMYEKNPRNPTRPVLIRDHNLEERKKKKNAGEPPDRGENGSTLTADVGWLVRRGGSSRGRRRRLQIARGD

SEQ ID NO: 145966 - protein, 115 aa, Triticum aestivum
  unsure (1)..(115): unsure at all Xaa locations
  Clone ID: PAT_TA_40384.pep
SERKALQSRGINGVHDAGLWCSHPMAPWLLLPSFPWPPPPPPGSSSGRGGGGGGGXXXDWKPNVVTAIAGVHLGRSLRRRLSSLLCLPEVRSLDVLLRICLYLFLGSQPLDTHHI

SEQ ID NO: 145967 - protein, 140 aa, Triticum aestivum
  Clone ID: PAT_TA_40385.pep
NFFCALGYNVTAMGRFNETRYACPAVPVAVRDLNYPSITLPDLAGLTTVRRRVRNVGAPRSTYTAAVVREPEGVQVTVTPTTLAFGAVGEEKEFQVSFVARVPFVPAPKGAGGYGFGAIVWSDGPGNHRVRTPLAIRRRK

SEQ ID NO: 145968 - protein, 136 aa, Triticum aestivum
  unsure (1)..(136): unsure at all Xaa locations
  Clone ID: PAT_TA_40386.pep
PRCWATSATPRASTASPRGCRSSTPSPPSSSGRCWWRTRRSATRSGTSGSRGGSADATSRSSSTTRRCGTRSGGSPTQNSLAEKGRRIRELTFVDHKRFNFPENGVELYAEKVDNRGLCAXIAQAESLPYKPLGSL

SEQ ID NO: 145969 - protein, 71 aa, Triticum aestivum
  Clone ID: PAT_TA_40387.pep
PGGPAQYSRVATPPPSGRRWEGFHLYLRENKTGDFYTCIAQRSTNRMLIYRWMHLLNGSSLTLHPPGSTTK

SEQ ID NO: 145970 - protein, 50 aa, Triticum aestivum
  Clone ID: PAT_TA_40388.pep
FLIRGVSYQNSYSISPPSLLILGDTIEKIKMATVWPLIFFPHQQHHLNVI

SEQ ID NO: 145971 - protein, 38 aa, Triticum aestivum
  Clone ID: PAT_TA_40389.pep
IMYVDSCARRAFILFRILVLYSIGSYDYICSNLVEFDP

SEQ ID NO: 145972 - protein, 40 aa, Triticum aestivum
  Clone ID: PAT_TA_40390.pep
ITDDRNSLLFSAIPLNLKSFSAGKLLLGQKFLRFQNHIAA

SEQ ID NO: 145973 - protein, 49 aa, Triticum aestivum
  Clone ID: PAT_TA_40391.pep
PLVPPFKSAQAFSQSLSGTWKSFLIVKGIPQPCFQTACKSYLQNLLVPS

SEQ ID NO: 145974 - protein, 56 aa, Triticum aestivum
  Clone ID: PAT_TA_40392.pep
RSRPIYSIQAYLREQPMWGVFYLVPQYKLLGLCLDHDHWKNLLPTHLNLLTPDSPF

SEQ ID NO: 145975 - protein, 62 aa, Triticum aestivum
  Clone ID: PAT_TA_40393.pep
VSDPKTNGPIRTITYSNTTPHLDMQLVLELQPNQLITMTRRNTNLTPKNKPFTSRLVLLFST

SEQ ID NO: 145976 - protein, 61 aa, Triticum aestivum
  Clone ID: PAT_TA_40394.pep
VCYYEQEGCHLWDQQTLFVNIVIAFCREKEGTGKNKVRLCCCCMCLYIYNKCWIFLERPVD

SEQ ID NO: 145977 - protein, 90 aa, Triticum aestivum
  Clone ID: PAT_TA_40395.pep
VNEINFRKKHRVYMVQHELLISNSKRIPTPALENKPFSPRQVLFLLPLKVAPSIASDASGERPCIECFWRATPRDWRSLRRSALLLQPPH

SEQ ID NO: 145978 - protein, 106 aa, Triticum aestivum
  Clone ID: PAT_TA_40396.pep
EPPPPPKKGISKFFSPPLFFSPPPGVLNFQTPPPFFFFFFFFFFFFWFFFFFFFFFFFFFFFFFFFFFFFFFFFFPAGARTPKSFPPFQWLHHGNSTLWLHQVWGF

SEQ ID NO: 145979 - protein, 47 aa, Triticum aestivum
  Clone ID: PAT_TA_40397.pep
PSARARRKKERRSAPAGRRLAEGGSPSGASLLISGRMASPFDPCLMN

SEQ ID NO: 145980 - protein, 111 aa, Triticum aestivum
  unsure (1)..(111): unsure at all Xaa locations
  Clone ID: PAT_TA_40398.pep
GGPTRPRPTXPAPTARGTXTNQPAEGTDDSPHXRGNEDGPAHGNXHDGPSAHTGPXRNTPXHGQAGTRGANGHDANRSDGHTKDGDANNNEGAPTTAPAHTHTGRKKEADK

SEQ ID NO: 145981 - protein, 75 aa, Triticum aestivum
  Clone ID: PAT_TA_40399.pep
DRRDPCQYMRVHDIIQFAVEKFMIWVIWKSLPSLLVHSLIAWTSWVNRWTPPPSPGRHDAADLLYELNFSNFSQL

SEQ ID NO: 145982 - protein, 122 aa, Triticum aestivum
  Clone ID: PAT_TA_40400.pep
MSIPVNGQSVVPPGFRFHPTEEELLTYYLAKKVASQRIDLDVIRDVDLNKLEPWDIQERCRIGTGPQNDWYLFSHKDKKYPTGTRTNRATAAGFWKATGRDKAIYSAAGSGRIGMRKTLVFY

SEQ ID NO: 145983 - protein, 46 aa, Triticum aestivum
  unsure (1)..(46): unsure at all Xaa locations
  Clone ID: PAT_TA_40401.pep
MFGVGGILSYLTGGLLVPHLKGYVXLMRKNSLDFNDFSSTVMDGIT

SEQ ID NO: 145984 - protein, 57 aa, Triticum aestivum
  unsure (1)..(57): unsure at all Xaa locations
  Clone ID: PAT_TA_40402.pep
KQKTAGMSLPRPFPVLDPSYKVHRMXVVRFNPHHPKKKSGMVRLSFRRRTYEGDEMT

SEQ ID NO: 145985 - protein, 71 aa, Triticum aestivum
  Clone ID: PAT_TA_40403.pep
PLSPPAYRGFLLRAQIRTPSFSHVCVPALFFMSVELFCNKTFVYFLAALNLDGQWFRLIKPPHFFWSVVKT

SEQ ID NO: 145986 - protein, 98 aa, Triticum aestivum
  Clone ID: PAT_TA_40404.pep
RLLSSLGPVPLCRQFTCLVEIQGNQILDTDRTAQSTGSPIDRVRGPSCARMFSDYLSESKEDSGIKNIMVLERGFNGWEISGQPVCHCKDAPCKGTCS

SEQ ID NO: 145987 - protein, 75 aa, Triticum aestivum
  Clone ID: PAT_TA_40405.pep
RINLLAARQVLIDRLLLAAKDVGPHGLQLCHVGLDAGEGRLRDRLLHHLRQPDEAPAGQHGARVHGLHGPQVEAL

SEQ ID NO: 145988 - protein, 86 aa, Triticum aestivum
  Clone ID: PAT_TA_40406.pep
DRMGGSLGFGMSPQGRARSEPVVVRVGVEGSRVFEDRRWSWMEAVEGVTDGGGGRGDRRGHRMRGFCARPRPTPLLLAARYARKRR

SEQ ID NO: 145989 - protein, 85 aa, Triticum aestivum
  Clone ID: PAT_TA_40407.pep
PYKFVGLFPAGLSRRALWHLQSVRLRHESALPYPIARSRRYIGETACGGGLAARVPRQGREVRLGLQPPPVGSRTRGSYPGLPVR

SEQ ID NO: 145990 - protein, 119 aa, Triticum aestivum
  Clone ID: PAT_TA_40408.pep
APTRAPNVVYSNILRLNHDLAVVGVIAALVIVVVTAVTQPADLTRRIDTGCTATNPTWRTDAGRTVLRHDPGDIRRASSSPATHARRPSAPRMSRAHPTRPTSPTALLRSARPARTRRA

SEQ ID NO: 145991 - protein, 75 aa, Triticum aestivum
  Clone ID: PAT_TA_40409.pep
GAAAYWLRPLRLGRPRRSAARRWCASTGPGGPSWRADAVAAGGRQEEGAPNTNLGARGEKIGRWGEARGALNYVL

SEQ ID NO: 145992 - protein, 40 aa, Triticum aestivum
  Clone ID: PAT_TA_40410.pep
WNRTPAPPLYLKLVMRGHVCFVAQTSHLLIYDSITFLMER

SEQ ID NO: 145993 - protein, 135 aa, Triticum aestivum
  Clone ID: PAT_TA_40411.pep
MAFSHGGTWPVTPAVVLLMGGLFAAFPAASGGHVDAGDMLMMDRFRQWQATHNHSYLSAEERLRRFQVYRTNVEYIDATNRRGDLTYELGENQFADLTGEEFVARYASSHEAGGGTSSVITTAAEADGMWSSGGG

SEQ ID NO: 145994 - protein, 63 aa, Triticum aestivum
  Clone ID: PAT_TA_40412.pep
WGSMWVGISLPGGASLSVGLTNLHGERLPNVACLQTVNPPEAPANLHYLLKSNTSSNREISLF

SEQ ID NO: 145995 - protein, 114 aa, Triticum aestivum
  Clone ID: PAT_TA_40413.pep
RPCRPARAAGRCTLQTSWHQQTTDRRWITKEEKPLTVISPLASLPHLIPWVTAPTPTPSSRRTSWMKTMRMILCRTLPVLPPLALSRKLRSDFYAVNILPKCRHLHSHAVKLRR

SEQ ID NO: 145996 - protein, 120 aa, Triticum aestivum
  Clone ID: PAT_TA_40414.pep
MARNSSPTRPVTNRHKYPPLLASEVQTRHRPRERNQQIPNQSRLRSTPGSSNPHRLKMQIFVKTLTGKTITLEVESSDTIDNVKAKIQDKEGIPPDQQRLIFAGKQLEDGRTLADYNIQK

SEQ ID NO: 145997 - protein, 64 aa, Triticum aestivum
  Clone ID: PAT_TA_40415.pep
VDLFGKTVSRSSVSQTSCSARNTTDEIESCGEKGANLYKVYKLIMISRVPGYGHLEYLVLELFD

SEQ ID NO: 145998 - protein, 72 aa, Triticum aestivum
  Clone ID: PAT_TA_40416.pep
VEAKKRKKVKKGMLHVMERTKDCFTVLFTSVYMGGHIDYRACLAGPKLDILKSWMAYYNILTSVRLFFVKSV

SEQ ID NO: 145999 - protein, 102 aa, Triticum aestivum
  unsure (1)..(102): unsure at all Xaa locations
  Clone ID: PAT_TA_40417.pep
MVCSRGCPEKLGGAPKVAVDNKVYAKAQAVKVAKVVMFGSIKRTAXKILTSVTFYRPKTLVKARDPKYPRIITLGRNXLDQYLILKNPLTXTESGMKKIEDN

SEQ ID NO: 146000 - protein, 132 aa, Triticum aestivum
  Clone ID: PAT_TA_40418.pep
MAASGGSCGGCAWPDLQPEMLGVVLSRVPSHADRVRLAAVCRPWRSTARLLRPLPRARRRQALAGELLPPLLPWLALCDGTFLSLPDGAVHRLPVADDASSRVSTGSALFLVHGDGRCCLMNPSPVTTSPVP

SEQ ID NO: 146001 - protein, 60 aa, Triticum aestivum
  Clone ID: PAT_TA_40419.pep
NGSIQRVASLSSYWATVIRGGIWTTSLFCLLTNFKLFFFFEPLFSIAGLAIFMGCFCLVP

SEQ ID NO: 146002 - protein, 83 aa, Triticum aestivum
  Clone ID: PAT_TA_40420.pep
DRYALDRLKLACAQKLWEGVSADTVADALACAEIYNCQELKSRCIDFVMAKDNFKKTVLTESFISLLHKFPSIRAELRAKVGS

SEQ ID NO: 146003 - protein, 87 aa, Triticum aestivum
  Clone ID: PAT_TA_40421.pep
LVVAMLLLWCGRVVIGRSVCVVKNDDLFATGCKFFCCRGLLSRFRDDDTGLRRSSCVMVVLGDYRCSWSFVFAFQWACKSQLLWTDS

SEQ ID NO: 146004 - protein, 134 aa, Triticum aestivum
  unsure (1)..(134): unsure at all Xaa locations
  Clone ID: PAT_TA_40422.pep
MEAAPMEPLVPAPVAVMAAPPRRRRRSMRVAAPAPAPPPXMLSAFEKEQEDVALCXLMLSRDSTGGMRGSPAPKQAHLPRNGYGYNSDEDSALFQYGDAKTKSVAKSKKRRTSHYALNSASPKQRGEAAPPPAK

SEQ ID NO: 146005 - protein, 36 aa, Triticum aestivum
  Clone ID: PAT_TA_40423.pep
CFQFGIFSFNFLVFSQGVLFGHQLTNEFNFFYYGWL

SEQ ID NO: 146006 - protein, 101 aa, Triticum aestivum
  Clone ID: PAT_TA_40424.pep
RPDASVRPVDLGRLVNNAMGRDGETEASLEPKDSQSATRDFMDDNTEGLACRKPTPLYGTTVGTPGAEFYHALKEISSDGATLSSNSIDDQCCETPHNMLT

SEQ ID NO: 146007 - protein, 136 aa, Triticum aestivum
  Clone ID: PAT_TA_40425.pep
MCGGRRRRRGGSDATAGEPGGWGFCAPALAFLALAAAAAVAFLEGTAGGVAYAGDGWFHECAKWDAEGGRFLVSTFFGAGVAEVRVGAGGEEALAERVVVADPEVTGRVALGLAVDAPRQRILVAYADRPPSFGYA

SEQ ID NO: 146008 - protein, 67 aa, Triticum aestivum
  Clone ID: PAT_TA_40426.pep
KIQRCRHSYIKQEAMGKANTWRRSEDQRVQKMKSYISRFLPVAQQKVVLSTLLQLGAIVGRLVAHAS

SEQ ID NO: 146009 - protein, 38 aa, Triticum aestivum
  Clone ID: PAT_TA_40427.pep
KLRVTPWIDNKALVMLHRTFVHGKIDWRWHPLTLWYLD

SEQ ID NO: 146010 - protein, 43 aa, Triticum aestivum
  Clone ID: PAT_TA_40428.pep
GPDALLRPVKVRTLDNYGMAGHLENDPFLEHYDSHSATSNTDA

SEQ ID NO: 146011 - protein, 61 aa, Triticum aestivum
  Clone ID: PAT_TA_40429.pep
SKVGLFDSMYNQSTTDSILSMDTGQRKSNIKRSETDSTTLNSKNISRNQHMENYEIFFTLL

SEQ ID NO: 146012 - protein, 125 aa, Triticum aestivum
  Clone ID: PAT_TA_40430.pep
LAMAPQRQQQQQHKAAVIALFLLSALVAAPAVAASRPESGGYAPATPSEAATPAEPASSTPADAASPSKKAAGYTDSTPAEPSASTPADAATPAKKAGGYTDSTPAESSASTPAQAATPTDAAAS

SEQ ID NO: 146013 - protein, 92 aa, Triticum aestivum
  Clone ID: PAT_TA_40431.pep
MLSTMTHLIEDSDMELLMAMASTHGHHHLAADAATYRAAHPSPSLVTQLDDDGDTHRPLAASRRQRRSPCAANVPLTWSLPRRHRRLGSTRL

SEQ ID NO: 146014 - protein, 88 aa, Triticum aestivum
  unsure (1)..(88): unsure at all Xaa locations
  Clone ID: PAT_TA_40432.pep
MPKKMGVNSKAEAARERRSAEESDRRQRAERAKEEEYWREAEGSKSRAARXREEEAEKRAEAAARKAENRRLAEAEAAAVAFAVSKTD

SEQ ID NO: 146015 - protein, 121 aa, Triticum aestivum
  unsure (1)..(121): unsure at all Xaa locations
  Clone ID: PAT_TA_40433.pep
LRPCPGGEKNCKANMGLWTYNIYISKVLKQVHPDHXMCCKAMIIMNSFINDIFEKLACEAVKLVLYNKXLTITLMEVQTLVRFVLPGELVKHALSEGSKAVSKFTCSYILFFVEFLLVCYF

SEQ ID NO: 146016 - protein, 69 aa, Triticum aestivum
  Clone ID: PAT_TA_40434.pep
LQSFPKKMLGDELTTHRIRTECLVHTVCLTNRIPQAMNIHLILRISHQWTIWYYSGSALFLPDGILTQS

SEQ ID NO: 146017 - protein, 137 aa, Triticum aestivum
  unsure (1)..(137): unsure at all Xaa locations
  Clone ID: PAT_TA_40435.pep
KTDEYGDVENRDLSTSISGERKNDEIDKMASYYEQIANEKRAAFRGRXLQIIYHASAGATLLTDVTFWGLLVPXSYRDKFGLSMVTDGMHSGNAALLLIDTLLNNMPFAWYRIAFLVFWRCFYVTFQRVIHAYGAVS

SEQ ID NO: 146018 - protein, 144 aa, Triticum aestivum
  unsure (1)..(144): unsure at all Xaa locations
  Clone ID: PAT_TA_40436.pep
EKQQSVGLQILISTLEHSSQHSTGAYTDTTESGAVGRVPTPLGLPVAIPDEAATSRSAIASAHSAVDRFKGVVPQTNGRWGAQIYDRHARVWIGTFPDEDAEARAYDVAALRYRGLDAXNNFPRTGASTELDFLAAHSKAEIVD

SEQ ID NO: 146019 - protein, 43 aa, Triticum aestivum
  Clone ID: PAT_TA_40437.pep
PNTGWGAQIYDRHTRVWICTFPDEDTEARAYDVAALRYRGLDG

SEQ ID NO: 146020 - protein, 102 aa, Triticum aestivum
  Clone ID: PAT_TA_40438.pep
LESGLVLEALIIYIQEVIDQLHNQGLVPTQGRYTVPMSHAVPHTECHAVTPGTGHCTAHAIHHGNTVYAEGAASNIGDQLTYELVLEDASLSTAAYDVKSAL

SEQ ID NO: 146021 - protein, 97 aa, Triticum aestivum
  Clone ID: PAT_TA_40439.pep
FVSSKNLCADVGLNFFILTRNLGRIVFVCAGMSPCYWENGMCLCHAQEYMLVTTLFGCQRLAECSGCKLNTPKTEATPPEKKRRAAKNVGLSLCMSS

SEQ ID NO: 146022 - protein, 129 aa, Triticum aestivum
  Clone ID: PAT_TA_40440.pep
QQMKLQQEQQMKLQQEQQMKEQRMKQQLAEQEQQMKQAAEQERQMKMQQQQQLALSDDDEGDSFEVESITKQVAAAAAGKTKQLETDPAYDYSPSKTEKAAFAQLPPPAPPNKLQTMRGVFSEERRDEP

SEQ ID NO: 146023 - protein, 140 aa, Triticum aestivum
  unsure (1)..(140): unsure at all Xaa locations
  Clone ID: PAT_TA_40441.pep
GRVGSPLTRIEGFVSLFAQAKDKRFFSIPSRELLRFXHCVPFYRTHXNERGGVAEELLELDTAALSSDLETEFPFITLNTYMCSELISYPYPESEFHNFEEDRSCEKFESGQIWALYNDADTFPKVYGWVSKVEIQPFEV

SEQ ID NO: 146024 - protein, 54 aa, Triticum aestivum
  Clone ID: PAT_TA_40442.pep
ICITKALLELKKERVPSEQIYRNFYHCFDLSHEVFILCLNQRGKRGYKAFFFSM

SEQ ID NO: 146025 - protein, 146 aa, Triticum aestivum
  Clone ID: PAT_TA_40443.pep
PTRPHRERFCRARSPVARDRSPIARGGSPVTCAPRQRSRSPPIQPCPSLARSWVEVVGHSSLCVSVPPRSQSGCCKDSNVCTSLVSALESQLALLRTELLQEVELLRIELRDTLAKFEVASVVPLLPELQVGSIDEDAECCFEDFS

SEQ ID NO: 146026 - protein, 46 aa, Triticum aestivum
  Clone ID: PAT_TA_40444.pep
LAFRIDNSTFLFVRFYLTKLTLTDQLMSSISVSVNFCFTKLFNCSA

SEQ ID NO: 146027 - protein, 88 aa, Triticum aestivum
  Clone ID: PAT_TA_40445.pep
GVGWIYFIPETPFYTITRGLTQPSFFESSWTVSLLLAGEGGHHQLFFFQKNFSGTAVETTKKKTPTTSSLHLFFAPSQELILLRQGCF

SEQ ID NO: 146028 - protein, 89 aa, Triticum aestivum
  unsure (1)..(89): unsure at all Xaa locations
  Clone ID: PAT_TA_40446.pep
ALARCALLFPPLRSCWLAFGCSVGVXFVPXALALSAVAFALLLCRLLLSWAFAPCASPLRLVGLLVSACVRWLCXRGRARRPPRAFRXG

SEQ ID NO: 146029 - protein, 114 aa, Triticum aestivum
  Clone ID: PAT_TA_40447.pep
VFETISPSQASLFFRINNSTFLFVTFYLTKLTLTDHLMSNILFNSNFCFTKFSNCSFLNKKIKSLPSSLKDPILRTRACLHISFLYLYLNLIYFPFFYKLITLKTLSFPNLNLP

SEQ ID NO: 146030 - protein, 135 aa, Triticum aestivum
  Clone ID: PAT_TA_40448.pep
LSPDNPTPAPPLPAAPTTTAPAPSTGPSRLSPDNPTPAPPLPAAPTTTAPAPSTGPFRLSPDNPTPAPPLPAAPTTTAPAPSTGPSRLSPDNPTPAPPLPAAPTTTAPAPSTDPFRLSPDNPTPAPSLAAAPTIT

SEQ ID NO: 146031 - protein, 40 aa, Triticum aestivum
  Clone ID: PAT_TA_40449.pep
TINTFTKSHICHLKAHLNLPNFMYTCLNSLLKHSYLIPFL

SEQ ID NO: 146032 - protein, 63 aa, Triticum aestivum
  Clone ID: PAT_TA_40450.pep
FLPTMWQDLGVTTQQQKLQDTLTHEYKTPHACTSKAPLTKSPCGVSTTQGHTNNDQNAQLHNK

SEQ ID NO: 146033 - protein, 86 aa, Triticum aestivum
  Clone ID: PAT_TA_40451.pep
AEDDAVAAPITTSSCHTQWPPLVVDGAFATPITTPSSPRSIAPQPATSGIAPPPAITSRRRPPPHMESTASPPSQPLPPPPPRRPP

SEQ ID NO: 146034 - protein, 118 aa, Triticum aestivum
  unsure (1)..(118): unsure at all Xaa locations
  Clone ID: PAT_TA_40452.pep
RPLPCSIQQRASRSAPRPSQPPPGPAVQRPPGPASTSPXSLPLTSAWASAPGPXPPRPARPPPPTWAEPMGENPPKRPCPVQPGRLDSARMYFFYLPANFVIIRRITELQKTPCCSCI

SEQ ID NO: 146035 - protein, 116 aa, Triticum aestivum
  Clone ID: PAT_TA_40453.pep
VREGVRQGGLGLRGGFRRAQGAPVPGGQGGDGERRAAPAAVRRRARQGRAPVAAAQVQRRLPADDHHWHRHNQPRQVMHACVEHMWFFFACDKAPIVYSVLVCLFYRNLIKRGNSY

SEQ ID NO: 146036 - protein, 81 aa, Triticum aestivum
  unsure (1)..(81): unsure at all Xaa locations
  Clone ID: PAT_TA_40454.pep
RNRLKERLDKMHKEKLLDGGDVLDDXTKHTLKKEEVSAKVLEFVESPCITRDVVSSDVNKEKNRLRKTKGTFGEKMMYADP

SEQ ID NO: 146037 - protein, 119 aa, Triticum aestivum
  Clone ID: PAT_TA_40455.pep
RPRDADHRTTFISRHRTATGRPRHRAAASHHLAPSATPATIAAGTVVAATDQQGSDANCWRHLTSQRHFFFYLELPLTTLFSLSHNSLVFSLKNSLMNTHTHAHIYQGRGTALPETLPW

SEQ ID NO: 146038 - protein, 64 aa, Triticum aestivum
  Clone ID: PAT_TA_40456.pep
LSKDQLLLRRGFLSSHSPKPSFRCFFCHTCNQNIFLLHCPNYKISPHYLESSSNNLQHSKPRKH

SEQ ID NO: 146039 - protein, 69 aa, Triticum aestivum
  Clone ID: PAT_TA_40457.pep
MASLDNVSSAVSTAGINKTSRSTHRWTMPEHKECIAIQLKLFIVVLYFDYVATCRTLVFPRLIYHVMLL

SEQ ID NO: 146040 - protein, 70 aa, Triticum aestivum
  Clone ID: PAT_TA_40458.pep
VTTSNRREAARDLATSPAYWPSRVSSRVAEAVNPHEAHCWQCYYSCMQQKCGGYRNPAAHTACNDSTAVA

SEQ ID NO: 146041 - protein, 47 aa, Triticum aestivum
  Clone ID: PAT_TA_40459.pep
KGFIIISEQSDFVHIYSKRRPPRRHCFPDNNLPAAYYMHSVCYLGLI

SEQ ID NO: 146042 - protein, 117 aa, Triticum aestivum
  unsure (1)..(117): unsure at all Xaa locations
  Clone ID: PAT_TA_40460.pep
IFVKTLTGKTITLEVESSDTIDNVKAKIQDKEGMPPDQQRLIFAGKQLEDGRTLADYNIQESTLHLVLRLRGGMQIFVKTLTGKTITLEVESSDTIDNVKAKIXDKEGIPPDQQRLI

SEQ ID NO: 146043 - protein, 114 aa, Triticum aestivum
  unsure (1)..(114): unsure at all Xaa locations
  Clone ID: PAT_TA_40461.pep
TIKKKKALTPCEAKANTYLKSVIIRLSLFYQVSNSLXNAFYNHILQXLRKKYNLDQRFXSLAYKLEFVKHNIHFFPKLLRNERSNFSQXGVIILLAIEIVISLCEINKYSSMMS

SEQ ID NO: 146044 - protein, 49 aa, Triticum aestivum
  unsure (1)..(49): unsure at all Xaa locations
  Clone ID: PAT_TA_40462.pep
RIAISTHAYASYKGTIKWRTNNIAAXPLMSRFFQGTHTFSFFFRNMSRI

SEQ ID NO: 146045 - protein, 141 aa, Triticum aestivum
  Clone ID: PAT_TA_40463.pep
EKINRAHFMLNKIEKEKTLEVENLEREVVSLTAQVSSTHEERENATVDAIREVSVLRAEKAKLEANFENVSAQLRHYESQLEDLRKESKSKIKGLVDSLNASKQSEEMLTADAEHMKKLMETAKSNEDELRKSSGELELKL

SEQ ID NO: 146046 - protein, 61 aa, Triticum aestivum
  Clone ID: PAT_TA_40464.pep
KGTGEAGLRSGGSAQSHSNDTEKDSMQFMEETPISFTKNLVALICNMGKVHFIHSVVVVLF

SEQ ID NO: 146047 - protein, 82 aa, Triticum aestivum
  unsure (1)..(82): unsure at all Xaa locations
  Clone ID: PAT_TA_40465.pep
ASLFQKVPXLECTSLHNLKHKMQYTEATIMAQLIRPXSIRSPSXDMLSLSRFLCVAQAQARFLRRXXCWYRDRGGSDYPAEA

SEQ ID NO: 146048 - protein, 119 aa, Triticum aestivum
  Clone ID: PAT_TA_40466.pep
LVLDAGGRRVVDQKSPAAGLAFPPLAPSPSAVFMLKLLRLRPPAPFMEKLFSCTPAAASTGAAVWLTSRSPSRARPSRVMRSSLFLAPAIDAFARLRDCADGGGFMCLLRWIIREPTRP

SEQ ID NO: 146049 - protein, 71 aa, Triticum aestivum
  Clone ID: PAT_TA_40467.pep
KASMAGARNNELFMTLLGLPLFRAPGSQPHRISIRGWDILDSLHLPHVFRGDKHNKWFYDIHGFLLIAKLL

SEQ ID NO: 146050 - protein, 136 aa, Triticum aestivum
  Clone ID: PAT_TA_40468.pep
HAFDQQETNELEGSSAGGGGGGPESGNDPSGADDLHSPTTTGAQQHPQQQVVMQHGGGRYGQQEHGMSGVHPHKLDPGAGPSVADAAFVGLDPAELLGGDAHVGAADDLYGRFEPGVRMRYGPAATGAVSGDVSLT

SEQ ID NO: 146051 - protein, 121 aa, Triticum aestivum
  Clone ID: PAT_TA_40469.pep
MSSSKKAGAHRSGGMRPAPPPPQPENPTFCLFPPGSSGHSSMDTDEAGGSRFYAWERDRFAPYPLMPVDCETSWWSSQQSHGASESTPAPAPRRLFGQWIGLGRSSPENRSPEGSSYRQMH

SEQ ID NO: 146052 - protein, 94 aa, Triticum aestivum
  Clone ID: PAT_TA_40470.pep
IRTKPEQREEEDAVSAVAETPMSARWSPEAEIGMRVEDIWDRLDQPQLCRSDKLNSCFDAMPVCSLPQTLGAQLVDMHSYATLAEGVYILCRNR

SEQ ID NO: 146053 - protein, 63 aa, Triticum aestivum
  Clone ID: PAT_TA_40471.pep
FGWVIYYMQDKNRGPDAWEIKTVAPNRTPENLTGYGTASNLSTIVATTQPDGMVWPGIDLERA

SEQ ID NO: 146054 - protein, 113 aa, Triticum aestivum
  Clone ID: PAT_TA_40472.pep
KSLRLGGCYVSSVLLRHLMFFSCPCMQLDCCLLPVFYWVFLGYTFLDPLLVFYVSAVGVMAFWSGRFVLWALAQAVCFLFGPWVWLIKCPFSGALSQVPRTVSFPFFFFFSLF

SEQ ID NO: 146055 - protein, 66 aa, Triticum aestivum
  Clone ID: PAT_TA_40473.pep
ESKFPVKNNVQSYFRTLAQQVCMSNYAPFFLRVKNVLLNSLPAVFIYLTIRALLRYYFLSSRPKGS

SEQ ID NO: 146056 - protein, 49 aa, Triticum aestivum
  Clone ID: PAT_TA_40474.pep
QERRASTLPCISWIILCVVEFATAISIVLTCLRLCGAATDFEIQVWSSI

SEQ ID NO: 146057 - protein, 63 aa, Triticum aestivum
  Clone ID: PAT_TA_40475.pep
CPVLFQKLWHIRYACATMLLFHSRVKNVCFGSSTSCVYFPNCQCSIGKATAKQLIISILKKST

SEQ ID NO: 146058 - protein, 81 aa, Triticum aestivum
  Clone ID: PAT_TA_40476.pep
VKLAGLTSITCYYSQNLAPALKNTLSDTQFARTCTTSSTASNSKTGCAKRTPSNKHSPRLSSDHTYDTRLMRALNICEFLF

SEQ ID NO: 146059 - protein, 50 aa, Triticum aestivum
  Clone ID: PAT_TA_40477.pep
LRSSLFFQFLFCSVVSLDSIMQFSICLDKDNGCIWDVMCYVMIHFVPGVC

SEQ ID NO: 146060 - protein, 49 aa, Triticum aestivum
  Clone ID: PAT_TA_40478.pep
SILPQEFARTHWTEIFLILNQFRKESNYNYDSFTKLNMCFSRSIEKPLC

SEQ ID NO: 146061 - protein, 96 aa, Triticum aestivum
  Clone ID: PAT_TA_40479.pep
TIDIALSIAGRVSSHLAGSRRDRSPPHRPQGQRRAQPTDSTLPPGATSTTMASRACARAFGLTALTPQDLDRQAVVVATQPPLTYESSGLLRKLGT

SEQ ID NO: 146062 - protein, 93 aa, Triticum aestivum
  Clone ID: PAT_TA_40480.pep
HSASPARSLHIWRAVDETVLLHIGLEVNDAHNLRTRLFHPELHRPRWRVGHVQELLVFQRCRRRTRIVRPSWRQSSRRSHMGLQVGCGILGHG

SEQ ID NO: 146063 - protein, 61 aa, Triticum aestivum
  Clone ID: PAT_TA_40481.pep
TTAKETRAMKKQATQKTTARKVNDRDGEEKSVLNCAEIDQNERTLHDSAGSCAGSLRCHER

SEQ ID NO: 146064 - protein, 61 aa, Triticum aestivum
  Clone ID: PAT_TA_40482.pep
IYRGNLFCMRKIRVYMNCAFVFLSLYYIYKRFVVCSRDVNPPPGLFLCGLYFYYPRRLGCG

SEQ ID NO: 146065 - protein, 48 aa, Triticum aestivum
  Clone ID: PAT_TA_40483.pep
AIAVICGSIPSIFSFSHHCRWCPKSVGVLVHQVNDKHKTTVNKKVLFT

SEQ ID NO: 146066 - protein, 88 aa, Triticum aestivum
  Clone ID: PAT_TA_40484.pep
KFQWQQHMKMEVWSMPFLFCRFFFPFVWWCFVIHNILLICFLYFLLPIKMGIDIIQFNHLFMLPGFSSIYIYVCLSAHLCLQNNTSIV

SEQ ID NO: 146067 - protein, 70 aa, Triticum aestivum
  Clone ID: PAT_TA_40485.pep
HAYEYTRRRLMRYCHRYGRDRYRQRDHHRISTNGALALLITRGLSRDTSSWGSTSRNYSTKHLRMGGSNL

SEQ ID NO: 146068 - protein, 126 aa, Triticum aestivum
  Clone ID: PAT_TA_40486.pep
LLRRTRGPVLDLPFPPAPCLKIRPSCRHRPPDQAAPAPPVLDPAAALSTSAPYLSDSAPARGDAKPSCYSIGSHRGASRAPSLPLFLSFLLPHTLSVWSPAGTRHVHHGQQPCGKSSSSKFLSTGR

SEQ ID NO: 146069 - protein, 67 aa, Triticum aestivum
  Clone ID: PAT_TA_40487.pep
MSPPGWKFEPGGQKGRQKFSELRKKNTQTFDEFPRHRQPYRDGVHGGSRGDSGRSRGSYYRGGRGDY

SEQ ID NO: 146070 - protein, 96 aa, Triticum aestivum
  Clone ID: PAT_TA_40488.pep
SAAAPAGRRREPASLGRVWELCSWLPPFLPTPQGGGVLVQGRRRGPATGEQPVGVVSTGGAGGEWGACRYDFLLQPSSDFATTDTKFCYKDFMVKL

SEQ ID NO: 146071 - protein, 48 aa, Triticum aestivum
  Clone ID: PAT_TA_40489.pep
IGAGLKRLVFLRKREHQLRATTHRLDLVSITIRYSSMTKDKLTYMTPV

SEQ ID NO: 146072 - protein, 61 aa, Triticum aestivum
  Clone ID: PAT_TA_40490.pep
FYLELALSMNVNSLDILLINMCTLQAEAASMEQTHIHFLLYAVWYKQYENSRNGSEVGNIN

SEQ ID NO: 146073 - protein, 74 aa, Triticum aestivum
  Clone ID: PAT_TA_40491.pep
TSIRSLAEGFYVGVPHPMGELCAALNTVVADHSMPGTDQEVQGLILLSHSGLRLIQTAQVTDEACHGQHLSPQA

SEQ ID NO: 146074 - protein, 97 aa, Triticum aestivum
  unsure (1)..(97): unsure at all Xaa locations
  Clone ID: PAT_TA_40492.pep
IAGSVNNIEVEVDMPLVLTIVQKYQGCIFITVETSGRNAIXSVLKSGDQVLYTXSFFGDELGTANKLVFTMTDFQAKPDSVYFVVSYVGGYIDVTPL

SEQ ID NO: 146075 - protein, 101 aa, Triticum aestivum
  Clone ID: PAT_TA_40493.pep
MSCQEMSRRRRRLAPSPAVEPPMEDENLLFEMLLRLPPDPCSFPRAYVGCKRWRRLIFDPGLFRRFRLHHRRNPSFLGSFSHLYLVPTMEAPNRDPDGHFC

SEQ ID NO: 146076 - protein, 61 aa, Triticum aestivum
  Clone ID: PAT_TA_40494.pep
IHRVLVGTRSQCLSYNIKFSSIHRKIFSTIFTCFVRSVWLNFRVKYSMVRDELVCKLSVMN

SEQ ID NO: 146077 - protein, 87 aa, Triticum aestivum
  Clone ID: PAT_TA_40495.pep
NRFFSRVRTHISCCSKPDNLEDELDSNNDAMVSICLSVRLCDKPYILFRQNSGAAIIHTVFGMAVVRQNSYRLATSLEIRFCCNLVV

SEQ ID NO: 146078 - protein, 50 aa, Triticum aestivum
  Clone ID: PAT_TA_40496.pep
IQIRPPFFFFYYIVFFFFSFFFFFFFYFLVFFFFFFFFFFRTSNVGCLRR

SEQ ID NO: 146079 - protein, 124 aa, Triticum aestivum
  unsure (1)..(124): unsure at all Xaa locations
  Clone ID: PAT_TA_40497.pep
EQASLSSQQLDKVSHYRLSIVRCDLDDELKVVLRPLSNLKYXRVKYCGFTKIEFHAAKLSTFVYKGDCIPIALHQAPEMENAEICFCASTFRRGSAVVLNGLPHVQNLTLKISVEVLETSLDIR

SEQ ID NO: 146080 - protein, 109 aa, Triticum aestivum
  unsure (1)..(109): unsure at all Xaa locations
  Clone ID: PAT_TA_40498.pep
PRVRCQAHRYYLQGPKAGHYELLADLPGYPDNVRRDEKGGYWVXXNQEKGRPGVTTAPVKHLVGVRLDGGGVEVEELTAAKGVTLSEVTERKGQLWLGSVELDYIGLVV

SEQ ID NO: 146081 - protein, 54 aa, Triticum aestivum
  unsure (1)..(54): unsure at all Xaa locations
  Clone ID: PAT_TA_40499.pep
KLTLFSLRYHQEGDSQPLVVYLEAASKSSRTTGTIINHFLTEDSYHLGASKVXE

SEQ ID NO: 146082 - protein, 90 aa, Triticum aestivum
  unsure (1)..(90): unsure at all Xaa locations
  Clone ID: PAT_TA_40500.pep
PVCKSGRRRIPPSAPGWCCPVTSVESPTANTAGMSCGPTTALEEERGXAADAGEADRRRSAARKSAAAGARLGGAHASAHASAHASAHAS

SEQ ID NO: 146083 - protein, 80 aa, Triticum aestivum
  Clone ID: PAT_TA_40501.pep
PLVVEPYLDTMDALVAAWLPGTEGHGVADVLFGDYGFSGKLPRTWVRSVDQLPMNYGDKLYDPLFPFGFGLTTKPAADRS

SEQ ID NO: 146084 - protein, 131 aa, Triticum aestivum
  unsure (1)..(131): unsure at all Xaa locations
  Clone ID: PAT_TA_40502.pep
EQTQEVVLWGKHGESFDEEAILKKSLEGIVIAIFAGITATSQXFTGTIQGSSSSATQVYLDLNIPEVQHYRSSYQWKFPTLQKNLPKVAHLSPLEAAGKLYTIEQISTLPTTSFQGGATFSTIAKVTSIIP

SEQ ID NO: 146085 - protein, 42 aa, Triticum aestivum
  Clone ID: PAT_TA_40503.pep
PERRARILTRNGSHGATTNTCAFCLQQHDDPILKLQTDTPVQ

SEQ ID NO: 146086 - protein, 53 aa, Triticum aestivum
  Clone ID: PAT_TA_40504.pep
YYSYLNHLQQIMPLTLKDLASYEATNRRNVAFCVGELCKNGGAAALKYVTRGK

SEQ ID NO: 146087 - protein, 60 aa, Triticum aestivum
  unsure (1)..(60): unsure at all Xaa locations
  Clone ID: PAT_TA_40505.pep
HAGVTSSLAKPTRIFFWXDDACKIETERLQEQISTSSGHSSLRRLDSGVSPPPTSTSVWQ

SEQ ID NO: 146088 - protein, 46 aa, Triticum aestivum
  unsure (1)..(46): unsure at all Xaa locations
  Clone ID: PAT_TA_40506.pep
LLSLVKLIETEFPDRPLIXXPHTYGSVLCNMDYLHVAHAGGPFKRS

SEQ ID NO: 146089 - protein, 117 aa, Triticum aestivum
  Clone ID: PAT_TA_40507.pep
HLHAAMPLCVVEVATTQVLRGLLTVPPRPPHRAAHLRHTARSIAQPPANTAIAGTPPARRTTPKTTKLMIPIVVAESGCSLSLSSLTDRGRRKETHWTRGFFRPAHERPNLFPLSNG

SEQ ID NO: 146090 - protein, 125 aa, Triticum aestivum
  unsure (1)..(125): unsure at all Xaa locations
  Clone ID: PAT_TA_40508.pep
LFFRGPSVAFSGFLGVFVAVLPVPCPAVAPLRRRLGWPXSPLCPWPFGSFSCWRGAPXLPGACLPSFLVFRAVPALLFLRWXSFLLPRLGSVPAFPAVGVGWLARRAPSPCLARSPLPLSCLPCF

SEQ ID NO: 146091 - protein, 77 aa, Triticum aestivum
  unsure (1)..(77): unsure at all Xaa locations
  Clone ID: PAT_TA_40509.pep
METSSKKMASHLTDIPDHLLAEIFLRLPDPAXXXRASAACVTFRRLATDGSFLRRFRPRSTNPIPLGRRHVLYHSAA

SEQ ID NO: 146092 - protein, 102 aa, Triticum aestivum
  unsure (1)..(102): unsure at all Xaa locations
  Clone ID: PAT_TA_40510.pep
QMQRKGATQNECIAAANGGLAPXVANRDGDFRWKCCKLGRIDXXPFNVKATNDQFGTIADVNAVVTVATAGKTEMFQLLRNDGDKNRKRIKAPNGCLLQANK

SEQ ID NO: 146093 - protein, 97 aa, Triticum aestivum
  unsure (1)..(97): unsure at all Xaa locations
  Clone ID: PAT_TA_40511.pep
DGITVVARKCSRVSPGTRGIVGKGYTRRPSGRTNGTRRHHRVGAEQADRDFSXXMTTTTTTPGTSKCSIPSAAHHPVPPQLPDNSRCLTGAANMKPG

SEQ ID NO: 146094 - protein, 72 aa, Triticum aestivum
  Clone ID: PAT_TA_40512.pep
QKLFKYFKILSIFGYTKEKCCVDRQWMHAWASNGNTSVLAFPTICMYVHNIFKLFTIHSCRRIFPTRLIHGN

SEQ ID NO: 146095 - protein, 35 aa, Triticum aestivum
  Clone ID: PAT_TA_40513.pep
LNGTIDPTSLHGSCPVVKGEKWVATKWIRDRGSTS

SEQ ID NO: 146096 - protein, 95 aa, Triticum aestivum
  Clone ID: PAT_TA_40514.pep
MAPLLKDELDIVIPTIRNLEFLEMWRPFFEPYHLIIVQDGDPTRTVMVPEGFDYELYNRNDINRILGPKASCISFKDSACRCFGYMVSKKKYVYT

SEQ ID NO: 146097 - protein, 111 aa, Triticum aestivum
  Clone ID: PAT_TA_40515.pep
IILFCFLYILIIMRRYSTYFCNHSVPRIDLVASSIISISCVANSKLHLVWSIYDLHSYASFVLLGRGVAIFYSRISSWVDRYQAIQAEGAGHTYSGGTPPLSPQLLMRSCG

SEQ ID NO: 146098 - protein, 93 aa, Triticum aestivum
  Clone ID: PAT_TA_40516.pep
RIAFPHARIMLRQPASAYYRASTLEFLLQVEELHEVREMITRVYALRTGKPFGLGGQTRWRTEFSASRLINSSQCVLFMLRANNVNYCLQAPT

SEQ ID NO: 146099 - protein, 74 aa, Triticum aestivum
  unsure (1)..(74): unsure at all Xaa locations
  Clone ID: PAT_TA_40517.pep
TKKIDLGGKGVERETKAAVAVLGDLANTLGPIXKDLFRNHLFHVEFFREGLDSDKKIREASSWAQGMINQAGVA

SEQ ID NO: 146100 - protein, 72 aa, Triticum aestivum
  Clone ID: PAT_TA_40518.pep
NVQALHSLYVLYAAASQPIVTATYGGQRVLTYTSIIIDHKSFSHKDATETQNYGTYANAIVVAPGPGIYVRT

SEQ ID NO: 146101 - protein, 62 aa, Triticum aestivum
  Clone ID: PAT_TA_40519.pep
RTRGRTRGFACRFFNIEESDLVLRPEIQKERKKHLLGSTNDDLHCHYKRPCCTSVSGFNSGR

SEQ ID NO: 146102 - protein, 114 aa, Triticum aestivum
  Clone ID: PAT_TA_40520.pep
TCEQIQLFLRPSLVHIVAEQPHSYRCPGGHGAVGSSPAGAWPTGSSRCVWCHGGLLGGEHSGVRGIVIERGEDHVRSYPCDWVRTAGGITIGGSRSVSLGLFLSDQPPIQIEFY

SEQ ID NO: 146103 - protein, 41 aa, Triticum aestivum
  Clone ID: PAT_TA_40521.pep
ILYINPLVIYLNSKLLFYMIFYYGNLVRCLFTSFNASIIYL

SEQ ID NO: 146104 - protein, 111 aa, Triticum aestivum
  Clone ID: PAT_TA_40522.pep
MARRVLHLRPHLPSLAPRLVPSRQYMSDMRRSVFLDRLLRSLRSEISSCRAEPAPPLPPSAAPFAIEDRPGEQYVRLRRALSAEEEITVDASMVDGAAAPTRSGVNAEDGG

SEQ ID NO: 146105 - protein, 96 aa, Triticum aestivum
  Clone ID: PAT_TA_40523.pep
MPPSVSLVLALRLYDTGEERCIACYLWEDICPGQALSMEANERVDGSRRTTTFYICMTKCIDCGVWQEARPVLAIDARPNCELFTVTNGGLLNSKE

SEQ ID NO: 146106 - protein, 86 aa, Triticum aestivum
  unsure (1)..(86): unsure at all Xaa locations
  Clone ID: PAT_TA_40524.pep
MASFSEAPPGNPAAGEKIFKTKCAQCHTVDKGAGHKQVMLIXGPNLNGLFGRQSGTTAGYSYSTANKSMAVVWEEKTLYDYLLNPK

SEQ ID NO: 146107 - protein, 35 aa, Triticum aestivum
  Clone ID: PAT_TA_40525.pep
KHGGHSSVLILISPSTNILNSNHTTITLPLTFFSI

SEQ ID NO: 146108 - protein, 61 aa, Triticum aestivum
  Clone ID: PAT_TA_40526.pep
NKDGRGSEINRKLLFNSSQPLAVSFSFGEPHKNFYPRRIKTKTTWVIPMAPTWSFIPKHLG

SEQ ID NO: 146109 - protein, 114 aa, Triticum aestivum
  unsure (1)..(114): unsure at all Xaa locations
  Clone ID: PAT_TA_40527.pep
QDRNARGGGTDARGTRRPTGGPEEEQKGGEEEQSDQTRGAEEAGTGXAERIAQEKEKHTERPADDGRKKNGREDTKGRRGEARKENRQHNKKPGAEEHEERKTRREADQTNKPT

SEQ ID NO: 146110 - protein, 43 aa, Triticum aestivum
  Clone ID: PAT_TA_40528.pep
SRKYRLKQSSYHIITRGEFIPILLLFPAIAKPFKIHGSLLNTL

SEQ ID NO: 146111 - protein, 104 aa, Triticum aestivum
  Clone ID: PAT_TA_40529.pep
PILGSIAPPVDRPVHGDSMFRLMFLLIALRYPSVLHSVLDAESYVWSHARGHGVCKSVSSIFYASFHPFIFQCIPGCVVAFAVPVISQIISICMAIFRWFSHRF

SEQ ID NO: 146112 - protein, 36 aa, Triticum aestivum
  Clone ID: PAT_TA_40530.pep
QSDLLNLAIISLLVCTFTFFMDSLPLMSPRLTNHLS

SEQ ID NO: 146113 - protein, 125 aa, Triticum aestivum
  Clone ID: PAT_TA_40531.pep
SLECVQLSRSLMSDARTLCYCYLVTCYAHTATGSSLVYQARRNLFSKMLTYTHKRHPVGAWTTDRLKAQKQIFPIRGHDARQRCSQYAPNPYFLMLEQINRERLPCSICIRSLNKHPWLPLKSDI

SEQ ID NO: 146114 - protein, 46 aa, Triticum aestivum
  Clone ID: PAT_TA_40532.pep
FSIYNLYNAGRALDKVPIHHSADHNRLRSKRFLYENRLTIIAHQAN

SEQ ID NO: 146115 - protein, 71 aa, Triticum aestivum
  Clone ID: PAT_TA_40533.pep
NAKVSPYIVLLLQIQCSAGCRKCRQKFRRLLGSTLIRARNTRIRAETLGNRLRGAGGGWMGGFPRVRHASD

SEQ ID NO: 146116 - protein, 103 aa, Triticum aestivum
  Clone ID: PAT_TA_40534.pep
YILDSLITALHNQYRRHRTNPSYKTKQIKNTLFRSTVEFNGMQFVGQPCANKKLAEKDAAGEAISWLTGGEAPPVTANARDRQDADHMSVLTKPAPRMRRHHH

SEQ ID NO: 146117 - protein, 45 aa, Triticum aestivum
  Clone ID: PAT_TA_40535.pep
LMGVCLVSIQCPTGGGMYRVYPLSISMGVLTVCNNLLTRTQMYNY

SEQ ID NO: 146118 - protein, 70 aa, Triticum aestivum
  Clone ID: PAT_TA_40536.pep
AFSFVNLVVAPRSIFLKSRVKVDPILLLVKRIALFHVIQMDGVGHGNKVDHMLFSSKLVSNLAGLIRLLH

SEQ ID NO: 146119 - protein, 89 aa, Triticum aestivum
  Clone ID: PAT_TA_40537.pep
SEILLLCDHAWLDPGCNGMLSNLMLHEFCRQKPCLKSAVTCYAIAIVHTGSLFYHDDCSFPRFGFGVIENLYHILFYQAAGVLAGSFDS

SEQ ID NO: 146120 - protein, 44 aa, Triticum aestivum
  Clone ID: PAT_TA_40538.pep
QAKLLNLANISRLVGNIPLHMEKLNLINMCKANELSLMLAHNSS

SEQ ID NO: 146121 - protein, 37 aa, Triticum aestivum
  Clone ID: PAT_TA_40539.pep
MFMFNYIFSLFIIIVSIVLLPPFFFALWTNSFLTIYF

SEQ ID NO: 146122 - protein, 106 aa, Triticum aestivum
  Clone ID: PAT_TA_40540.pep
STSTAIRWTRRNPSWPPSTRRRRRRGQRLHLLDVVRLHGTRPANSEALLDPNCYVVMVFYDGSVLLPLLGLLYLLQLETFSFSHRVFIRVMNAELPAKKESTAHAS

SEQ ID NO: 146123 - protein, 93 aa, Triticum aestivum
  Clone ID: PAT_TA_40541.pep
HTGTSRRQSMYSTAPCLFDAHTHRGESLFVLRTVVWSSAHEPTAAPPTVAILTRIVLLNSWICRAVSIDDPFPQWLRGWPSPCSSYSSSRTAL

SEQ ID NO: 146124 - protein, 134 aa, Triticum aestivum
  Clone ID: PAT_TA_40542.pep
TPATDHAVGHIGDANDDDNKDYDKDDDKDDGDDKDDKDDDDKDDKDDDDKDDDDDDDKDDDDDDDKDDDDDDDDDDDDSGGSDWGKYFKCKKKCIMDCYRSLRHHRRRRRRHRPSPGPKPPSPKPPKPKKFPPN

SEQ ID NO: 146125 - protein, 84 aa, Triticum aestivum
  Clone ID: PAT_TA_40543.pep
RTRGCAAWNLFRPSSTGQFLYPFCTSPIFDGFTYLIRSLFWGKRRSEDEHQMIRLQKLREIRDLTAVIYCFLYHAGIRALPISS

SEQ ID NO: 146126 - protein, 128 aa, Triticum aestivum
  Clone ID: PAT_TA_40544.pep
MEVRPHLLVLLCLLGAGAGAGMAQSLPPAPVPQSGAAAAAPRPTPFGRTMSTVITVAISVFFFLLFFCAYINQCRLAENAAPQGANAAAAGAGASRRGKRGLDPALVATFPIMQYREIKEHMIGRGVL

SEQ ID NO: 146127 - protein, 70 aa, Triticum aestivum
  Clone ID: PAT_TA_40545.pep
GKFFSRKNKLFSRGGICELSFPPLWIGCFTLPVRWSPHQWVQNNMSASFPGAILFPPFVDSFASPRVTRL

SEQ ID NO: 146128 - protein, 49 aa, Triticum aestivum
  Clone ID: PAT_TA_40546.pep
HVGPYQNCQASTLLGDFFGKCMEDPRHWNKGLGLTLTHYFNNTHWLRYF

SEQ ID NO: 146129 - protein, 135 aa, Triticum aestivum
  Clone ID: PAT_TA_40547.pep
GCPGWPVCLEHYITCFSTLYTANHGPICLLFCSCATLTLTPIIWRCTCKLWGASRGMGRGGVELRQGRRRSGWGWRLDRRRRRAPLAPVTAEADSAPTSSPLGGNHMGSISSGVPNRSDHRDSSPALPTRPPTRP

SEQ ID NO: 146130 - protein, 76 aa, Triticum aestivum
  unsure (1)..(76): unsure at all Xaa locations
  Clone ID: PAT_TA_40548.pep
GRFERCLLVVAIPVIPLRMLKIQVMTNQKAVDEINDXQRGGQAVPKHLTEQLVNRRSEDNISCVAVNVRCYESFSQ

SEQ ID NO: 146131 - protein, 115 aa, Triticum aestivum
  Clone ID: PAT_TA_40549.pep
MATETETFAFQAEINQLLSLIINTFYSNKEIFLRELISNSSDALDKIRFESLTDKSKLDAQPELFIHIIPDKATSTLTIVDSGIGMTKSDLVNNLGTIGRSGTKEFMEALAAGAD

SEQ ID NO: 146132 - protein, 124 aa, Triticum aestivum
  Clone ID: PAT_TA_40550.pep
MAVDLEQAGYHAIPADPRDDEAPPVLGNAPAAKSSHMDGPTFLILMLLSVGVTALMLGPMYYMEGANVASFSVGLAGYEGIDPARPGRVVSPAFNLTLRMNKTCADRAEVVLTYSGVALGWARV

SEQ ID NO: 146133 - protein, 97 aa, Triticum aestivum
  Clone ID: PAT_TA_40551.pep
PNSLIIHVRAWLKPFRRSQAQWRRPARPAPPPSSSCCWPSPSPRRPTRRRRASRRSPSPSSRGRRDPSSRGRRRSPPSRGRRRRWTCRRRAWGRCWS

SEQ ID NO: 146134 - protein, 52 aa, Triticum aestivum
  Clone ID: PAT_TA_40552.pep
RWTTPVRFSLFIYFLIIHSFLFLMKLHFFKLQTGGKKIVLKSNYTQGGDSKH

SEQ ID NO: 146135 - protein, 123 aa, Triticum aestivum
  Clone ID: PAT_TA_40553.pep
MAPLAASPLLPSPSPPCHLLLRRCPDSLWLPAPRSPRLPLRRLSRDGGGSECLSRLRHVRPLRAVPVIAPGDQWGNWAFLLSAAAFGTWAEERTAWGAALSGALVSILAGLAASSAGLVAPGA

SEQ ID NO: 146136 - protein, 81 aa, Triticum aestivum
  Clone ID: PAT_TA_40554.pep
WVKTSTPTRVKIRREIVTNNLVHGRLVLANPPPGAGTKQLHARAHGMSCVAISQCMLCVGVDVVSLLVAGSCGSGWCGACC

SEQ ID NO: 146137 - protein, 52 aa, Triticum aestivum
  unsure (1)..(52): unsure at all Xaa locations
  Clone ID: PAT_TA_40555.pep
NTFCXLGFFFKVNKLNNYTSSQRHTNIYKNQTHMMCQNRMRCSHHTTNTFKL

SEQ ID NO: 146138 - protein, 61 aa, Triticum aestivum
  Clone ID: PAT_TA_40556.pep
TRAGVSDCLGGSSEAQDNLLSTMAGTLVLPVDLEITLEGRTSGQYCKFMEPGGLPQCWHSH

SEQ ID NO: 146139 - protein, 112 aa, Triticum aestivum
  Clone ID: PAT_TA_40557.pep
PAMANPLEVTSLGHVQSIVKGYDGIFDLPVRIISIDSLRDAEEIVALLYDKVSEEGGEWRIKEFPLLQRLDKLHDYVRRASTLLDEIDSAVENHDELMIRPQLLRNTGVHTL

SEQ ID NO: 146140 - protein, 41 aa, Triticum aestivum
  Clone ID: PAT_TA_40558.pep
LCSFCKLMLQACVLDCHYSCLCRLIIITLRCGVHDLAYALY

SEQ ID NO: 146141 - protein, 48 aa, Triticum aestivum
  Clone ID: PAT_TA_40559.pep
YNGGHAGFTLWSPNVNMLRNPRWGHSQKTPGEDPDVSRRYTDVYVRGL

SEQ ID NO: 146142 - protein, 88 aa, Triticum aestivum
  Clone ID: PAT_TA_40560.pep
KHWGIWRFFLIRFMTQTWDLQIRVIGRKPTALPPAYPWGRGTIRHTGSFFKIAAQLASVHYLKRGRTPAANTLQYTTTTACSGWFGDP

SEQ ID NO: 146143 - protein, 51 aa, Triticum aestivum
  Clone ID: PAT_TA_40561.pep
SSAKAELQSCRTLLSAGVSFFLCVLVVVVCILAMQRPGIAHCVCIRLSTRP

SEQ ID NO: 146144 - protein, 78 aa, Triticum aestivum
  Clone ID: PAT_TA_40562.pep
SIQSHKSNDAPPDADMYCKPKTRDDVTAKCASSVADTCCIVSADGYNAPQPVSGVKISEVSIGSSAESNTSSVSKGYN

SEQ ID NO: 146145 - protein, 106 aa, Triticum aestivum
  Clone ID: PAT_TA_40563.pep
GRVGNKPTFTSCLTSLSLVRSIDDDTKILHDMTIEVRLPDNKLELGWLESYDLKYNVAVINIGRYHSLQVTCLDHQRQFESHSKVVAVGRCFNSRKLVATAGMLTD

SEQ ID NO: 146146 - protein, 57 aa, Triticum aestivum
  unsure (1)..(57): unsure at all Xaa locations
  Clone ID: PAT_TA_40564.pep
LKDLFCLTAVGHRLRGGRPAVVAGGVGSARAALFGFRLVPCLALKKSKKXGRSGRVG

SEQ ID NO: 146147 - protein, 111 aa, Triticum aestivum
  Clone ID: PAT_TA_40565.pep
PTRPHGPAFLLPRPLHFDRRRTPKPSFAGADGGRRSRRPFLHSSGATHLIGRSSSPRAAMAPGSQKKNTKGVKEVDPTAKLTDDLLVDIISRVPYKVTCCCKCVSRRWRNL

SEQ ID NO: 146148 - protein, 72 aa, Triticum aestivum
  Clone ID: PAT_TA_40566.pep
GRVGLAENAYKDNKKSRIVPRHLMLGVRNDQELGRLVARVTIVHGGVLSNINPDLLPKKTGGNAPKSTQKAC

SEQ ID NO: 146149 - protein, 57 aa, Triticum aestivum
  Clone ID: PAT_TA_40567.pep
LSAPCHDRTTVHGTIIGVDISMNTHLKTVKLTLKGKNPVTLDHLSVRGNIAQRPLPR

SEQ ID NO: 146150 - protein, 64 aa, Triticum aestivum
  Clone ID: PAT_TA_40568.pep
GANHAAMKASNMPEQAMSTQQQHQSFVQHNTMMVHQGTDYSLAAVKIKKKLVLQITHAEKTARL

SEQ ID NO: 146151 - protein, 42 aa, Triticum aestivum
  Clone ID: PAT_TA_40569.pep
SPCMAVLALFLPRTLRRSCRPYVPASPRGAFRQYCYCYLACT

SEQ ID NO: 146152 - protein, 54 aa, Triticum aestivum
  Clone ID: PAT_TA_40570.pep
PSSPADATAASSMAASYRAKLGAQLYYRTRRSPLGVTARGPLMHLFMRGSASLF

SEQ ID NO: 146153 - protein, 95 aa, Triticum aestivum
  Clone ID: PAT_TA_40571.pep
PCRGSWGPPASLMRCRAVPCVGGARFRWDFRRFVFPGASTCEMRAGIGLFSRYYMYLRTSFILSFWGITGNIFVLWSRNHFSPTTSWLLFLVVIS

SEQ ID NO: 146154 - protein, 45 aa, Triticum aestivum
  Clone ID: PAT_TA_40572.pep
CVGGVALAIRLKTTVSGKRCRTSLRKVHRVRGIKCVNTSSQGERW

SEQ ID NO: 146155 - protein, 112 aa, Triticum aestivum
  unsure (1)..(112): unsure at all Xaa locations
  Clone ID: PAT_TA_40573.pep
MADRANHPYVMQKVGGQSHLASNFIEGARARNIYPSVPSYERRFTTSRYITDNSDMSVRNMSSSSTXRNAPSEKKGVTNFAIGSLMGRASVVIXKTDAATIERVKLLIQNQD

SEQ ID NO: 146156 - protein, 64 aa, Triticum aestivum
  Clone ID: PAT_TA_40574.pep
GRASVHSLPSSSCVTGAEISIVNHSTMTGSLDVSLVKSTPLFRILCSSFVRFAPLAKAMLVQFP

SEQ ID NO: 146157 - protein, 49 aa, Triticum aestivum
  unsure (1)..(49): unsure at all Xaa locations
  Clone ID: PAT_TA_40575.pep
VFEMLSSRESGRFGGGDLRSADRAYAGEXHLPQEGPWGVXDMDSAVYVS

SEQ ID NO: 146158 - protein, 134 aa, Triticum aestivum
  Clone ID: PAT_TA_40576.pep
PSWVPLHLPPSLCSGEDQPPCGCAPPATPTSCSPRASSSNCLLCYPGEAPCTDPRQRNSAADGGFIRRCGRGGSPAQQQQGAGKRDPEGKRGRTLKREEGKEGAAADEVARDAAKEDWSLGFRGLCPMGAADAH

SEQ ID NO: 146159 - protein, 49 aa, Triticum aestivum
  Clone ID: PAT_TA_40577.pep
MAPAKPRFWLGAGLLTLLLWAFVAQLVPLGRLLDLFGLPGGPKNLQKPW

SEQ ID NO: 146160 - protein, 78 aa, Triticum aestivum
  Clone ID: PAT_TA_40578.pep
KYTCLIFSFTATSSCSISMLISSSSYAKISPAFSSAFMTHDPQPLSSDLAWTNRVSFVPISSPEDRLTVRIPGRTNYP

SEQ ID NO: 146161 - protein, 79 aa, Triticum aestivum
  Clone ID: PAT_TA_40579.pep
RVQVDQGWGEHHQPQAAAAANYCYLSINNGGGDTTNRLEAPWKLWDDPGRLLKNSAAVVAGEGQNHGQRGLVRPSVVVE

SEQ ID NO: 146162 - protein, 81 aa, Triticum aestivum
  Clone ID: PAT_TA_40580.pep
CCRSRQSLTVMTGRPTGARLNPPFYRLSQAMAAQICRGRMATSPITELNDAQSRPPLRSCSRAVLSSPWILLEINQHGRVG

SEQ ID NO: 146163 - protein, 44 aa, Triticum aestivum
  Clone ID: PAT_TA_40581.pep
PTCLITWSLTCSPKLYSSYINKSNVRWCAQLDEGKIIEYFTNKS

SEQ ID NO: 146164 - protein, 56 aa, Triticum aestivum
  Clone ID: PAT_TA_40582.pep
CYMECIECFYFFCTQNITAWCKSTAWFCRTKICHSCTGQSCKGDPICEDNILVSCR

SEQ ID NO: 146165 - protein, 69 aa, Triticum aestivum
  unsure (1)..(69): unsure at all Xaa locations
  Clone ID: PAT_TA_40583.pep
AHAFSPYIHLSREKXVXLNWYSMVRKAEKLKLPMRVINLHWWENLLIYTYLLTDVANLIYFNTNFKDSK

SEQ ID NO: 146166 - protein, 95 aa, Triticum aestivum
  Clone ID: PAT_TA_40584.pep
SPVSQSFIQLFSLYWANTWNVFCIAGQAVDGGAEPTRLHSDSPMTPANAVVDSGVPDSAEYVVDPKQRADDNLHAGLISKFLLSLFVARSYVQVL

SEQ ID NO: 146167 - protein, 94 aa, Triticum aestivum
  Clone ID: PAT_TA_40585.pep
HASGHLSISPKSTHPRSPKSTRPSHGRRRRGGHDGAAAAASGVGGGRAPAFPDGRPDRGRLPHLLHAQRRVPAALERLHHRARLLILPLTGRAR

SEQ ID NO: 146168 - protein, 79 aa, Triticum aestivum
  Clone ID: PAT_TA_40586.pep
PDIEFVTILHLQKEYRRSHIILVVIIQMADTRFSRNNIMMFQICSDMTKAQISKVVVVLAVTADQSTPRVSPRVRPRVR

SEQ ID NO: 146169 - protein, 76 aa, Triticum aestivum
  Clone ID: PAT_TA_40587.pep
MFCSLQSGSFIQKKESERSSGPVQLSKFLGREEEESGKRSVISGKKIMMKLEKSKEDKAAESKRNELLKFLNASYD

SEQ ID NO: 146170 - protein, 83 aa, Triticum aestivum
  Clone ID: PAT_TA_40588.pep
ISEPLPSPWSWRRSPPSPCPRWSSTPPHRPTVANLSPGPAPYRHPAYSLPSPTPASSSTTWPSCASAYPLSPTSRLPSLPGPS

SEQ ID NO: 146171 - protein, 103 aa, Triticum aestivum
  unsure (1)..(103): unsure at all Xaa locations
  Clone ID: PAT_TA_40589.pep
XXRKGGTAFCIFLNHXYSRTSITNGERQRTRGFQDPNKQGFLQRRHPTAYRGGGHHGQRSERIQRTPREQWARAQPYKTNGNLAAGSAGGRNLGAPLKIEQHA

SEQ ID NO: 146172 - protein, 87 aa, Triticum aestivum
  Clone ID: PAT_TA_40590.pep
RAPRSSSCTKRLTSSSVPTLEPVTQGSTQLTLGPPAPSDVIFDGYRLLSRRGTEHPHYHYRHVAASKRASSMTLQLARSYVGHEDYR

SEQ ID NO: 146173 - protein, 85 aa, Triticum aestivum
  unsure (1)..(85): unsure at all Xaa locations
  Clone ID: PAT_TA_40591.pep
SPTRSPTRXRTRGCXTSPPPSPSQSNFVPHRFLRSPPRSLARVPAAAGERLPFMADQEAAERPIVXIPRRPPTPLLPWTPSRSGT

SEQ ID NO: 146174 - protein, 120 aa, Triticum aestivum
  Clone ID: PAT_TA_40592.pep
RERSIPTVRSAPPVPFPFLARFLFPPPQLPCRFPPPSSLSAPSTGVGLIVVNTAAALIGVNTVAFPSTQPRLGLLVHSPPPRRRTLLLYPRPLRRREGGHGRWGSPHAWIWVPLCTSGRI

SEQ ID NO: 146175 - protein, 119 aa, Triticum aestivum
  Clone ID: PAT_TA_40593.pep
RTRGAEKYHAALAENRKLFNEIQELKGNIRVYCRIRPFQPGEDEGSNSVEYIGDNGELVLSNPTKQKEGGKNFTFNKIFGPTTTQDMVFKDIQPLIRSVLDGYNVCIFAYGQTGSRKTY

SEQ ID NO: 146176 - protein, 52 aa, Triticum aestivum
  Clone ID: PAT_TA_40594.pep
PTRAKKKPFLCPTHLEDGWRAYPQESRLSASSYCLHPWPLLKVPVMACPCAK

SEQ ID NO: 146177 - protein, 32 aa, Triticum aestivum
  Clone ID: PAT_TA_40595.pep
QLILGGSIYKISRRLHACVSLVALYRPLAIYL

SEQ ID NO: 146178 - protein, 85 aa, Triticum aestivum
  unsure (1)..(85): unsure at all Xaa locations
  Clone ID: PAT_TA_40596.pep
CXYDNTSHRIFINLVDLITPQSNINFLILNSKYNISIFGIPSVVLVVANTLIGGKELIIQTRQPLSQNLEGKDTHMFCSMHLFLK

SEQ ID NO: 146179 - protein, 69 aa, Triticum aestivum
  Clone ID: PAT_TA_40597.pep
PHGVGAPPVRVGPRALERLRSNRHLFFYRRRGDSGQRRLRFRVVRGPGTVGKLRVGGLRLRPRVLERVG

SEQ ID NO: 146180 - protein, 157 aa, Triticum aestivum
  unsure (1)..(157): unsure at all Xaa locations
  Clone ID: PAT_TA_40598.pep
LHHPNHLQTLQGPSQTVGDPCGKDAPRCLKERVPTVPTVVVVRVARALDRGTIVVVEGRXEXGLLEQQVVREDEEDSLAADYRRHGGAAAPPRRAAVLLPPLQPRPAAVLLPAPAAAHPSVDPPPPRSSPAAWPGPGGWMGFRVWSGRTDRDGGRTD

SEQ ID NO: 146181 - protein, 70 aa, Triticum aestivum
  Clone ID: PAT_TA_40599.pep
WAETGWRLRLRRTRTRTFPEASSSSETEIEMPWISDDEDDMGGRTELGTARRERARLRWWARLGRACRNR

SEQ ID NO: 146182 - protein, 99 aa, Triticum aestivum
  Clone ID: PAT_TA_40600.pep
MAGALAGAGIVWQTPANPPEAQDYIFRNGRRYVRPYYFEFISHAKNRWAGKTIVDLFTDEFKGRPREYYVHAVKCGRLQVDEQMVHADYIVKSSQKISH

SEQ ID NO: 146183 - protein, 158 aa, Triticum aestivum
  Clone ID: PAT_TA_40601.pep
AVDSIEGEITQSFSQQRKKREAAGPTYYDSFAYAQGPFAPVPEVFHTKAESPAQQRVYEEFVHVWQSSHGQSVGAASSGTAAVSSNFGVPRAYSPSLAQASSGFLSAQTASLTLTQPTELVYEELIPGASQLSSDSPAQVGTSDSSGWLGGTIGDAST

SEQ ID NO: 146184 - protein, 113 aa, Triticum aestivum
  Clone ID: PAT_TA_40602.pep
TRSRKRDFTHCCKHQTQERETGHSTYYDSFPYAQGPFAPAPVVFHTKAKFSAQQRVYEEFGYVWQSSDGQSVGASSSGTIAVSSNFGVPLSLQPKFSTSFQWFFVCLNNFTYI

SEQ ID NO: 146185 - protein, 145 aa, Triticum aestivum
  Clone ID: PAT_TA_40603.pep
RTRGRTRGLPWRDFALWSIQFAVLSYSSRCIVQPLALSVICYRCFGAAQGAAAKDLPEILYGVLHAPPRRAQGPGRRRRPVPPRRPRGQERQTALRQRRVRPPRPGARRRRSKRRPCSRAMTLTRPFATSMMASLTFLAGCSSWA

SEQ ID NO: 146186 - protein, 119 aa, Triticum aestivum
  Clone ID: PAT_TA_40604.pep
VYGGQYQIFGVAPKKKKKKGEKKKGEGGGTIFNGKIGIRKKLVAGLFFTPPSATIFTYLGGAALGDQSFGTGAGEVKVFFWGARKAFPGGGVSTAGVGKPGGGPILFPLEEIPFFPGGF

SEQ ID NO: 146187 - protein, 139 aa, Triticum aestivum
  Clone ID: PAT_TA_40605.pep
TNITGCKNTCMGNCSCIAVFFDQKTGNCFIFDQIGSLQQKGASKTNFSSFIKVSSSGSRQAGSGSDSGNHNIIIVVIIVVTLAVIGGLSYVGFFIYRRKRYPPSSQDEAGSSEDDGYLQTISGAPVRFTYRELQDATNN

SEQ ID NO: 146188 - protein, 38 aa, Triticum aestivum
  Clone ID: PAT_TA_40606.pep
MACRKVGERKKAVTRSAKAGLQFPVGRIGRFLKKGRYA

SEQ ID NO: 146189 - protein, 45 aa, Triticum aestivum
  Clone ID: PAT_TA_40607.pep
ILIVFSWLNIRKLVNDGFIFRNPYKIHFRSFTWCVFFSKHYVRYS

SEQ ID NO: 146190 - protein, 73 aa, Triticum aestivum
  Clone ID: PAT_TA_40608.pep
TKWMESIQKDEVAYQYKFLLRQHNRLESGDFLMRDALQPLPEVGSLSVPYFPAGPRLGLQIIRNGRRRHCACA

SEQ ID NO: 146191 - protein, 91 aa, Triticum aestivum
  Clone ID: PAT_TA_40609.pep
IIGPGKELGEQDDDEEGGRRREEQLEQQLHECRRSRGRGRNTNPESGPSSRPLARAGGRRAAAGLGARRGSRWSSRRSCRMWRWRRCRWLG

SEQ ID NO: 146192 - protein, 129 aa, Triticum aestivum
  Clone ID: PAT_TA_40610.pep
DAWGNTVAANRILDEMAQKGCAPNLFTYNVLLESLWKAGRTTEVERLLERMGEKGYSLDTTSCNIIIDGLCRSSKLDMAMDIVDEMWNEGSLALGRLGSSFSSLASDSFLSKKCLPDRITYTTLMNALC

SEQ ID NO: 146193 - protein, 35 aa, Triticum aestivum
  Clone ID: PAT_TA_40611.pep
RTRGQTLSLPTGSLDETAQKACALNLITYNVLLES

SEQ ID NO: 146194 - protein, 126 aa, Triticum aestivum
  unsure (1)..(126): unsure at all Xaa locations
  Clone ID: PAT_TA_40612.pep
TGDACLRLLLPXPICSTEKKMEKGAARWSRCRRAAGAPPRTRSGARARSRPACPSVETQLCQRRRTTWLPPPADQQVAVRCELRGGRDDERAPVVLFSSGSPPRPQTSGVDVGRHRRLTRKWRTRG

SEQ ID NO: 146195 - protein, 107 aa, Triticum aestivum
  Clone ID: PAT_TA_40613.pep
PPPTSWPETKMDKKPACRSRGTLAARGHHSSHSGDDERSSTEWPSVGTSLRRSERPTWQRPPSDHQVAVLCELHGGTDDDRAPLIVFSCGYKTRPRSPARHRGRGRS

SEQ ID NO: 146196 - protein, 134 aa, Triticum aestivum
  Clone ID: PAT_TA_40614.pep
GRVGCADTFVTDALLSYISGRAPSLKSLQLSLCDEVSNEALADAVKGFPQLEELEITFCSLNSNVCESVGRACPHLKSFRLNERWTVLQRGFAVFEGMDDDTGALGIASSMPELRDLQLIGNNLTNAGLAAILD

SEQ ID NO: 146197 - protein, 67 aa, Triticum aestivum
  Clone ID: PAT_TA_40615.pep
ASKRLLYPRDPDIVLWYVRLLTACASILSEFKLLCILDLEQEKYRKRSSSLQSIHQTVFLGYSPRVR

SEQ ID NO: 146198 - protein, 133 aa, Triticum aestivum
  unsure (1)..(133): unsure at all Xaa locations
  Clone ID: PAT_TA_40616.pep
SPRCRRHLLPVPAPPDPPPPRPLPPXPTSPSSSTTPRRREREASPPATTAVPPPPSSXASPAPRRPGALLLFIPSKSPLPTAARNQDPIPSPPIQSSPAATEIQPDPPSSMATAGNAPAPASASRPSSSSTRA

SEQ ID NO: 146199 - protein, 66 aa, Triticum aestivum
  Clone ID: PAT_TA_40617.pep
AERTGGAVEHSSVSRLGAMLFALNSCLFLVYWLFIFLFFSFIWFLLFSYFIFIIYFFYVFFFGFSF

SEQ ID NO: 146200 - protein, 132 aa, Triticum aestivum
  Clone ID: PAT_TA_40618.pep
PYRMRDGGDSDGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAK

SEQ ID NO: 146201 - protein, 118 aa, Triticum aestivum
  unsure (1)..(118): unsure at all Xaa locations
  Clone ID: PAT_TA_40619.pep
RTGGATAATATARASRRGRTTXRRKSTARSNPRAGGSRTRPXTTRHGARPTRRPAAAGRRARSTADGTTRAAGTRPPTRAPGTRAATPTSTSRGPRRXTGSAPGQQRSTTRRKASTAG

SEQ ID NO: 146202 - protein, 104 aa, Triticum aestivum
  Clone ID: PAT_TA_40620.pep
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEE

SEQ ID NO: 146203 - protein, 85 aa, Triticum aestivum
  Clone ID: PAT_TA_40621.pep
PVSPHTCDLSTNPYICWGDHSITIPTLMLIFHLEVGSEAPMLYTAVGWFHFDRAQALGEDTYYTFSMELTSHPYRILLFFTRMNC

SEQ ID NO: 146204 - protein, 128 aa, Triticum aestivum
  Clone ID: PAT_TA_40622.pep
SFLLSMRRRYSLLDALSIRDMMLRDYFSAGMVQPPPLYTSSIAPNGTEEAPSQSIEGMAKAHGAAAALSPDGGYTSDTHDEGGPQEKEGDGRRFAATDQGPKPVGRHNSLSDHVSEWVSSIDSESLCI

SEQ ID NO: 146205 - protein, 50 aa, Triticum aestivum
  Clone ID: PAT_TA_40623.pep
RMGGQWNKARTRSRTAGLQFPVYRMGRLLKNGLYVQRVSFVTQVYLGAVL

SEQ ID NO: 146206 - protein, 89 aa, Triticum aestivum
  Clone ID: PAT_TA_40624.pep
MATRIQFENNCEVGVFSKLTNAYCLVAIGGSENFYSTFESELADVIPVVKTSIGGTRIIGRLCVGNKNGLLLPHTTTDQELQHLRNCIP

SEQ ID NO: 146207 - protein, 131 aa, Triticum aestivum
  Clone ID: PAT_TA_40625.pep
FCTSKIQKEKKKSLCCLWDAVHSQPHERARTMWDAILHAVIRRTVRRRTPNCTRAAGDEHILDLGEGSLQGEEAVRQGDGRAPGGMGGGEHRLVSPTMSLEEAGKGRRHPDPYADNRRRALGMEKSSGRVG

SEQ ID NO: 146208 - protein, 95 aa, Triticum aestivum
  unsure (1)..(95): unsure at all Xaa locations
  Clone ID: PAT_TA_40626.pep
LKYAMKARGVDARPGWSWXQAGRSVHVLEVDGGSPAHPETPEIYGEMSRLVSQIRMVGYVPDTVCIAYDIPXEEKERLLLCHTQKLCRTLQYVSD

SEQ ID NO: 146209 - protein, 100 aa, Triticum aestivum
  unsure (1)..(100): unsure at all Xaa locations
  Clone ID: PAT_TA_40627.pep
PPVLVFLALFFSFCPLFLPCPAVFGLPGLLVVAASGGCCAWSWXRFPCLRRLAFAFCPRSCWSALASRRLCXRRRSPVPAACAACFSLXAPSSPVRVAPP

SEQ ID NO: 146210 - protein, 96 aa, Triticum aestivum
  Clone ID: PAT_TA_40628.pep
PAILSWLLTPLSFSPSSGSPPARRTRIFTFSSMMWSPAASLRWCRLSWVLPSCSYFFFSCILFEFFIFFFCYIWCFFCLFYFFFIYIFMCFFNFLL

SEQ ID NO: 146211 - protein, 131 aa, Triticum aestivum
  Clone ID: PAT_TA_40629.pep
DAWVANLHSESQEEVGKLVMDLQKLNDELSEVQDSNLIVEDLLCELMNTISVLNTEKDAALLQLQLSLERVTDLKSEVSETQLEAEKTEEKLQVLEQEFAQKNVMVDFLQSSLQDEGKKRVEAETLLMSKE

SEQ ID NO: 146212 - protein, 130 aa, Triticum aestivum
  Clone ID: PAT_TA_40630.pep
PRVREHEPTGHTAMLQPDGEATKVEQEQLSDTAMLQPDDEGGRVEHEPLSNAPMVLHNEEARNVKQEALIGTAMPQPYVEDRRVGAEPPRDAAMVQPNDEARCVKQELLIDTAMPLPNEEAGAAANPVPL

SEQ ID NO: 146213 - protein, 127 aa, Triticum aestivum
  unsure (1)..(127): unsure at all Xaa locations
  Clone ID: PAT_TA_40631.pep
GRVGFQNSGTKLGVLKAANESLTRVVVYVSLMALYILGGSKVSAGKLSIGTMASFIGYTFTLTFAXVHFSYPLRSDVDVLNGLDLVIECGKVTALVGSSGAGKSTVVQLLARYYEPTQGRITVAGED

SEQ ID NO: 146214 - protein, 72 aa, Triticum aestivum
  Clone ID: PAT_TA_40632.pep
GCQPDQFMAAEPVEDADPGADTIMDRSSELKRKYEMLASCTRLYQTNDRALLCSSRLPTRASSTRSGPGANI

SEQ ID NO: 146215 - protein, 83 aa, Triticum aestivum
  Clone ID: PAT_TA_40633.pep
CVVAEEEGGDGVDAHVRQRPAPRRARPCCPCSSCSVGRLLWRLEVGIHGGVAERHALVRRGAELPPHRPAGGDWGIGGEGKKR

SEQ ID NO: 146216 - protein, 128 aa, Triticum aestivum
  Clone ID: PAT_TA_40634.pep
CFPESIGSLRNLQVLSLDYCGSLHSLPSTMTQLCSLRCLSLDGTKIDQIPKGIAKLKFLNTLQGFPVGDGSDNVNVQDGCKLEDLSYVSQMRDLGLVKLERAAHCATNAVLTDKMHLKNLSLRWTERG

SEQ ID NO: 146217 - protein, 34 aa, Triticum aestivum
  Clone ID: PAT_TA_40635.pep
FWGYCVSLHSLPSTMTQLCSLRCLSLDGLKNRSY

SEQ ID NO: 146218 - protein, 52 aa, Triticum aestivum
  Clone ID: PAT_TA_40636.pep
NLSCSARKPIYHGMLSPVFFCKFDLLASIVDCFQKELMICSKLICDLHVSTS

SEQ ID NO: 146219 - protein, 129 aa, Triticum aestivum
  Clone ID: PAT_TA_40637.pep
DAWVETPFLVVTLGEIEIVNLERVGFGTKNFDMAIVFKDFKKDVLRIDSIPSTSLDAIKEWLDTTDLKYYESRLNLNWRPILKTIIDDPQKFVDDGGWEFLNMEASDSEAEETEESDQGYEPSDAEPES

SEQ ID NO: 146220 - protein, 103 aa, Triticum aestivum
  Clone ID: PAT_TA_40638.pep
MAKEVSEEPEHAEPAHKDYFDPAAVPMFDMGELRMWALYRALIAELVVTLLFLYITVGTVIGYKVQMADVPCGGVRVLGIAWALGDMILVLVYCTVDILEGHI

SEQ ID NO: 146221 - protein, 45 aa, Triticum aestivum
  unsure (1)..(45): unsure at all Xaa locations
  Clone ID: PAT_TA_40639.pep
LLASTSTISCCSTSPRVRQYLISHTPNSTRYRKESXXTLVEGGEA

SEQ ID NO: 146222 - protein, 84 aa, Triticum aestivum
  Clone ID: PAT_TA_40640.pep
PSVQGTKKNTCTWKVEHRMVSALLRFIATWQGIKKDVKPLTSTKANKEISHQPYPLQPRWVSHGAECSCRPPYPLQQLNPAMPS

SEQ ID NO: 146223 - protein, 101 aa, Triticum aestivum
  Clone ID: PAT_TA_40641.pep
LRVSPPPCRKRHHRPRARSTDRTARTPRAWRDAAASSVAPSPPSTAALVVAPVSPPIYPTAPLQAPSTSPHPRKMEARQRAAREQRRMRRRHPGVDLRTRG

SEQ ID NO: 146224 - protein, 88 aa, Triticum aestivum
  unsure (1)..(88): unsure at all Xaa locations
  Clone ID: PAT_TA_40642.pep
MATHPALARHGNYVFPAGHMVQGNAWTTHPANIIADGVPHWAYNIALHNPSGHEAYSGTMRMPNGSFXDYQAGPSATFHGPFPSIKPI

SEQ ID NO: 146225 - protein, 94 aa, Triticum aestivum
  unsure (1)..(94): unsure at all Xaa locations
  Clone ID: PAT_TA_40643.pep
MDAAMDSDAVSKDYYQNYYXTFDSNRAVLEELYQHSFMLTLEGEKFGIPGKIGCMLLYLPLQKSQNKICTVYWQHWGPQGCVLVFISSTISNGP

SEQ ID NO: 146226 - protein, 128 aa, Triticum aestivum
  Clone ID: PAT_TA_40644.pep
THISSVYSFISGTPKEAKWRENLGHLALPIKKPTGNHHRFFLDEHTPGQWLSWRGVRGGRLTGLAAAEEAAGDGGPRTARPEHDLLPPTRHRRCGRSGSFAVAVPSASAWAWSWVAWLLLSGRSPTRP

SEQ ID NO: 146227 - protein, 80 aa, Triticum aestivum
  Clone ID: PAT_TA_40645.pep
GKLNLHLVSLSGLDYACQAGDDDPVPVPAGADHAPDRGTGRAVAARAASKASRSARSGSIGTHGGSTAWRADKSGWGRWS

SEQ ID NO: 146228 - protein, 95 aa, Triticum aestivum
  Clone ID: PAT_TA_40646.pep
PWSGAEQPTDRKQAGRHGGGGGYATTRHRRLVKAFNPTVEPRNFGIGLVAGFLLVTCAYFSTAKFDAIHIAPLVSPLETRIGSPATAGSKTQLDL

SEQ ID NO: 146229 - protein, 81 aa, Triticum aestivum
  Clone ID: PAT_TA_40647.pep
MAATVRKLVVEVVEARNLLPKDGTGTSSPYARADFDGQRRKTRTVPRDLNPAWNEPLEFSFPGPGSGGIDPVAGEPLEVAI

SEQ ID NO: 146230 - protein, 127 aa, Triticum aestivum
  unsure (1)..(127): unsure at all Xaa locations
  Clone ID: PAT_TA_40648.pep
LTAGLPLQSMGMLTLSWALPVFHSDGCTSFTSFSGACSPSPVQVTIFYVSLYLVALAEAGHKPCAQAFGADQFDQHHPEESVSRSSFFNWWYFGMCSGTAATTMVSSYIQDNIGWGLGXGIPCLVMV

SEQ ID NO: 146231 - protein, 54 aa, Triticum aestivum
  Clone ID: PAT_TA_40649.pep
RRRPTLPCIVTLNKICIYVYFPCIITTYGINLIVSLPNAASAYRTPASPFEFDV

SEQ ID NO: 146232 - protein, 95 aa, Triticum aestivum
  Clone ID: PAT_TA_40650.pep
RTRGRTRGSPPTPSPRRRAAASAANIGASATLMAATSHSLLSPAPTSPPRARLPLPSVRAGDPRRRYFFPAGAAPASLMACSYAEEKKGTMLRCG

SEQ ID NO: 146233 - protein, 49 aa, Triticum aestivum
  unsure (1)..(49): unsure at all Xaa locations
  Clone ID: PAT_TA_40651.pep
LRRPVPCLLVSLLRAFXVACXRXXAWFLLXGRSRSXSXRVGXRVGXRVG

SEQ ID NO: 146234 - protein, 74 aa, Triticum aestivum
  Clone ID: PAT_TA_40652.pep
QSEVGKMEKPSATSPLLHLSNQNTTLDTCSIDTFKWMKAIHSGCGKFLELQRLELDGEVAVTGTQEHQILGRVG

SEQ ID NO: 146235 - protein, 127 aa, Triticum aestivum
  Clone ID: PAT_TA_40653.pep
KVLSLTSKDQLKVEVTTVFGSAAPPLRVNLVQVLGSDSKIITTDSKELQFDLDNNVHYLDITPLKIDVGKYSLVFEITLQDSEHETVYTTGGRNTESVVVTGLIKVDKAEIGISENDAGSAESVEKL

SEQ ID NO: 146236 - protein, 128 aa, Triticum aestivum
  Clone ID: PAT_TA_40654.pep
PLPAYLRPPPPSLLRPPPGKSSLIAVPLLSPSKSASDPPGRCPNCAAPRNPQFTNPDPASTPIPSSSQPNRILAGIRVQVVIRFFFIYIYIQISQPGFDTVQVDMSKRKISLHSCSTAAAAVEMSKRK

SEQ ID NO: 146237 - protein, 128 aa, Triticum aestivum
  Clone ID: PAT_TA_40655.pep
HASDDDDTGVHSSPNTAGVHVIINDVTSEGPPKANGTDVQTEVDLRLPESAPHFQDLYPSESHCSGDQHQDAESHCSGDQHQDASASHCQPEPEDGARFSPDFSADETSKSNASASHCQPEPEDGARF

SEQ ID NO: 146238 - protein, 66 aa, Triticum aestivum
  Clone ID: PAT_TA_40656.pep
DYNPRRWSCRTLCTDQCSPRRHFPIRPRRTKSVTLAFRRRNWKSSGRAQIHSVATRDAFVRFTYCE

SEQ ID NO: 146239 - protein, 78 aa, Triticum aestivum
  unsure (1)..(78): unsure at all Xaa locations
  Clone ID: PAT_TA_40657.pep
ELYARVFTRESSLANPSFRXYGAGPAAVPLVWESQPGTPKDATSWCRKALPVVPDITPPAYYNARAFPAYSNLAGIRI

SEQ ID NO: 146240 - protein, 76 aa, Triticum aestivum
  Clone ID: PAT_TA_40658.pep
STLVIPCVSHVTSLVKLSAHLARALKHGQCDGEVCNQERYSKPRGRLHDRVDGPLGRSLRPSVCAVKLQLFQRTRQ

SEQ ID NO: 146241 - protein, 77 aa, Triticum aestivum
  Clone ID: PAT_TA_40659.pep
PTRPLKSFSHKCTHSARESAHNWAYNFEIRPGTTPGSEHRITKLTSTVTIFEDDVQMCRLFYQTCDGRQTLGPKGGR

SEQ ID NO: 146242 - protein, 120 aa, Triticum aestivum
  Clone ID: PAT_TA_40660.pep
HMTQPPDPLAAVIAARPWSPGRQLPGDFRLPKSPDLQSSAPPPPAPNASPRASGPPPVAARRQSPPPVAARRRTAYRRWLSPALRSHLFRRSSPTHSSSQRAPARTGVLRGGWSPLLADA

SEQ ID NO: 146243 - protein, 85 aa, Triticum aestivum
  Clone ID: PAT_TA_40661.pep
EQCAVSFNEIDTNSVEHAETVLNTNFYGTKLLTEALLPLFRRSPATSRILNISSQLGLLNVSASMFFQLRWMVFQSLQTCRCGLD

SEQ ID NO: 146244 - protein, 84 aa, Triticum aestivum
  Clone ID: PAT_TA_40662.pep
PTLRSAESGALIDTTGVDIRLPMLVYVSREKRPGYDHNKKAGAMNALVRTSAIMSNGPFILNLDCDHYVHNWGALREGMCYMLD

SEQ ID NO: 146245 - protein, 32 aa, Triticum aestivum
  Clone ID: PAT_TA_40663.pep
NVDFFLNEENFMLASKILLFSCLTHASDQESS

SEQ ID NO: 146246 - protein, 46 aa, Triticum aestivum
  unsure (1)..(46): unsure at all Xaa locations
  Clone ID: PAT_TA_40664.pep
XIFIILKIFSSSASNSCRRFLHSFIQPHIKGSRVPVYPSVLFGFAC

SEQ ID NO: 146247 - protein, 124 aa, Triticum aestivum
  Clone ID: PAT_TA_40665.pep
GRGADAWADAWGLASVSAVLKALAASCPMLQVVELTFAFCEPDWPTEIGFTQEGIVTLIQSCPIRSLLLNGASILYDEGMKCLSSSQFLEKLELVDCRSITDASMNFIIQAPCLSNLTLRKCKK

SEQ ID NO: 146248 - protein, 74 aa, Triticum aestivum
  Clone ID: PAT_TA_40666.pep
ANLSLSLIPLTCCTLGAPTLHRFMTSEVNFLRDYVSFSLFLHPQKRIPVFFVHLIYPLRSNSNPCGYERQTHSR

SEQ ID NO: 146249 - protein, 126 aa, Triticum aestivum
  Clone ID: PAT_TA_40667.pep
PTRPEDLHYLWLDGNLLEGTIPSALANCSALLHLSLQGNALRGILPAAVASIPSLQILSVSRNLLSGAIPAAAFGGERNSSLRILQLGDNQFSMVDVPGGLGKGLQVVDLGGNKLGGPFPTWLVEA

SEQ ID NO: 146250 - protein, 85 aa, Triticum aestivum
  Clone ID: PAT_TA_40668.pep
GAHWKNFLHRSRPCKPWDDLGGYETTLVLTWSCSPAPTPRMPCHSPLQPSHLLSKLRTRKRGVEKKRRGWWRSTSSSVCASWRRW

SEQ ID NO: 146251 - protein, 45 aa, Triticum aestivum
  Clone ID: PAT_TA_40669.pep
LALEDFVESCVYPASCNTFVSTWRLHTGFYRCISRLLVRHLTPYA

SEQ ID NO: 146252 - protein, 41 aa, Triticum aestivum
  Clone ID: PAT_TA_40670.pep
GRLTADYLGTTQAQANKGARGPCHGRSTHGDTLMKTWTFHK

SEQ ID NO: 146253 - protein, 72 aa, Triticum aestivum
  Clone ID: PAT_TA_40671.pep
WLAMFYMCIPTGIALGYVYGGLVGGHLHWRAALCGESILKLTFAILGCEIKPLYLKGFTHNKNTKEYGQMLS

SEQ ID NO: 146254 - protein, 83 aa, Triticum aestivum
  Clone ID: PAT_TA_40672.pep
KPQDLELDRRRQSGLTPRTENSFCQRKKRGKLTSSRRKFTSLVIKRWRVGASKVQHVGGIKLRERLAQDEELLILIYISVTIE

SEQ ID NO: 146255 - protein, 49 aa, Triticum aestivum
  Clone ID: PAT_TA_40673.pep
HNFTSPPTTALENLSVSHSNSLQERQGVDLSCVAKMFIESYLLDSPNVR

SEQ ID NO: 146256 - protein, 74 aa, Triticum aestivum
  Clone ID: PAT_TA_40674.pep
GPMGPLVLGLIRDKGRLLRGQVSLAWKSSKPLYKERRCINLIKQELRRKSLPSCPAVGKKTPGRPSRALLLAAP

SEQ ID NO: 146257 - protein, 124 aa, Triticum aestivum
  Clone ID: PAT_TA_40675.pep
LCSGHDSRPRPLFQNFLPEEVESPLCSSSDKKASRQLLSNPAFCNMFKAFVKEWLELRPIDQRKLLGKPLQLPLSLELCYLTNSISHSTQGLIKGGSKRRIAPLSVVSDDLPENAEWRKVVLRR

SEQ ID NO: 146258 - protein, 102 aa, Triticum aestivum
  unsure (1)..(102): unsure at all Xaa locations
  Clone ID: PAT_TA_40676.pep
PTLRTYYDTERESALPSVRPIHAIHTKPSSTIVDMLILLRSYACVLNGKAEPNLAXSGACLLDPGGYLIVNGTDKVILIQQQLLMNRXIIDTDFKGRVTSFF

SEQ ID NO: 146259 - protein, 56 aa, Triticum aestivum
  Clone ID: PAT_TA_40677.pep
VIKRAHNPRLVEKLSIPLMCWGGILLFLTIYKQRDLVTLYKGLSGTLIITFYKIWK

SEQ ID NO: 146260 - protein, 48 aa, Triticum aestivum
  Clone ID: PAT_TA_40678.pep
IPTLYLVEKLCYDCIACTLCCGLCCYIPACPFQTLLYCSYPCMSSTKH

SEQ ID NO: 146261 - protein, 78 aa, Triticum aestivum
  unsure (1)..(78): unsure at all Xaa locations
  Clone ID: PAT_TA_40679.pep
MAETEYRCFVGGLAWATDDNNLQQAFSQYGEILDAKIINDRVTGRXRAFSFFTFGRAAMMTNSVEAFNRKALEGFNIF

SEQ ID NO: 146262 - protein, 67 aa, Triticum aestivum
  Clone ID: PAT_TA_40680.pep
MGWLSCCKRSNGAQPGRKKKKDTTWRIFSLKELQLATNNFNYDNKLGESGFRSVYWGQLLDGSQIAV

SEQ ID NO: 146263 - protein, 115 aa, Triticum aestivum
  Clone ID: PAT_TA_40681.pep
SRTRGSSLLLLLLVASLSTPACATLSITTIVMPQLRSADPKRRHPRTRPLALCSSATESNARTPSPLYTSFPGHLPLAYLCACPADCHLPLSLFLYGTDSQGGRHGRPRSSAPTL

SEQ ID NO: 146264 - protein, 66 aa, Triticum aestivum
  unsure (1)..(66): unsure at all Xaa locations
  Clone ID: PAT_TA_40682.pep
SSPHNRHFFSCGVEQTLPRLKIESREXFYVYHKSGLSLAXCVFSSDGEPKLSRVSYQRLCLWDLHG

SEQ ID NO: 146265 - protein, 57 aa, Triticum aestivum
  Clone ID: PAT_TA_40683.pep
MGEDLVTTLSMENGGGGGGHHGLCTLLSMDPSGHLDDRAVGVMVQPRAGGGPPHAHA

SEQ ID NO: 146266 - protein, 138 aa, Triticum aestivum
  Clone ID: PAT_TA_40684.pep
HASADAWADGVLSIESSSSFETTVDVEEGMEIDRGYISPQFVTNLEKSIVEFENARVLITDQKITSIKEIIPLLEQTTQLRCPLFIVAEDITGEALATLVVNKLRGIINVAAIKAPSFGERRKAVLQDIAIVTGAEYL

SEQ ID NO: 146267 - protein, 74 aa, Triticum aestivum
  Clone ID: PAT_TA_40685.pep
TGRAWQPHYLAAVFSLAGGYALGVIYLAAHSAGVKVAAVSIDSQRRVFNVYFGAYVATLDAALYEVWGVQFHPK

SEQ ID NO: 146268 - protein, 83 aa, Triticum aestivum
  unsure (1)..(83): unsure at all Xaa locations
  Clone ID: PAT_TA_40686.pep
MKKGGLLRCVSTGACRVAPGAVAEMAISPSASGKVPAGHVPVEVGAEGEETERFLVPAELLGRPPIDELLRRAXQEYGYARRG

SEQ ID NO: 146269 - protein, 61 aa, Triticum aestivum
  unsure (1)..(61): unsure at all Xaa locations
  Clone ID: PAT_TA_40687.pep
TRSDIIVADEVVHWAVQNGGYLSRSTVVYFKHKXLASLASTLEKLTRGNKRTEKIXRYIVV

SEQ ID NO: 146270 - protein, 82 aa, Triticum aestivum
  Clone ID: PAT_TA_40688.pep
PRVRPYVRSRVRTDTSPYPVVSVDMVTTERPIVSVKALDGDMINDADRRSHAERYEGADPPRHHELLPQVCVRATDQMLLMS

SEQ ID NO: 146271 - protein, 44 aa, Triticum aestivum
  Clone ID: PAT_TA_40689.pep
GSPPSRGSSRCGLGPGSYNRLVGAGAGRTGERRGDESPAAIQHL

SEQ ID NO: 146272 - protein, 68 aa, Triticum aestivum
  Clone ID: PAT_TA_40690.pep
VGLTEAPLLHAYSFCWCSCRPILDTESLLWKLVTNWLFSMLNGSNSFSIWTVKVPTRSPRCCFILFKC

SEQ ID NO: 146273 - protein, 35 aa, Triticum aestivum
  Clone ID: PAT_TA_40691.pep
VYMVRTMEYGQMLLLGEDFETWLRLLRKTEVNPTR

SEQ ID NO: 146274 - protein, 67 aa, Triticum aestivum
  Clone ID: PAT_TA_40692.pep
RLLFPVTIQNTLQFPKNFELIQHHSPPHVWSRRRVSRREDPRKIRSSRVCRTTSAGVHDLDLKRPFI

SEQ ID NO: 146275 - protein, 138 aa, Triticum aestivum
  unsure (1)..(138): unsure at all Xaa locations
  Clone ID: PAT_TA_40693.pep
RVKFLGTVSTPRLTATTPSRRPWIPDSHGTRTQWSSSATAQGKXGCVAXRXKPKGRRXTKGRGVVALSGAKAAPLPPSATASAFVPSGRRLPLGCFSERNGKGMVARXRLVGXXXAGXREAWPASASLEGEGAAAAVP

SEQ ID NO: 146276 - protein, 72 aa, Triticum aestivum
  unsure (1)..(72): unsure at all Xaa locations
  Clone ID: PAT_TA_40694.pep
LQIIKNKKFVRDREFYPQLKVILTRALGEDGXTLLKVRLTPTHTEIMIRVTRSQNVLSEKGRRITELTYVVQ

SEQ ID NO: 146277 - protein, 96 aa, Triticum aestivum
  unsure (1)..(96): unsure at all Xaa locations
  Clone ID: PAT_TA_40695.pep
MASTAAFLPLLALLLVATAHCSPLLPQRCPQADRQALLRVKQALGSPATLKTWSPASADCCAWDHLTCDEAGRVNNVFIDGADDVRXQIPSALAGL

SEQ ID NO: 146278 - protein, 139 aa, Triticum aestivum
  Clone ID: PAT_TA_40696.pep
DLAANNPVLVTLNFYLTYLRVEPADLELLAKNCKSLISLKISDCDLSDLIGFFQIATSLQEFAGAEISEQKYGNVKLPSKLCSFGLTFMGTNEMHIIFPFSAVLKKLDLLYSFLTTEDHCQLIAKCPNLLVLAVRNVIG

SEQ ID NO: 146279 - protein, 78 aa, Triticum aestivum
  Clone ID: PAT_TA_40697.pep
RLDCIQIYHKSSRALSPSFLLKSIHCKAPNKLSQDVFSQYALTSKICHILLYSQYSKSQNIDFFLKQSPGFFLGLRAT

SEQ ID NO: 146280 - protein, 92 aa, Triticum aestivum
  Clone ID: PAT_TA_40698.pep
MAARRASARARPNVLVTGTPGTGKTTTCSLLADAAGVAHVNIGDLVREKGLHDGWDEDLDCHVINEDLVCDELEDRMEEGGVLVDYHGCDFF

SEQ ID NO: 146281 - protein, 59 aa, Triticum aestivum
  Clone ID: PAT_TA_40699.pep
LLKAGADTKGALIHAAKNLHSGKFISTDCCNSLLEDADTNGIVVDDIRFTSLTVQVCCL

SEQ ID NO: 146282 - protein, 87 aa, Triticum aestivum
  Clone ID: PAT_TA_40700.pep
EPLDSGQTPTGHDKNGPPTGQCAGARSQAAAPPCARPRPETAPKTARLVTTTRFRAKCTMWHGRPLSAVARVPDAWVGVGRPGRYCG

SEQ ID NO: 146283 - protein, 65 aa, Triticum aestivum
  Clone ID: PAT_TA_40701.pep
PTPTTGIVTSPTQSKGVITPPPRRGRCEHNKRLRLMSKSRQSFRLGPVCSRSLPGPFVSLPHACV

SEQ ID NO: 146284 - protein, 143 aa, Triticum aestivum
  unsure (1)..(143): unsure at all Xaa locations
  Clone ID: PAT_TA_40702.pep
GAVVRDRTEVIDVVAGKKXEGTTIVVKTSSGEEFHAAKCIITVGAWTSKLVKSVTGSDLPVQPLHTLLCYWKVKPGHERELTTEAGFPTFSSYGDPCIYSTPSMEYPGLIKIAMHGGPRCDPDSMDWTVGTTEGEGGLADPVA

SEQ ID NO: 146285 - protein, 139 aa, Triticum aestivum
  Clone ID: PAT_TA_40703.pep
TNTNAPLALELHAYQTGTREGTMFLRNLAGNRHLGAVRAGNKPATDRRMNWIGVSVLERKRDKNRALGTTGANLELVSDRRNRSRSGGSPFRREMAGIGGGIGWIRGFKARVLGAGAGQGAGLGFGVGDGIPGARRRSA

SEQ ID NO: 146286 - protein, 110 aa, Triticum aestivum
  Clone ID: PAT_TA_40704.pep
NKGLQDRANKGLKVARKNSITHRQLWFFKTCQASMRATISGSKRFFLQSVFPPPSHIMHPTDCNLLPPGTRTPALQPRRPGLPELPLLPPVIPLTHLHPNPTTRCMSSAA

SEQ ID NO: 146287 - protein, 120 aa, Triticum aestivum
  Clone ID: PAT_TA_40705.pep
GRVGRSVDGRTAIAAASGAVAAMGNPASAAITHVLHNKQEFPLAVSMDDILVLSIGTGALFSAATCGNGWSTPMPTRSPSRDELARVTAQGVADMVDEAVAMAFGHASDSNYVRLQASSA

SEQ ID NO: 146288 - protein, 130 aa, Triticum aestivum
  Clone ID: PAT_TA_40706.pep
PRVRPRRELLVIDEAAAIPLPIVKALLGPYLVFLSSTVNGYEGTGRSLSLKLLQQLESQSQPSASSDGPSSSRLFKKIELNESIRYASGDPIETWLNELLCLDLANSIPNISRLPHPKHCQLYYVNRDTL

SEQ ID NO: 146289 - protein, 48 aa, Triticum aestivum
  Clone ID: PAT_TA_40707.pep
TQSLRCACLVSARIVRSMSIPHVFRTRAGTLSSSDALSRVPRSGFELL

SEQ ID NO: 146290 - protein, 131 aa, Triticum aestivum
  Clone ID: PAT_TA_40708.pep
DAWADAWVGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRR

SEQ ID NO: 146291 - protein, 124 aa, Triticum aestivum
  unsure (1)..(124): unsure at all Xaa locations
  Clone ID: PAT_TA_40709.pep
MAMARRRALALVSQILQRRVLPAPRFLSSAAGGALDRLNSPPFARQAAHRNPAPPSPWDRLGGQKRTMFIQTQSTPNPQSLMFHPGKPVMEVGSSDFPHARTAMTSXLGEGAVAIEGVTRVFFG

SEQ ID NO: 146292 - protein, 127 aa, Triticum aestivum
  Clone ID: PAT_TA_40710.pep
SGFGPAPSLAAIIANRYRMPTDVKTFNLSGMGCAAGIVGVDVARGVLRAHAGAVDYAVVVSAEIVTIGWYRGRDRSKLLLNCFFRTGCAAALLSNTASAAAPVKYRLVALKRTTIAVDDRGYNLAMR

SEQ ID NO: 146293 - protein, 47 aa, Triticum aestivum
  Clone ID: PAT_TA_40711.pep
SLAVSAMGKEKTHINIGGIVHVNSGKTTTTWPFDLQAWNVSTSRLIR

SEQ ID NO: 146294 - protein, 88 aa, Triticum aestivum
  unsure (1)..(88): unsure at all Xaa locations
  Clone ID: PAT_TA_40712.pep
GSHFLGYEGHGVILYIGTMAKGIGNGIPIGAVVTTPDIAKGLNNKNYXNTFGGHPVSTVDGHAFIKVLENEKYQENAFFVFFYLKEKL

SEQ ID NO: 146295 - protein, 74 aa, Triticum aestivum
  Clone ID: PAT_TA_40713.pep
GRVGLEINLDTGEPLSVELHQVYAWVEFGPDMIGSTNRELGESPKNSTKKGMFLFFGEKYLATVREEDTLEYIA

SEQ ID NO: 146296 - protein, 121 aa, Triticum aestivum
  unsure (1)..(121): unsure at all Xaa locations
  Clone ID: PAT_TA_40714.pep
RAGALNKSIRVEKIPGGHLADSMGLKGVMSHQDVAPPGTMSRRMVHPRIMPLDCPVECKKGDIXSLAESMSEEDWKVPLDFVEDTIKNLCVQILKFKPAPGISXNGHIDIALHYLSNAGVV

SEQ ID NO: 146297 - protein, 90 aa, Triticum aestivum
  unsure (1)..(90): unsure at all Xaa locations
  Clone ID: PAT_TA_40715.pep
MSTDAIGVDIPVPEAEATADPNEETTTDAHDDDAKTTKATNAKVVKTSKAPKVKKPWRPRKPKAEPTHPIYAEMVEEAIVXLKERGGLST

SEQ ID NO: 146298 - protein, 45 aa, Triticum aestivum
  unsure (1)..(45): unsure at all Xaa locations
  Clone ID: PAT_TA_40716.pep
RLASSRDRXXGRFXRGSQRFTYRGCYATVHSFVLLVXXLNSISLG

SEQ ID NO: 146299 - protein, 137 aa, Triticum aestivum
  Clone ID: PAT_TA_40717.pep
DEGRVKEAKEGEGNDDDGDDIIDLCSDGEEGERTAVAGEMEMEGDEDGDDKVPLSQRFKRLRRAEPGELESGKGDGQGQIDSVSILGNDQQKSSFVKMEEQMTRTGKMACMPEASKVAAFVQESAVVKSEKVDDEIP

SEQ ID NO: 146300 - protein, 61 aa, Triticum aestivum
  Clone ID: PAT_TA_40718.pep
QSSCSRHPTIRSQSREGSRPAYLPPGHSCIYRQRPFQSPSWPIRANNRPSQPTPTRPRTRE

SEQ ID NO: 146301 - protein, 88 aa, Triticum aestivum
  Clone ID: PAT_TA_40719.pep
APRHPNGFTSTGEGTIGGGKNKRLFKGREGCKKKGGDPFTKKQGCYIKGPVVVNNPNGGETLVFKTPGTKIGLKGLKHQVVQVFLTCL

SEQ ID NO: 146302 - protein, 86 aa, Triticum aestivum
  Clone ID: PAT_TA_40720.pep
PIFRPLVRCLVASPLIGMRQYYCAQIQSMSLHSPPLITKPRHGFYRGQAPVGSLRKHFRHARSPNSATGPNRSPLLSAAQPQWRMG

SEQ ID NO: 146303 - protein, 138 aa, Triticum aestivum
  Clone ID: PAT_TA_40721.pep
GRVGPATNISPSLPFHLRFSLLLCPSSLPPICSPIPASGVGSVPFSRSLERGQETRERAAARSGGGGQRKREATAAARVSIPAAVRRTIHNIKEIAGNHTDEEVYAALRECDMDPNETAQKLLHQDTFHDVKRKRDKK

SEQ ID NO: 146304 - protein, 40 aa, Triticum aestivum
  Clone ID: PAT_TA_40722.pep
MTSFVSCSPSRKVLSKIACLRLQKELVKWQASPPRGFTYK

SEQ ID NO: 146305 - protein, 55 aa, Triticum aestivum
  Clone ID: PAT_TA_40723.pep
PYISTGPFSGAPSGGGGGLFSRRGIYHQLPNSSHSESPWRLPLHPFKSTTTFLLT

SEQ ID NO: 146306 - protein, 60 aa, Triticum aestivum
  Clone ID: PAT_TA_40724.pep
LMCQRTKPIGKFAFVDMIHSKWGFLNLAGKLPPYALQAEVRLKQPIDRDGATTCSKRFSD

SEQ ID NO: 146307 - protein, 66 aa, Triticum aestivum
  Clone ID: PAT_TA_40725.pep
MVQGLKTDLRLQSFAGYTLDEAVQAYLLVLFEDTNLCAIHAKRVTIMPKDIQLARRIRGERAYAAF

SEQ ID NO: 146308 - protein, 70 aa, Triticum aestivum
  Clone ID: PAT_TA_40726.pep
GGPTHPAGRPAYLATDERGRFHRVLKIWNLNNLAAAVGVFNCQGAGNRTWEALLGTRLHEPRIARRRIHP

SEQ ID NO: 146309 - protein, 33 aa, Triticum aestivum
  Clone ID: PAT_TA_40727.pep
VMSFYEISMDEVFFRSHMFVRSLFRYVDLPTRP

SEQ ID NO: 146310 - protein, 88 aa, Triticum aestivum
  Clone ID: PAT_TA_40728.pep
DAWGLGKQSRRRPPIPPPFPLIPSNPATALPPMAVSSRLPAPPARGLLRRSPTRILPSRRLACGTRAVYGSPGPGGSPLPRRTTAPLD

SEQ ID NO: 146311 - protein, 91 aa, Triticum aestivum
  unsure (1)..(91): unsure at all Xaa locations
  Clone ID: PAT_TA_40729.pep
SPARVRSSRRRSVRPSTSPSPRAPPASSSPTTSSGRGHSRASTEESWARSSATSAPXAPTASSSSTSSTSAPRAPSSRVSALTHFGTRPFQ

SEQ ID NO: 146312 - protein, 45 aa, Triticum aestivum
  Clone ID: PAT_TA_40730.pep
QNARGLVKNCRQKKFVASSCHSTIILTTGKITDQRILAGLILSGV

SEQ ID NO: 146313 - protein, 42 aa, Triticum aestivum
  Clone ID: PAT_TA_40731.pep
SAADRKNLAEQMAATLTRDPGFKAALVSALSGRILELSPSDS

SEQ ID NO: 146314 - protein, 49 aa, Triticum aestivum
  Clone ID: PAT_TA_40732.pep
TCNPSGRRRGEGGTRRLACGRVRVSARHAETARDPMPPAHQAGAGDKSV

SEQ ID NO: 146315 - protein, 50 aa, Triticum aestivum
  Clone ID: PAT_TA_40733.pep
LLQHLFNVIHVDRGVPYFIIKINSGGHNFPSPNKAIIYQDLAPGVRGSVG

SEQ ID NO: 146316 - protein, 104 aa, Triticum aestivum
  Clone ID: PAT_TA_40734.pep
PRVRPRVRSSAQQQPEAWASIPMARTKQTARKSTGGKAPRKQLVTKAARKSAPVTGGVKKPHRFRPGTVALREIRKYQKSTELLIRKLPLQRLGRGIAQDLKTD

SEQ ID NO: 146317 - protein, 73 aa, Triticum aestivum
  Clone ID: PAT_TA_40735.pep
MVHVNFYRNYGKTFKKPRRPYEKERLDAELKLVGEYGLRAKRELYRVQYALSRIRNAARELLTLDEKNPRRIF

SEQ ID NO: 146318 - protein, 130 aa, Triticum aestivum
  Clone ID: PAT_TA_40736.pep
PRVRFPRIMAALSKSGKDVPEVSKEVCGAIYFLARGYDVAISSEVDHSKKRISSELSPFLGGVIDALLSASELDMKTPFGLPASASAYGALIEVVRVSNIWDLKAVLAIIVLMPRIMRRLNTVLDAKAIS

SEQ ID NO: 146319 - protein, 60 aa, Triticum aestivum
  Clone ID: PAT_TA_40737.pep
RSCGWMRGLERPLFCFGLSCLRPRSWIVKMHQTCGLISFEGAFLAGSDYMLTLNGLISCT

SEQ ID NO: 146320 - protein, 87 aa, Triticum aestivum
  Clone ID: PAT_TA_40738.pep
MALDLGALALKYTGLAVSDHDSIVAINIFIALLCGCIVFGHLLEGNRWVNESTTALVLGLITGGVILICTKGVNSRILIFSEDIFFI

SEQ ID NO: 146321 - protein, 74 aa, Triticum aestivum
  Clone ID: PAT_TA_40739.pep
DRSAWLYFYHSSISSSSSSQLLPSAPSISMEFGPPATSWHEGLFLAISLWGLIHLSKGLKSVTTSEKLREPDVL

SEQ ID NO: 146322 - protein, 89 aa, Triticum aestivum
  Clone ID: PAT_TA_40740.pep
RTPHGKKRRRAPRLLQRTDCLLLHDQRERKADAACGMDNIFTTCSLSSCLPMIFDSSTQECVCGWTMFGASVHCRKWKLFISATSSSII

SEQ ID NO: 146323 - protein, 129 aa, Triticum aestivum
  Clone ID: PAT_TA_40741.pep
RTRGQQVDKFYSLSNGFSRHNISDNISTVSYPEKLWMRADGVNSVRSTRSTPVDGCIGRDGRTSSAHNHLDIHSNFSLHPDRPNSQLLPLVMKPCELNYNSVDEVAGRIYMLAKDQNGCRFLQKVFAQG

SEQ ID NO: 146324 - protein, 68 aa, Triticum aestivum
  Clone ID: PAT_TA_40742.pep
CCHPESNLKGTVANSSVLGIIQSLYKGLHLLMKKSTFLKTWLLDFYVTSAEFVTLSTMAHMADIAGCR

SEQ ID NO: 146325 - protein, 128 aa, Triticum aestivum
  Clone ID: PAT_TA_40743.pep
RTRGQDGDIVLVNRQPTLHKPSMMAHVVRVLPGEKTIRMHYANCSTYNADFDGDEMNVHFPQDEISRAEAINIVDANKQYIGPRSGEAVRGLIQDHIVGAVLLTKVDTFLSREEYSQLVYGSCVSSSR

SEQ ID NO: 146326 - protein, 96 aa, Triticum aestivum
  Clone ID: PAT_TA_40744.pep
MSYMRGDLLTKTRKLVKGLAKPAPAWLKAMEQAPPVTFPRTDGKIEKIELPEDVYVKRFFRRHPDSLYHDAIKISGFDPPPARVFAWCVLELKGQG

SEQ ID NO: 146327 - protein, 127 aa, Triticum aestivum
  Clone ID: PAT_TA_40745.pep
GRVGASVFFKTQADGHVSCAKEMTKLSGISDIIPEMEVCDFDFEPCGYSMNAINGSAVSTIHVTPEDGFSYASYEVMGMDASALAYGDIVKRVLRCFGPSEFSVAVTIFGGRGHAATWGKKLEAEAY

SEQ ID NO: 146328 - protein, 45 aa, Triticum aestivum
  Clone ID: PAT_TA_40746.pep
FKRVISPSISKRFYSLLTRLIQLGSIYTICNVNNLPLILQIMPGL

SEQ ID NO: 146329 - protein, 130 aa, Triticum aestivum
  Clone ID: PAT_TA_40747.pep
GRVGPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVTAKGESVGNIADLLGTGLSIFITKRNP

SEQ ID NO: 146330 - protein, 102 aa, Triticum aestivum
  Clone ID: PAT_TA_40748.pep
MASSALPAPSVVAVAVAVAFVFAVATLAATASAAVTYDRKALVVNGRRRILLSGSIHYPRSVPEMWPDLIQKAKDGGLDVVQTYVFWNGHEPSPGQYYFEGR

SEQ ID NO: 146331 - protein, 92 aa, Triticum aestivum
  Clone ID: PAT_TA_40749.pep
WPRASSTSFMSHKLRSCRAYSSFTFLDLFPSSSTLVTSSGSFMPARGAVKYNLEELETFHITCLWLNVGVIQQPTVMPYGHPFCTGRLIGRR

SEQ ID NO: 146332 - protein, 51 aa, Triticum aestivum
  Clone ID: PAT_TA_40750.pep
CYQKQTKEILLSNNCLAPNSIIYAGWWAEYNNVKYWSIRDTAKAFLLVYDT

SEQ ID NO: 146333 - protein, 96 aa, Triticum aestivum
  Clone ID: PAT_TA_40751.pep
RTRGRTRGARFAALPPASYCSPPVWGCAAVGGGEARGSRGEPRKEMAAWTSVGLVAVAVLVVGIAMPASAAVQPAAPAPFSDGTSIDQGIAYVLML

SEQ ID NO: 146334 - protein, 40 aa, Triticum aestivum
  Clone ID: PAT_TA_40752.pep
KTIAYLERCTSDFMNLTGYQGSTFKEVLCPSHDRIHTYVV

SEQ ID NO: 146335 - protein, 50 aa, Triticum aestivum
  Clone ID: PAT_TA_40753.pep
VAKNHTVVVTDDGKSLAFGHNKFVQLVTGSLNNEIDASTSSFSCYRCDWC

SEQ ID NO: 146336 - protein, 52 aa, Triticum aestivum
  Clone ID: PAT_TA_40754.pep
GPVGQIIVQLLSKQLRAFVALDVQRDRPAAGIALDLPIYFVGQRSRVVQFTV

SEQ ID NO: 146337 - protein, 47 aa, Triticum aestivum
  Clone ID: PAT_TA_40755.pep
TFKLCRNVVVLKHGTNIDYGEPLLPLQFEITPIMIRSYENNRKRTRE

SEQ ID NO: 146338 - protein, 96 aa, Triticum aestivum
  unsure (1)..(96): unsure at all Xaa locations
  Clone ID: PAT_TA_40756.pep
MAYAYDREDGLAPWKADGGRRGDYYNPNYVPVLLKTFVVYLDRRIQNENVXEIHLMYRGRVAAALRRGFADTRGARGVAREVXCDGDHVLLGVYRE

SEQ ID NO: 146339 - protein, 51 aa, Triticum aestivum
  Clone ID: PAT_TA_40757.pep
TPRFGNRAPVNQNPTGTEGKSGPKKKGTFPSGQGRSQKKPKFRFRNPVGRV

SEQ ID NO: 146340 - protein, 85 aa, Triticum aestivum
  unsure (1)..(85): unsure at all Xaa locations
  Clone ID: PAT_TA_40758.pep
MASTTTRLVCAPLFLLLLSMSNANSVQETGSSLKSSTQKNVFVLDNYGARGDGKHDDTQALAKAWNAACSSXRPAVLVVPRAKPI

SEQ ID NO: 146341 - protein, 81 aa, Triticum aestivum
  Clone ID: PAT_TA_40759.pep
MRPIFCGNLDYDARQSEIERLFGKYGRVERVDMKTGFAFVYMEDERDAEDAIHRLDRTDFGRKARRLRVEWTKEDRRCCPK

SEQ ID NO: 146342 - protein, 129 aa, Triticum aestivum
  unsure (1)..(129): unsure at all Xaa locations
  Clone ID: PAT_TA_40760.pep
DAWVNEELWNEARTYGDIQLMPFVDYYSLILWKTIAICIYGTNVLSAKYVMKTDDDAFVRVDEILSSLHQVNISHGLLYGRVNSDSQPHRDLYSKWYITSEEWPEESYPPWAHXTRYIVSEDIAXEVYR

SEQ ID NO: 146343 - protein, 107 aa, Triticum aestivum
  Clone ID: PAT_TA_40761.pep
MLPTAPPLPPLHCSLQRRQRSGGKGRRRGRSIRSAEDKEGEEGERERKEEREVWWRMREGHRKERDDLQAKGGGGAARFDLREREDERGRKREREKEGEERREKERG

SEQ ID NO: 146344 - protein, 107 aa, Triticum aestivum
  Clone ID: PAT_TA_40762.pep
HASESPPIPPSEQLASPAMSGRGKGGKGLGKGGAKRHRKVLRDNIQGITKPAIRRLARRGGVKRISGLIYEETRGVLKILLENVIRDAVTYTEHARRKSVTDMDVVY

SEQ ID NO: 146345 - protein, 75 aa, Triticum aestivum
  Clone ID: PAT_TA_40763.pep
GASSGGAPALSPALCSSSRSNRGGWWWWWWYRRHLNFYGARHEKHRRQKQLLHPPDGQPQSYVLHLRPDVRGHPR

SEQ ID NO: 146346 - protein, 113 aa, Triticum aestivum
  Clone ID: PAT_TA_40764.pep
HRRDSCPPCRRRGFGHQGPVLAHPPREDPALLRPLDHDVRIIAAAAAAPPFGTRIPARMVSAGVDVHVGCGAWLGVVRGGCPAPGWFASSHCPFKKPLAEAAADGPRRCPRVR

SEQ ID NO: 146347 - protein, 96 aa, Triticum aestivum
  Clone ID: PAT_TA_40765.pep
HASGQRMTGFFITRHCKKNILHYGTEGVDRKAPTTPPPSPRPHMGTLPCFGLRVPRVMHKISLNTPSVQNYLSRKWIKMDVFRIKIRLDTSISPTS

SEQ ID NO: 146348 - protein, 69 aa, Triticum aestivum
  Clone ID: PAT_TA_40766.pep
QERIQHAYAQVPQSNANVDKQLPVGRYGYPAMVALNVKKGAYAALINAFELAEITEFVKVAVRGGKGIL

SEQ ID NO: 146349 - protein, 69 aa, Triticum aestivum
  Clone ID: PAT_TA_40767.pep
NQITLLVVIKKGYTKHRREANKDDQDGALHALELQADGVVKTGRAVCHDVGEAPEPWRHGNGNRDRTRG

SEQ ID NO: 146350 - protein, 100 aa, Triticum aestivum
  Clone ID: PAT_TA_40768.pep
WYSPRRDAADLITAAGVAVPYLSLNPTSRGRGPPSPQSGLHHHCRHRRSPSSSAAGTSSCPVQCLAVGSPSILPSSEVGHTSRSAAPVFVCITMETVHST

SEQ ID NO: 146351 - protein, 125 aa, Triticum aestivum
  Clone ID: PAT_TA_40769.pep
GCVMISTEGSCKRRCRSAMVIFGRGGAGGMNTLMKAGRVVRRSRSGVVARTAVAGTGTLVGRNTLRKAGRPQSLSHSDADADASAGAICNEAATEAAGPLALPGCIVLVDWWWRSGAHSGGVDGV

SEQ ID NO: 146352 - protein, 145 aa, Triticum aestivum
  Clone ID: PAT_TA_40770.pep
SKDKALLVRADALLVLDLGLDIVNGVRTLNPSDVCMHACMCVPCCGRNQCFDPFWKSSAQNEPCWNKRRVDAGGSSAIAVLSRWIGPLDAFSSVGSTSGGICAVGSKSDRKNLLLAPPPARFYFVFTVLKSLMCGSVRGWAFVVS

SEQ ID NO: 146353 - protein, 63 aa, Triticum aestivum
  Clone ID: PAT_TA_40771.pep
STKLSHLVLHQNRKHDLQGVSSTIVDTFCHTQLWTFLTFHSNTSIHFHHDAIHLGNETEQIGN

SEQ ID NO: 146354 - protein, 56 aa, Triticum aestivum
  Clone ID: PAT_TA_40772.pep
TQSSSRYRKDMSPHACVGKPAHSISASVFLLFGTSTMHSALINEITSHFCPYISPS

SEQ ID NO: 146355 - protein, 118 aa, Triticum aestivum
  Clone ID: PAT_TA_40773.pep
ELQVAKALASVLESQRVPPNLCAHNAQVQGAFQVTYRMSVWLTARPVHTHSHEHNLMKVQCNPRRVSLVQPWFCQARCCKTPASRLQLGAAIKELIRRKYEYVSMKPLCQLCHQPRPD

SEQ ID NO: 146356 - protein, 75 aa, Triticum aestivum
  Clone ID: PAT_TA_40774.pep
ERHRVKHSDLILVTEHDRVALVHKLKGEEDSLGRHFLSGGGDTPIYLPLFSHPPPSSLTKQEISNPCAAGAAAAD

SEQ ID NO: 146357 - protein, 84 aa, Triticum aestivum
  Clone ID: PAT_TA_40775.pep
PSSSALPCLLGISATGEQQLCSAPICSALSVTGRTKEGGRRGRAYCTVLLYWLQSSASAGTSTRDLLAAGWICSPLLCSAGWLY

SEQ ID NO: 146358 - protein, 42 aa, Triticum aestivum
  Clone ID: PAT_TA_40776.pep
GCHLLREPRGYGHAFGHCYYHLQAQGLWTKPFLFQMSLLTNY

SEQ ID NO: 146359 - protein, 71 aa, Triticum aestivum
  Clone ID: PAT_TA_40777.pep
SRRRAGMRWETCYAYPLRYTLFIRRPRGRSKCSSSGSGGMPVGMPGGFSIPMRHVWKCLVVYLEGCLLVTL

SEQ ID NO: 146360 - protein, 145 aa, Triticum aestivum
  unsure (1)..(145): unsure at all Xaa locations
  Clone ID: PAT_TA_40778.pep
DPNRHLPVGPRAGNCRLRPGPAGRPRSSLGVSSSPGPKRAEHXTPPSPQCHGVPSSRRASSPGRLPSRFAAYAPSSPDSSRSDSSSSSAVAGHGSPAVEGCGCGGTRGRGRRASEVGGGGQRRAVRQGGAWQEAATRWRCRPRVR

SEQ ID NO: 146361 - protein, 53 aa, Triticum aestivum
  Clone ID: PAT_TA_40779.pep
GIGINSREVVEGRGMYMNLGYAIGKITPPVCEYVCLGQEKRLLQIKCRVRVGR

SEQ ID NO: 146362 - protein, 48 aa, Triticum aestivum
  Clone ID: PAT_TA_40780.pep
EGEPSYTRRHPPMKGRSGGVAAKGGANTTARPETSGATTRSISKEGVP

SEQ ID NO: 146363 - protein, 107 aa, Triticum aestivum
  unsure (1)..(107): unsure at all Xaa locations
  Clone ID: PAT_TA_40781.pep
DAWAVPSTIPPPPPPPTIPPPLSHPPSRXADSPPPRPLPQSPLTTQQQHWQHPTNPDHHCRRATQPATTLLECLPSPPLYFARFLPRAGFLPKTMEPVVLRMRWVLI

SEQ ID NO: 146364 - protein, 83 aa, Triticum aestivum
  unsure (1)..(83): unsure at all Xaa locations
  Clone ID: PAT_TA_40782.pep
PRVRGRVGGRVGENINNGLELLMKSGMYTLGYKTVLKTLRSCKGKLIILVNNCSFLRKTDIEYXAMLAKISVHYFYGYNVYFG

SEQ ID NO: 146365 - protein, 62 aa, Triticum aestivum
  Clone ID: PAT_TA_40783.pep
ALGLFGMAVFHYYGSKYLSARSKVLFERGHSGLSGNPTYKHLGQASILPPCSYRPNLSVVVG

SEQ ID NO: 146366 - protein, 73 aa, Triticum aestivum
  unsure (1)..(73): unsure at all Xaa locations
  Clone ID: PAT_TA_40784.pep
YIQLLRGGGALIKRRTSVRSXCAACAESSWCSTSSEWASLIGISEIPIITARVLRSRQLSSALPGVSHSQKEW

SEQ ID NO: 146367 - protein, 28 aa, Triticum aestivum
  Clone ID: PAT_TA_40785.pep
VYHIDTVPPSHERQSSMLQRSFGLAVLR

SEQ ID NO: 146368 - protein, 51 aa, Triticum aestivum
  Clone ID: PAT_TA_40786.pep
TGWSVISRRYNTRISKGKSSFTERRDFWFRKQVGAGGRGASAGVLLRSWCG

SEQ ID NO: 146369 - protein, 59 aa, Triticum aestivum
  Clone ID: PAT_TA_40787.pep
LLHCLVCKMFRSITSVCPCSPFVTMEATNAVENCPRTQTFLRGFLPAERKIKFMASNKM

SEQ ID NO: 146370 - protein, 70 aa, Triticum aestivum
  Clone ID: PAT_TA_40788.pep
GSRPIRAAGRRGPPSRSTPRTAPSRRPRPTPSDAPAPSPPRTARTPSAPHPGSGTGLWIKARGERNGGEA

SEQ ID NO: 146371 - protein, 97 aa, Triticum aestivum
  Clone ID: PAT_TA_40789.pep
QLHTLKLQEGSRAYIGSSSQLTCNGSHVTICFTWIAQLIADLVGAWPNKRLMTTTTPSWVEGRRRLAVVGAEDGVSDPACRERRAADGGELGATGGA

SEQ ID NO: 146372 - protein, 59 aa, Triticum aestivum
  Clone ID: PAT_TA_40790.pep
VPPVVLLVGCLLPISGCRWSVWVRLLLLCPLAWFAPREGGELRNVCAWFARALLSSRLS

SEQ ID NO: 146373 - protein, 96 aa, Triticum aestivum
  Clone ID: PAT_TA_40791.pep
MAVTFFDLHTADGLKGLEAHLGGKTYISGDGITKDDVKVFAAVLVKPSAEFLNAARWYDAVVGAVFLRFPGQAYGVSAFLGSGGGCSVVFKDEDDD

SEQ ID NO: 146374 - protein, 60 aa, Triticum aestivum
  Clone ID: PAT_TA_40792.pep
ASKTRAFFVPYPRRSTRARITPPPSSPFPQIQLNRAARGAIRSRKRRQLATETALSRYRT

SEQ ID NO: 146375 - protein, 69 aa, Triticum aestivum
  Clone ID: PAT_TA_40793.pep
PRSKKKKSFFPYLSSGGLLVWDSYPHEPLPRAHHPQGGPASSAGATRPQLPRSATFPPPESRSRLHDPG

SEQ ID NO: 146376 - protein, 136 aa, Triticum aestivum
  Clone ID: PAT_TA_40794.pep
HQPHLLAAQRLTTGSTLSPPGYITSPSGGFAFGFRALDSDPSQFLLAVWFNFNLTQAPDPAQEKVVWYAKNLGSGSTVMATKLSVFSIGPQLSLTDNTGSIIWTNPYPSLQAGSILVLQDSGNLQLLAPTRPPTRP

SEQ ID NO: 146377 - protein, 67 aa, Triticum aestivum
  Clone ID: PAT_TA_40795.pep
VGEGQLFNGINGGDRLVFHGANKYFRLGGMLTNGIAGSWLNGANSVLKMIFRNTTLAYIVLPNNCRM

SEQ ID NO: 146378 - protein, 92 aa, Triticum aestivum
  Clone ID: PAT_TA_40796.pep
CCASSFTGRASYSIELGDLASRSARLRRTCPRSPMLRPSSERRPQERRNPRELVRPLPRLVHGPRVALVASEPRPTGPSGVAPRPRVRERVG

SEQ ID NO: 146379 - protein, 76 aa, Triticum aestivum
  Clone ID: PAT_TA_40797.pep
LLSSPFDRRRSSRSMPAPASEWLLWWHRRGATGRRGLGQKSGLFASVAAAAATGTGLFMAAKWLMVPFFGFFWLVD

SEQ ID NO: 146380 - protein, 123 aa, Triticum aestivum
  unsure (1)..(123): unsure at all Xaa locations
  Clone ID: PAT_TA_40798.pep
PSRALASSSTTQARAPTAAPWTGGPSRPPAAVLVRVRGTRPPSSTXAPPSCPVAAGHPPAAPATRLCSTRTAPASVASPPSSSPRRLRSTPARSSWPRPPPSGDSPFPSSRRRSSCPRPPHAS

SEQ ID NO: 146381 - protein, 46 aa, Triticum aestivum
  Clone ID: PAT_TA_40799.pep
RLQTTPFIYQARGTRLGLKQPTQTLHRYFLSLPAPPTIFNHGNCLQ

SEQ ID NO: 146382 - protein, 114 aa, Triticum aestivum
  Clone ID: PAT_TA_40800.pep
DTGGNFTLRPHTPADAHTKSKSLYQDPNTYIYPHPHGGPARVRHNTCAPARQLRSYTPIALDLAERTSAPPHVPYSWRRLVQELAHHAVRPELRPPLPKGPQCGAQAGLSSQHH

SEQ ID NO: 146383 - protein, 90 aa, Triticum aestivum
  Clone ID: PAT_TA_40801.pep
LQEQVDKFVQERMSANPPPQELHQDDPEAMNEEEDEEVDICSGVCLLVIEPQPMMQERHQDGPEVMAEEEEEEEVDICGGCYILPSVPAT

SEQ ID NO: 146384 - protein, 119 aa, Triticum aestivum
  Clone ID: PAT_TA_40802.pep
AHEVGHPIAVAVPGTVCRVPAASLAPSIAVLLGIVEPYHLVHPLLEHVGLGEEVVDLAPERVHLRHLRPIGSGGRRLHQRRIRPRSLHCGPSHRGHLWCRRVMTNSRRKVARREEVGFG

SEQ ID NO: 146385 - protein, 55 aa, Triticum aestivum
  Clone ID: PAT_TA_40803.pep
NLVVQFWNSAILVFISVKGPKFPLELDWNLTKYFKKFKCNLRIIQICAYYRSCYE

SEQ ID NO: 146386 - protein, 135 aa, Triticum aestivum
  Clone ID: PAT_TA_40804.pep
RTRGESGHQPRLSCDAPRFSYDGRESASKRREMPRLSLDIKEGPLRIREMDSRPKPNMNDTERSISFGSDKESNAEIQKEQPAASKRLPSVVAKLMGLEELPEPNDTKVISPQAPKSVQERKQEHILLPLSLSSH

SEQ ID NO: 146387 - protein, 59 aa, Triticum aestivum
  Clone ID: PAT_TA_40805.pep
KVGCGLYVDMNLFLGFRREHVPWNFKKTENHVYLHVVLWQKLDADESEPAEEATLLTIG

SEQ ID NO: 146388 - protein, 98 aa, Triticum aestivum
  Clone ID: PAT_TA_40806.pep
DAWGVGIIVYRGLYLGLYDYMKPVLLTGTFQDSFFASFALGWLITNGAGLASYPIDTERKRIMMTSGEAVKYKSSLDALQHILAKEGGKSLFKGAGGN

SEQ ID NO: 146389 - protein, 41 aa, Triticum aestivum
  Clone ID: PAT_TA_40807.pep
FTGENDSNLYATLDMLYAGMENQTRFFGAGENITYYLAGIY

SEQ ID NO: 146390 - protein, 53 aa, Triticum aestivum
  Clone ID: PAT_TA_40808.pep
HKLWQGKFICLFYQQTNITYDRITQIIDEQTLNLPQLNNLRPRVPKLLHLVPR

SEQ ID NO: 146391 - protein, 122 aa, Triticum aestivum
  Clone ID: PAT_TA_40809.pep
GRVGGRVGKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPEVVEHQV

SEQ ID NO: 146392 - protein, 69 aa, Triticum aestivum
  Clone ID: PAT_TA_40810.pep
FGYNAGSGHYEDLMADGIIDPTKVVRCGLRHAVSHAKTFLTSDVTVDEIKEPKDEPLANPMDNSGYGYC

SEQ ID NO: 146393 - protein, 123 aa, Triticum aestivum
  Clone ID: PAT_TA_40811.pep
ARRAQEETTVRHQTPLLRCPRVQSACLRPPCRARRTRCLRRPSPVRHWASTPSPAPPMSTRCPYPTSLCPHHDPTPPPPAWQSCPSQMLQNLPSPCPPCARPSGQEGTLMQRGQFILQRHPRV

SEQ ID NO: 146394 - protein, 126 aa, Triticum aestivum
  Clone ID: PAT_TA_40812.pep
QAAPNPRHVQTQVEFDYTMSTGCYLTKSQDEKVVEIARKIRSEIPLYVAIMKKLNVNVKDCSINIPLRLVSHLKEEAGSAIIKLEAPGGNIYNVRASKHSEDQVVLQSDWDAFVAANHIQLNDLLI

SEQ ID NO: 146395 - protein, 97 aa, Triticum aestivum
  unsure (1)..(97): unsure at all Xaa locations
  Clone ID: PAT_TA_40813.pep
MALSRRRLLLLSLVAMTAVTGTSKVIVTRCYPPPTPHPNGRGAFHRSLLSLLDDLPSAAAPTGFASMRTRGAFARGLCFGDPAPGPCXHCLSDAGGK

SEQ ID NO: 146396 - protein, 91 aa, Triticum aestivum
  Clone ID: PAT_TA_40814.pep
IDDHTKYTPHIESQWYVPTGGLACLCLHALCPHTHRRRHLVINPCLVAGFSQSRVSYACPWLHLHSAASMVNSLVPMLMGRQAERVTEFRR

SEQ ID NO: 146397 - protein, 54 aa, Triticum aestivum
  Clone ID: PAT_TA_40815.pep
ARGGRRQTISDYVAGYRKSKWHDGDIKKIIENDYRERMKNMQQRNERLLIMERL

SEQ ID NO: 146398 - protein, 89 aa, Triticum aestivum
  Clone ID: PAT_TA_40816.pep
MMESQPLQAPTAEPHGAGAADDQAGAGAPPAVVPGKEFTRTCKGLVVVLIGGYVLLQLLPSSLNYLAIIPAKTIPFVWTVFTAGYIEQV

SEQ ID NO: 146399 - protein, 59 aa, Triticum aestivum
  Clone ID: PAT_TA_40817.pep
TPTRTRTTRNPLQGLGFYADGPRRRSRRSHDAPSATRVLLRRVHIRTNAPWYTHKTTYH

SEQ ID NO: 146400 - protein, 88 aa, Triticum aestivum
  Clone ID: PAT_TA_40818.pep
DAWARTFLFQSTEKLEVIMSTDAIQQGLKSHDAHSRAQNAKQRGGRTAGGLTSTILNYTVPKAWKTAARGTTIAHGLVCNTGTPSTNT

SEQ ID NO: 146401 - protein, 119 aa, Triticum aestivum
  Clone ID: PAT_TA_40819.pep
DAWVTQHVEFVTHDEKRTYLIDLLQKQSFTSSDGKPQQPLTLVFVETKREADSLRYWLYNKGFPATAIHGDRTQEERESALRSFKSGLTPVMVATDVVARGLDVPNVAHVINYDLPKSI

SEQ ID NO: 146402 - protein, 74 aa, Triticum aestivum
  Clone ID: PAT_TA_40820.pep
QDALKHNIELTGQKAWKSDVSGPTIAQALGFYRATSCTNTIVTSRRRYGSGHYCATISAAKSTIALLTIWMQMN

SEQ ID NO: 146403 - protein, 101 aa, Triticum aestivum
  unsure (1)..(101): unsure at all Xaa locations
  Clone ID: PAT_TA_40821.pep
GRVGKGYSYFYTWDPRAEGKISEAVKQNGGAFEETAISGGKKPSEDGXLVILAAGDTALYYDMVPAFSVHGKNPVFLWEMLKGSKMXLVVIMINGQYDECF

SEQ ID NO: 146404 - protein, 42 aa, Triticum aestivum
  Clone ID: PAT_TA_40822.pep
LLLSATFRRLGLYYSRSSTSRTKILCIQARGLSFYIRWSQIR

SEQ ID NO: 146405 - protein, 65 aa, Triticum aestivum
  Clone ID: PAT_TA_40823.pep
GSFATLANWLTSFGITMTANLLLSWSAGGTFVCYTLVSAFTLVFIILWVPETKGRTLEEIQWSFR

SEQ ID NO: 146406 - protein, 62 aa, Triticum aestivum
  Clone ID: PAT_TA_40824.pep
MVLDSLSSPHRRSQNTFFLSSPKKPQSSRDDVGSWSALVERHRFLLTTLVVLAFLCTIYLYF

SEQ ID NO: 146407 - protein, 52 aa, Triticum aestivum
  Clone ID: PAT_TA_40825.pep
RTHPHSLLFKHHLKDEREDLPDCDPMVLESLLKIKYERDPSLTCRPSCREGI

SEQ ID NO: 146408 - protein, 90 aa, Triticum aestivum
  Clone ID: PAT_TA_40826.pep
QIRRADEQNGLSLGVSSKSGTTQRAYYSLLVIVATRETGIFHATPPNTNCACKEPKRCQRRWPNGAKLKLMDDILTGIMRNTRSARPYMS

SEQ ID NO: 146409 - protein, 49 aa, Triticum aestivum
  Clone ID: PAT_TA_40827.pep
MEVNGRHKPTREYVDRGCNGVKPHNNFGKVDPWTAWAYRPRTISLLLMG

SEQ ID NO: 146410 - protein, 125 aa, Triticum aestivum
  unsure (1)..(125): unsure at all Xaa locations
  Clone ID: PAT_TA_40828.pep
GHIPNYPNLLPQLICQLHDVTMHADVETDEVYAQMTLQPLNPQEQNDAYLPAEMGIMSKQPTNYFCKTLTASDTSTHGGFSVPRRAAERVFPPLCGLXDFTQQPPAQELIARDIHDVEWKFRHIF

SEQ ID NO: 146411 - protein, 93 aa, Triticum aestivum
  Clone ID: PAT_TA_40829.pep
PAHVLWWRRQSLLLVIIMASLNPNLRLLWFLFRPQWAQLFRAGWNIRGLNGPRCPVLVKYYSSSLVAKKKKKKKKKKKKKKKKKKKKKNPRVR

SEQ ID NO: 146412 - protein, 46 aa, Triticum aestivum
  Clone ID: PAT_TA_40830.pep
KCCHFLLIHQSQSGFRASRPIFVEKLPLLPKTDFRYPPCMVVPQVP

SEQ ID NO: 146413 - protein, 126 aa, Triticum aestivum
  Clone ID: PAT_TA_40831.pep
ELLMAFRRAVTADPLGALRGWSYSDDSACAWNGVICNGFPQQQASTVNLTSASSDGNGNFSTLAGGRANGTLLGLNASMAAATVSRVIGLVLPGAQLSGSLPAELARVEHLRHLDLSGNGLNGTLP

SEQ ID NO: 146414 - protein, 85 aa, Triticum aestivum
  Clone ID: PAT_TA_40832.pep
SCGPLHGFFVDRHRYVQASCLRVWSRSSLFCRTGRSDWPCLPAGARARARRTSLRGRRSRRRRWGRRRGRGWGLGLGTDAWADAW

SEQ ID NO: 146415 - protein, 51 aa, Triticum aestivum
  Clone ID: PAT_TA_40833.pep
WRVDGPILQDHPLTCVTTNFILCISSYTCCRARRERGLRRMMCCSANKRSR

SEQ ID NO: 146416 - protein, 91 aa, Triticum aestivum
  Clone ID: PAT_TA_40834.pep
GRVGGRVGTSGNHHQLLRLHRSSTNASLHRNRTPMTYPPIWHAALGCSRWCRRPLLLTIDRRRSFDARCALYGGDRILQLITVVLVVVARR

SEQ ID NO: 146417 - protein, 53 aa, Triticum aestivum
  Clone ID: PAT_TA_40835.pep
MFWMEPNWGVFTGCATSNTCNLNVTNHIIRGEADLMLIGEYYALSHTNCIGRF

SEQ ID NO: 146418 - protein, 55 aa, Triticum aestivum
  Clone ID: PAT_TA_40836.pep
QESHDACTENDRTDKDITPMGGFPYYGEVKGDYLMIKVCCEGPKKRVVDPHFSPC

SEQ ID NO: 146419 - protein, 45 aa, Triticum aestivum
  Clone ID: PAT_TA_40837.pep
HSLLHMNAVCTRTDMISILNNSLRALAASVLVDGAGLYYLSNRLS

SEQ ID NO: 146420 - protein, 125 aa, Triticum aestivum
  Clone ID: PAT_TA_40838.pep
IPISLYVSIEVVKVAQAHFINQDIHMFDEETGNTAQARTSNLNEELGQVHTILSDKTGTLTCNQMDFLKCSIAGVSYGVRASEVERAAAKQMASGAADHDNPVEDVWESNEDEIQLVEGVTFSVG

SEQ ID NO: 146421 - protein, 77 aa, Triticum aestivum
  Clone ID: PAT_TA_40839.pep
GRVGFFLNHESSYLKRQVGAESIHAYIHTYKKERPDQTRPDHVYMLGCFPLPIILILLLTLHYIGLVSYSKDQTDSI

SEQ ID NO: 146422 - protein, 70 aa, Triticum aestivum
  Clone ID: PAT_TA_40840.pep
ITLWIKGIFFFGGQAPPHHIDHDMDMFASRNRNAVPAHDLNSIKEEGWQIILCESALTIYHDIQWIYCRD

SEQ ID NO: 146423 - protein, 64 aa, Triticum aestivum
  Clone ID: PAT_TA_40841.pep
TFCNGVAFPITLSAIIGWSGWVSCFLTRGTKIEGSQTAFMRGAVCTFALEPCIRGAVVTYWCHL

SEQ ID NO: 146424 - protein, 119 aa, Triticum aestivum
  Clone ID: PAT_TA_40842.pep
LVARKGRATGSWFDKFLEASIMCINCEDHCWGFLSSLLSDWSKFGNSITELKEYRDQGGFRLQFSFNVMPILQGHWCFGNVNSLLIPPGSNGKYYLYAHCWVLQVCQDSSHGLIKKSSA

SEQ ID NO: 146425 - protein, 100 aa, Triticum aestivum
  unsure (1)..(100): unsure at all Xaa locations
  Clone ID: PAT_TA_40843.pep
MRECMWIHIGQAGIHVXGNACCELYXLEHGIQPDGQMPGDKTVGGGDDAFNTLFSETGAAKHVPRAVFVDLEPTVIDEVRTGAYRQLCHPGQFISGKEDA

SEQ ID NO: 146426 - protein, 80 aa, Triticum aestivum
  Clone ID: PAT_TA_40844.pep
GELSSHRLGKKGVESIITCHYGHVTGNLAISLYNMLKSVQLAARVVDLDARHGPCGSTCAPQWRRVGMVGGSYAAHIGRR

SEQ ID NO: 146427 - protein, 135 aa, Triticum aestivum
  Clone ID: PAT_TA_40845.pep
PRVRPAELFRSFPIVEAIFVNNNQFSGKIPSNLGDSPVNYLALANNQFTGPIPSSIGRAANTLLEVLFLNNKLSGCLPYELGLLAKATVIDAGTNQLTGTIPASYACLRKVEQLNLADNLLYGEVPDALCRLAYP

SEQ ID NO: 146428 - protein, 80 aa, Triticum aestivum
  Clone ID: PAT_TA_40846.pep
LTCDLHQLYRTLPLMQLALPCNLLAPSMPHRIYVIFINSTSSSMPLHNDQDFMQIDYQYPFVLELSLVVLPGFHSSVLPN

SEQ ID NO: 146429 - protein, 124 aa, Triticum aestivum
  Clone ID: PAT_TA_40847.pep
KCGIGIPFLWLQDRPNKKTNNSNSYMNILASLFLENVELEFPEEFRSHFLWLQDRPNKKTNDSNSYMNIFASLFLENVELEFPEEFRSHFLWLQDRPNKKTYDSNSYMNIFASLFLENVELEFP

SEQ ID NO: 146430 - protein, 59 aa, Triticum aestivum
  Clone ID: PAT_TA_40848.pep
NPPRARRRTADPVKVWFSVFGTYGSTWRRTLNRPVPTMQPARVTLLVPYASVKECRHAW

SEQ ID NO: 146431 - protein, 129 aa, Triticum aestivum
  unsure (1)..(129): unsure at all Xaa locations
  Clone ID: PAT_TA_40849.pep
SFRSLLGIMEKKVGSWSNQSPXDAGHGVRPDPQVLLEVSPVVGAGDPEVDQQVPHLRLLVLPRVRQVRPHGRRVGGLLGGPVLTGFLLGAVRGVGRLGSSGFFLRVHPREHRHDVRELGVDRTRGRTRG

SEQ ID NO: 146432 - protein, 85 aa, Triticum aestivum
  unsure (1)..(85): unsure at all Xaa locations
  Clone ID: PAT_TA_40850.pep
MSACKKARAEATYVVSSDRLSSLPPELKGDILSRLNVEEAVKTSTLSSTWRDAWTNMPKIFLRDGNFARTKFVTLXDMVLSLHNG

SEQ ID NO: 146433 - protein, 60 aa, Triticum aestivum
  Clone ID: PAT_TA_40851.pep
AFLYTFSCKGRGISWGGVKSTHMPSMSNLMNIIALTKNNLQNLKAHIPFANNSKCYNSPT

SEQ ID NO: 146434 - protein, 76 aa, Triticum aestivum
  unsure (1)..(76): unsure at all Xaa locations
  Clone ID: PAT_TA_40852.pep
MPSAGAVDPQSGYCAVTRTFHRLRAPIPVAAPYPAVFFPAFGXFLLPFPVPGHAVFLDAGTGEAVPFPAFLGQVRA

SEQ ID NO: 146435 - protein, 120 aa, Triticum aestivum
  unsure (1)..(120): unsure at all Xaa locations
  Clone ID: PAT_TA_40853.pep
SHSLTVVSYPIPLXTPDLILNPIIIHSTAPVYPKSFYCTPTSTFHITTLAHSSSSPIPANLLSVLFLLPSSIPVTLPRHLSLFLHRLIHPLSFLSFSITDLLHGPSFPSSHIPLLHYLYS

SEQ ID NO: 146436 - protein, 69 aa, Triticum aestivum
  Clone ID: PAT_TA_40854.pep
KGVGKDPILQRYVVLPSQNKCLNLSTLVQSCDTYFETGICYRILALFRPICCKESILCTYYSYYLCFSH

SEQ ID NO: 146437 - protein, 104 aa, Triticum aestivum
  Clone ID: PAT_TA_40855.pep
MAPKADKKPAGENKVEKATEKTPAGKKPKAEKRLPAGKTASKEAGGEGKTRCRMKGSKAKKGVETYKIYIVKVLKQVHPDIGMSCKAMYIMNSFINDIFEKLAG

SEQ ID NO: 146438 - protein, 106 aa, Triticum aestivum
  unsure (1)..(106): unsure at all Xaa locations
  Clone ID: PAT_TA_40856.pep
RRHSFFLARIRPSRIPHGTGRPPALPPTSSPAPAPVVTAPWLHGRPAPPWPPPPPHPARSPALPQASRTARHGRRPAPCPPXPTWPSPPPHPSRPPALPQDRIPPT

SEQ ID NO: 146439 - protein, 83 aa, Triticum aestivum
  Clone ID: PAT_TA_40857.pep
RTRGLQATRGRSALAGRGRAGPCVCAASMAGRWCRGWLCGGAARRAGQGGGMDPRPVEGRPTVKSLFLQWRRTKDLIVFTFTF

SEQ ID NO: 146440 - protein, 81 aa, Triticum aestivum
  Clone ID: PAT_TA_40858.pep
LATAALLAVFQRWGLRYGLTVNPGRPCGTRDWIYSFAQNASVDCSCDGSPVCRITHLFMPRLPGSSEASGFSAFPVPLLVY

SEQ ID NO: 146441 - protein, 78 aa, Triticum aestivum
  Clone ID: PAT_TA_40859.pep
IHGDGPYKRVHKTGRKIIAMNDLHSERQLYISLSLSLIVLPMEHEGKCWLCFLGELLPGERLPTRPPTRPPTRPTTRP

SEQ ID NO: 146442 - protein, 70 aa, Triticum aestivum
  Clone ID: PAT_TA_40860.pep
QYRASVQGVTVSEIIFADTLTDTPSGISIVSDARMVFIFARHGGWARPRWGRRPPPGNAGKRVGFGERVR

SEQ ID NO: 146443 - protein, 73 aa, Triticum aestivum
  Clone ID: PAT_TA_40861.pep
ISGPSCSPTSGEARCPLASIDPPLGSRDPFFLIQILVCCFTPWRGVASSTGHAATGNAVWQVKRSRPTRLRRN

SEQ ID NO: 146444 - protein, 47 aa, Triticum aestivum
  Clone ID: PAT_TA_40862.pep
DAWADAWDSGHMVPMDQPKAALEMLKRWMSGNLSDASSSSQRFDFAI

SEQ ID NO: 146445 - protein, 61 aa, Triticum aestivum
  unsure (1)..(61): unsure at all Xaa locations
  Clone ID: PAT_TA_40863.pep
IFTCGGPYIHSSVDTKLNWRTGRTHVIIGAAXLEIPYLMQWRAPTLSACQYTRMSSPYLVS

SEQ ID NO: 146446 - protein, 66 aa, Triticum aestivum
  Clone ID: PAT_TA_40864.pep
RTRGPMSAPYLFHQLKMETMVLLILWTLHRRKVEILSKNAMLHLMFILVDPLPFFFSFDEILLSLL

SEQ ID NO: 146447 - protein, 105 aa, Triticum aestivum
  unsure (1)..(105): unsure at all Xaa locations
  Clone ID: PAT_TA_40865.pep
HHHKDQAPSSSDPNQIFKIYCRSSXDYCLAVRYIYVVLAPVNPKDETHHWLKDMRFITTINDEVGMPSFVLVNKATVLAFKHSIFQSHPVKLVPFNPAFYDTSVL

SEQ ID NO: 146448 - protein, 42 aa, Triticum aestivum
  Clone ID: PAT_TA_40866.pep
CDHLFLLSNIQGFFSKKKSNIQGYINQQSMHYPVSNLLSSKR

SEQ ID NO: 146449 - protein, 67 aa, Triticum aestivum
  Clone ID: PAT_TA_40867.pep
HLIVTNVKINLPFFYHSVFSHYQTLVVCSGCKTMLFQPTGGKGRLTKGCLIMEKMKPFLRFTTTYPR

SEQ ID NO: 146450 - protein, 56 aa, Triticum aestivum
  Clone ID: PAT_TA_40868.pep
RPQVGIGLESVAILLQASELAGESTERGANPLVLQLIAKLLSENSHLIQGTVYALI

SEQ ID NO: 146451 - protein, 54 aa, Triticum aestivum
  Clone ID: PAT_TA_40869.pep
LCTVKVMKPAPLPAWHQLLLHRAIEMLHIQELCIMFQYSIHTSTSQIFSLVLDG

SEQ ID NO: 146452 - protein, 48 aa, Triticum aestivum
  Clone ID: PAT_TA_40870.pep
PSWSDSCPSTSTDYTTSSAIQRAQNLNGMDARFKRIIWHEAVHELRSS

SEQ ID NO: 146453 - protein, 130 aa, Triticum aestivum
  unsure (1)..(130): unsure at all Xaa locations
  Clone ID: PAT_TA_40871.pep
FPSXFLSPLAVASSSCSAQTLIPSPPPRTEAAGAQAGRRGAKWRARRTAGSSWAASRSTPTSASSRTPSAASARSSTPRYRTVAAPLRVCFRLLFFIYCFAGMYVYIAARSAELDGVEGRKANVMHMAKV

SEQ ID NO: 146454 - protein, 100 aa, Triticum aestivum
  Clone ID: PAT_TA_40872.pep
KHPSKPLRSPIPAPGAGPAMARTKQTARKSTGGMAPGQQLATKAARKSAPATGGEKKPHRLRPGTFVLCEIRTYQKSTAMLMRKLPFQRLRREIAQDFKT

SEQ ID NO: 146455 - protein, 122 aa, Triticum aestivum
  Clone ID: PAT_TA_40873.pep
NIGPKPGGVLALTNLVKGSLGLIMCAPRPYPAIVHTSVAVHNRRITNPICRTVRPLPTSPPCRSLSPQRCTVPPRGASTGQSPPFTVPSTPRRRSPGSSTISSPPSKGSGYIWPAPMGRRRR

SEQ ID NO: 146456 - protein, 66 aa, Triticum aestivum
  unsure (1)..(66): unsure at all Xaa locations
  Clone ID: PAT_TA_40874.pep
KREPPFAPPRGQRRTRWRRPPPARDPPSPPSPTPKPXPAPPPPEAHPLSPSLRPPSTPHAPYQSRA

SEQ ID NO: 146457 - protein, 38 aa, Triticum aestivum
  Clone ID: PAT_TA_40875.pep
RVHAYEGGGANGQRLFRLTYIYCSTCCLTTTSHGTSAV

SEQ ID NO: 146458 - protein, 132 aa, Triticum aestivum
  Clone ID: PAT_TA_40876.pep
PRVRGRVGDDHDNGDVLMYTGSGGRPRNGGDHLSDQEFQRGNLALAYSCNYDVEVRVIRCHDCDASPSGKLYVYDGLYRVESSAYGPGKSGREVCQFKLVRLPGQDALGSNTWRSVRDLTDALVAKIRPPGY

SEQ ID NO: 146459 - protein, 94 aa, Triticum aestivum
  Clone ID: PAT_TA_40877.pep
THPFHIHPLGACLRRGGSRLFGIPSRRSGRSRGPYASSRPLAAAGALLGPDLRDGRRPRRSFRGREGRNGGRRSSRARAFGELDWGAGAEPTRP

SEQ ID NO: 146460 - protein, 124 aa, Triticum aestivum
  Clone ID: PAT_TA_40878.pep
NPHDDLSPPRAHLHDGSAPPRPAPAPLPRVTTAGHLPSAVRCPPPPPSSATAPPSCSAPPLRLQWIRTAAALPLHRHPCLPALIHRRVKASVTTAPRLRPRPAWPPDGWIPAELVLGAPAATHG

SEQ ID NO: 146461 - protein, 113 aa, Triticum aestivum
  Clone ID: PAT_TA_40879.pep
EEIDRPLIVPVGMAWERHPYSARDPSTVLGALVRQMYPPPIGPKIDQKPVLCWEDYKWSPGPEVRTAASKIVEEFWWRFKCDPSEQEKADGVLEENLTRKVKLMLHEEKAAAI

SEQ ID NO: 146462 - protein, 53 aa, Triticum aestivum
  Clone ID: PAT_TA_40880.pep
YFNNAHAVIIYKWQFWSGPYVSMVNAVVKHGYFVDIWRCNIIDSHHTVVFGLV

SEQ ID NO: 146463 - protein, 79 aa, Triticum aestivum
  Clone ID: PAT_TA_40881.pep
KLPTETRVRHLNLSWAEATNQSNAHESELAYGSLASTANNAQSLQNTLPRLHKAEHRPSVICTFEAFPDFPRKSGARGS

SEQ ID NO: 146464 - protein, 127 aa, Triticum aestivum
  Clone ID: PAT_TA_40882.pep
DENLGRSDQPDWVTVEATISHIKTEKFSYPACTREVNGKRCNRKVTNNGDGMWHCPKCQQSSQNCEYRHLFQCKIQDHTGTTNATAFQEAGQEIIGISAEELFMIKNVDLDDARFAKIIHGACYQQF

SEQ ID NO: 146465 - protein, 51 aa, Triticum aestivum
  Clone ID: PAT_TA_40883.pep
QTCQINTYVSFINVNSSTFSYQMTLLSDLPASWTDKASTVSFLFFCISLTT

SEQ ID NO: 146466 - protein, 58 aa, Triticum aestivum
  unsure (1)..(58): unsure at all Xaa locations
  Clone ID: PAT_TA_40884.pep
KIAEAKRRLLEELPDSWKGPPEDRTVHPDCINASNPYHGCSEYCFKKIADANAAXXRG

SEQ ID NO: 146467 - protein, 88 aa, Triticum aestivum
  Clone ID: PAT_TA_40885.pep
HAFGQLLLFFYLGGEPNSIHNRQAARNGRRPCSDTSRSTRRAHVRALRAPLHRVGAAPPGAPAALSGHPEASLQTAVRIRGRIHSHDQ

SEQ ID NO: 146468 - protein, 50 aa, Triticum aestivum
  Clone ID: PAT_TA_40886.pep
DAWDCSHKLARSMTFAWLPMKIAIPCDVVMASTLRVDMLTKRSIHCMVVI

SEQ ID NO: 146469 - protein, 84 aa, Triticum aestivum
  Clone ID: PAT_TA_40887.pep
MAETEYRCFVGGLAWATDDNNLQQAFSQYGEILDAKIINDRETGRSRGFGFVTFGSEESMRQAIEEMNGKELDWRNITVNEAHS

SEQ ID NO: 146470 - protein, 90 aa, Triticum aestivum
  Clone ID: PAT_TA_40888.pep
RVRWLLWAILLLSSGARVPRSWQVVSSTSGAILGGANFTSPCLSSAAELGGASIQLSRRLSYVERGSIGHNLHSLMMMMSSILQENYRQY

SEQ ID NO: 146471 - protein, 134 aa, Triticum aestivum
  unsure (1)..(134): unsure at all Xaa locations
  Clone ID: PAT_TA_40889.pep
LSSGLYFSCRPEQPKEKASTFGSNVMPYTGGDTKKSGELGKMFELHAERSRKSGPLGNAPSRNPLFGGAAFNYGPVSNAGGRTNYSGSFSSLVPGAWRIIMXKSNSGPLNLHGXPVKRSFCPQSGGVTPMVRQN

SEQ ID NO: 146472 - protein, 130 aa, Triticum aestivum
  unsure (1)..(130): unsure at all Xaa locations
  Clone ID: PAT_TA_40890.pep
SPLRPSIPRLPEPDTPLPPQIPPXPPAPRHRANSLSLSPPPPCRPSAPPSPPPDLAPRPPFFYGVPARPAHSQXPPSPPPASYSSSPSFYSSQPSSPPPSPSFVTSCKGRPSRPPSLPSGRGGTARSCRP

SEQ ID NO: 146473 - protein, 137 aa, Triticum aestivum
  Clone ID: PAT_TA_40891.pep
ALSNMVVVVHSDVDSWESHIQCNGRSILWDLRKPVKAAIAASAEYVSGLLPSHLAYSSAHETASEDWTWSVGCNPLSISSKGWQLSEFQQDVIARNYIITGVEESIRVVNSAIQRLVTERTSEQGFKIFKTKESVMV

SEQ ID NO: 146474 - protein, 107 aa, Triticum aestivum
  unsure (1)..(107): unsure at all Xaa locations
  Clone ID: PAT_TA_40892.pep
MFNAMNRGNHMGHAIVYYDASYDATKDRMHDRNPDRTANQTVYELVIERIIERVDQRANLLIKLIINKINCKLLWGLIVDNHGETYRXTYALIDFKNECNVGCALIY

SEQ ID NO: 146475 - protein, 73 aa, Triticum aestivum
  Clone ID: PAT_TA_40893.pep
MRGVVVVAMLAAAFAVSAHAEQCGSQAGGATCPNCLCCSKFGFWGTTFDYWGTGWQRQCNGCRGGTPVPVPTP

SEQ ID NO: 146476 - protein, 68 aa, Triticum aestivum
  Clone ID: PAT_TA_40894.pep
LKLLVLRLERMRHGLHVRAVVVGEQNLPRRLYVYIHHTTLAQAARNEDINNGAAPLRPPRPTRPRTRG

SEQ ID NO: 146477 - protein, 28 aa, Triticum aestivum
  Clone ID: PAT_TA_40895.pep
WKFVNLVKLWAWDVKIIIHYNKDSKCIT

SEQ ID NO: 146478 - protein, 80 aa, Triticum aestivum
  Clone ID: PAT_TA_40896.pep
SSASGQAYQNCYLDSILECWQSLEAIHCEHNVVLQPGGSTLDINSFYLFPAPLLQRSPRRSSAYRPRAFSEYSKCAPTRG

SEQ ID NO: 146479 - protein, 84 aa, Triticum aestivum
  Clone ID: PAT_TA_40897.pep
MVIPDALKGMRLRPGHRYCLLGQVFKEVGWNYADTIRELEEKRKEKVNVFVPRIKQLAKLLCKARKAVEEKLGTQLEILGSIKH

SEQ ID NO: 146480 - protein, 130 aa, Triticum aestivum
  Clone ID: PAT_TA_40898.pep
GRVGGRVGGRVGCGGNEYIYQTLALLEARAERFEQARTLFQLATQCNPKSCASWLSWAQVEMRAENNVIARKLFEKAVQASPKNRFSWHVWALFEANQGNTDKARKLLKIGHAVNPRDPVILQSLALLEY

SEQ ID NO: 146481 - protein, 49 aa, Triticum aestivum
  Clone ID: PAT_TA_40899.pep
LACIEYPPAIKSVFVQSDGLVLPAEQQSGPCTFSAHIPRDNPRVRPRVR

SEQ ID NO: 146482 - protein, 58 aa, Triticum aestivum
  Clone ID: PAT_TA_40900.pep
RTRGRDRALPVDFSYPSRPDVMVFKEFSLRIRAGQSQALLGASGSVKSTVIALIERLY

SEQ ID NO: 146483 - protein, 137 aa, Triticum aestivum
  Clone ID: PAT_TA_40901.pep
PPQPRAPPPRPAAASAGSVLEPAPGPRPALQLGDEEVSGAGGRRLARDLVDRGPDAALAVVEVVGGGVGELAEEAPRHGLLKVLHRHHALHHQHRGGRAAVVAAGVRLGRAVHLGLRLVKCLELRRSRRKGERGRVG

SEQ ID NO: 146484 - protein, 102 aa, Triticum aestivum
  unsure (1)..(102): unsure at all Xaa locations
  Clone ID: PAT_TA_40902.pep
MGIDLVAGGLNKRTKRTAPKSDDVYLKLLVKLYRFLARRTKSQINAGILKRLFMSKTNRPPVSLCGLGKCMDGKDNQIPWVVWTISYNKRVXEVPAINVAAF

SEQ ID NO: 146485 - protein, 56 aa, Triticum aestivum
  unsure (1)..(56): unsure at all Xaa locations
  Clone ID: PAT_TA_40903.pep
NERPATTHAXAHANERHKISHHRPTGGKGTYARAQRHSTGIEPPKRKPLGEGKQRA

SEQ ID NO: 146486 - protein, 83 aa, Triticum aestivum
  Clone ID: PAT_TA_40904.pep
SPNPATKNEAVFENFRKKAPPIMFFNAQGPFLGKFLPAAVGPFAQPKPAPSRRAGLPRRQHLEGRDVPLPLGAMDNGAGAHAS

SEQ ID NO: 146487 - protein, 60 aa, Triticum aestivum
  unsure (1)..(60): unsure at all Xaa locations
  Clone ID: PAT_TA_40905.pep
GGRRLKGDLLIPGGGKDTFSXWTGFELTEVAXYDAPLHVVSXTIAKNFVVFGDIHKSVYF

SEQ ID NO: 146488 - protein, 90 aa, Triticum aestivum
  Clone ID: PAT_TA_40906.pep
VAPTDVQVVKAGELLAVLLSQKGGVLVAVALDEDLVVRHHVHLQIVAAADAVVEDARLDPVAKVAAPDGVPYLVESGVEARAVSCLCVRV

SEQ ID NO: 146489 - protein, 85 aa, Triticum aestivum
  Clone ID: PAT_TA_40907.pep
SRASVPWHRQEEITGREGDKGTRTRTREPTMGQGNHPLCDFLNDRIPPPPYLLTARLEHSIIFIVLSTCWLYHHHHYCLIDSNNL

SEQ ID NO: 146490 - protein, 85 aa, Triticum aestivum
  unsure (1)..(85): unsure at all Xaa locations
  Clone ID: PAT_TA_40908.pep
CCSWPASCLLFVCSGRPFLLGLCSAGVPLSCACPSVPRQGGFLFSWLVLVSVPPAWSPSSGRCVASMFIINVRVGXRVGGRVGRP

SEQ ID NO: 146491 - protein, 59 aa, Triticum aestivum
  Clone ID: PAT_TA_40909.pep
MTSDKGRTSKKAAEGSPSALAVPDGRASSGPQKGRLSNGRTTGPARRSTKGNWTLEEDD

SEQ ID NO: 146492 - protein, 92 aa, Triticum aestivum
  unsure (1)..(92): unsure at all Xaa locations
  Clone ID: PAT_TA_40910.pep
GGLLFCPARVACRCXWAPRCVLRRVVWLFWPGSSALRCFFAGASACPCGACPSPRVPLAASAARSLLARAPAPSFLFLCWXKIKPRVRXRVR

SEQ ID NO: 146493 - protein, 133 aa, Triticum aestivum
  Clone ID: PAT_TA_40911.pep
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTDGILGGHINPAVTFGLLLARKVSLLRAVMYIVAQCAGG

SEQ ID NO: 146494 - protein, 46 aa, Triticum aestivum
  Clone ID: PAT_TA_40912.pep
ASQVCPWEKVLKGSHIARLSGSDNACSLCLCLLRKVLLHSINFLFF

SEQ ID NO: 146495 - protein, 126 aa, Triticum aestivum
  Clone ID: PAT_TA_40913.pep
LARLIDFLMEGGERGGQRDNLGLEFELRFKRRSASWPDIQPDLETMAGNKVRHYLPLFVLVFSLVVSFAERHRDSHGYIDGLLDRSLERYLEDQAEDQAIYKGLAEVSAFVGVLLGAILTAMFSAQ

SEQ ID NO: 146496 - protein, 79 aa, Triticum aestivum
  Clone ID: PAT_TA_40914.pep
NRLKVRIRQWNSKSIMNSTLTMLQDRSPRVPMHYISCVLKSPHCLVVLTPTKKWAAGSSLISPPGFWDGAKINTFFGFL

SEQ ID NO: 146497 - protein, 125 aa, Triticum aestivum
  Clone ID: PAT_TA_40915.pep
IPNQGGFHLSEGKGREGVTTEPSARTRQQAPRSSAGTKRGLTLTKLLRRLFAKKEMRILMVGVEAAGKTTMLYKLTLGEIGTTVPTIGRKGGTVPHKNIKVTGWDVGGQDKDRPLWRHFFQNTQG

SEQ ID NO: 146498 - protein, 125 aa, Triticum aestivum
  Clone ID: PAT_TA_40916.pep
VREDEEEYGVREVPGSNFTVRKKKVRLSSIQKEQLKDGYITVNKTKLTPAQKEVVKHKVHSIDSEIPIFAAVMRKSNLNSRFNLTFPRHYAKKYLREEPSMCLRRRERKWGVRFGEINGSNKLRI

SEQ ID NO: 146499 - protein, 82 aa, Triticum aestivum
  Clone ID: PAT_TA_40917.pep
AMLESAGIVIPALLTKSGLIHTAGWYTAGEQAILRAKTTISEGMLIGPDRAKGTGTILEQHTVLLKRRLPHRLRLCHPCTLL

SEQ ID NO: 146500 - protein, 133 aa, Triticum aestivum
  Clone ID: PAT_TA_40918.pep
MASLTPSAGARLLRRLLSTAAEVAREAPAPAAKNTKKAAARPVRKRAARAVAPQDAKEAAEAAPDAEGAKKAAEAAPDAEGAKKAAAAGTKDSRPLYRRLSALGNAGEGSVSAVMNKWLREGRETRSVDLERY

SEQ ID NO: 146501 - protein, 141 aa, Triticum aestivum
  Clone ID: PAT_TA_40919.pep
MRNIGSSSFTIGYMPIMLRSYACVLNGKDEAELARYGECPLDPGGYFIVKGTEKVILIQEQLSKNRIIIDTDNKGRVTASVTSSTHEVKSKTVICMDKEKIYLHLNQFTKPIPIIVVMKAMGIETDQEVVQMVGRDPRYGD

SEQ ID NO: 146502 - protein, 64 aa, Triticum aestivum
  Clone ID: PAT_TA_40920.pep
INVKILFEFPSFCKPQYKLRLRHDSITIFFNNWQLTTHQMFCIEMDHFVRLGLVGHNGFILRQG

SEQ ID NO: 146503 - protein, 55 aa, Triticum aestivum
  Clone ID: PAT_TA_40921.pep
GIMIHLVLSTPASIICLILFGSTVTEPLGAYSCPGRCDLSASLSSPRLARPVQIP

SEQ ID NO: 146504 - protein, 103 aa, Triticum aestivum
  unsure (1)..(103): unsure at all Xaa locations
  Clone ID: PAT_TA_40922.pep
VHKRAVFDVHPAALARLFLIDWYRERINGKQEDMIGYSDSRLDSARLSPTWXMYNGSEDLVKVAXQSAVKLTMIHGRGGTVGRGGGPTHAAISPQPHDTSNGS

SEQ ID NO: 146505 - protein, 142 aa, Triticum aestivum
  Clone ID: PAT_TA_40923.pep
DDICFRIVCALVIVAVLATVVTLLVIAFVPRPFGVSVEDAALARLALADKNATATALAYNISIAVGVHNENWIMRAKHTARLDADLLFARTRFARVGLATAGAVVRPRRREVYHATAAADSASVALGSSGMADFLKQSETGK

SEQ ID NO: 146506 - protein, 148 aa, Triticum aestivum
  unsure (1)..(148): unsure at all Xaa locations
  Clone ID: PAT_TA_40924.pep
GNPGRPTRPRTRGADTIFLPPQRTPGRAQPPYRLPRCRGRRTGEPHTRRLPRRANRKTATWENRKKSRKTTPGDAEKPPDREDEGTVGRPEKYDYPKLRQGKIEEPAARAQKSKHQAERTGAGRATTPGIHXFRGPKGARTLQRAGKG

SEQ ID NO: 146507 - protein, 91 aa, Triticum aestivum
  Clone ID: PAT_TA_40925.pep
PQSNVLQDPVKGSLHLTVDGFLLAILGGSPLSFLQRDGRLPGTQFLLLGLDRSRPAVELHVGVTQQVHVFLMLVSTFFSTIISTSVSFSST

SEQ ID NO: 146508 - protein, 130 aa, Triticum aestivum
  Clone ID: PAT_TA_40926.pep
PTRAPTRMYRSENHRARPDGSDACHGGARRCARPPSSCMLFGWADPDVSVAQGRGARPRCFRLCGCSYPGGRVAQGRIADSVLGGDAYRGPQLMLAEHAAAPVIFGALRETRPADCLCQDRQSATRAQHF

SEQ ID NO: 146509 - protein, 75 aa, Triticum aestivum
  Clone ID: PAT_TA_40927.pep
NRSSAFYLTYDGLRATALASLSIRQLDEPFRFLRWLYEPPPTPSSSGSALLHLLRRTLEGCNLGCLICVRAPTRP

SEQ ID NO: 146510 - protein, 48 aa, Triticum aestivum
  Clone ID: PAT_TA_40928.pep
SLSSIQYKGGIKPINMILLNSSHGLLLRQGPRPSPAPEPARIHPCPLK

SEQ ID NO: 146511 - protein, 115 aa, Triticum aestivum
  unsure (1)..(115): unsure at all Xaa locations
  Clone ID: PAT_TA_40929.pep
SSRPPAKTGGRTRRPARTKPRKASKAREKETGQTGTRPKERRTGRHRARQGPGPKGKNRTRSEEAPTKTGRGQARAXRTKKNNTAGTREAAGTQDRESTHGREHGDGKNVKGRKG

SEQ ID NO: 146512 - protein, 91 aa, Triticum aestivum
  unsure (1)..(91): unsure at all Xaa locations
  Clone ID: PAT_TA_40930.pep
PTRGRTRXFFTHAPPAAAAMGTRQCSPRHENITLQAGHGAPVVDTPRPETAEWGRRTSTLLSLAETRHVPPPSRGLPNLQRIRPGAWPSSR

SEQ ID NO: 146513 - protein, 137 aa, Triticum aestivum
  Clone ID: PAT_TA_40931.pep
GRVGQELTEMVQGLAKEVEHQKSEKQRIPAMLAERDGLRQELIRTRAALDYEKNAKAELMAQVQAVEKDLVTMAQESEKLRAELEKRKPPSFSGHGAYGPPMTTLGMGLQDIYDSGYSYRENRYGAGPWDPPGYPHP

SEQ ID NO: 146514 - protein, 68 aa, Triticum aestivum
  unsure (1)..(68): unsure at all Xaa locations
  Clone ID: PAT_TA_40932.pep
LIKTLSVENPVHSAAARRRKTVGDWGARRTLDAECESVXVVGCSCVVVKDYGEDSEGLHIVQEYVKSH

SEQ ID NO: 146515 - protein, 130 aa, Triticum aestivum
  Clone ID: PAT_TA_40933.pep
MGKSSKKSAAPTVVAPAAVLTKGKAGKKREADDEIEKAVSAKKQKAAPAKAVPGPKEAAKKAKKQPPPKKVESSSSEEESSESEEEEVPKKTAKPVKHESSDDSSDDSSFDEEPAKKPSAKPVTPAASNG

SEQ ID NO: 146516 - protein, 141 aa, Triticum aestivum
  Clone ID: PAT_TA_40934.pep
GRVGSPLVSLTVGQLLRNDFSREHWMGVLENNEWQKEGNVDDIMPSLRISYDYLHFHLKKCFSYFSLFPEDYKFKKIDITYFWIALGIIEKDENYIEELVENGFLMKEDDEFEGQYYVMHDLLHELSRSVSSQECLNICSS

SEQ ID NO: 146517 - protein, 111 aa, Triticum aestivum
  Clone ID: PAT_TA_40935.pep
GEILLVEKQASHAILTKNVFPDLVKQTRISPWLPQLVDAVGCPMTINTYELGLIRGEALLLLQFSSLLLCGFASSKIEISWWVSLEASYFTIIIVWFTLEFDFNACLRIFG

SEQ ID NO: 146518 - protein, 138 aa, Triticum aestivum
  unsure (1)..(138): unsure at all Xaa locations
  Clone ID: PAT_TA_40936.pep
ASTVDYCDELAAAADGAADAAVGVAAGGNGGGLSGFAMDSLVGVLDGFHNLTGLPWWITIFDYTVAMRLIILPALIVQFHKTAKIGQLFRKXRSYRDQYSLFQKKRRELGCPSFLWNFAYFSVQFPCFILWMASIRSM

SEQ ID NO: 146519 - protein, 122 aa, Triticum aestivum
  Clone ID: PAT_TA_40937.pep
ALKVIPASSSDLALKVNAASSSRSSSAFLLYLHPALTTNLAPLRLGLEGVRLPLRPGLAGERLRHLLHSLCRDEGVCLVVAGLWAGEHLLVEHGWIWSASSPPLLVVRVKIRWIAYFAGRVG

SEQ ID NO: 146520 - protein, 72 aa, Triticum aestivum
  Clone ID: PAT_TA_40938.pep
TRMPFSKEVIPCRALTYITYSYTWLEGQVNQLSGPKVHIKKIYLCVITFTHAQDRGPIVLLFHCVGGYTLND

SEQ ID NO: 146521 - protein, 94 aa, Triticum aestivum
  unsure (1)..(94): unsure at all Xaa locations
  Clone ID: PAT_TA_40939.pep
APAGPQEEKKGXXENNKEKRPGGHKKPEDXAPAPDTHAGPAPEHAPAPAAEEESSPDAKEKKGPPGKNKDKPPGHHKTGEEDKAARTAXEHKPN

SEQ ID NO: 146522 - protein, 41 aa, Triticum aestivum
  unsure (1)..(41): unsure at all Xaa locations
  Clone ID: PAT_TA_40940.pep
VVHLRECNRIVSCFGAFSCSSSLCLVXVARKKSIRASADAW

SEQ ID NO: 146523 - protein, 72 aa, Triticum aestivum
  Clone ID: PAT_TA_40941.pep
LAAGTAPIIELGILYNILGRVIAFRYFRCWRVFSNQITDDFEFTPSWISSSHSVKHIYTMLCILTHAPPWNC

SEQ ID NO: 146524 - protein, 99 aa, Triticum aestivum
  Clone ID: PAT_TA_40942.pep
KGGIEHLRRTLLALRLYPCRSWFESTARSGRPGGTESTSRRLERRGDGDGEGTGGMRSAEEQTTRRRPGRLTAPCAAKMVRRDRLKKGKFLDSGGARFG

SEQ ID NO: 146525 - protein, 132 aa, Triticum aestivum
  Clone ID: PAT_TA_40943.pep
MASANVLLLPESGSGHLMSLIEAGKRLLAHGGDGLTVTVLIIRPATPESASQVDSHVKRVAASACGLGIRFHHLPAVDPPTDCAGNLQEFKSRYMQLHAPHVKAAVSDLGAAALVIDFFATAVIDVAHELGV

SEQ ID NO: 146526 - protein, 81 aa, Triticum aestivum
  Clone ID: PAT_TA_40944.pep
PMGGEAPEPRRLSRALSLDGSGVPEEALHLVLGYVDDPRDREAASLACRRWHHIDALTRKHVTVPFCYAVSPARLLAALPR

SEQ ID NO: 146527 - protein, 107 aa, Triticum aestivum
  unsure (1)..(107): unsure at all Xaa locations
  Clone ID: PAT_TA_40945.pep
DPMAISEDEGRCRQLQRRKVPSSLACRRDPVFVLSIGSQGLWIWIGRGARTEGRAGGVGVWAGISGGVIVGGRGGHGQWRRTGGEXSRSRSRXHGDGGGVGVAGRVG

SEQ ID NO: 146528 - protein, 115 aa, Triticum aestivum
  unsure (1)..(115): unsure at all Xaa locations
  Clone ID: PAT_TA_40946.pep
MALTRIGLAGLAVMGQNLALNIAEKGFPISVYNRTTSKVDETVQRAKLEGNLPLYGFHDPAXFVNSIQKPRVVIMLVKAGAPVDQTIATLAAHLEQGDCIVDGGNEWYENTERRE

SEQ ID NO: 146529 - protein, 74 aa, Triticum aestivum
  Clone ID: PAT_TA_40947.pep
WKIRFFHQRSGCGRLILHGCTSFSFQFVLVLQHEFTFMHVDLVAFCCKGVHQICCKDIYIWSKVNFDIYFPEPL

SEQ ID NO: 146530 - protein, 133 aa, Triticum aestivum
  Clone ID: PAT_TA_40948.pep
PRVRGCVGGQTIPMPFIGAQAITFMPPAPPSQPHATPIAYSAAPVHPRPPSSQPPATHSPPQPQPSPRQQKPPTMPPVTPQPHKSPAPATPQLQQQAPAVNSSWMDIVVAPSEAPHDSSGYHGFGGGSGPTSS

SEQ ID NO: 146531 - protein, 126 aa, Triticum aestivum
  Clone ID: PAT_TA_40949.pep
MSSEPAPASASTEELEADLSAATISKKQLKKDARKAEKAGKASHRQQQQQPQAEEADLFAANYGDVPVEEIQSKAIFGRSWTDIGDLDEAAAGRSVLIRGSAQTLRPVSKKMAFVVLRQSMSTVQC

SEQ ID NO: 146532 - protein, 65 aa, Triticum aestivum
  Clone ID: PAT_TA_40950.pep
DAWAFILLFAYPPPGTGWCGGCCAHHHTRCFVRPYHQSHYIARRRERFDSQTKEWRLASYLTFSA

SEQ ID NO: 146533 - protein, 93 aa, Triticum aestivum
  Clone ID: PAT_TA_40951.pep
MRECISIHIGQAGIQVGNACWELYCLEHGIQPDGQMPGDKTVGGGDDAFNTFFSETGAGKHVPRAVFVDLQPTVIDEVRTGAYRQLFHPGQLI

SEQ ID NO: 146534 - protein, 88 aa, Triticum aestivum
  Clone ID: PAT_TA_40952.pep
LWYVLGFCVTRWKRSYEDCLLSVSNHWNAEMSHRGISNVYHQVYRIQSAFCPYDRRANSEPPISSFNKYGLSFYNLWLCAYVYNLVIC

SEQ ID NO: 146535 - protein, 44 aa, Triticum aestivum
  Clone ID: PAT_TA_40953.pep
PWAASTEQSTMHVTAATHDLGLMLFAPSEVQENANPGMPLASSR

SEQ ID NO: 146536 - protein, 77 aa, Triticum aestivum
  Clone ID: PAT_TA_40954.pep
PDPDITLILILGIAQSKIIDSHNRRVLLSAAIDIYYYDEQDGFDYDQTSEEGEWMIKAAAIEMVKLLELDAFAYHNH

SEQ ID NO: 146537 - protein, 126 aa, Triticum aestivum
  Clone ID: PAT_TA_40955.pep
ALYLYALADRRLPDAALLHLRLIDRPGSPVPPSPTDYRAVVRCLVADHGRLEDAVALKDEMLASGFAGPDPHVYSLLMAGFVEAGDGAKAVELHQELQDKLGGKPVLDGIVYGSLMKAYLLMGMEE

SEQ ID NO: 146538 - protein, 136 aa, Triticum aestivum
  unsure (1)..(136): unsure at all Xaa locations
  Clone ID: PAT_TA_40956.pep
STKLKVLKIEGWFTHLNLHAPYLTSVWIGLELNSDTDGASTTRCNFNLSPFIASLSDVETIRFHGHILECVEHEFLILKQPKLFNRLTEISLEINLGDLKEANFALCLFQHAPNLRFVKLKLIXRNSVVPTVHFWE

SEQ ID NO: 146539 - protein, 62 aa, Triticum aestivum
  unsure (1)..(62): unsure at all Xaa locations
  Clone ID: PAT_TA_40957.pep
MQFSSVLPLEGKACISSVRREGYVCXRLKVGDSSSIRHXRAFRRMCNGGRGPSATGAQCVLT

SEQ ID NO: 146540 - protein, 44 aa, Triticum aestivum
  Clone ID: PAT_TA_40958.pep
MKGAKFKGAGKAHTKFAAKSKGLENPSAKGKKGMARLDPNKPNR

SEQ ID NO: 146541 - protein, 95 aa, Triticum aestivum
  Clone ID: PAT_TA_40959.pep
DRNRNKRARSGSGLPYNFSQEPLVNVLMAVHLVPMYIPRGNLTYEALIIYSLEDSPPARGAKKICVAYSNWAKTPCCFCFWQFPSRYLGFLCTFI

SEQ ID NO: 146542 - protein, 60 aa, Triticum aestivum
  Clone ID: PAT_TA_40960.pep
PSEVAVGGLLISQSDGADERKDEIGDLFGDGAGQRDNIIGEVFGDAADDELFKQQPAAGR

SEQ ID NO: 146543 - protein, 126 aa, Triticum aestivum
  unsure (1)..(126): unsure at all Xaa locations
  Clone ID: PAT_TA_40961.pep
MASGGIKTMASGLLFLNLIMYVVVAVIAGWAVNYSIEDSAHSLRGASPPVRLFPIYFPMGNLATGFFIIFALLASAVGISTXLTGLRDVTEGYPASMMSAAAYGVVFWTLTLLCMGLACKEISIGW

SEQ ID NO: 146544 - protein, 74 aa, Triticum aestivum
  Clone ID: PAT_TA_40962.pep
RYKTWIGGVDIEKKMLRLIQPYTYAEGGYALPTLLPSTFSYYLKNTTPGLFPSTETNYSENALNNATIHGDTSV

SEQ ID NO: 146545 - protein, 64 aa, Triticum aestivum
  Clone ID: PAT_TA_40963.pep
MGKIKMPALFRRRSFYKLRSASPPPTSQEEEGTRPASGAGSPARSAEEEMERVFRKFDANGDGR

SEQ ID NO: 146546 - protein, 54 aa, Triticum aestivum
  unsure (1)..(54): unsure at all Xaa locations
  Clone ID: PAT_TA_40964.pep
QQHHFYAFVTCKMGGWENILHCSKCECXHSKDAKNSHACEERAMHHYCTRCLQY

SEQ ID NO: 146547 - protein, 75 aa, Triticum aestivum
  Clone ID: PAT_TA_40965.pep
KQRKHGATQHPRLELVVGTHGTVVEPHHNYCQPARHALCYLLMVQRAISLNLNLKLNYPCLEHSTDHRPSYTHAS

SEQ ID NO: 146548 - protein, 91 aa, Triticum aestivum
  Clone ID: PAT_TA_40966.pep
MAALAGSNLLLLAAALILCGPASTEAYDTLDPNGNITIKWDLNECTTDGYVALVTTYNYHHIRHISPPGWQLLWTWANNEVNLTMVGAQTT

SEQ ID NO: 146549 - protein, 113 aa, Triticum aestivum
  Clone ID: PAT_TA_40967.pep
HACGLMWILLCAEWISTDRVHDGLRMAILGAPWTIGILYCSTDWVRDVSWVLMLYIWPQWMLNLIPGERSVRQYLNKYGGVDTSPIEGGGSAVICTKYGRNLWSGFIKGITDA

SEQ ID NO: 146550 - protein, 58 aa, Triticum aestivum
  Clone ID: PAT_TA_40968.pep
MDSNDPFKIKVSDMLIAKLTNLGFISTNKISRKWDKLVVSAFARRRLATIMVKLNFLC

SEQ ID NO: 146551 - protein, 60 aa, Triticum aestivum
  Clone ID: PAT_TA_40969.pep
EASTFTTFTNQDPSEERSGAHFVHGCQHTRGGWTWPSTCRRRAGRCCKLMCAQPRSTLFN

SEQ ID NO: 146552 - protein, 72 aa, Triticum aestivum
  Clone ID: PAT_TA_40970.pep
CQQVWCLSAGQASCFQRRHSCVSPRKVAFDSVMSRIDLPIDALVVQVLTHKNVPCVPVRVGRRGSSGPVRCR

SEQ ID NO: 146553 - protein, 41 aa, Triticum aestivum
  Clone ID: PAT_TA_40971.pep
PESLEVPHVTNSGFFKNSSFWIFNHVWFLRPKHTSCFVEAN

SEQ ID NO: 146554 - protein, 127 aa, Triticum aestivum
  Clone ID: PAT_TA_40972.pep
GRVGSNANLELNDKYHPHVSVDLADFYHPKHVLYSYAYVIGYSMMTWRVLSLPLALSLLWSVLSGFCYCTVYYMLTRFEVTFLGIPVDSRYGDEKQRAHMRKSEAGACMWKQKKKSISLESDQASAT

SEQ ID NO: 146555 - protein, 137 aa, Triticum aestivum
  unsure (1)..(137): unsure at all Xaa locations
  Clone ID: PAT_TA_40973.pep
PRVRPLSVSPPCSASGSHFIQSGWSAPHLGGSFSPAAHHAQASTTPTPQVTVDKELRSTSHLSPCPGGHGLMLLLLSFRAFLWCIRHSGWCNLXSEVNMLYSPMYLQKLSYGELFIMLLAYFLSNKLDTSVXNINIE

SEQ ID NO: 146556 - protein, 138 aa, Triticum aestivum
  Clone ID: PAT_TA_40974.pep
FGEASLYVFRGPAASSSKGAVEAMKDTLSRWGKSMAETTSMVESLSRDTWQHFKTGPSFTEAAMGRLAQGTKVLAEGGYEKIFKQTFEILPDEQLKMSYACYLSTSAGPVMGVMYISTAKIAFCSDNPLSYKGGNKTE

SEQ ID NO: 146557 - protein, 98 aa, Triticum aestivum
  unsure (1)..(98): unsure at all Xaa locations
  Clone ID: PAT_TA_40975.pep
MRCAVLHLLVFASVLTAKAIYIPNLKNSHFIPVTANVVLVNGTVVNGVKAIPKWETSGFAEYIEFDHKQGDMLLVVPXGAYSVRLDNDASILQCIPVV

SEQ ID NO: 146558 - protein, 55 aa, Triticum aestivum
  Clone ID: PAT_TA_40976.pep
YTVTSNSGVQHGIANLSHMFKVILNTFSVLTDCHTSRAEARQISFMIFDSTGKTA

SEQ ID NO: 146559 - protein, 79 aa, Triticum aestivum
  Clone ID: PAT_TA_40977.pep
RSYEPRVVLLQALFPFSFMALSRQTSIGCGPALVCGPNYHYCLVQWPVKCSILFGAANVVLEHDINAGAVLVLSEKLTV

SEQ ID NO: 146560 - protein, 111 aa, Triticum aestivum
  Clone ID: PAT_TA_40978.pep
PTTSKKNPFLIFQGPGTKEVTAALLTPTAAVFKAEYPTPPAADRLGDDYLMLFTHGAGFLLPWNAYITAVDYFLYLYPGAPGDRVFFCYYMHCCLIPLLHIMLVFPKNSGR

SEQ ID NO: 146561 - protein, 122 aa, Triticum aestivum
  unsure (1)..(122): unsure at all Xaa locations
  Clone ID: PAT_TA_40979.pep
RTRGRTRGACVTFETKLANSGSGGASGRCQLISLSLSRCQPNACLLMLLFVVSCDVIPVKRVAKDRCDLGERIHLDSTRSLPVLLIDCRPDWICILVSIYSFKXEXXXKNKDSKQKKXGRPF

SEQ ID NO: 146562 - protein, 52 aa, Triticum aestivum
  Clone ID: PAT_TA_40980.pep
DAWVPNGSFCLWKHVQRLAFHMEQIYSERASDTFKIAHRRLNMQYTKSLKPC

SEQ ID NO: 146563 - protein, 52 aa, Triticum aestivum
  Clone ID: PAT_TA_40981.pep
IPPTLAVSFSSPPQLDKRKKEREELVGRARDLCSERGILEVRMLTSRRAHDQ

SEQ ID NO: 146564 - protein, 40 aa, Triticum aestivum
  Clone ID: PAT_TA_40982.pep
FLTQQQQQLLLQAQQNITSSSGEMDARELGMLTSSRTRDQ

SEQ ID NO: 146565 - protein, 131 aa, Triticum aestivum
  Clone ID: PAT_TA_40983.pep
SLFLPPLLSSLLSPSHLLSLLGFVREEGIEKAGDDETPPRMKRRGGGAEGERGRRGGGAEGKKRDEDEAAAAGEEAAAGARARSFFSCWPLASPFLSLFALLRRLLAFAALVAALVATVTRTLFMRKKGYV

SEQ ID NO: 146566 - protein, 107 aa, Triticum aestivum
  Clone ID: PAT_TA_40984.pep
MGIDLVAGGRNKRTKRVPPKSDDVYLKLLVKLYRFLVRRTKSKFNAVILKRLFMSKTNRPPLFMRRLSNFMKGKEEKNIAVVVGTITDDMRIQEVPAMKATDLRFTE

SEQ ID NO: 146567 - protein, 128 aa, Triticum aestivum
  Clone ID: PAT_TA_40985.pep
TTPPTPARSRGHAGSEIPLPHAPSSSARHDPDPAGGAPLQAAAARPDRRASGGSLASSAAAYDLQHPIVWRAAAVSKPWRGSWSLRPDGVRHVRVQAGRRRHGVQAPADRQIPRREGKGNDAHSPEAG

SEQ ID NO: 146568 - protein, 108 aa, Triticum aestivum
  Clone ID: PAT_TA_40986.pep
MDACELKKVDGKKFGGPRKKLVTRSVKAGLQFPVGRIGRFLKKGRYAQRVGSGALVYLAAVLEYLAAEVLELAGNAAKDNKKTRIVPRHLLLAIRNDQELGRLLSGVT

SEQ ID NO: 146569 - protein, 117 aa, Triticum aestivum
  unsure (1)..(117): unsure at all Xaa locations
  Clone ID: PAT_TA_40987.pep
DLAAVGENXRSIENPLTLLNDASYVEPLGNCGKKVLLWWLRVEARADSKFPQGWVIEPPLEVVVPAKRTPWPETTMDVSSEMLDAKQEQEDRQLPRTNNRSARPRSTTTKRKGDVHN

SEQ ID NO: 146570 - protein, 74 aa, Triticum aestivum
  Clone ID: PAT_TA_40988.pep
KGIHCKSCYRPCCTVAAFKHQDRAPSARDRDPRCSSSSERHLLCRTHPHCSHHGLLSDMPMKVLVMPNKPPSRP

SEQ ID NO: 146571 - protein, 95 aa, Triticum aestivum
  Clone ID: PAT_TA_40989.pep
NGRESDAGTSLQRSSPSSMASPHPPAPPAPTPSTPTAHHCRFPKPDRLPGSFLPPLPPTRLGAATQLADDLTHRRRPTLTPAAPPSPPALLPLPR

SEQ ID NO: 146572 - protein, 84 aa, Triticum aestivum
  Clone ID: PAT_TA_40990.pep
RQHCFDLSNRPSMRRGISIFLAASMLGGVRRSRLPCCHHHKRRQDLHSPHLSGSHCLSSLPETVNVCVLSGALGRVGRPGPAGA

SEQ ID NO: 146573 - protein, 50 aa, Triticum aestivum
  unsure (1)..(50): unsure at all Xaa locations
  Clone ID: PAT_TA_40991.pep
NSLLGSNYLILAMKHKNNQRXHLLFGSVETKLYTIHGHMANHKLEHFNQL

SEQ ID NO: 146574 - protein, 142 aa, Triticum aestivum
  unsure (1)..(142): unsure at all Xaa locations
  Clone ID: PAT_TA_40992.pep
QPERDLHVTNTRRLAAGRHRFWVPVDAMAAKGRTDMEVGGDAVHAMNKYNLLVNSLCIDVLLRXSESYIQALQSTQVKAIAVTWKGRKLSGGCYSSSFRDRYRRRMDQANVAYISXIDILTVLQQGTTXPSGAATDGLCLAG

SEQ ID NO: 146575 - protein, 135 aa, Triticum aestivum
  Clone ID: PAT_TA_40993.pep
VLCVFFLYIWCAATDPADPGVFKSKKYQRLYGGCKHRRLKESIQGVSDVGLRLEGTGEKREHEVADANEKSMTELKNKSSSCCSAIFSAFLLIFRPLSFVFSCCQSREWSSEQQDSEDGMFFCSLCEVEVLKYSK

SEQ ID NO: 146576 - protein, 89 aa, Triticum aestivum
  Clone ID: PAT_TA_40994.pep
MNYRFQNLLGAPYRGGDAVFAGDSSVLLSAVGNRVATTDLVACSCLTLRFESSANIDRTRTSCLDDLLLCCDEKGRALYTNLRRRAVLH

SEQ ID NO: 146577 - protein, 64 aa, Triticum aestivum
  Clone ID: PAT_TA_40995.pep
FHNKCLLYVNVGVHILGILSQTLLFPTQPYRLLSLCLSQGHKTNHDLIYPVVMASLLIRSKCWS

SEQ ID NO: 146578 - protein, 50 aa, Triticum aestivum
  Clone ID: PAT_TA_40996.pep
QQWAREHAAKEVTFGVGAHATMPRCVNDLADAVKVTMGPKPTAAAEAISS

SEQ ID NO: 146579 - protein, 73 aa, Triticum aestivum
  unsure (1)..(73): unsure at all Xaa locations
  Clone ID: PAT_TA_40997.pep
XXXXXKYVLSLRKIIFIRGGVLTIGGVFSLTNIITGKIKRRGRRPPTFIKKAWSTNDFFSSPPVSSHTQRGGG

SEQ ID NO: 146580 - protein, 95 aa, Triticum aestivum
  Clone ID: PAT_TA_40998.pep
RLALPPPPTRGRPPRRTRTGLGFASPPRLGSDVKTAGEEKRDRLARLSAGCWRAAFPPFSFPRASISSRQNTPNCFCFPFFPNDFLCLYCPGCSN

SEQ ID NO: 146581 - protein, 60 aa, Triticum aestivum
  Clone ID: PAT_TA_40999.pep
VRPCFANPPKERLGSGRDAPSGGRATNLHSCLCEKRTHPVNYFFKNHIINPRDPPQILFI

SEQ ID NO: 146582 - protein, 130 aa, Triticum aestivum
  Clone ID: PAT_TA_41000.pep
FGPPGTGKTMLAKAIANDAGASFINVSMSTITSKWFGEDEKNVRALFSLAAKVAPTIIFVDEVDSMLGQRARCGEHEAMRKIKNEFMSHWDGILSKSGERILVLAATNRPFDLDEAHHRRFERKSVKCSI

SEQ ID NO: 146583 - protein, 77 aa, Triticum aestivum
  Clone ID: PAT_TA_41001.pep
RPPWTGMTMLATTMASDTCTSFINMTMSTVTSKWFGEVKKNVLSSFRFAAKVAPTIIFIDEADSMHGQSAPLWRAGF

SEQ ID NO: 146584 - protein, 67 aa, Triticum aestivum
  Clone ID: PAT_TA_41002.pep
RMRPPTVRTSLQGPALPWPATYFKGPPTALWARRPNIPYSDLPTVDTDQDNVDSAGYIYSKMLEEDP

SEQ ID NO: 146585 - protein, 122 aa, Triticum aestivum
  unsure (1)..(122): unsure at all Xaa locations
  Clone ID: PAT_TA_41003.pep
PPPPPLPYQPRINEPSSYQPRISEPSPYQSRVNEPQLYQPRRTDAPPMFNMQPPYQPRQSDALPSFNMQPPYQPRHSDGPLALPGQPXXPPYPPRAGFPGQQYSFRSDDMPPVHFDNNALPV

SEQ ID NO: 146586 - protein, 114 aa, Triticum aestivum
  Clone ID: PAT_TA_41004.pep
MALASTTASRLISRRLVAPLPPPPSSSCAAPRGGARPGPRRFAVRWEGRPRALLGGFSDADEDVSDDEDEEDGPGALSGGPPRQQQGCEDVIELAAAAFSGPERWDVLGLGQAM

SEQ ID NO: 146587 - protein, 109 aa, Triticum aestivum
  Clone ID: PAT_TA_41005.pep
TLPDHTTAPSRKKSHTGGLAAGRLLCPLPAASPVAPTSPGGLTLDSASSETPSPSCLPYVHPAPRDGAPFPPRFFPSDSVSYASSGLLLSIVFVNHGVQQGGSELEKAA

SEQ ID NO: 146588 - protein, 70 aa, Triticum aestivum
  Clone ID: PAT_TA_41006.pep
QTGGLRDSRVLSPLPAISAGESTYRVSLTLDSLSNETPPPSCLSNVHPAPSDGAPFPPQIFPSDRTFYAY

SEQ ID NO: 146589 - protein, 43 aa, Triticum aestivum
  Clone ID: PAT_TA_41007.pep
TLVCFSTQLRRPRVCKSKEALQFCSLKAGVARAPPGNRYRCCG

SEQ ID NO: 146590 - protein, 68 aa, Triticum aestivum
  Clone ID: PAT_TA_41008.pep
PAQWFMRLRQPLLRMGAPHANLSDLEGCLLRSQLLLLGGMVMISRPSLGTTPSRACEAVSVISRRTGN

SEQ ID NO: 146591 - protein, 131 aa, Triticum aestivum
  unsure (1)..(131): unsure at all Xaa locations
  Clone ID: PAT_TA_41009.pep
HASAHASAHASADAWARRASNGRKQTQRGREGGRTRPAGFRLSVHPARRRRAAAPPPPWPCPSRSRATPPASSTSSARTSPPASSPASKTPPTSPAPXPSPAPGADSSRGTASSRRCASASSRSWPSSRPR

SEQ ID NO: 146592 - protein, 39 aa, Triticum aestivum
  Clone ID: PAT_TA_41010.pep
KSANRQCHAGAPRTGVALRVEPVPYTSTKVMMTDPLRVG

SEQ ID NO: 146593 - protein, 113 aa, Triticum aestivum
  unsure (1)..(113): unsure at all Xaa locations
  Clone ID: PAT_TA_41011.pep
VASPPPKVKLAQGASRMSEIAKKLFPAKTERKGNGQKNDFDKPNTALAMVVAGTIGVEADKRLENLDRSIETLKKQKNENSHRKTSVGQEGESXEQFVTTLEAXLHVQPCKDQ

SEQ ID NO: 146594 - protein, 46 aa, Triticum aestivum
  Clone ID: PAT_TA_41012.pep
NTYTNKIQFIAKICMDKLNAKAISKNGFCQNHSPSFLLATYSAELR

SEQ ID NO: 146595 - protein, 86 aa, Triticum aestivum
  Clone ID: PAT_TA_41013.pep
MDAGFLVMGGPFFGDAPNGGENRMGTTIVGVFYPRGGVLAADFKTSTGMYVANRASDQNSQLTDKGYVWRSGSGADTQGILKYVRY

SEQ ID NO: 146596 - protein, 50 aa, Triticum aestivum
  Clone ID: PAT_TA_41014.pep
CRKGIPTSRSTESERLRGKKIAGYGGQAGNPHAGGESEGLRLWMGIGLDL

SEQ ID NO: 146597 - protein, 46 aa, Triticum aestivum
  Clone ID: PAT_TA_41015.pep
KKFHSKSRLQHKLKIPKTMYIMTGYNCQSPLHWSSHDSDQESADAW

SEQ ID NO: 146598 - protein, 66 aa, Triticum aestivum
  Clone ID: PAT_TA_41016.pep
GFGGLKVPQNPPKNLDLWLNLKPVKGYIFLWFKVGKSPFMFKMYKGFRTNPTFKKKKKGPLTLYFQ

SEQ ID NO: 146599 - protein, 134 aa, Triticum aestivum
  Clone ID: PAT_TA_41017.pep
PGNWWASSSSCAHQVPPPLSLSSIPAPSVATHRPSQNSPLLSSPPPKAAPIQQLPHNPTQEHIKINLWERRNACPQFLMRRCDLRQSHNSRVSGGMSSSLPILPNSLKETFHGPYNPQLTPMQRQLTSDLVPLH

SEQ ID NO: 146600 - protein, 66 aa, Triticum aestivum
  Clone ID: PAT_TA_41018.pep
SLDAIVLGWLILSVSNSRSNFSRHHANDHLRHPSVDKYGIGQGNHEFGLHTINGNCSLSRCSCITC

SEQ ID NO: 146601 - protein, 90 aa, Triticum aestivum
  Clone ID: PAT_TA_41019.pep
PPLQPAGGQALQGDSCLVFFNSSIKIVLHLFFLRSDICVDFRRVPFNPYVHPCKTADRLVMARSPARRPSSGRRHRLPRAAGMSVISEDI

SEQ ID NO: 146602 - protein, 114 aa, Triticum aestivum
  unsure (1)..(114): unsure at all Xaa locations
  Clone ID: PAT_TA_41020.pep
MDSRGLDSTGREFSSATEMWAQEIGATASGCAWASEVPPGAADDAAVXSNGDAGEEAGGEGKREEWYSKGIVYWQGVEALTEGELGGYGCVNDADVKGRAVFLRAMLVERFGAE

SEQ ID NO: 146603 - protein, 110 aa, Triticum aestivum
  Clone ID: PAT_TA_41021.pep
MAMAMAVQASWLGGLACIFSTSLLFQILVRPCSNGGGLFFCPQSPNAPSILSSKDRTAYHFQPPKNWINDPCGPMYYNGIYHEFYQYNPDGSFNPNTSYNIVWGHSVSTD

SEQ ID NO: 146604 - protein, 112 aa, Triticum aestivum
  unsure (1)..(112): unsure at all Xaa locations
  Clone ID: PAT_TA_41022.pep
SASSRAARRRRXSRSRWRASRCSRPQTKKTIASTATMKRMLGLILVSTVSSADDPGAVHDELLMVLVVLRTEPTAPSKQAATDESPSFGLTIRSKGGASAWPRWPTRPPTRP

SEQ ID NO: 146605 - protein, 78 aa, Triticum aestivum
  Clone ID: PAT_TA_41023.pep
SPKPLCRSSICSQPYSAKSRWPCPTHYGFDQDHSSILFAPSAGSRDGDLLVAPLWNATGTATAYSPLAAWPSCSMWTL

SEQ ID NO: 146606 - protein, 93 aa, Triticum aestivum
  Clone ID: PAT_TA_41024.pep
SKVHLQELTLGMANTRLCVISGEFYGRPPPAYIAPEIPLWHVNDPVVPFSLKGGFRWAPASIGCMRAMVYILQNMACSTRLQVLALSGGAHAC

SEQ ID NO: 146607 - protein, 39 aa, Triticum aestivum
  Clone ID: PAT_TA_41025.pep
DAWGVLVGAEKERCEVKVALSNSFGFGGHNSSILFAPFK

SEQ ID NO: 146608 - protein, 66 aa, Triticum aestivum
  Clone ID: PAT_TA_41026.pep
ILAQNTNKYLCRLVRRPVSKVLLLHISRLSKYCLWLASNLICYRLAAVANPIAYPNPRSATDRAAT

SEQ ID NO: 146609 - protein, 55 aa, Triticum aestivum
  Clone ID: PAT_TA_41027.pep
IPPRALNITQQYRFLYYPCSNSQIYIERVLYMFPKPYSAIYLRQVHQTELGPCAP

SEQ ID NO: 146610 - protein, 54 aa, Triticum aestivum
  Clone ID: PAT_TA_41028.pep
LLMVPCHHNTVANPRLIQIIIQIQVQTKVQNSNFSNMQTKMFKVLPIFHNKLWW

SEQ ID NO: 146611 - protein, 88 aa, Triticum aestivum
  Clone ID: PAT_TA_41029.pep
RPVPRTCRACLEGPSARPWVWIRSALKGGCVSGCPRWDRSVVEVTRTGVLLLLLYRGNVYVGTARSRRGRCPSRCHSRSSPTRPRTRG

SEQ ID NO: 146612 - protein, 48 aa, Triticum aestivum
  Clone ID: PAT_TA_41030.pep
NWSYLELHLNHCFCHCGLRNPGCKLLPVNVRLTTILQYLISTYIYEHC

SEQ ID NO: 146613 - protein, 81 aa, Triticum aestivum
  Clone ID: PAT_TA_41031.pep
MDAWPSSLPLRIVIVQGLALVHLLTCLELAERIAFRGHRVSYVCTPRNLARLPTSAPRVDLVALPLPRVDGLPDGSEFTND

SEQ ID NO: 146614 - protein, 76 aa, Triticum aestivum
  Clone ID: PAT_TA_41032.pep
ILVYKHGNLTRVVHESVHGPSFGHDANASSPYADVLWNNQVAPVLKVHVKLGTEDAHKCCLCSQGGNEDHSKSIIP

SEQ ID NO: 146615 - protein, 95 aa, Triticum aestivum
  Clone ID: PAT_TA_41033.pep
GRVGGRVGGRVGGRVGSGLFSPAKPPPRLSPPAAADEAHRRPRRLRGPTVAAPSGRQLRAVALTSWSSSPPSLFASCPPPRPPRRSSSSTSSTRP

SEQ ID NO: 146616 - protein, 130 aa, Triticum aestivum
  unsure (1)..(130): unsure at all Xaa locations
  Clone ID: PAT_TA_41034.pep
RTRGYESITSRTHARPARGQAVLVLGASSPSTLASSPGLPRPAPTPPPTXAHPAPSPPLKIQGTLARPPPAPRNAPLLTMSSLSIPPPLLRSSHSPSPPAAAAAKANWRKRAARVRVRAPVAALAGDCGC

SEQ ID NO: 146617 - protein, 99 aa, Triticum aestivum
  unsure (1)..(99): unsure at all Xaa locations
  Clone ID: PAT_TA_41035.pep
MDSGDSWGRSSSTSSSGGVERRLQSRYDLYMGFDDADAGGDHVEARGAXAYNCPFCGEDFDFVRLCCHIDDEHAIEANSGVCPMCATRVGTDLIGHLTM

SEQ ID NO: 146618 - protein, 129 aa, Triticum aestivum
  unsure (1)..(129): unsure at all Xaa locations
  Clone ID: PAT_TA_41036.pep
PRVRYPVIKYIPFPESRPFSRDKEESDAPQYFRDVACCNNMIKFVHIESHDPCCTGNKDWKATTWNRKLSWGYWRQRFTVKGDDISAXPKYSALLPELWDSETGKLDLKKLNFYTPTLSMCDDDFLYVM

SEQ ID NO: 146619 - protein, 92 aa, Triticum aestivum
  unsure (1)..(92): unsure at all Xaa locations
  Clone ID: PAT_TA_41037.pep
QRHVNLTGEKGEAKMSWRVKGSMGLSMVGAKRHRMVLRXNIQCITKPSIRCLPRLGALKRILGLIYKETRGVLMIFLENFIPDAYSLTKLSY

SEQ ID NO: 146620 - protein, 59 aa, Triticum aestivum
  Clone ID: PAT_TA_41038.pep
RTRGRIQDRSRAKGGRRRCLRRSAPPTRARTRCLPLITLIIYTIILHVCTFNKKAPYSI

SEQ ID NO: 146621 - protein, 132 aa, Triticum aestivum
  Clone ID: PAT_TA_41039.pep
RTRGRTRGRTRGRTRGEEQSPLDDHFSLADLSGCPNQDDGYVRQAGPIMFSDPSNGDQAYYPMRTYGNRNHAYRALSAEEFSDTGNGTNAYSGQQQACPSDDQNLYSGLQQACPSDEQNLYLPTNGLPFPQQ

SEQ ID NO: 146622 - protein, 68 aa, Triticum aestivum
  Clone ID: PAT_TA_41040.pep
VRLWSSFQILLQFLMLLIIHFCTLMELHRLLSSVEYTPNTFLSDLPLNDSSLYFIKLNAANPHGVLKN

SEQ ID NO: 146623 - protein, 95 aa, Triticum aestivum
  Clone ID: PAT_TA_41041.pep
ARLWPSFQILLQFLMLLIIHFCTLMELHLLLSSVEYTPNTFLSDLPLIDSSLYFIKLNAANPHGVLKNYVLSISYSLVLPPSLHIRRFCSLIRTE

SEQ ID NO: 146624 - protein, 132 aa, Triticum aestivum
  Clone ID: PAT_TA_41042.pep
RTRGSPRRHQARRRGHRRTAIDLAAPERNCSTAVMCGPQSLVQLAFGGGGKGEEALADKSRNGPRRERRPAARLRCRNSSSDGKATPSPSPLINRPTMTRFEDQSTSVTLLAGQGRGGHCMSHGLQPHGSQP

SEQ ID NO: 146625 - protein, 133 aa, Triticum aestivum
  unsure (1)..(133): unsure at all Xaa locations
  Clone ID: PAT_TA_41043.pep
SLGNFLCPLLLLQCICSLLHINKIFEVGISEHLANKLQHMSIDLVEKANSSITAELDYVSNLVIGVIDVQRSKEKGYETLVKENLCDELDELRMVYEGLPDFLEQVSANENAXFPFSLECRKAPLIVYVHQIG

SEQ ID NO: 146626 - protein, 121 aa, Triticum aestivum
  Clone ID: PAT_TA_41044.pep
EREHSSTQEKLDMELQDLDKRLQQKEAEMKQFDTVRKQHYETKLDEMVQEKRALQKEIVDLRHAVANTSNSTDKWSNYLEKLNMIETQVSQHEKKREAHEQLLRHKQKSDDEAMRLQGEIQ

SEQ ID NO: 146627 - protein, 100 aa, Triticum aestivum
  Clone ID: PAT_TA_41045.pep
MQPLPERSNYILSLMHACLAEFPPSIFCSYIALTNQTTYEVARRKRIFYLRGIPDRVHPFSKGICRNIYDFCFTRENGFVLEAAPPIEELEARAAPYTCR

SEQ ID NO: 146628 - protein, 79 aa, Triticum aestivum
  Clone ID: PAT_TA_41046.pep
FWSKEFWLHNPAMICPKRYTTSSPPLYVSTLIYRSSAKIWSIKLSAGTSHLEQQPAWIPRSSSGRQASAVGAGHWTAPS

SEQ ID NO: 146629 - protein, 57 aa, Triticum aestivum
  Clone ID: PAT_TA_41047.pep
DAWADAWGMCEDIYFSCDTIVAWEKKKLQHYRLLTCVFLLALYQPFLILKRCSTPMK

SEQ ID NO: 146630 - protein, 89 aa, Triticum aestivum
  Clone ID: PAT_TA_41048.pep
CLLHRVRAGRSSGGRPDQTTSPARPSAGGGSPPRLPSSSSRTAAGIGISRLAPAPPRANPSRPQGWVASRQQDPTLLNIDYAWWMRMPH

SEQ ID NO: 146631 - protein, 113 aa, Triticum aestivum
  unsure (1)..(113): unsure at all Xaa locations
  Clone ID: PAT_TA_41049.pep
GWLAGGKVKLSGSISSQYLSPLLMAAPLALEDVEIEIIDKLISVPYVGPTLNLMERLDVTAGHXSDSCDRSYIKGGQKYKSPGNAYVARDASSASYFLAGAAITGGTETVECC

SEQ ID NO: 146632 - protein, 86 aa, Triticum aestivum
  Clone ID: PAT_TA_41050.pep
RIDMFYFIFRFRHRTFRGQLRCGKPSQKEKTKLKRWKKIPMFHGMAPHETLFSLSRPSHLSGYVGLKMCFFIQEARSNPGCVCEPT

SEQ ID NO: 146633 - protein, 66 aa, Triticum aestivum
  Clone ID: PAT_TA_41051.pep
RTRGRTRGRTRGRTRGFMSYVMLFRIVFFQKFYRHVYIWYHWFLHMSHTSNYFLKFFWVTLLYLVL

SEQ ID NO: 146634 - protein, 68 aa, Triticum aestivum
  Clone ID: PAT_TA_41052.pep
MAGAGAGKEDAAWERPISAGGKRAPVFPFFGPKTLTLDGAGKVFNGRLPLAGLFERFPLLEELFGGGA

SEQ ID NO: 146635 - protein, 62 aa, Triticum aestivum
  Clone ID: PAT_TA_41053.pep
LQAAWGRFEQPTPATRAGVYGVEGTIRVQPKYLSAWIYLAPLGLGYVTYQQLFSQILLGNIG

SEQ ID NO: 146636 - protein, 70 aa, Triticum aestivum
  Clone ID: PAT_TA_41054.pep
RAGGSEKTGDGALGEARRTHRAQMPLWCLHGSFMVLPRPPSASSAIPQFCFLRSIGIPASGFLLFPLPFF

SEQ ID NO: 146637 - protein, 49 aa, Triticum aestivum
  Clone ID: PAT_TA_41055.pep
RGPPGSFRARVAPVHTAGKAPPPGVGYPRLPGPARQAAAREPVRPGGVI

SEQ ID NO: 146638 - protein, 85 aa, Triticum aestivum
  Clone ID: PAT_TA_41056.pep
RTRGRTRGRHSTRLPCQIRTAWHLSRRGSSDHRIEVGVASLSLWPSHPPVVRTVHACNPLAVDVQCVCAIRRELKQRHRSVHYVL

SEQ ID NO: 146639 - protein, 107 aa, Triticum aestivum
  Clone ID: PAT_TA_41057.pep
MAEGEDNQALVRGGGTGKGRAGRAGDDAPRAGAPRSAGRPRHTGATVGRGQKEAKAGDEAQPKRGTLTGEHPNEHGTVSNGDDREKMGEDTINNEEREAPEEHPGRG

SEQ ID NO: 146640 - protein, 86 aa, Triticum aestivum
  Clone ID: PAT_TA_41058.pep
PSTIRKMEKVVLLSQLPPAYAGLINQHWHRKRCRKISSCSAALKMTNLLFKHHTEQCPRIECKNSVNTTLHFFLFNASLFILSLSH

SEQ ID NO: 146641 - protein, 110 aa, Triticum aestivum
  Clone ID: PAT_TA_41059.pep
QSSYGVSVVDGFNVGLSVTPHEGRGNCPVLACRKDLTQTCPGELQVPGGGGGVAASKSGCLAFGTDELCCRGAYNSPAACRPSRYSDFFKSECPQAFTYAHDSPFLTHQC

SEQ ID NO: 146642 - protein, 46 aa, Triticum aestivum
  unsure (1)..(46): unsure at all Xaa locations
  Clone ID: PAT_TA_41060.pep
GGAPKVPHIHDLGRGVQIVIGTPAHFIDMIXALDTNIRLVTYRVMV

SEQ ID NO: 146643 - protein, 98 aa, Triticum aestivum
  Clone ID: PAT_TA_41061.pep
RRLFFFLGRFRQLRRFGRGTLASRVRGRRSCAWAYALLGAALVRGACAALRSWSRLLPWPRFLPAPFCLPASSSLPPLLGSCSVLCWATRVRRCSPPF

SEQ ID NO: 146644 - protein, 70 aa, Triticum aestivum
  Clone ID: PAT_TA_41062.pep
QQTIGSWEPRAGAAPGPQRPDRRPRKYSSQMCAPSPRDYNDDTTMILLFLRGNPAPGPGACRPNPPVLQA

SEQ ID NO: 146645 - protein, 88 aa, Triticum aestivum
  Clone ID: PAT_TA_41063.pep
IATLNANFCSTRQQEPNKYTMNMICVVFIWLVPHTHDLLLLQELMGKKGRHTCLLELHVWPVEAQLNATLFHQFQVGLSSSFCRSHAS

SEQ ID NO: 146646 - protein, 88 aa, Triticum aestivum
  Clone ID: PAT_TA_41064.pep
PGGRTTRPTTRTPNNNNGRRSHNKEQARKKDAGKQKKAAEKKIGEQKKKAGTRTGKAGQQTPGGRSGRNHKKGRYAQARSSGAPGNQD

SEQ ID NO: 146647 - protein, 109 aa, Triticum aestivum
  Clone ID: PAT_TA_41065.pep
PPRPTPPPTRAQLHPPPSPRSGRNTEDRDRARTPTLCAPSRTNRSQPSGRKSQSPTTTRRRPPSKPHTPPPTRPPRSPTACTQHTRRPSPPPQPPPPAEPRPWRLTDQA

SEQ ID NO: 146648 - protein, 101 aa, Triticum aestivum
  Clone ID: PAT_TA_41066.pep
VRSSLSPGWSPVIGPLACFRCCALCVPSLWGFPALSGPRCFCLRLLVRPLVLLSCLLSARPSSSAFPSLARVPAFAPRAFRWWPPLSSLVTVCSLSSPSRP

SEQ ID NO: 146649 - protein, 89 aa, Triticum aestivum
  Clone ID: PAT_TA_41067.pep
LNRVPSYFSSARSGFSYTYLTPLSPGPSRPHTDTAAASNFINITKILICPRLYLREHPCQPLPPLPGPTFRSAASFAWLLCVCCWWWRA

SEQ ID NO: 146650 - protein, 68 aa, Triticum aestivum
  unsure (1)..(68): unsure at all Xaa locations
  Clone ID: PAT_TA_41068.pep
FGRNFCTGACYVKNILYSGGAEADEXKFALLLAELKGSDITDWIAFGWEKLVGVPLGGGAIAVGAPAA

SEQ ID NO: 146651 - protein, 111 aa, Triticum aestivum
  Clone ID: PAT_TA_41069.pep
PNSKHYKYNMQLGIILKREHLGIIEKKEGDIVIKTRPALEWFDYYDNDTLDDKGRTAADRVKEVFWNLFEIHVKDDEDLDKVEDDADRVLDNYAMKKVRDTMYQLCVDAVK

SEQ ID NO: 146652 - protein, 97 aa, Triticum aestivum
  Clone ID: PAT_TA_41070.pep
GAVQDICRVLGVLPVGLLRLTLLAVRRPRHIGPSLLRGHEVVLLIVTALLPVEDGRPRRRSVLHDKLPHESACDWAFASGRRIRGPALSAVRIISHE

SEQ ID NO: 146653 - protein, 84 aa, Triticum aestivum
  Clone ID: PAT_TA_41071.pep
TPAVRSGFGRPRVDLLKEISTRFFGHITAFVTCREAASWIQEGMFLQHLPTRNWRTTSLRWSSEGVMAHDVRARPAIRTRRLCV

SEQ ID NO: 146654 - protein, 63 aa, Triticum aestivum
  Clone ID: PAT_TA_41072.pep
AWSSRRRLFFFCHRAELLFVLSGVSFLFISKAVIRLLLSIGIKMPPGLLSPVCGVVCFLTWFL

SEQ ID NO: 146655 - protein, 94 aa, Triticum aestivum
  Clone ID: PAT_TA_41073.pep
GGTHASAEAWERRRLHRTPKTLGREPPQQRGGAQEPRVYAGVRRGHNDVVTAMATAMDNRPLSACSSRDKTLRAWDLTNPNQASQDGRAEYGGP

SEQ ID NO: 146656 - protein, 91 aa, Triticum aestivum
  Clone ID: PAT_TA_41074.pep
LPSDWGKTQTSDETQPRPWRTTTHILAGDDLMMGDGMGDYGGAEGTGMKVDEEKEIGKQGLKKKQLKEGEGWNTPEVGDKVEDHHNGTIRD

SEQ ID NO: 146657 - protein, 110 aa, Triticum aestivum
  unsure (1)..(110): unsure at all Xaa locations
  Clone ID: PAT_TA_41075.pep
GRVASQQPNHPPLPNPPTRSPKARRRHHQHPRRRPRWAPPPPTSLSPWPPPSLARPPISRAPPAASPXLLPRPXPASPSTPPPPPTLATTIPRTTRTKMMTKIQAAPGRR

SEQ ID NO: 146658 - protein, 63 aa, Triticum aestivum
  Clone ID: PAT_TA_41076.pep
RRPAPRPGRPGCRGPNLSALQLQPGLHPTTHPCLRSPIQQTPLINHNTYTLTQPRSKARFSKG

SEQ ID NO: 146659 - protein, 82 aa, Triticum aestivum
  Clone ID: PAT_TA_41077.pep
LSTSRIICLTCDETTSKQLLNQPTRRNVRQSFQSHSQIQTQSNKQAGSSFAQVGRRWAQGDSSELLARVLLVDDLQLAPRVR

SEQ ID NO: 146660 - protein, 87 aa, Triticum aestivum
  Clone ID: PAT_TA_41078.pep
MEVGKNKRISKGRKGSKKKAVNPFTKKQGQDIKAPQMITSRNVEKTLGSRTQGTKIASEGLKHKEYEESLDKNKNDENQTYKKNRIT

SEQ ID NO: 146661 - protein, 84 aa, Triticum aestivum
  Clone ID: PAT_TA_41079.pep
KVLVASLDNVLHAPPPNVAVVSVRTVPQAITFHYVNTCHILPWPLSTSSSHCLASFMSSSMPLVHLTLDVPSINSNNRVNPTRA

SEQ ID NO: 146662 - protein, 83 aa, Triticum aestivum
  Clone ID: PAT_TA_41080.pep
HPVRATIEQAAIMNTQLFFIFLIQQFRYTRTILARSTLASQQQPNLQLDEWIHHRLEAPRSISPEADHRSGQEGERNRWPGLT

SEQ ID NO: 146663 - protein, 86 aa, Triticum aestivum
  Clone ID: PAT_TA_41081.pep
WLASATCPYFFLVSSLFVTLACAVYTPSVLCIILVRVDEHSAPQFGQATPSSQQAVAPELFLCFLVMPQLLHVAGVAGSSRIRSVS

SEQ ID NO: 146664 - protein, 87 aa, Triticum aestivum
  Clone ID: PAT_TA_41082.pep
AASVGALGAAVMYGRARNSGTNDMGEDMKAARQWLVDFLRGQGVLTGMDIAQRFGLWRVRYRDDGHIGWVCRKHIAARGDEVFELPL

SEQ ID NO: 146665 - protein, 102 aa, Triticum aestivum
  Clone ID: PAT_TA_41083.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAATYCTG

SEQ ID NO: 146666 - protein, 30 aa, Triticum aestivum
  Clone ID: PAT_TA_41084.pep
NELTSIKREGVSSTSTITGVDISMNTYLKT

SEQ ID NO: 146667 - protein, 36 aa, Triticum aestivum
  Clone ID: PAT_TA_41085.pep
ATTRPTLSDQSPYFFSSTVPLGVGSYPRSVRTSRLF

SEQ ID NO: 146668 - protein, 45 aa, Triticum aestivum
  Clone ID: PAT_TA_41086.pep
DKEPLKHFMPACKKKVDLNKLYVVSGARSCVINYMSVPMRVPLYP

SEQ ID NO: 146669 - protein, 121 aa, Triticum aestivum
  Clone ID: PAT_TA_41087.pep
INQCKWHMGQKMYRIFRHIVEQHVGMPCVFHLELRRVVHCLLNGGIFWKAIQDARTLEDGTESGSVDEFFLATATTDGSVAVAIPNAPKPIFLAVISTPALSAATFPITSHSHCFLRATTG

SEQ ID NO: 146670 - protein, 65 aa, Triticum aestivum
  Clone ID: PAT_TA_41088.pep
GSYRCLILAIQAACRQRGLRTGEGKGPNPLTHCAVTDACIYHFIAGHYIPCCFLLANYGQYVTAM

SEQ ID NO: 146671 - protein, 112 aa, Triticum aestivum
  unsure (1)..(112): unsure at all Xaa locations
  Clone ID: PAT_TA_41089.pep
PGNGVDLRXXEDQEQERDXGDGAAPGPRDCHGNGGNGGGERERIPPRRRWIFYIQPPFFRVNSIRVLQTPKIPCSKGRRASDANVQLQKHSLAKSTAPPPPPNDSDSPPRVR

SEQ ID NO: 146672 - protein, 63 aa, Triticum aestivum
  Clone ID: PAT_TA_41090.pep
RGLLRLYILMARLPCLAEGNLWSSQLTYRIYPEERWLNVKYPPLGRGDSISLCCNAAAVIMEI

SEQ ID NO: 146673 - protein, 44 aa, Triticum aestivum
  Clone ID: PAT_TA_41091.pep
VVVVEPHQLNGLVHDQFREPLLGQVPERVVHPVLDGVRAPTRRR

SEQ ID NO: 146674 - protein, 72 aa, Triticum aestivum
  Clone ID: PAT_TA_41092.pep
RGQSRPALGDPSSLAIEADCWISPTLATMMQHLDFSQASTSKKWTANSSKRQPGQGFDASRNSMEFAMEAPH

SEQ ID NO: 146675 - protein, 74 aa, Triticum aestivum
  Clone ID: PAT_TA_41093.pep
RSAISSLSLLVRRSLSLLAEPPATYGQLAVDLCLLELRAGRWRTYVRTGKIDPSMLFLAIHQIARLIPSGPCRF

SEQ ID NO: 146676 - protein, 33 aa, Triticum aestivum
  Clone ID: PAT_TA_41094.pep
PTRSVHPHFHLSIKPHPRQGPFDRGRGYFIIHF

SEQ ID NO: 146677 - protein, 132 aa, Triticum aestivum
  Clone ID: PAT_TA_41095.pep
MNAFRASLAEGLPAVTPHIPGEQAIVPEPVREPPVELSVQELLALDPFDNLKKQFIVKVTITGLGSDNRWWFLSCRKCHKTAYTSGRQYRCSDYGCSSIIADPSYCVCTFGSDGANEAEFMFFDRAAKQVIG

SEQ ID NO: 146678 - protein, 80 aa, Triticum aestivum
  Clone ID: PAT_TA_41096.pep
LTTGSCDEGVNSRNAVAVGSYSLSSGGLSLFACFSHSVVTFSIVVGVVVVIKRTHSKERLTKNYDVHSLPRDAWGVARIR

SEQ ID NO: 146679 - protein, 79 aa, Triticum aestivum
  Clone ID: PAT_TA_41097.pep
YAYKLIVPSLVLSWITISPLVRRKRGMMLNMRSNNGWVLGNTNHFTKAVCSVVTYGATCNNYPFFLSTSQLGSHPEVWA

SEQ ID NO: 146680 - protein, 77 aa, Triticum aestivum
  unsure (1)..(77): unsure at all Xaa locations
  Clone ID: PAT_TA_41098.pep
SIRVSVGSHSLQQNDRRVGCIIHRDMRPNNILVTHDFEPLVGDSGLARWPPDXDMGVETRVIGTFGFLAPEFAQSGQ

SEQ ID NO: 146681 - protein, 62 aa, Triticum aestivum
  Clone ID: PAT_TA_41099.pep
VNSFEASNKLATLREELGYIIYFPKKKKNFPFFTPGDTPHILEKKNTRGEHNKENLISAVPK

SEQ ID NO: 146682 - protein, 62 aa, Triticum aestivum
  Clone ID: PAT_TA_41100.pep
LNFLVGYWGTSGQAIGSSNKPLTFRGLLRLAQRGYFWGEGGLKREKNLFFLKTRALWYQNPG

SEQ ID NO: 146683 - protein, 142 aa, Triticum aestivum
  Clone ID: PAT_TA_41101.pep
IHHFPLEALDSQGCSFVHSLFLTSISIKPHSGISGFTILRRLVLKFVEILGDFPGLLAKCSELEDLVIIWCYGVHDLIIPHKLDKLQHLRISGTDVQMVEFHAPDLSHFEYNGQVIPIVLHGCTKLEKATIKFNGTQALAHA

SEQ ID NO: 146684 - protein, 100 aa, Triticum aestivum
  Clone ID: PAT_TA_41102.pep
PRVQPRVPWKGAPTAVHGREVTQRKLSSLLTRVVTTMHTITNCVHKSTSNIGAVAAVRLYMEKRSALTIFQPPFYQTMNTPSLGGTFRTNFCRTPIYLFF

SEQ ID NO: 146685 - protein, 141 aa, Triticum aestivum
  Clone ID: PAT_TA_41103.pep
RTRGRTRGDFLNWTRVDHPLYSSNASIMLECLDFFAVLPGSNNGLDMSSAIPNGAKHVLKMGLNFGEDVYVIGVYDLKRDVFVPDTDDSRLWPRIDYGNFYASKTFFDSKHGRRIIWAWTTETDSSSDDVAKGWAGIHSFP

SEQ ID NO: 146686 - protein, 104 aa, Triticum aestivum
  Clone ID: PAT_TA_41104.pep
PKHPRSIGTGDHSDLICYQLTAVTNPIANPNPANAGQGGALGKHLQSAYKGCWGSHIERLRWVFLALCFYYHRFGPQPCSKTRHRTRARARLRPPLIRKQGGAS

SEQ ID NO: 146687 - protein, 99 aa, Triticum aestivum
  unsure (1)..(99): unsure at all Xaa locations
  Clone ID: PAT_TA_41105.pep
DNQYLCILLDHLIGRRRMLKYTPEHMHCFTMFWGRLIPQKNCVLVLQSLSVDKVPFDNSAKRXVQEFNTTRRFMKKIKLTGTLCIIFKKPVLMKGGAHI

SEQ ID NO: 146688 - protein, 38 aa, Triticum aestivum
  Clone ID: PAT_TA_41106.pep
LSEHSGWGYQLKLNLKLHKHFTLPFVAKRKKNITLYKG

SEQ ID NO: 146689 - protein, 87 aa, Triticum aestivum
  Clone ID: PAT_TA_41107.pep
YSSASELSLRTPPVSSLVTPDLSSHYQHALTVRYAHELYMSKPSYMMLDRLLFNRCYPNSLMYIIIPDPVLSCVATHPSQHAHFHYT

SEQ ID NO: 146690 - protein, 56 aa, Triticum aestivum
  Clone ID: PAT_TA_41108.pep
DAWTDPWVETVAMRRGGRGRLLLRVLKLCSGALIMVVGEAVHAAADCVHRVGELQH

SEQ ID NO: 146691 - protein, 145 aa, Triticum aestivum
  Clone ID: PAT_TA_41109.pep
VAHRRMSTKKEKPRILILGGALEYQRVSNLLSSFDTLLQQETDYLKMAVVKIKAHQPSVVLVEKSVSRYAQDLFLEKNISLVLNIKRPLLERISRCTGAQIVPSIDYLSSQKLGNCDLFHVEKYVEEHGTAGEGGKKMLKTLMFF

SEQ ID NO: 146692 - protein, 80 aa, Triticum aestivum
  Clone ID: PAT_TA_41110.pep
LFFFFFFFFFFWEGKISGKGDRFFLQIFCRCKSIQFFSTGHQLTYILIMAGYRDTFGNQPPNLLNVFWVYFIHSGLVGIC

SEQ ID NO: 146693 - protein, 110 aa, Triticum aestivum
  unsure (1)..(110): unsure at all Xaa locations
  Clone ID: PAT_TA_41111.pep
MAAEDVEFVDYERDDGDDGMEDEEEDGEVXSQALTRTDIIYLACGSNSMKTFICRKLYVRAYIEMMWILSSSTAIGCMDKMIHFKEKXTVGGXENNGVAHLKAPGLMASD

SEQ ID NO: 146694 - protein, 40 aa, Triticum aestivum
  Clone ID: PAT_TA_41112.pep
AAENTCPVRGGVHVVNHGVSSLRVLVGRADLTRPVEPQGP

SEQ ID NO: 146695 - protein, 36 aa, Triticum aestivum
  Clone ID: PAT_TA_41113.pep
PCSGVPSTNENYSKCTGDIWRLRCRKESLIEAWKDT

SEQ ID NO: 146696 - protein, 50 aa, Triticum aestivum
  Clone ID: PAT_TA_41114.pep
IIRMNDLKIAHAIWENACINSSMFKDYFTREASTIATHASQGGGSSKASP

SEQ ID NO: 146697 - protein, 76 aa, Triticum aestivum
  Clone ID: PAT_TA_41115.pep
MRAHDNLDVYYDREVRHPDRNKPILCTLYEQHHPRSRACFPHRSARSHRNVATIRGAKPHELDPSPHIQHNSTSIV

SEQ ID NO: 146698 - protein, 90 aa, Triticum aestivum
  unsure (1)..(90): unsure at all Xaa locations
  Clone ID: PAT_TA_41116.pep
SSTRTPTRSWTRGPPAIPMAAPPAEPPILRTHDELLEEILLLLPTDADLTRAYLARAFFRRLITGHALLRRYRTXHPPPMIGVLEVDDNA

SEQ ID NO: 146699 - protein, 104 aa, Triticum aestivum
  unsure (1)..(104): unsure at all Xaa locations
  Clone ID: PAT_TA_41117.pep
ETDMALILDVVRFKYTLNWHTLTLMWDAMNTTDEATXLLMRIMLGSRRRSSTSLLYTTCCGHTRWKSMATYCVEDVPNLLTDENGDTVTTTLCRLVESLPGNAG

SEQ ID NO: 146700 - protein, 134 aa, Triticum aestivum
  Clone ID: PAT_TA_41118.pep
LVTKREREKQELERELELCKQKVLHYEDREMRRMPAFKDNARSTNGNGTSESSSGEDSDENSDDSCELGESPSGNLQSSPDAVLSPRADQENAGHLVALDDSLTYMEMERLSILEELKALEERLFTLEDDDING

SEQ ID NO: 146701 - protein, 92 aa, Triticum aestivum
  Clone ID: PAT_TA_41119.pep
MASPKLLLLLATLLPSCGLLVADFAPMTLTVVNNCAYPIWPGIQGSAGSEVLEGGGFFLPSLSHRSFPAPAHAWSGRVWARTGCAPSGAGAR

SEQ ID NO: 146702 - protein, 48 aa, Triticum aestivum
  Clone ID: PAT_TA_41120.pep
MSSESRELLGIDPNELRFAFELKKQISCSLHLTNRTDQYIAFKVIESF

SEQ ID NO: 146703 - protein, 63 aa, Triticum aestivum
  Clone ID: PAT_TA_41121.pep
FQVQQSYVRTTDHTINDHSIVYSSIITITVFFKDTMVTNSAWHCPYCILRLNSFQTITSVLPT

SEQ ID NO: 146704 - protein, 109 aa, Triticum aestivum
  unsure (1)..(109): unsure at all Xaa locations
  Clone ID: PAT_TA_41122.pep
MSLRPNERAEVRRXRYKASVDAEDGRRRREDQMVEIRKNQRDANLQKKRRDGFPAGAASAAGGAPQMGHSSALQQKLEGLPAMVQAVLSDDNAVQLEATTQFRKLLSIE

SEQ ID NO: 146705 - protein, 78 aa, Triticum aestivum
  Clone ID: PAT_TA_41123.pep
SSGKSSVLEALVGRDFLPRGSDICTRRPLMLQLVHQLRRPADAKRDEWAEFLHHPGCRFYEFPDIRREIQVLEQLRGQ

SEQ ID NO: 146706 - protein, 96 aa, Triticum aestivum
  Clone ID: PAT_TA_41124.pep
KALYLYVLPNSCFLVNNSTTHKDLFLKHHLMTKGCIQRTIIYSIIIMLVQRTLCLHIISIKKIIVIHTPKSKQVVHYCKQFTNHKIASPRVRGRVG

SEQ ID NO: 146707 - protein, 44 aa, Triticum aestivum
  Clone ID: PAT_TA_41125.pep
ISPCRRIKSMKTCSRRRSSLASSFAQVDAGKCAVVHDQNYPTRP

SEQ ID NO: 146708 - protein, 63 aa, Triticum aestivum
  Clone ID: PAT_TA_41126.pep
SLLGLLLAGQPQLQSPPLEYGTIAGYLTYEEWTYEEWTYEEWNTNILKKQEPQRLYLSITSSE

SEQ ID NO: 146709 - protein, 84 aa, Triticum aestivum
  Clone ID: PAT_TA_41127.pep
ILCFSVGLLVLVRGLDSCSDILALIPNFSKIIVEEQDMEDLKPLQEGVPCRIWFVPSCFSYCGFNVVGEQECAQGCLYWSCLFD

SEQ ID NO: 146710 - protein, 60 aa, Triticum aestivum
  Clone ID: PAT_TA_41128.pep
RGKIHCLDIFFREIHSLDIARVLPVLVYRCSCDVSVRKLDNAWHAGCGHFLLPEYCKRLL

SEQ ID NO: 146711 - protein, 72 aa, Triticum aestivum
  Clone ID: PAT_TA_41129.pep
PRVRPRVFPRVRPRVRGRVRGLVFKRVELSIPAAHSQPLVGTRGSLKNTVIVFIERLYDSMGGKVMIDGNDI

SEQ ID NO: 146712 - protein, 69 aa, Triticum aestivum
  Clone ID: PAT_TA_41130.pep
NFYYPDRQTDRQREEAIPLGRFPPFIRFSYKCACFIVYELSGICTESVLFCTSHFYMSVMIETVTNFWS

SEQ ID NO: 146713 - protein, 55 aa, Triticum aestivum
  Clone ID: PAT_TA_41131.pep
RIPPFVLGWCHGSQTIWYHMGAVVGPVCSLNRCWAIFLKNMALQPALDFFGPGFV

SEQ ID NO: 146714 - protein, 95 aa, Triticum aestivum
  Clone ID: PAT_TA_41132.pep
QRADGRNGSFRSKWYSPMDHLHLPGCGGHPPAQICLGPSGRGRGGRTDLAARGDGSVVGEGGRPPSAERPGEGGGVGVTGTRRRSDGEGMVVLGG

SEQ ID NO: 146715 - protein, 112 aa, Triticum aestivum
  Clone ID: PAT_TA_41133.pep
MAGKKQAAVSAAPSEGEEGAVVPSSTAKRGAGRPKKDPVPAAASPGSAAKRGPGKPKKDPVPAAAAKRGSGRPKKGAAPAESGEGSAPEPGKSEMGEGEKGATPKNRGRGRR

SEQ ID NO: 146716 - protein, 66 aa, Triticum aestivum
  Clone ID: PAT_TA_41134.pep
IKHSYTFNTTLHDPSSYQLNRKNTNTYFFLHHKENRNPSATMCVILPSMASNNYANKTRLSMEFQT

SEQ ID NO: 146717 - protein, 136 aa, Triticum aestivum
  Clone ID: PAT_TA_41135.pep
GAAAGPCPVVRFDMADFTVADRVSVGLHGRSDEMIFEATVRDPSSELYGSTVVLRQLTSSQAKRRGRRALEVLKKLARRQMMYHSYAMQVHGYVTPSKAMEEGDSPLVLVHGYHGSYSLRHWLQLSDWLPTLEATL

SEQ ID NO: 146718 - protein, 99 aa, Triticum aestivum
  Clone ID: PAT_TA_41136.pep
GRVGAAATSSSRRHQHHSFRARAAHRPPILLSRRPFIRARRRQIRAQPIVLHLPQQIQGTAESHCRQMHRRPAASASRSAGSPPRACFIARRSVELDPW

SEQ ID NO: 146719 - protein, 102 aa, Triticum aestivum
  Clone ID: PAT_TA_41137.pep
KVVGAPIETERQLNKKELKKKELAELDAVLAELGIFENTCDAAQDGNNTADKKGASQARDGERKEDSPAPSESKNAKKKKNKKDKSAKEAKEACVVEEATSA

SEQ ID NO: 146720 - protein, 62 aa, Triticum aestivum
  Clone ID: PAT_TA_41138.pep
FLDEYSFGLDQGIVMIPVLWEIASILPLQYDFLLQKLQVGFTLDKEFSVPLFDGTGTYATST

SEQ ID NO: 146721 - protein, 55 aa, Triticum aestivum
  Clone ID: PAT_TA_41139.pep
LDSKPIVHLHRFYSQPVSDHDFGHSPCIKRLFVFAEFKPKFHDPTKTGSVFVQLR

SEQ ID NO: 146722 - protein, 113 aa, Triticum aestivum
  unsure (1)..(113): unsure at all Xaa locations
  Clone ID: PAT_TA_41140.pep
HXYSTAPAAPPPPRAXGVPHRLAAALLLFPSPSAPNLLRRHHSLLYLQPPAAVYLQFASKSVSVFVRDNFSKTECPARTPQGFGCHKTEPLTEIPSKSPRITTFEEPSNIAPN

SEQ ID NO: 146723 - protein, 105 aa, Triticum aestivum
  Clone ID: PAT_TA_41141.pep
MFLCCRRHLTFSPLTAVPSPSGHRPLKPRTLRAPILASKNPPPRPWPLPRRQWRWRCSNTDAAQPPPVVEASVSGDGEKKSFWAAVSLIIGTAVGPGMLALPSGT

SEQ ID NO: 146724 - protein, 128 aa, Triticum aestivum
  unsure (1)..(128): unsure at all Xaa locations
  Clone ID: PAT_TA_41142.pep
DAWEFFELAAEFFGGASNDEGDGNHPTLCKALIMSVTSMLKAEELNNSPLMDSDVKKGVXMLSTAGKLLPSIWPSASVASDQAEANIFLFLHTFYSYQLLDRMDTSAHPQQLQLVKNFASSKACTPCH

SEQ ID NO: 146725 - protein, 130 aa, Triticum aestivum
  Clone ID: PAT_TA_41143.pep
SPPPRRPIRRPAPRRRRRPRGPPGSSPPPPPPQPTAPRTPTRRRRRPSWTPTTGPRSPTPPGPRPCSRPPRPPPTPPSLPRTPPTPPPPHRPWRTSPTRPGTAASGRTTAATRRLGAGAPAAAAAVGTTP

SEQ ID NO: 146726 - protein, 112 aa, Triticum aestivum
  unsure (1)..(112): unsure at all Xaa locations
  Clone ID: PAT_TA_41144.pep
MAPRGAVKKPVENTPAGKKPKAXKKVPASKEGGCDKKGMXKAKKSVETFKIYIFKVLLQVHPDICFFFMVISHYELLLLTTFFSKLFFCFIYLAALQLCCPFSLFFVILVSF

SEQ ID NO: 146727 - protein, 80 aa, Triticum aestivum
  Clone ID: PAT_TA_41145.pep
LKQVHPDIGISSKAMSIMNSFINDIFEKLAGESAKLARYNKKPTITSREIQTSVRLVLPGELAKHAVSEGTKAVTKFTSS

SEQ ID NO: 146728 - protein, 88 aa, Triticum aestivum
  Clone ID: PAT_TA_41146.pep
MSWRRGGGDGAVARRWVLLLCAGSFSLGLLFTSGMWTLPEATEVAKPNETRGKEAELAAVDCDSTKVGRKHDFRDTLQALDTHNAVQT

SEQ ID NO: 146729 - protein, 36 aa, Triticum aestivum
  Clone ID: PAT_TA_41147.pep
GEVRPSLPSANITFYDGACNRVASSAQQIVGGGPHY

SEQ ID NO: 146730 - protein, 63 aa, Triticum aestivum
  unsure (1)..(63): unsure at all Xaa locations
  Clone ID: PAT_TA_41148.pep
MDAMRKQLDVLMGANLNGYVRXVNRKYFDRDVCRLFLAXLCPYDLFQIMKMDLAPCPKVHLLQ

SEQ ID NO: 146731 - protein, 107 aa, Triticum aestivum
  unsure (1)..(107): unsure at all Xaa locations
  Clone ID: PAT_TA_41149.pep
MGKAGFGVAAGCAAVTCAIAAVMVAQRVAARARWRRAVALLREFEEGCATPPARLXRQVVDAMVFEMHAGLRXDGCSKLKILLNFLRRALLRCFKKCVYFCQFDLGS

SEQ ID NO: 146732 - protein, 96 aa, Triticum aestivum
  Clone ID: PAT_TA_41150.pep
CVVRGGRRWRGGHVRDRLCYGGSAQVWSVHSIFRRLLFILILLFVTDLLLGAFCPIYILFTVFKLFNIFFSFFPRFVGLFFFVFFFFFIGTFFYFY

SEQ ID NO: 146733 - protein, 63 aa, Triticum aestivum
  Clone ID: PAT_TA_41151.pep
DAWGSYYPPSPSTGTDPNTPGGGGNPPSPTTPGVADCPTAPSTCTSPSTPGGGGFYLFLSSIV

SEQ ID NO: 146734 - protein, 123 aa, Triticum aestivum
  Clone ID: PAT_TA_41152.pep
KATLLPRPKDVEEAAQANHYAYRHSASSPVVRRTPLDGHYGLSSQPNGEGLRCRGGRKDGARSCGRMARGGRMARRPDPGLPPAPRRTAAATAGREPGPKSRGFRAAFPPIFRGRWGFAQPRA

SEQ ID NO: 146735 - protein, 58 aa, Triticum aestivum
  Clone ID: PAT_TA_41153.pep
DAMYCLCISDSNPVAMHKAFYFSCGMGAFCTQITCSGPCFHSFLVVVHCSYFCHSFYH

SEQ ID NO: 146736 - protein, 75 aa, Triticum aestivum
  unsure (1)..(75): unsure at all Xaa locations
  Clone ID: PAT_TA_41154.pep
LSSSLFFFFTYFFFFFFFNIFFLFFFLFFILXIYITFFFFKFLFFFFFFIFYFFHFKLFYYFFFLHFFFLFFIFF

SEQ ID NO: 146737 - protein, 44 aa, Triticum aestivum
  Clone ID: PAT_TA_41155.pep
FVRIRRYHLVCSSARDRRLHLPPAYSPATCAWLARHPQQYVRLV

SEQ ID NO: 146738 - protein, 51 aa, Triticum aestivum
  Clone ID: PAT_TA_41156.pep
RTRGSKCQFYVCPSLQWAASMPMMEGDHSSQDNGSCGVQSHYSEMGGHVCH

SEQ ID NO: 146739 - protein, 60 aa, Triticum aestivum
  Clone ID: PAT_TA_41157.pep
HQKHTEVTYCNHPSPETFSLEQVHLRKVSMSEQNSRAIPSRLSATCHCNPHTHQHYSSSM

SEQ ID NO: 146740 - protein, 49 aa, Triticum aestivum
  Clone ID: PAT_TA_41158.pep
HACRGRSEQDFAHKSAPAASSGHRVARLIEIIWVGMTILNVLGATIVVT

SEQ ID NO: 146741 - protein, 103 aa, Triticum aestivum
  Clone ID: PAT_TA_41159.pep
SPPSHLLPPAQPPPTSPPPSTAGDARGSCLRCQSRTAACLSLLPCQPTTPERDARGSPVPGDLPPPAPPSPDPLSFPAGAALPQSTFFPRRCRPPPIHLFPLP

SEQ ID NO: 146742 - protein, 40 aa, Triticum aestivum
  Clone ID: PAT_TA_41160.pep
SLVMDLVLITLKVLRKGLTICAPRRYLLASDRTQPQVQDG

SEQ ID NO: 146743 - protein, 88 aa, Triticum aestivum
  Clone ID: PAT_TA_41161.pep
RHAPHAISTRSVRTDPLSPSPAMSSSSDNPNTVTDRGLLQQEQQGRRRLHEEEARGEDRGGGGRRRVHRQGQGLHPRHRREDLGGCGV

SEQ ID NO: 146744 - protein, 81 aa, Triticum aestivum
  unsure (1)..(81): unsure at all Xaa locations
  Clone ID: PAT_TA_41162.pep
AMLSTAMAPLQGGMLEFSRLRSSSSMPIRRNATSDDSMSAVSFKTYAVSTSXNHERRQTEAKLKVDEQQTPASSGTHSCGT

SEQ ID NO: 146745 - protein, 70 aa, Triticum aestivum
  Clone ID: PAT_TA_41163.pep
KKTRRTSSPCLPGHRTLTLSPCKSGTPRMIVEPPSSTAGPQSAVTPFGHIEREVRDVLQLCSLAFPFLNP

SEQ ID NO: 146746 - protein, 75 aa, Triticum aestivum
  Clone ID: PAT_TA_41164.pep
GLGRESVVGEEGLAFLGRLVTVGRGREGGRGAVGRRGPVAASSSGAAVGVAGHGRAIARRRCSRNWLGPGNNRGG

SEQ ID NO: 146747 - protein, 38 aa, Triticum aestivum
  Clone ID: PAT_TA_41165.pep
LPISSVTPRLLGRLIGGLVRAVMAKTYPVVSVEYYEAV

SEQ ID NO: 146748 - protein, 46 aa, Triticum aestivum
  Clone ID: PAT_TA_41166.pep
MMDPSTAYLLDELTDDCCSDYRNLMASAEHVDFHTCCLYASQLKRR

SEQ ID NO: 146749 - protein, 52 aa, Triticum aestivum
  Clone ID: PAT_TA_41167.pep
CGGGSASSSCAGCCCRGRARRLRHPTHSTLRLAPFINFFVHYFNHPTLFECY

SEQ ID NO: 146750 - protein, 45 aa, Triticum aestivum
  Clone ID: PAT_TA_41168.pep
DAWAGVLFAYHQLHILCSGMKDGSGHAYRGRNHDEQVKSVPSPAL

SEQ ID NO: 146751 - protein, 40 aa, Triticum aestivum
  Clone ID: PAT_TA_41169.pep
VQGEEGGGSGGGWSFAGLIKTLAEDLPPRDEQEASEDEDD

SEQ ID NO: 146752 - protein, 104 aa, Triticum aestivum
  Clone ID: PAT_TA_41170.pep
IGSSAHQRLSMLRSGLGNQLANKSRNLNLRSTTFLIQLGTSKPNGKSLCGLQMAMLTTRRPRCWRGTSTRTGIYCRICMIYMTKDFPYIIYLCRGVFFFCIFSL

SEQ ID NO: 146753 - protein, 66 aa, Triticum aestivum
  Clone ID: PAT_TA_41171.pep
FLKLEEEVVIPTTFKCAITYDLLFKPVVLVCGHTFLFLSIAEHMSILVDTLCSLCMTHVAHFSKIC

SEQ ID NO: 146754 - protein, 89 aa, Triticum aestivum
  Clone ID: PAT_TA_41172.pep
MATRLAISYDLRSAFRIRAVFSSPCPRAPFHRPYPAGLLLNRAAAYSLYVAAHAAPDTPTPTFDKHTGTKITDEFTGAGAVGEECQVIG

SEQ ID NO: 146755 - protein, 59 aa, Triticum aestivum
  Clone ID: PAT_TA_41173.pep
LTPTQIWRLEKIEIVILCRFLYLLIFPVWSIVSWLYFPCMLRGTRRWLCSWFRCLSPST

SEQ ID NO: 146756 - protein, 49 aa, Triticum aestivum
  Clone ID: PAT_TA_41174.pep
QQKSTKLKLNARAYALYICIATDDNNELDDKCSTHVVAVLINPGMLIMP

SEQ ID NO: 146757 - protein, 79 aa, Triticum aestivum
  Clone ID: PAT_TA_41175.pep
RTRGPNSSRFLSPCLLVLPLQGDRRRGISTWAFSYQLNQSHGAQGDRLSFLWGTYPMRQLLEDFLAVLAIHEHVSPCAT

SEQ ID NO: 146758 - protein, 55 aa, Triticum aestivum
  Clone ID: PAT_TA_41176.pep
DVSNWPNPTRLSKRARSLPLSVSWMCAWCRLGFMRVRLALLLAPPCSTEHSYNRY

SEQ ID NO: 146759 - protein, 42 aa, Triticum aestivum
  Clone ID: PAT_TA_41177.pep
NRLIPVAALPYGHLDPYPANWKLLEMRQRRCLLGTHASAHAS

SEQ ID NO: 146760 - protein, 112 aa, Triticum aestivum
  unsure (1)..(112): unsure at all Xaa locations
  Clone ID: PAT_TA_41178.pep
RTRGVIPNIGSCSSQNPGLPATERVAKPHLRWPLHVLPLAWLQQXALEEHIRDSRPRISGWLTSRPTXATFSEAAGKALDLIKPSSRGRATIYGVPYMXHLSVSELRDFVNV

SEQ ID NO: 146761 - protein, 54 aa, Triticum aestivum
  Clone ID: PAT_TA_41179.pep
MGNELGYGETKVRIKRLDRIWRIASASGFKCNSTCLEALSSGNPAKEHINPWMD

SEQ ID NO: 146762 - protein, 104 aa, Triticum aestivum
  Clone ID: PAT_TA_41180.pep
MGLPNQNTVDYLSFKLVIVGDGGTGKTTFVKRHVTGEVEKKYEPTIGVEVHPLDLTTNCGKIRLYWWDTVVQEKVGGLRDGYYIQGQCAIIMVEVTLRLTYKYV

SEQ ID NO: 146763 - protein, 69 aa, Triticum aestivum
  Clone ID: PAT_TA_41181.pep
PPWVHGVSIQNFAVFGIHWANLGLGVRTVQPPPGGVVVKEAFLAQQPGGMPAANKIGFRMGSPSFATAA

SEQ ID NO: 146764 - protein, 41 aa, Triticum aestivum
  unsure (1)..(41): unsure at all Xaa locations
  Clone ID: PAT_TA_41182.pep
SVPLPDSWELGCNFTTXIILGGYXAIMTVIFFWDAYKDKLF

SEQ ID NO: 146765 - protein, 99 aa, Triticum aestivum
  Clone ID: PAT_TA_41183.pep
RKVTMASSINIPTHNGRGNPGGAGGDRPAGVVGLGTGKPAQLVAQGGFPGLLFRGNKKGQLNGLKANFGKVLGMAGIGRGFFQQTKQMVGWQPGIVLDA

SEQ ID NO: 146766 - protein, 104 aa, Triticum aestivum
  Clone ID: PAT_TA_41184.pep
VIPPLDTVERVPPCTAARRERKLEDYFSGRVVQPARIYTREIAPSRTGATPTHNVRGLSTAYGTGAGTITCGGHTSDTHEEVSPQEIDRDSRRFFAYDQGPKAV

SEQ ID NO: 146767 - protein, 130 aa, Triticum aestivum
  Clone ID: PAT_TA_41185.pep
VTGETSWEIPNGLASVGAADGVTSASVPTHMGYSVEAQAHVLPHSNVEAYPSDVSVGNGTATYTAMGTYTHDPYAYTGAVASHGRVDIDPLQLAKYGEDLLQRLKLLERPHVAIDSLELIKREIEIRIAD

SEQ ID NO: 146768 - protein, 59 aa, Triticum aestivum
  Clone ID: PAT_TA_41186.pep
YRSHWLNFSILILRALQKLKRMYDTTGTLKGLVVIHVLARAQKPTLLWKLTMRRLLLTL

SEQ ID NO: 146769 - protein, 103 aa, Triticum aestivum
  Clone ID: PAT_TA_41187.pep
MSKLSTDALKEAITQVVADAKEKNRKFTETVELQIGLKNYDPQKDKRFSGSVKLPHVPRPKMRVCMLGDAQHVGEAEKIGLDSMDVEALKKMNKNKKLVKRLG

SEQ ID NO: 146770 - protein, 88 aa, Triticum aestivum
  Clone ID: PAT_TA_41188.pep
MEASEEEGEDVVVGQMPTFMVPKHINKRALKNKALSVSLDKKALKDFVTGFHKRKKKRRKEAQRITQEKDRRKRIEARKKRKQEKEIA

SEQ ID NO: 146771 - protein, 42 aa, Triticum aestivum
  Clone ID: PAT_TA_41189.pep
SITPVDSFFQYITNIRGSSPRWVQLHQHFSLLYSLTTAYKVH

SEQ ID NO: 146772 - protein, 59 aa, Triticum aestivum
  Clone ID: PAT_TA_41190.pep
GRVKQLGVLLNLYTHIGVERTIVTDAIIIFVSCKLYKIFSNNSYTYALVCICNVYHRKL

SEQ ID NO: 146773 - protein, 50 aa, Triticum aestivum
  Clone ID: PAT_TA_41191.pep
TTRSCSRGRLTANDSLEPAHLVWRPYITLTGIGLDSTEVTLHTMRSTQLI

SEQ ID NO: 146774 - protein, 98 aa, Triticum aestivum
  Clone ID: PAT_TA_41192.pep
LSWCRPTPDLESRRSAPDAGDLRQIRLDRERGSAHPAAPRASGKRPRRESGGARGREAAEGRTGSGAARVEGAPEGVPGGGLWRARRPWRSLVQGREK

SEQ ID NO: 146775 - protein, 123 aa, Triticum aestivum
  unsure (1)..(123): unsure at all Xaa locations
  Clone ID: PAT_TA_41193.pep
PNATLQAHLLAAHARHRRPAPAAHARRHRPAPAVPRPSASSSLCPSAPLPGSXAPSASSPRPXTPPPRLAQAPTPPSQCPGCYSLCSSLDTAPPPPPPPPPPPHKYPSPLQMRWSKKKAIFGR

SEQ ID NO: 146776 - protein, 121 aa, Triticum aestivum
  Clone ID: PAT_TA_41194.pep
RTRGSGGNPKAAAALVPDFQRAFEHMCIHSGGKAVIDTVAKLLGFAPAVVEPARATLHRFGNTSSSLVFYELAYFEAKRRVRAGDRLWMLAFGTGFKACIVVWRALRDYGPVADIPWIGCA

SEQ ID NO: 146777 - protein, 75 aa, Triticum aestivum
  Clone ID: PAT_TA_41195.pep
ARWGGELGCSSGDESLVWCVGEESLLDPARGLRCDHGGSGGGGRGLRHAGAFHGRTRAAGRILRRPMLSACFQDF

SEQ ID NO: 146778 - protein, 75 aa, Triticum aestivum
  Clone ID: PAT_TA_41196.pep
MQIFVKTLTGKTITLRVVSSDTIDIILAMIPDQVGIPSIQHDPIYAVKHMKDGRTRSEHNMHKVFTTLATLLLKC

SEQ ID NO: 146779 - protein, 75 aa, Triticum aestivum
  Clone ID: PAT_TA_41197.pep
ILVAAPTPMCSSITIPNKRTPSMLLSLRRASASMVGSCTTRLVTSSSERHALVLEHRMARTASGDVKKMWRKPAG

SEQ ID NO: 146780 - protein, 121 aa, Triticum aestivum
  Clone ID: PAT_TA_41198.pep
AGGMHGAGDERRLWASESSCRRGCWPDPEHGPETGRAARSGDGKRAPGRPSMAVLTDTGSGGGRGPWRAPAGHAVGSSSRRIETERRRPPLPGSLDLAPQSLGRPEDRRREERWGVWHGRN

SEQ ID NO: 146781 - protein, 90 aa, Triticum aestivum
  Clone ID: PAT_TA_41199.pep
MIPLKPSSTSSCRVAPRTLLPSLHPNCPSSIIHSFSSFTPKLPPPFTSSPFSYKCLVSGFSLFASLRNNTFQLCAVLGRCSRSLSLHLSF

SEQ ID NO: 146782 - protein, 51 aa, Triticum aestivum
  Clone ID: PAT_TA_41200.pep
EKKEEDTILHSFSAQLIILFHPMTYALLPRRSHQLHIQYIQTHADSHLLHI

SEQ ID NO: 146783 - protein, 74 aa, Triticum aestivum
  unsure (1)..(74): unsure at all Xaa locations
  Clone ID: PAT_TA_41201.pep
MGRGWVELXRLYNKINRQFTFAKRRNGLLKKAYXLSFLCDSKVSLIVFSNLCKLYEFCSTQSMTKTLDMYQKFN

SEQ ID NO: 146784 - protein, 57 aa, Triticum aestivum
  Clone ID: PAT_TA_41202.pep
PSSRRAVGRVDLAYSLDSSLDFRYLKLELGSYVARLIMPLGTCNSNPMSGPQTQILI

SEQ ID NO: 146785 - protein, 104 aa, Triticum aestivum
  Clone ID: PAT_TA_41203.pep
ARLGRRGRRRRRSRRQDVEDAAAGGGRGGRRHRVRCGGGGGVRAGGSHGQRQRRGRLKRQRLLHVPRQQAPADWPESSPHRLRAVPHGRRSPGYTGLILSKAFP

SEQ ID NO: 146786 - protein, 69 aa, Triticum aestivum
  Clone ID: PAT_TA_41204.pep
AFFLLHESTLLAIQLISNKPKHVYTKKEVQRTPPLCQIVAIHKMMPRPRERAPLRNRHKIDSRLRPMRA

SEQ ID NO: 146787 - protein, 115 aa, Triticum aestivum
  Clone ID: PAT_TA_41205.pep
DAWADAWDPFGGITGAGKTCIVWTTIQRAKGAQDLGLSIELLPLSRPDEDFNMSLFYANLIGLEGDEVLQYVPSAGEKLEDMTDQLRKRMMKKRKVKTLSFAITNDVCIEVNTYA

SEQ ID NO: 146788 - protein, 57 aa, Triticum aestivum
  Clone ID: PAT_TA_41206.pep
WLGSANNSLLGSIKGICRATSFSPGTSIPGNSRDCSSSAISPPAEYVDHLNPRFIMQ

SEQ ID NO: 146789 - protein, 57 aa, Triticum aestivum
  Clone ID: PAT_TA_41207.pep
YCMMNQGNKWYAYTARRENAPKERSLIYTGIDVPRGKKKALHVPFMLTRRLIEAHQA

SEQ ID NO: 146790 - protein, 58 aa, Triticum aestivum
  Clone ID: PAT_TA_41208.pep
GFYCLLPQSGAEYSVMKVTHAFLSKLKWGGSYFKNYHTVGVPTTQMRFTYIELRAIHI

SEQ ID NO: 146791 - protein, 82 aa, Triticum aestivum
  Clone ID: PAT_TA_41209.pep
VANPILQVGPTIRALKPALLISLTCIDPDSENIPKIAQVSRMLEHLEVPFRQDRRNRRSLTRSMDMELISEGSTSAEFANQR

SEQ ID NO: 146792 - protein, 114 aa, Triticum aestivum
  unsure (1)..(114): unsure at all Xaa locations
  Clone ID: PAT_TA_41210.pep
DAWGRFKLLFLNGILPAGTGNDLARVLSWGGGLGVVEKRGGLFSVLKDVEHAAXTVLDRWKITIKDNQGKLMCSPKFMNNYFGVGCDAKVALDIHNLREENPERFYSQFMNKVL

SEQ ID NO: 146793 - protein, 68 aa, Triticum aestivum
  Clone ID: PAT_TA_41211.pep
KRVMKTTFSHRHRVDAHKNAILRSQRNLILPVLSPFMTEKTGGIHCPNTSVILQQVYRVYFVDSTRSK

SEQ ID NO: 146794 - protein, 64 aa, Triticum aestivum
  Clone ID: PAT_TA_41212.pep
PKIEIDPSYGEMVNPQQWLKETTNVHTTTQQAYSISSPLCYYWTGVVKLTAGTGSGQDGVQIPP

SEQ ID NO: 146795 - protein, 90 aa, Triticum aestivum
  Clone ID: PAT_TA_41213.pep
GVTCNRLTALAHWMLGKLGVALGPKPSSDAHKARERQTLILILRHRLKYALTYPGVQSILMQRHIMVDGKVRTDKTFPAGLMGIIFISKT

SEQ ID NO: 146796 - protein, 64 aa, Triticum aestivum
  Clone ID: PAT_TA_41214.pep
GGGVADPHRRRRGFPPLTFAGASRTRRVSSVVLFPAGDPHPKKEGREEGSNLSCCKIIILHFLL

SEQ ID NO: 146797 - protein, 68 aa, Triticum aestivum
  Clone ID: PAT_TA_41215.pep
VQPAATAPRKQLATKAARKSAPATGGVKKPHRFRPGTVALREIRKYQKSTELLIRKLPLQRLVREIAH

SEQ ID NO: 146798 - protein, 61 aa, Triticum aestivum
  Clone ID: PAT_TA_41216.pep
CKKESYISIQCSKGTEHARVDRNKSYLGSSTTSQATLMDNNPPMFMNLRLSKIASASSKLD

SEQ ID NO: 146799 - protein, 74 aa, Triticum aestivum
  Clone ID: PAT_TA_41217.pep
ASSLVASTTTGAGASTSASTGAGTSSVLATSSAATGVSTAGASSVSAAVGFWTSAVAIAVVDARHMPGLPVPVV

SEQ ID NO: 146800 - protein, 53 aa, Triticum aestivum
  Clone ID: PAT_TA_41218.pep
ASPPLTVRVYFFDSPSLPGSGLITYPTLPQSYTASMPPGGKQGRGSPMSYLYI

SEQ ID NO: 146801 - protein, 33 aa, Triticum aestivum
  Clone ID: PAT_TA_41219.pep
FQTPFNRKYLSSTRNNNTLKSLNPLRLILHGLV

SEQ ID NO: 146802 - protein, 48 aa, Triticum aestivum
  Clone ID: PAT_TA_41220.pep
FCRCTFHLTCDIHERTHSTLLASEITEVAKCPLVIKKKNRAVVLDDSS

SEQ ID NO: 146803 - protein, 38 aa, Triticum aestivum
  Clone ID: PAT_TA_41221.pep
VLPGQQLFNWGKCIDLRYLDTKHIRWDGGARKLESSTV

SEQ ID NO: 146804 - protein, 105 aa, Triticum aestivum
  Clone ID: PAT_TA_41222.pep
GWIGSGRATPPSARPLRPQRPPLPQRSTRPPRRPPPPLPLAAPAPTQNFTQLVFLRSPQISSRRRVLKLPSSAWLCSSHIWWWPVACTLGALSPLLSLRFCPRVR

SEQ ID NO: 146805 - protein, 60 aa, Triticum aestivum
  unsure (1)..(60): unsure at all Xaa locations
  Clone ID: PAT_TA_41223.pep
SFYLDDIILVAKGSLIIKVMLLGKWPLVIKQNPIVLVFWKRYIIESVGVRVGVGRHLXFR

SEQ ID NO: 146806 - protein, 54 aa, Triticum aestivum
  Clone ID: PAT_TA_41224.pep
AFSLLHLFIQTQFFCCCGEEDHKLFHTYSLPSLKKKKKFFPSNSIQVNLRVHPT

SEQ ID NO: 146807 - protein, 113 aa, Triticum aestivum
  unsure (1)..(113): unsure at all Xaa locations
  Clone ID: PAT_TA_41225.pep
TWQQLSMKGFAGDTAKARAKTSMIAGEGLSNIRTVAAFNAQDTILALFCSELCAPQMHRLRRSQIAGVLYGLSQLSLYASXALILWYGAHLVRHHVFAFFRVIKVFVVLVITG

SEQ ID NO: 146808 - protein, 57 aa, Triticum aestivum
  Clone ID: PAT_TA_41226.pep
TTTHKFLFLPHKQSALDKFYYPPLISYFTFKPPYSILKTFPSNKITFFYLKPTILKS

SEQ ID NO: 146809 - protein, 55 aa, Triticum aestivum
  Clone ID: PAT_TA_41227.pep
NINITVPETILNWCFAKNDQPGFGTCYHIGFGIKKDGLDLVAGRIHVIQIAEADL

SEQ ID NO: 146810 - protein, 91 aa, Triticum aestivum
  Clone ID: PAT_TA_41228.pep
RSRKGRAGVPRGSRYLSSPHPALVTANLQMARHLLRLGEEGRPLSQIYGPGCEHQRRAITARVGRGLYRCGGNPPPLFLGMKRKIKQLKEW

SEQ ID NO: 146811 - protein, 35 aa, Triticum aestivum
  Clone ID: PAT_TA_41229.pep
NMVDIIEGKRQCSTINIHNGVHHMITSISKGLRLG

SEQ ID NO: 146812 - protein, 51 aa, Triticum aestivum
  Clone ID: PAT_TA_41230.pep
NHVNSFQQLNHQLTVIKSNSNKVNAIAGYKQCSTTGIHNAVHRIITSISSV

SEQ ID NO: 146813 - protein, 48 aa, Triticum aestivum
  Clone ID: PAT_TA_41231.pep
HQLDLIFYGGTARVTSNDQFRITHVIANERIGRACPQRFVDLQTVRWI

SEQ ID NO: 146814 - protein, 84 aa, Triticum aestivum
  unsure (1)..(84): unsure at all Xaa locations
  Clone ID: PAT_TA_41232.pep
PRXLCTITRTTLHNNGNNYARANSNLSRLTPLHESSKVAIYIKMKTSLYFKIIFTYTPKITITLIHMHPTLLPKLQTVAHDTSK

SEQ ID NO: 146815 - protein, 57 aa, Triticum aestivum
  Clone ID: PAT_TA_41233.pep
GRVGDKGDLITANEVSPSCDFYRKTVSIHKRGIIFSFKRMSMESKLRFKLKNFTNAS

SEQ ID NO: 146816 - protein, 51 aa, Triticum aestivum
  Clone ID: PAT_TA_41234.pep
KKERKREGVSVAMRTLSLSIIAVFHRCSMPCLSLYVEETDAAASKPPDAWA

SEQ ID NO: 146817 - protein, 71 aa, Triticum aestivum
  Clone ID: PAT_TA_41235.pep
RLPKCSSWAAHACIFIHSGVIMDLLSTTIIKVLMYTMDPCIRHPDQIALIANHNCFCTHLTISLTQSPCYA

SEQ ID NO: 146818 - protein, 35 aa, Triticum aestivum
  Clone ID: PAT_TA_41236.pep
PFSSYQKHCLTQLHTHNYSTATYPLIHSRHMMYTL

SEQ ID NO: 146819 - protein, 78 aa, Triticum aestivum
  Clone ID: PAT_TA_41237.pep
RVGSGGVSVGSSNLPVGVSFIHQRLFILLISTSMWFRNTAFSYSLIMIFFFFTSFFSNFYHFFHFFLFFYLLFFFFHF

SEQ ID NO: 146820 - protein, 75 aa, Triticum aestivum
  Clone ID: PAT_TA_41238.pep
LTHRQTPRSVLLRHLTLRLVCDFITLPIKFAAASTKLFYFSFYYSSRFLYLLQQVINKNGSSIIIISIRCQAVVI

SEQ ID NO: 146821 - protein, 59 aa, Triticum aestivum
  Clone ID: PAT_TA_41239.pep
QFIFFCRSQLLLNTPAHLIEEIPLLCLIKINVKYVSTKTNYNLFFLVSTDVDYEILGPE

SEQ ID NO: 146822 - protein, 77 aa, Triticum aestivum
  Clone ID: PAT_TA_41240.pep
PTHTKTHSTNTSISLGAGFLLDYLITHLHLFTINQHLANPINLSDITDMLLIYSLPYLLFFIHITLSSSLFVFNHLL

SEQ ID NO: 146823 - protein, 142 aa, Triticum aestivum
  unsure (1)..(142): unsure at all Xaa locations
  Clone ID: PAT_TA_41241.pep
RTGTVCPARPTHTTKAVTKPVEEFMINHRGAKTTRVTHAIHNYQNHTFKSKIESXPPGTATRNSGAXDGRRKLSNLLKQQGVHSKRAPKSSPPPNQEVPPFLXPRGRLAVYYTHGNTRTSLPKEGNGKFYTGDCYIWLYTYH

SEQ ID NO: 146824 - protein, 51 aa, Triticum aestivum
  unsure (1)..(51): unsure at all Xaa locations
  Clone ID: PAT_TA_41242.pep
PTHTXPPQHLNTLTIQNPHTSLPGFFTGPPSTHSHFSTIPHPPPSSISTLL

SEQ ID NO: 146825 - protein, 50 aa, Triticum aestivum
  Clone ID: PAT_TA_41243.pep
WRKGSRHEIYCLERVCVSNVEKEAFWKVPVIALDIPSMKGMSTCPCMAIS

SEQ ID NO: 146826 - protein, 84 aa, Triticum aestivum
  Clone ID: PAT_TA_41244.pep
RWWYDSHEHGWTGPSVFDWAWPYSSLLSPVLLFQIPGKGRIMDFVCFQTSVVGMLIHSDILLRPHHHFASRRPLSSLFCLTSYC

SEQ ID NO: 146827 - protein, 47 aa, Triticum aestivum
  Clone ID: PAT_TA_41245.pep
RPRVRWTVVPKTDKGKGKALPAYKDKFISKMFTTPGISYIIILRNPK

SEQ ID NO: 146828 - protein, 57 aa, Triticum aestivum
  Clone ID: PAT_TA_41246.pep
PYIILLQSRTPTQYDLYSMILYHSNVSRTIASSEHSNFFKVTIPKTRSVPLKLAAPS

SEQ ID NO: 146829 - protein, 105 aa, Triticum aestivum
  unsure (1)..(105): unsure at all Xaa locations
  Clone ID: PAT_TA_41247.pep
MLQVKTWAXVHGVNSPTAQTMSSMSIICLVDFHLQRXTRHATILPAFSALLKDGSDFASVEKNISLFKGFGSTNKELVAELFVTLMNKLLSVESLWEHGLCASNF

SEQ ID NO: 146830 - protein, 64 aa, Triticum aestivum
  unsure (1)..(64): unsure at all Xaa locations
  Clone ID: PAT_TA_41248.pep
KLDDALAASFIAPQQDSLEDDNQLTIDEYXRSWELNXELGLNDMNTSSAYMAYNTTSTSKSLLV

SEQ ID NO: 146831 - protein, 48 aa, Triticum aestivum
  Clone ID: PAT_TA_41249.pep
LRTKSVAHKMLLSAEQMHVTWVAYALLFQHCEIFGRSGTCTTSMPPGV

SEQ ID NO: 146832 - protein, 58 aa, Triticum aestivum
  Clone ID: PAT_TA_41250.pep
STMTLLNWTLTLLALDISWACAPKGSSHCLYSVRLKCLVRPPLSSFPNGRWSESPTRP

SEQ ID NO: 146833 - protein, 102 aa, Triticum aestivum
  unsure (1)..(102): unsure at all Xaa locations
  Clone ID: PAT_TA_41251.pep
FTYLDNXVVCHGGSMAETLQHAQKLEMSMHGLQDATDDSFSFFGPEDVGDVEKYQSRERHHMDFSEHWKSRGSQKILMISPILLSLDHAMYRKVSCRTPRVR

SEQ ID NO: 146834 - protein, 68 aa, Triticum aestivum
  Clone ID: PAT_TA_41252.pep
GRVGEDKLEFSKILEAIKANFNDKFDEVRKKWGGGVMGSKSQDRLKGKLHGICSDNTYRARLSSSSAQ

SEQ ID NO: 146835 - protein, 71 aa, Triticum aestivum
  Clone ID: PAT_TA_41253.pep
ACLKKKGQFVLQFHENLLMRCYCTGTKNVMVFFFLFRSPPTYELRLWAWQNVTIIFVQQLDFIPRRAISLI

SEQ ID NO: 146836 - protein, 82 aa, Triticum aestivum
  Clone ID: PAT_TA_41254.pep
HRPSQIKEALFVVNIVIGQILLLGQILLFSIETMAYNMLDAINNGKDSWKVKVRVIRLWDAINLNNNELISPDMFLVDEQGT

SEQ ID NO: 146837 - protein, 34 aa, Triticum aestivum
  Clone ID: PAT_TA_41255.pep
GRVGFFFFFFFFFFFFFWFFFFFFFFNSAYDLIL

SEQ ID NO: 146838 - protein, 118 aa, Triticum aestivum
  Clone ID: PAT_TA_41256.pep
MDMAMRCFEEMQKGGCQPDVATYTCLLGGYGNARRMDRGTAMLEEMAQKGCPPDGRTYNALIKLVKNRNIPDDAVRIYKKMINKGLEPTVHTYNMMMKSYFLGGRNYAMGCSLWDEMH

SEQ ID NO: 146839 - protein, 74 aa, Triticum aestivum
  Clone ID: PAT_TA_41257.pep
KREFDENLLKKVFELLYENELLDLPYAPDVGDYLVSEDPNFPTSNKDPAPIPDGMSGTEVEKRLNGPAYQGDPK

SEQ ID NO: 146840 - protein, 131 aa, Triticum aestivum
  Clone ID: PAT_TA_41258.pep
AVPAIDCDCGNPKAPKPSHPPKTKPPTKGPKPGPKGPTYPSPAPKGHLPHPPVVGPPKGHVPRPPVVGPPKGHVPHPPVVGPPKGHVPRPPVYGPPKGPITRPPVTAPPVVVGPPVTYPTPSVTAPPVTYP

SEQ ID NO: 146841 - protein, 80 aa, Triticum aestivum
  Clone ID: PAT_TA_41259.pep
WNCRAICTRWGNNAVCSWLTLRLRSATVCERGGKEDGEAGAEAHLEEHRRDVSGGHGSPSSFPEMAVPLPFLWLALCARA

SEQ ID NO: 146842 - protein, 132 aa, Triticum aestivum
  Clone ID: PAT_TA_41260.pep
DRGDSNVRYGWLGSTKSDIVRILINGFGNTGKPAEKACLSAGVYLSPEDRAFTSVGLCDVDEKAVQYMLLCRVILGNMEAITPGSQDSFPSSEIYDSGVDDCSNPKCYVMWPSHLNTHIRLEYLGSFRLSPK

SEQ ID NO: 146843 - protein, 127 aa, Triticum aestivum
  Clone ID: PAT_TA_41261.pep
GGVSQLGLTAVAVGCRDLEYIAAYVSDITNGALESIGTFCKNLYDFRLVLLDRQKQVTDLPLDNGVRALLRSCTKLRRFALYLRPGGLSDIGLDYIGQYSGNIQYMLLGHVGESDHGVIRFAIGCIN

SEQ ID NO: 146844 - protein, 130 aa, Triticum aestivum
  Clone ID: PAT_TA_41262.pep
DVSEANSGTSSESTSQIANDKDIRSSIQETGLAVSGITPGMLPVNHSVASEGQVKHADGAKDESSTEQSSAAPTGSVRPLSREKPTAELTRTKSAAGRKKKRKEMLSKADAAGTSDLYNAYKGPHEQSDS

SEQ ID NO: 146845 - protein, 83 aa, Triticum aestivum
  unsure (1)..(83): unsure at all Xaa locations
  Clone ID: PAT_TA_41263.pep
MGERAKGTVXRFNVTNGFGFIYPHDGGEDLFLHQLSIKSDGYRSLNENNSRDFEIITGDDXRTKANVVSPPXGGALSGRSRPV

SEQ ID NO: 146846 - protein, 78 aa, Triticum aestivum
  unsure (1)..(78): unsure at all Xaa locations
  Clone ID: PAT_TA_41264.pep
GRVGKDDAFYRYKMPRMLTKLEGRGIGFKTIFGTLVVLAKALARPVSXQTNSFDXEAGAQSKFDEKTGIFLVNGAHDT

SEQ ID NO: 146847 - protein, 116 aa, Triticum aestivum
  unsure (1)..(116): unsure at all Xaa locations
  Clone ID: PAT_TA_41265.pep
LPLSLRKQTAPQLQYLVDQMANKLPKWRAALMPKSGRLTLVQSVLCAMPIHAMMALDLPIKTIEAMIKICRGFLWCRRMEAKGGNCAVAWDAVCAPKWAGGLGLPNXRWMNVAMQS

SEQ ID NO: 146848 - protein, 106 aa, Triticum aestivum
  Clone ID: PAT_TA_41266.pep
ISAIAVRVLPHRNIVPLRNICPVGSKAIPGMLLALVLSFDHRKSKGVAVPSDLSPSSKRRKYVWFALTGYGVGLVTALAAGILSQSPQPALLYLVPSTLGPIVYLS

SEQ ID NO: 146849 - protein, 32 aa, Triticum aestivum
  Clone ID: PAT_TA_41267.pep
PTRTPTRPFFFTEPVVGYHNCKAASYTGTSLS

SEQ ID NO: 146850 - protein, 39 aa, Triticum aestivum
  Clone ID: PAT_TA_41268.pep
PRVLPRVLFFLLNQHGGVTIARLLATHGLVFYDQKKLVS

SEQ ID NO: 146851 - protein, 130 aa, Triticum aestivum
  Clone ID: PAT_TA_41269.pep
DAWDPNKVSTSNYCHRGFLARAAGLRTIVLLPFEAGVLELGAMQNVLESAEPMETITSVFLGASSKKPACGKHDEYGSTQISPGLAKISRKDSNLSRPLVNTGALPLKMNERSWDMHKNCGGESLSLHNV

SEQ ID NO: 146852 - protein, 135 aa, Triticum aestivum
  Clone ID: PAT_TA_41270.pep
GVRGGIERRALRRAWLSATKRCCFLAAHIDRSARDRTICGLSHWIRRGESHQQREGELDLRYIARLRQMQSRLVVGAGGGAQRGVGSGAGGRESWPEQFPAAGPGSTGKGRGRRRGVEGGRGWGHRCRVGGPRVR

SEQ ID NO: 146853 - protein, 132 aa, Triticum aestivum
  Clone ID: PAT_TA_41271.pep
RNSRRMSNQYVSERLRAPSGLLQLQGIASFPRSRPPLAFDGSSDSFGSREQLHTLYKLAKSMVQEGAAHLELGEGILWREDLQSCPGVVRAAADGDQRKGVAAEAGDDSMRTSGGDGRIPAGRAEMRGAAAA

SEQ ID NO: 146854 - protein, 67 aa, Triticum aestivum
  Clone ID: PAT_TA_41272.pep
FCKDEHFIHYLEITILPFFYSSRVYLFNHQTLHVSNYIHMIMKNSFFFFTFSMIFKLFKLNSPMHPC

SEQ ID NO: 146855 - protein, 98 aa, Triticum aestivum
  Clone ID: PAT_TA_41273.pep
MAKTCTLALLGALVVLSLLVSPIACSRKLAKVGGHHKPAPVKGHKNQTTTNPSSSAAYGGGWLPAGATYYGNPNGDGSDGGACGYQTAVGHPPFSSMI

SEQ ID NO: 146856 - protein, 108 aa, Triticum aestivum
  unsure (1)..(108): unsure at all Xaa locations
  Clone ID: PAT_TA_41274.pep
MSTSTAEGGGDDEGVDAHALIVPDILDRFRLAYQPALYKVVFISHMKRFMKNLTVKLDCDDLDVLKKNVXSSTKYFLNKLKDLYLFVGESIHYDTRFCAPRTTSSGAS

SEQ ID NO: 146857 - protein, 93 aa, Triticum aestivum
  Clone ID: PAT_TA_41275.pep
NKTSILIRSMFASQSTRVAVAQNIFTFSRENLAPIVFSGQQKARSLLKTRGSPTSLFKVGVSAYFLSSSQNLRLKNSREAQPHWPLEIGRLGH

SEQ ID NO: 146858 - protein, 115 aa, Triticum aestivum
  Clone ID: PAT_TA_41276.pep
MKPRDLPLSLLKNITGNFSEKRKIGEGGFGIVYRGALPNAEVAVKRIIKNVQTNDENLFRREVDSMMEVNHQNIVRFIGFCSNTEHKRIQHGVPGGYIYAEARERILCFEYISNG

SEQ ID NO: 146859 - protein, 115 aa, Triticum aestivum
  unsure (1)..(115): unsure at all Xaa locations
  Clone ID: PAT_TA_41277.pep
HPARERYACWIXGSPEPEYAVEACRARKMDLWGERVLWQAGEWGGGELREAGGIGAGGSCGGGGGCTAEQGSCAPELNRGAQAELRGYARSAGRRPEKTRSAGYVGNLGRDFLQK

SEQ ID NO: 146860 - protein, 41 aa, Triticum aestivum
  unsure (1)..(41): unsure at all Xaa locations
  Clone ID: PAT_TA_41278.pep
SVSRRCQSQPVLASYXVYQKVLGSYSTLETLFCRAKTPTRP

SEQ ID NO: 146861 - protein, 57 aa, Triticum aestivum
  unsure (1)..(57): unsure at all Xaa locations
  Clone ID: PAT_TA_41279.pep
XHYFLIFNFFSKTYIQTAFFKTTPSLQKYIQIYYIQIFTHILLFLLILYHHLYFSNN

SEQ ID NO: 146862 - protein, 52 aa, Triticum aestivum
  Clone ID: PAT_TA_41280.pep
ILTSVYNALPTYFRVLHQGRHLIPRMILHHLKEQDSADFFLLLLIGDLKNSV

SEQ ID NO: 146863 - protein, 131 aa, Triticum aestivum
  Clone ID: PAT_TA_41281.pep
TPVYGTPSPSCLCTPTGEPGCQCPTPTPTPVYVAPPTPELPPPTPVYAPPTAPVYGTPSPRCLCTPTPAPGCECPAPTPTPGYGTPTPTPAAPAYPRAAPEYGAPPAPEVPAGVRHAQFTLSSGHHLAPLM

SEQ ID NO: 146864 - protein, 67 aa, Triticum aestivum
  Clone ID: PAT_TA_41282.pep
MAPIKIGINGFGRIGRLVARVALQSPDVELVAVNDPFITTDYMTYMFKFDTVHGQWKHHEFKGKDSK

SEQ ID NO: 146865 - protein, 67 aa, Triticum aestivum
  Clone ID: PAT_TA_41283.pep
WPTQAKCEPMPPRGCASPLREEEQQFHQQQLQHRQGSCWISRAGRTDHPAEFSLAVEWNPRVRPRVR

SEQ ID NO: 146866 - protein, 72 aa, Triticum aestivum
  Clone ID: PAT_TA_41284.pep
PFVRVDEASLWNNVSQQREEDSLWHYTNNRTEWKLGILVRLEWAGCRNKQHGRELADWRLQFWESKDARLEG

SEQ ID NO: 146867 - protein, 72 aa, Triticum aestivum
  Clone ID: PAT_TA_41285.pep
DAWADAWFFLIEEKCMGPCARDEKNLKRVSYEDIVKATNWFSLVHTISLTCTGSDYVGRFKSDKSLFAIQSI

SEQ ID NO: 146868 - protein, 59 aa, Triticum aestivum
  Clone ID: PAT_TA_41286.pep
INFLKTRTGGERVWYYTNNIAILKGNLYKVTHITYLMRDLTIYLVIILVCFFRVKGYYR

SEQ ID NO: 146869 - protein, 76 aa, Triticum aestivum
  unsure (1)..(76): unsure at all Xaa locations
  Clone ID: PAT_TA_41287.pep
ISPLNIISVFWDIGIIXESLGSNLGARIFPNHLSTPTLGIGGRVDHSISTSDVRGSGWGGGLSILEDTWLVVACIG

SEQ ID NO: 146870 - protein, 53 aa, Triticum aestivum
  Clone ID: PAT_TA_41288.pep
AMYYYTCYKIPAAVISDRCHAILSTRFRTSAITHNSNSIRTAIIGFPQTPRVR

SEQ ID NO: 146871 - protein, 85 aa, Triticum aestivum
  Clone ID: PAT_TA_41289.pep
VTSPSRHVLSRPIPYPLAAGTLVEEVMHLMPHLPLNIFVAGSEVSRRELYLITTSSLRSLSGSDIVAVCVRWCCIGPVFRGDAFI

SEQ ID NO: 146872 - protein, 100 aa, Triticum aestivum
  unsure (1)..(100): unsure at all Xaa locations
  Clone ID: PAT_TA_41290.pep
KITARAMERTMKKIGHLSXFTFSSLTGGSSSVDALTPKMQKDTLDSFRSGKVNLLFTTDVAEEGIDVTDCSCVIRFDLPKTTRSYMQSRGRARQISNYFV

SEQ ID NO: 146873 - protein, 100 aa, Triticum aestivum
  Clone ID: PAT_TA_41291.pep
MGTDDHEFRLLTIPTPIHPEDPDSPLPETILIDSFGYLSDRTNATTANGRRSRTEKKGKRILVTFWPAAPPRVSCFTVHCPDLKADAYGSIPKVCYTEDG

SEQ ID NO: 146874 - protein, 45 aa, Triticum aestivum
  Clone ID: PAT_TA_41292.pep
KVVNGERVADLQSLQELPKIGCRHRGLHRPGAVAVEVRLVHAGPA

SEQ ID NO: 146875 - protein, 68 aa, Triticum aestivum
  Clone ID: PAT_TA_41293.pep
STRPEPLPPYPIGPIPGLRVPTPVAPSLYVFMVVARLLVSYKFFTWTEAWIFWVALLLYIISDALNDE

SEQ ID NO: 146876 - protein, 84 aa, Triticum aestivum
  unsure (1)..(84): unsure at all Xaa locations
  Clone ID: PAT_TA_41294.pep
MPDPAMHGVGGAITSGWEMGGMPMTYTFPSQTVPIEALASXALANSPPETQRIMLDKNLDPLDDQLGHDQASKVTGMLFEMDHT

SEQ ID NO: 146877 - protein, 49 aa, Triticum aestivum
  Clone ID: PAT_TA_41295.pep
ASSASPCSSTKRPSAYLEGGFRTSSFTPTPTPNTLVLRPVRSWTFNYLP

SEQ ID NO: 146878 - protein, 71 aa, Triticum aestivum
  Clone ID: PAT_TA_41296.pep
MGDPAVAPDAPYLEAVTQKRIRIFEEIQARQALERLNIGGDPIRVTLPDGAIKEGKKWISTPMDIRTGIST

SEQ ID NO: 146879 - protein, 45 aa, Triticum aestivum
  Clone ID: PAT_TA_41297.pep
HIHRIYNYMNMNPNACSIPYKEPIPHPPPPCTSYFLRLKPFVHET

SEQ ID NO: 146880 - protein, 126 aa, Triticum aestivum
  Clone ID: PAT_TA_41298.pep
PRVRPRVRTNRPDAVDQALRRPGRFDREIYLGVPDENARKQILERLTQKLRLPPEGQFDLLKIAKATAGFVGADLKALVDTAGSVAMKRFFNARKDKFLKEGNNLDYRKHPLDKHEMQGLSITMDD

SEQ ID NO: 146881 - protein, 132 aa, Triticum aestivum
  Clone ID: PAT_TA_41299.pep
PSYSSHSFVYLGRLSSKREEIVRGEGGVSGYNFSTHKLRIIITPFGLRLPHKQQSNSSSLTRLHNEIDDSSPASVSSEIISPKTQPGIIAQAAQVVATNDRGGGRRRTAGVRTAAGAGDCGVVLLQGVAEPA

SEQ ID NO: 146882 - protein, 56 aa, Triticum aestivum
  Clone ID: PAT_TA_41300.pep
APEERYEQYRKRPDFLTEYIFPGGCLPSLARVVSAMSKSSRLSIEHVENIGPHYYT

SEQ ID NO: 146883 - protein, 74 aa, Triticum aestivum
  Clone ID: PAT_TA_41301.pep
IRANLNALKQRPNPHGGLARVAHSSALAALYRIVPHSHGEALGVKIGCHPCSWAAPACLARVSGRDRPRRRIRV

SEQ ID NO: 146884 - protein, 130 aa, Triticum aestivum
  Clone ID: PAT_TA_41302.pep
RTRGVPPPRALPWSRSGHQQISSRACYFGGPHFFAAIGLWEAATGRLGAATGDGHLRDAAALETVTSGMLEPVVFFAATSCNFCWNWCVLFPWIGVGGDFLLEPSSIFAGTSDMFSAMGRIFGGTGVSFA

SEQ ID NO: 146885 - protein, 46 aa, Triticum aestivum
  Clone ID: PAT_TA_41303.pep
LYFGTNILYLVTTYFFDLYTKINFLFRYDFCIYYEGFLFVLVWFYL

SEQ ID NO: 146886 - protein, 48 aa, Triticum aestivum
  Clone ID: PAT_TA_41304.pep
TYMSSGYWITYLYVVLECAHMWLGYIICRCIIHAKWLCCCLLLWVPKR

SEQ ID NO: 146887 - protein, 62 aa, Triticum aestivum
  Clone ID: PAT_TA_41305.pep
QYTLLNASSSREKHRSWCSTYTYCNVTFRLHTASKFNHEGQCLVIHFPPVTSNFKVTFIRYS

SEQ ID NO: 146888 - protein, 50 aa, Triticum aestivum
  Clone ID: PAT_TA_41306.pep
HASWAAGGGCHFRGTPFLTSDALTLAFITLVSLLYFKDYTATLHPTYKPP

SEQ ID NO: 146889 - protein, 113 aa, Triticum aestivum
  Clone ID: PAT_TA_41307.pep
MSGPSCPTTVPVGEDTTVPLRMLHGLAPETLNLHTHTMLSFLYSFLPKPPVSTLAPLCCAATAAVADGSADRLSCLPDDLLRRVLSRLPAKDSARTTVLSSRWRGLWRSVPLV

SEQ ID NO: 146890 - protein, 103 aa, Triticum aestivum
  unsure (1)..(103): unsure at all Xaa locations
  Clone ID: PAT_TA_41308.pep
MSVRGKDDKVLGKGVYNRHLKVLYYNMQFFTKPSMHYMARRDXVKRMFALIYXETRCVHKIFLENVIANAVTYTEHARRKTVTDMDVKYALKRQGRTLYRFCG

SEQ ID NO: 146891 - protein, 111 aa, Triticum aestivum
  unsure (1)..(111): unsure at all Xaa locations
  Clone ID: PAT_TA_41309.pep
HPPRPPLAQLTTSGTRSRTRGSSSLPAASQLLEPSRATTARTTADPPPCARTQPHGVVEVGEGEGVIGVAGGGEAALDGXNVSTYTQLRVEFDRPIPDLKPACRSTNTWPI

SEQ ID NO: 146892 - protein, 133 aa, Triticum aestivum
  unsure (1)..(133): unsure at all Xaa locations
  Clone ID: PAT_TA_41310.pep
TSQPQPPLSLFSVPPPTSRAAPLPPPSRSGVPQPPFATWQAPSGQPPPAPPSTATPKPPRAFPAPPAAXGPRSPRGVRPGPRPGPXRAPWPPCLLAHSLARSPRCRIGPALRPPGASPEQEHPTFARPRSHHS

SEQ ID NO: 146893 - protein, 132 aa, Triticum aestivum
  Clone ID: PAT_TA_41311.pep
GSYSREIGNALLVGPAVSLRPRRPPPPHPPKAARLLPRPQVKIHPGVVPSFLGSNDFGQLGDGTEESAKEPKKVNALATEFVKSVSCGAHCTAAIAEPRENDGTISRSRLWVWGQNQGSDYPRLYWGAFAPN

SEQ ID NO: 146894 - protein, 91 aa, Triticum aestivum
  Clone ID: PAT_TA_41312.pep
MRECISIHIGQACIQVRNSCWELYCLEHGIQPDGQMPGDKTVGGGDDAFNTFFSETGAGKHVLRAVFVDLEPTVIDEVRTGAYRQLFHPEQ

SEQ ID NO: 146895 - protein, 94 aa, Triticum aestivum
  unsure (1)..(94): unsure at all Xaa locations
  Clone ID: PAT_TA_41313.pep
GISEKLPSRPNPHRLPWRFLDLGWRQQSSRSRPAGHSGVPGGAGHGGWWWGARCGXLGVQLADKLKILRRQLHPDPRAVQVPTMTEGNKTFGSI

SEQ ID NO: 146896 - protein, 130 aa, Triticum aestivum
  unsure (1)..(130): unsure at all Xaa locations
  Clone ID: PAT_TA_41314.pep
TPPPFPSPPGPLPLASPPPPSSTPWPPPRRRPRRSPATIWAFATAPTSPRSPSAAAPPAHSHLSPSSSTSPTPIPXPKPLTPSTARHLLPPVAVAPASPPAPVSPPAKPALQGAAIKPLLAFIATGVIIW

SEQ ID NO: 146897 - protein, 77 aa, Triticum aestivum
  unsure (1)..(77): unsure at all Xaa locations
  Clone ID: PAT_TA_41315.pep
MRSILMKGHXRPFTFLKYNRDGDLLXFLCAKDHTPTFWYAVNGDLLFTYRGHNCSVWCWNDLLFSSFVYQLFAFFFD

SEQ ID NO: 146898 - protein, 106 aa, Triticum aestivum
  Clone ID: PAT_TA_41316.pep
MAGHAKLLLYIVVVDESGASFRYTRSLLHSTLQLMGCKPRHAFEISRRVFDVVRGDPAEMEMLMAMSGSQGGRGVQRYELPDAATSPRQFQFELYKRRTTVLIPRD

SEQ ID NO: 146899 - protein, 118 aa, Triticum aestivum
  Clone ID: PAT_TA_41317.pep
PTRPVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLA

SEQ ID NO: 146900 - protein, 46 aa, Triticum aestivum
  Clone ID: PAT_TA_41318.pep
YTCLHTTLLYISLRGLGHSCKLKLSIKSFLYLFYLIQLSPTYLSIV

SEQ ID NO: 146901 - protein, 82 aa, Triticum aestivum
  Clone ID: PAT_TA_41319.pep
RVGLQRRWCAAFLLVPTRWLVCRPVTLVVGSHDCLLGYLPLSINPSRGMGNVLVLFLTESGSNKDADNFAADHLTIAGNCSL

SEQ ID NO: 146902 - protein, 52 aa, Triticum aestivum
  unsure (1)..(52): unsure at all Xaa locations
  Clone ID: PAT_TA_41320.pep
GXXRGDATPSILFWWSHPCVRFSHVRDPTCVRSLVPPTFLIFLQLLYFTELS

SEQ ID NO: 146903 - protein, 71 aa, Triticum aestivum
  unsure (1)..(71): unsure at all Xaa locations
  Clone ID: PAT_TA_41321.pep
FFVLYDLILFFLCLFDLFLSIYFFFSFILYSLYLFFIIYNYFFIYFYFXIFIFSLFILYFYIFYYFYIYYY

SEQ ID NO: 146904 - protein, 77 aa, Triticum aestivum
  Clone ID: PAT_TA_41322.pep
DAWAPLGCSFTHFRRRHPWEPESEADTLVSMRAKWKKKRMRRLIRILLMFMHLFKLVALYGGLAFFYIYFVLIFEGF

SEQ ID NO: 146905 - protein, 91 aa, Triticum aestivum
  unsure (1)..(91): unsure at all Xaa locations
  Clone ID: PAT_TA_41323.pep
LFXDSDXXGITIQTPLAQLGQXXLVDLGLKEGXXSRXXYAXNIPFSXXDXXLEXXPFLXTXXXSXRXXHXVXVXXTXPRKXFELKPRXVIX

SEQ ID NO: 146906 - protein, 126 aa, Triticum aestivum
  Clone ID: PAT_TA_41324.pep
LELGGKNCLVVSTVEDEEGSSVRPMCLAPCMPAGIGDPSSITMFSQSGPSRGSATLTSPEHIGGRIVSEILSFFRMGGYPTSSTCQALTCLFLSDPTTDSSQSISSMRQMDGSTAFTKPPRGRGRV

SEQ ID NO: 146907 - protein, 64 aa, Triticum aestivum
  Clone ID: PAT_TA_41325.pep
MAMDRVLCSMHVYLVLLAGSLFSLSFSYEEAKKLCTVIGINLYITYSCVGVYKNGYFYFYSSIV

SEQ ID NO: 146908 - protein, 43 aa, Triticum aestivum
  Clone ID: PAT_TA_41326.pep
RKETYFATSVGVSTQDVLNSSRIAHAQSRAAGGAVGARPTVRD

SEQ ID NO: 146909 - protein, 98 aa, Triticum aestivum
  Clone ID: PAT_TA_41327.pep
PPSSSAWSSSTKTTGSSSRPSPLAPLRTPSSTSRPTAAQPMAGIRGRGSRSSIWSWRRQAPCRRCSRRRMTNSALPPPSPSSARTRITASVPERGALI

SEQ ID NO: 146910 - protein, 132 aa, Triticum aestivum
  Clone ID: PAT_TA_41328.pep
RTRGRTRGVQGDHMPMTPHGAHLPNVPFVDNVSHTQLKLPTGDMQQLLPQLGMPTPFYTPNSFGSPYYQNLHPASVLANPYVTAGYALGGSGFPPVMTSYSPQSSAATPLDSPMTPSFSGRPSGFPSAGNLT

SEQ ID NO: 146911 - protein, 65 aa, Triticum aestivum
  Clone ID: PAT_TA_41329.pep
MNYHVRTWCMCGRVKNLDYGALIRITQVNYAERLVTAVRGSPASRLLRYSIYLPDSSGRVGGRVG

SEQ ID NO: 146912 - protein, 61 aa, Triticum aestivum
  Clone ID: PAT_TA_41330.pep
SYCPTVKVLLDTTHLTNKDTYTITHDAVAFSSCSSESLIALHRLNGHCCGGRCLLLLLVRI

SEQ ID NO: 146913 - protein, 45 aa, Triticum aestivum
  Clone ID: PAT_TA_41331.pep
VRNRFHAGSFEVEPMRVTHSMADCSQLMLFSGLNTIFHTYDCKID

SEQ ID NO: 146914 - protein, 74 aa, Triticum aestivum
  Clone ID: PAT_TA_41332.pep
SPHQHGCQHDRSRTSMQPHAARATDRIGSTPRRPRRNPSGFGVGLGLIQAGRRIQWCSAGFFSSSRSRPGPTRP

SEQ ID NO: 146915 - protein, 85 aa, Triticum aestivum
  unsure (1)..(85): unsure at all Xaa locations
  Clone ID: PAT_TA_41333.pep
GRGCQWPGKRGRVWYRERERTQGEVLDEKNSEIEKLRHAXDEKISETENVKHALDRNSSEIEKLKHALDEKNSELEKLRQALDVN

SEQ ID NO: 146916 - protein, 100 aa, Triticum aestivum
  Clone ID: PAT_TA_41334.pep
GQNRIERRRKRRRMKGRRGGTVPGGGHRQQRWSSGEQAATWKARSGDPLPNQNEHGGGRALFLDSAQGGVGPTGLDGLEGRGRPGPAGRWIRKEQAAAVM

SEQ ID NO: 146917 - protein, 59 aa, Triticum aestivum
  Clone ID: PAT_TA_41335.pep
GRTDAAHPLRLPILSSWFIQIHHSGSGALSCPPPHHSRSLLLPEPPASRPWSSLPFKPV

SEQ ID NO: 146918 - protein, 73 aa, Triticum aestivum
  Clone ID: PAT_TA_41336.pep
GKEDQQHPPSSSPLQAVAAPPPPSKQRKRKKSSSALQAKKGKQAEKGKGAIPCAPKKVVFSRIMETVCSPVMC

SEQ ID NO: 146919 - protein, 52 aa, Triticum aestivum
  Clone ID: PAT_TA_41337.pep
NMSHDVVLVAQTYLELFSKLQTYGYYLAYFWMNNNMTRKALGIKEVHTISFA

SEQ ID NO: 146920 - protein, 60 aa, Triticum aestivum
  Clone ID: PAT_TA_41338.pep
VLTIGVQVIKFLYSESVRQQHPHKKSFCSYKVSTTNPRVMNLVLRARQSTQLSTPPARPT

SEQ ID NO: 146921 - protein, 103 aa, Triticum aestivum
  unsure (1)..(103): unsure at all Xaa locations
  Clone ID: PAT_TA_41339.pep
PLVLPRVRRLVRALLLGDVVNHYYLNLFYRRSVNLLFIVLTNTVYLCDTTSGSTSSIVSGDXDDGSVTSESWAPDAPEHCXIGLNFSVVQISYYSSNRLLSTL

SEQ ID NO: 146922 - protein, 67 aa, Triticum aestivum
  Clone ID: PAT_TA_41340.pep
LRFWHLRFVNNVTVSRRNLYGVLMNLGAGLTLRTSLGSQSASGVHCHGCLSRPTTSCRRPPCETIHR

SEQ ID NO: 146923 - protein, 49 aa, Triticum aestivum
  Clone ID: PAT_TA_41341.pep
KKLFAYSMCFQAVSLQFQRAPTCASNICGPGPCLSLPIRSLVSKYDYGF

SEQ ID NO: 146924 - protein, 49 aa, Triticum aestivum
  Clone ID: PAT_TA_41342.pep
GALGVLIDWLEVKKTCDVTCYCANRNICEVCLPPPLRVRAAYSLSLPIK

SEQ ID NO: 146925 - protein, 131 aa, Triticum aestivum
  Clone ID: PAT_TA_41343.pep
NKPEVNQKMMKSALIKDLYFEMDRLKQELYAAREKNGIYIPGEQYLADEAEKKAMSEKLDRLELGLESKDKQLDELQGLYDSQKVLSADLSDKLQTLQKRMQETECALAVLEEKYMQANNTIKEKEYLIEN

SEQ ID NO: 146926 - protein, 52 aa, Triticum aestivum
  unsure (1)..(52): unsure at all Xaa locations
  Clone ID: PAT_TA_41344.pep
PVRARRTESPSATRQFCSREKTTVGFNCFGRIERLVMXIAIDRDDIELVSCQ

SEQ ID NO: 146927 - protein, 73 aa, Triticum aestivum
  Clone ID: PAT_TA_41345.pep
MMVLMLTPILGQWYSICVVQACKLTEQADAGAAACNLPCADDRTVIDSHSHDRRFLIQMTDWVAHRQTVRRTG

SEQ ID NO: 146928 - protein, 55 aa, Triticum aestivum
  Clone ID: PAT_TA_41346.pep
SRGLCARSKDLLEATIHHSYFLICSNHSARRRQRRICAPCHPLIFYNKEHKTWHQ

SEQ ID NO: 146929 - protein, 50 aa, Triticum aestivum
  Clone ID: PAT_TA_41347.pep
AALVFFGEANGVGGNVSMYMNNLNEKIKLEALKKSLNADFSQFLKINQVL

SEQ ID NO: 146930 - protein, 62 aa, Triticum aestivum
  unsure (1)..(62): unsure at all Xaa locations
  Clone ID: PAT_TA_41348.pep
DAWVLGFWSFVFGGARGGSRVKGTVKFFNFTKGFGFIFPDDDRXDLFVHXFLIKSDSYRNLN

SEQ ID NO: 146931 - protein, 90 aa, Triticum aestivum
  unsure (1)..(90): unsure at all Xaa locations
  Clone ID: PAT_TA_41349.pep
MVSAWKGLHTGILTQCASAIDSSTTCYFNIITTNDNSPSPVALXMLARHIVELYSLFAXILKSLFVIIIFEDADNQWSLILPKLNLIMIK

SEQ ID NO: 146932 - protein, 105 aa, Triticum aestivum
  Clone ID: PAT_TA_41350.pep
QEETGSQPHRTTAGHGEPHRTRWARASSRASERTRRPRRRCPGHEQQEHRVHDHGWISSFSVHMRAARTSSRTGLSSASQDQLGGRGVCDGEHTGAWYQGRPEML

SEQ ID NO: 146933 - protein, 127 aa, Triticum aestivum
  Clone ID: PAT_TA_41351.pep
RGLRFLEVMKAFEGRRLDFCAGSFPKLRFLHIWGAAQLNQVRIEEGAIKTLAELWFTDCPELKFLPDGIEHLAALEKLILKDTSEELIKKLRQKRDSDECSEDVMKISHIRNVTVALSHNGFEERIW

SEQ ID NO: 146934 - protein, 81 aa, Triticum aestivum
  Clone ID: PAT_TA_41352.pep
FDVPTRIILSSTSGAYTVYILHVICTAIKKFKAALVHHQQRTSKACRARAEVAPTPTAAIARTSAAATAPAAPSTCGTCTS

SEQ ID NO: 146935 - protein, 113 aa, Triticum aestivum
  Clone ID: PAT_TA_41353.pep
VPFCLLFVLDKPYLLYKSFGTKQGQKRSMRHQEVPSQGPLRIDADKPDLAEERPGSMLVNNPIVGQTSVVPPSTDDDMVALREHLIKQFLEIDKYGGRIIGIKEMGKLNVKAF

SEQ ID NO: 146936 - protein, 102 aa, Triticum aestivum
  unsure (1)..(102): unsure at all Xaa locations
  Clone ID: PAT_TA_41354.pep
RLLYHHHTTCGSKRHTHHHQQRLRYAPNPSPLALRRRLSPTAGAALLPDRVTPVSYGADDESDDHPREERGLVGVEVHPDACSLCYLGLQKLXHRGEDVAGN

SEQ ID NO: 146937 - protein, 136 aa, Triticum aestivum
  Clone ID: PAT_TA_41355.pep
RTRGKTYPDTVRRWCKWHVLKKAKETLGPLYSKKGDFQAEFHKVVNHMLTEEEFESAWAALLDKYNLRNHNYMTQIYETRRKWAKPYFQGVFCAKMTSTQRSESANHMLKSYMPPASPTHVFVRQYMKLQFDREQD

SEQ ID NO: 146938 - protein, 87 aa, Triticum aestivum
  unsure (1)..(87): unsure at all Xaa locations
  Clone ID: PAT_TA_41356.pep
FNKVVNHMLTEEEFRIAXTTLLHKYTLRNHKYMTQFYXTRRKCAKPYFQRFFCTKMTSTXRSESANHMLKSYMPPCTPTHVLIRQYM

SEQ ID NO: 146939 - protein, 57 aa, Triticum aestivum
  Clone ID: PAT_TA_41357.pep
GRLVITPPGSSCGVKSPNFEPCNLCYETPPSPARQARRDLGRDGGQCEPARRAVLRP

SEQ ID NO: 146940 - protein, 113 aa, Triticum aestivum; identical to SEQ ID NO: 129529
  Clone ID: PAT_TA_41358.pep

SEQ ID NO: 146941 - protein, 53 aa, Triticum aestivum
  Clone ID: PAT_TA_41359.pep
PRGLSRSRSSPTLSRTMRCLSYLNTYRYSLLNKNGKTVSTHPNSSLTATNSSL

SEQ ID NO: 146942 - protein, 106 aa, Triticum aestivum
  Clone ID: PAT_TA_41360.pep
PAARLCARTQIELYNSCPWSTTHCPLTPSDSITDYANSDIHRQHRMLAMLHTQTFCPRTDVAIQAYTCSDFVILLDAHSTRPWRDPDSNAIPQRFDGKHRSYLLPL

SEQ ID NO: 146943 - protein, 134 aa, Triticum aestivum
  unsure (1)..(134): unsure at all Xaa locations
  Clone ID: PAT_TA_41361.pep
PQNPSSFCPANPGEITACGGFCHHGHHGQNPPTHALIAARGNHPTFKIFCKADEGYCLSIRDGNIILAPSNPRDEHHHXFKDMRFIAQIKDEEGNSGFAIVNKATGLAVKHSLGQSHPVKLVPFNPEYLDKSVM

SEQ ID NO: 146944 - protein, 63 aa, Triticum aestivum
  Clone ID: PAT_TA_41362.pep
CFYDPEDYIELVSIKPLDPHQHLFKDMRFISHIKDEEGNPAFSIFNKATGLSVKHSLGQSHPV

SEQ ID NO: 146945 - protein, 99 aa, Triticum aestivum
  Clone ID: PAT_TA_41363.pep
MAITAQVPDIMGERQSGQDVRTQNVSACQAVANIVKSSLGPVGLDKMLVDDIGDVTITNDGATILRMLEVEHPAAKVLVELAELQDREVGDGTTSVVII

SEQ ID NO: 146946 - protein, 74 aa, Triticum aestivum
  Clone ID: PAT_TA_41364.pep
VILTMLCMVRIIQWLRGASSNLELPNSVSDCCMYKNETTLWRDMLRQIPTIICNIAASGLERSPPYSTLCRATI

SEQ ID NO: 146947 - protein, 56 aa, Triticum aestivum
  Clone ID: PAT_TA_41365.pep
PRVPPFYVIVLIYHKGSLIHYASFYNVITGKTVPLPNLISIQYILLSPDAFILQKP

SEQ ID NO: 146948 - protein, 97 aa, Triticum aestivum
  unsure (1)..(97): unsure at all Xaa locations
  Clone ID: PAT_TA_41366.pep
KDLTKYDFEADCFSSPGDDVNKRKLAYRHHAIGDKYAKSLQKILDHRMFKVWSDLYSSTDKYTDGXLSSAHKLLEEALGKSTAEPAVKYLSIKCIVT

SEQ ID NO: 146949 - protein, 63 aa, Triticum aestivum
  Clone ID: PAT_TA_41367.pep
GRPVVQQLLSCRESTIRIVVCPAKLPTKHFGDCVDQQNLDSLGCLVALSSMNGGGNALVGRQT

SEQ ID NO: 146950 - protein, 94 aa, Triticum aestivum
  Clone ID: PAT_TA_41368.pep
VVAALLLLLAVYLAGIYYYPPHRGYGGGFAGAGGDWTGWGCGLGFYMLLLLCLVLCAMFSEEGGSWWIPGVLLAACLLCLNLFSGGKVLGQEYF

SEQ ID NO: 146951 - protein, 135 aa, Triticum aestivum
  Clone ID: PAT_TA_41369.pep
DAWALREEGGDENAGDKESPLVLKNKSPRWHEQLQCWCLNFRGRVTVASVKNFQLIAAPAPPPPASGGEAAPEPSLQPQPPQQQPTSATAQPQPAGSSLSASSSSSSSHHDTVLLQFGKVFKDTFTMDYRYPLSA

SEQ ID NO: 146952 - protein, 71 aa, Triticum aestivum
  Clone ID: PAT_TA_41370.pep
IKRNFSTGILLLETSGALNFRGLFTEAWVKNFQLMIVPAPTILEVWRLGSSQIVFTGVTTPTASYLCYRST

SEQ ID NO: 146953 - protein, 64 aa, Triticum aestivum
  Clone ID: PAT_TA_41371.pep
TSPKSRPLASERLLTRQAVAMEEAVDHTHAAATGVLAYVALAIEGPHNLYKESTYYQLQDNALL

SEQ ID NO: 146954 - protein, 42 aa, Triticum aestivum
  Clone ID: PAT_TA_41372.pep
SRQFLMHISYRGISMPKIVPRNSPTKMCMLPLSVGCPCPRVR

SEQ ID NO: 146955 - protein, 66 aa, Triticum aestivum
  Clone ID: PAT_TA_41373.pep
HPRTYKLTSPNRYLSLKRGFLHGGGGYKGLPSSHTHCCYLSLCLPVAPFLLNELFPTEVHPINIQH

SEQ ID NO: 146956 - protein, 44 aa, Triticum aestivum
  Clone ID: PAT_TA_41374.pep
YFLGGPTHAFADAWAYTPNRQWSACTLGLARFWAHLLPFLNLYS

SEQ ID NO: 146957 - protein, 118 aa, Triticum aestivum
  unsure (1)..(118): unsure at all Xaa locations
  Clone ID: PAT_TA_41375.pep
IQPRAVLSLVGRKQCLLREATLCKGLLRFLKLDRXKDYLLMEVEFVVSHYRLPPSEXDMTEEDRSKVVHLTSTHMSVGSVEEIIVXNHAIDSTSWGPEYYVSALAIVDMHQLEPLCTI

SEQ ID NO: 146958 - protein, 132 aa, Triticum aestivum
  Clone ID: PAT_TA_41376.pep
GRVGPASLPRRRHLLRLPELSPSLVARGSWRSSSRCSGWRDASAAGRRGPRGPLDSPATSSSRRPARGTPPSSSPSGLGRRMSAVAPPPHTPVVAPPRGGGRHHRAPPGQGLLPRAPPARQTFPLRAVLADS

SEQ ID NO: 146959 - protein, 42 aa, Triticum aestivum
  Clone ID: PAT_TA_41377.pep
SQHVFPPLGVNGSKYIMLCKISATMPFVWCCFAFGKIWDCSQ

SEQ ID NO: 146960 - protein, 105 aa, Triticum aestivum
  unsure (1)..(105): unsure at all Xaa locations
  Clone ID: PAT_TA_41378.pep
ARVLKKVEELHKTYYYMKDIFFQAHXPLIEKFRELTGYRMKVQKAMXKKDRHLPDKFLNLPPTNKLVRLIIERYTSLVDALRVLDDSLTMEHLFAGLPSIEGELV

SEQ ID NO: 146961 - protein, 63 aa, Triticum aestivum
  Clone ID: PAT_TA_41379.pep
KEKKVSTYTPLFMCCVVLLVHCIWNIFCASTYFLVIWKKEIYYKNHPYVSQRLNNYYYEIEQY

SEQ ID NO: 146962 - protein, 128 aa, Triticum aestivum
  Clone ID: PAT_TA_41380.pep
SDAAKVRGLVGDTLQLVVQNSATLVAGLVIAFVSNWELSLIILALIPLIGLNGWIQMKFIQGFNADAKMMYQEASQVANDAVSCIRTVALFFVEEKVIDLYNKKCERPVQTGIRTGIISGFGFGVFFF

SEQ ID NO: 146963 - protein, 82 aa, Triticum aestivum
  Clone ID: PAT_TA_41381.pep
DPLKRDFYFEQCRLERWLSRQLREWGSPLVPSLCQAVRNHLCCTSSPARPDSAHGDWQLRSDCLFGGGFWALIRRGNDLVCV

SEQ ID NO: 146964 - protein, 129 aa, Triticum aestivum
  Clone ID: PAT_TA_41382.pep
TFVLANHEYLNNILIQNQLGGKDFPYDIISSQMFFIPVPLEDGWVVLMWDMMSRKPHILDLMIRGDGPTEPTKDKLELIAWKLHHALFHCLNEYYAGWLAYARRRVGGSLRTCCNGTFVRDETGGCVLH

SEQ ID NO: 146965 - protein, 51 aa, Triticum aestivum
  Clone ID: PAT_TA_41383.pep
LQNDSRSSSAHKGTRRNTCVCLGCERASQSKQVTFRRSYHRQFFQTSSVTK

SEQ ID NO: 146966 - protein, 71 aa, Triticum aestivum
  Clone ID: PAT_TA_41384.pep
PRVRPLFRPRVRSRGGCASAGGPPRCKLSSKFAGFCVPGTKVDRWLRARLSLSTRSRGGRSRSYLIMVMVF

SEQ ID NO: 146967 - protein, 42 aa, Triticum aestivum
  Clone ID: PAT_TA_41385.pep
MAEHDQDPTGGRRITEMPPLTEVWCFLEGASVKQPSPAAKWR

SEQ ID NO: 146968 - protein, 123 aa, Triticum aestivum
  Clone ID: PAT_TA_41386.pep
GDQPVQGEQADPHVYQEETYADREDWNRSVPDEHVLPPTRNLPRMLMRLLPQRFFTTFSRGTAHERAEYPPYRRSTAAKAMTGFLAHYANNLSHFSHGAEFFTISSSDEDDEFYIFTNDESSL

SEQ ID NO: 146969 - protein, 50 aa, Triticum aestivum
  Clone ID: PAT_TA_41387.pep
LNDSTDNEIPFPRLCIRTMASGEGLTSGKDAGGCLQQRRREGREGLERRR

SEQ ID NO: 146970 - protein, 77 aa, Triticum aestivum
  Clone ID: PAT_TA_41388.pep
ELFVGDAGLFGVLCSCHQLRMSVAKFCEHARGPAEKAGVIVLMENGMSIAHWFKYCVGVGSYVTDSNCDRPEWACLD

SEQ ID NO: 146971 - protein, 106 aa, Triticum aestivum
  Clone ID: PAT_TA_41389.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLINYAAAYCTGLLLA

SEQ ID NO: 146972 - protein, 47 aa, Triticum aestivum
  Clone ID: PAT_TA_41390.pep
LHAFAQPRPVVLELVRLGFGPSLTVLSPFISFCGSHRSRSRWLSPPV

SEQ ID NO: 146973 - protein, 89 aa, Triticum aestivum
  Clone ID: PAT_TA_41391.pep
GQGPDRGDELQVRRYQKDEWWRRALRSSARGSAIHGVGFKRRPGSKGSRSSSPVRAGRLVDRGRELEHEQGTEEEAAAAGGFGSGGRVG

SEQ ID NO: 146974 - protein, 31 aa, Triticum aestivum
  Clone ID: PAT_TA_41392.pep
FKEIHLLEGFPFFNFLFFYNFTQHTNFNHNL

SEQ ID NO: 146975 - protein, 29 aa, Triticum aestivum
  Clone ID: PAT_TA_41393.pep
CTAAPDQPWLWPTAGNESGPYVAPGLAAN

SEQ ID NO: 146976 - protein, 130 aa, Triticum aestivum
  Clone ID: PAT_TA_41394.pep
KGGILAHLKPIADENDLHSCLASYFGPEVSRIKNAIDGKCKSILEDLLSFVESHNSVQRLKELVPFIQEKCYKTILGVLDKLEAVLGNLSDALGTKKGDDNLPAASGIVERSLFIGPLLFGLRYLFSYVP

SEQ ID NO: 146977 - protein, 68 aa, Triticum aestivum
  Clone ID: PAT_TA_41395.pep
SSPAASAEAPWWSWRADDLKASGESVRRKSRSCGVTPSASASSSFPSAAEGLLGPAPAAERPCERGEG

SEQ ID NO: 146978 - protein, 53 aa, Triticum aestivum
  Clone ID: PAT_TA_41396.pep
SPDAYFFGVQALTGGAGDEFTAIQGPDAYSLGVQGPHPEAPAFGVPPLRRCTT

SEQ ID NO: 146979 - protein, 85 aa, Triticum aestivum
  Clone ID: PAT_TA_41397.pep
MLLTVSALPLPAATATPRVRVLPGLKPSSRLVARRSAGETVHATATEEEEQEGKELQEEGLPRRGQHAEDDHDHEHDPEIADIMG

SEQ ID NO: 146980 - protein, 112 aa, Triticum aestivum
  Clone ID: PAT_TA_41398.pep
RIRIAGKAPPNCLSHFCKPCACPGKISKTSRAPAWGHIISMATSVSALNCILFQKKHRPCPLSVRSGRITERRDGPVSYKKAPLISSQSANCFFFFSLIDSHARLAARVSVA

SEQ ID NO: 146981 - protein, 71 aa, Triticum aestivum
  unsure (1)..(71): unsure at all Xaa locations
  Clone ID: PAT_TA_41399.pep
MWRRLQTLAPALRRAVVVDGAAPSPASARAAPLFTVVAAFRRTGLLLFXTKPVASGTSVEDVMPIVSRLER

SEQ ID NO: 146982 - protein, 71 aa, Triticum aestivum
  Clone ID: PAT_TA_41400.pep
RPRVRGRVGAASMNNDGERFVPENDLGDNTWIDNEVCSSNLMNEDHKPIVSKSNNQVPDVCPDLRSPIQGE

SEQ ID NO: 146983 - protein, 107 aa, Triticum aestivum
  Clone ID: PAT_TA_41401.pep
MDASSTVNNPKEKKEAAGRKNGSRTKKNLSRPFKNGALLSVSRIRRSLKKGRYSQRVGSCATFYLMAVLDNIISELLELAGNAGKDNKKSRIILRHLLLVIMNDEEL

SEQ ID NO: 146984 - protein, 85 aa, Triticum aestivum
  Clone ID: PAT_TA_41402.pep
LQPDSVSVPGGPRATSALPQVAVGGRGDDGARGQHGCEFRGELQRAVGVGGWVSQVGCAHASSRPEPLRARERGGRLGKAWDGTG

SEQ ID NO: 146985 - protein, 37 aa, Triticum aestivum
  Clone ID: PAT_TA_41403.pep
CISSFRRTKNILGAIGRPGRRLQRREDVVFHFCPRVR

SEQ ID NO: 146986 - protein, 100 aa, Triticum aestivum
  Clone ID: PAT_TA_41404.pep
APRVSPGSLSNPKAVVGRPGLPGFLKRAWFLTTRSARAVGKPVWTGTRGGDRRAASSRPKEGRFSGVGIGGGEEYSRGGGDASGPTRPPTRPPTRPPTRP

SEQ ID NO: 146987 - protein, 101 aa, Triticum aestivum
  Clone ID: PAT_TA_41405.pep
KFGKISKAIRFPETLNLSCYMNSTDDNSPVYSLYGMVVHHDVMNAAFSGHYVCYVKDTHGKWYKIDDSQVKPVSLENVMSKCAYMLLYARCSPRAPNSVRH

SEQ ID NO: 146988 - protein, 89 aa, Triticum aestivum
  Clone ID: PAT_TA_41406.pep
PTRTRTRGRTLGLDHHSWRVLASARADTHPIISEGATLGIHTNVLTPTPQLLGHAPILLIRIACMNVELTYIGSVGNAFNGSQIQAPIL

SEQ ID NO: 146989 - protein, 79 aa, Triticum aestivum
  Clone ID: PAT_TA_41407.pep
GAYGVHVPHERFGYLWQLGEGKREVAAYLEINDISRLSQRSSARYDLHNTILFHRRPLYQIYDEEKAFYDTHITPIGDT

SEQ ID NO: 146990 - protein, 37 aa, Triticum aestivum
  Clone ID: PAT_TA_41408.pep
CSFFCGRHLHHGVLVVCYAAVFSPSCLMEEHSWVIKN

SEQ ID NO: 146991 - protein, 95 aa, Triticum aestivum
  unsure (1)..(95): unsure at all Xaa locations
  Clone ID: PAT_TA_41409.pep
THNDKAVLNHSAGDKMYRCRTLSTTEDAGKNNRVXGENLCYXAKLFLDHKTLYYDXDLDVIYVLRERDDRRRHMVGYFFKAKLSDGAYKMDCILT

SEQ ID NO: 146992 - protein, 81 aa, Triticum aestivum
  unsure (1)..(81): unsure at all Xaa locations
  Clone ID: PAT_TA_41410.pep
VNKVRPVLINGAAPAAAEQGQEVPPGKHTLFPAPRYAGQAEVLVXEVWRPGARVFNNRRVLHRFALAAAVGAEYKLAPTRP

SEQ ID NO: 146993 - protein, 57 aa, Triticum aestivum
  Clone ID: PAT_TA_41411.pep
GKLKPGFHEQGHRFFPLAAFPPGNLACLPASPPTRPLQVWWCCRRWCWVGGMLGRVG

SEQ ID NO: 146994 - protein, 90 aa, Triticum aestivum
  unsure (1)..(90): unsure at all Xaa locations
  Clone ID: PAT_TA_41412.pep
LYIAFDRHVPGVRTAHAVDQYRENGRGRGRSVSXAGWSDAQPIVVPLTSQPLVARQISXTVKIALRRDNGISILSAELCLLMFHPPPRSM

SEQ ID NO: 146995 - protein, 48 aa, Triticum aestivum
  Clone ID: PAT_TA_41413.pep
TPSPIIVPLKGPSLWVAARRSRSEVRFPPAPEQAHLDVERRVVSPHGA

SEQ ID NO: 146996 - protein, 79 aa, Triticum aestivum
  Clone ID: PAT_TA_41414.pep
AHAYADAWVLPQISAPNLAGSPSGGGWLLPESLAGGCAPKNLAYSILLKARLHLKFLRICLLLNKGRYSHTGEYGNDRY

SEQ ID NO: 146997 - protein, 76 aa, Triticum aestivum
  unsure (1)..(76): unsure at all Xaa locations
  Clone ID: PAT_TA_41415.pep
MEPGRRPFAGAVDLRRPKGYPAPSATPQPQAEAGAGDAHGDPCPRCESRDTKFCYYNNYNTXQPRHYCKSCRRYWT

SEQ ID NO: 146998 - protein, 122 aa, Triticum aestivum
  Clone ID: PAT_TA_41416.pep
MARTKQTARKFTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMP

SEQ ID NO: 146999 - protein, 52 aa, Triticum aestivum
  Clone ID: PAT_TA_41417.pep
TKLRTPSLAFSCSSPTMVKESFDHHFYSSHSPVFFFPCQFEHLIQLVTFSSP

SEQ ID NO: 147000 - protein, 106 aa, Triticum aestivum
  Clone ID: PAT_TA_41418.pep
SPPPDADGDGRAGALATDWPAMAAVLPHPIQSERPAADLTDAPRACCSTRTRLLYFLGSGYLIATPSRSLACFNCDLRRSDGALTLLLGLLQTLWTARSTGDPISA

SEQ ID NO: 147001 - protein, 48 aa, Triticum aestivum
  Clone ID: PAT_TA_41419.pep
ARHPFETGLNGQISVKSPPPPQKLRAGTGPGKRNHNLFLWPTKWWQII

SEQ ID NO: 147002 - protein, 89 aa, Triticum aestivum
  Clone ID: PAT_TA_41420.pep
KWRRGGVGEGRGEAKRVVVSFLSSPCHTFLSLSISSLPRSYMPPSRSIKLIAEILPMVFPRPMPTMEIYKPPRLYIQSGAVERGRGKRE

SEQ ID NO: 147003 - protein, 115 aa, Triticum aestivum
  Clone ID: PAT_TA_41421.pep
ALAGNTLLARRLRALLRKLGSVDLAGLSHQQKLAFWINVYNSCMMNAFLEQGIPTTPHELVAMMPKATVDVGGRTHSAMSIEHFILRLPYSVKHQVSPEGERTKGGDQAARAGAF

SEQ ID NO: 147004 - protein, 55 aa, Triticum aestivum
  Clone ID: PAT_TA_41422.pep
SSDNRNLYLVSWNDHFFFLKAERDAYYIINTLAERFYGGCRPAYILKLDDTTMIY

SEQ ID NO: 147005 - protein, 89 aa, Triticum aestivum
  Clone ID: PAT_TA_41423.pep
TVVMFSLSFMHLSTVHLRHASCIREQDIIRHCKRILNYCLSNAADDSATGKMASHYHAPYQGIVDGMACKIDALKWLVLFDDAGAKATG

SEQ ID NO: 147006 - protein, 52 aa, Triticum aestivum
  Clone ID: PAT_TA_41424.pep
NKSTGHWVNLLLQRFPYSVYPITHLLHKFLPYCLCRFILLIFIIHAPLSPPL

SEQ ID NO: 147007 - protein, 58 aa, Triticum aestivum
  Clone ID: PAT_TA_41425.pep
TAVDTLPSTQYYTTVEVRLLSIRYQSDTDTEGPAYVSPANEAEVCAAMSANTGRSTRP

SEQ ID NO: 147008 - protein, 52 aa, Triticum aestivum
  Clone ID: PAT_TA_41426.pep
TYARPSLSVSNSYRIANIRTSSIIYYCMLDNSSTSILLIPNVVPRSISYHSF

SEQ ID NO: 147009 - protein, 32 aa, Triticum aestivum
  Clone ID: PAT_TA_41427.pep
FHPPTTNNLFNQLGWGKSFGPLIYFTFNYLNS

SEQ ID NO: 147010 - protein, 60 aa, Triticum aestivum
  Clone ID: PAT_TA_41428.pep
GPCSPIYLDSDDELDDFGYKEPSGNLILPCEESMREEERNDYTEEGKTTQEKRGLIKEGK

SEQ ID NO: 147011 - protein, 54 aa, Triticum aestivum
  Clone ID: PAT_TA_41429.pep
KHTGSEVSTSLIFLLPAAAHLGRCVPLGTIIPGFHLVCAGGKPKMKRSSLACAG

SEQ ID NO: 147012 - protein, 71 aa, Triticum aestivum
  Clone ID: PAT_TA_41430.pep
PSPFQSQIICRHGISGGSVCGTGGGLKGRRVRSAVRIWREAGRRPAAGVASTEEQKTGSGRQRGEISPRVR

SEQ ID NO: 147013 - protein, 112 aa, Triticum aestivum
  Clone ID: PAT_TA_41431.pep
PTRPPTRTEGSNSSREHNRYKNATHESSIPLLILSFSHITTSQGSFFSSLLLRQEHQPVFLSRNSVRQWCCLLGLFLDRYRQTSEVSEQCVSGDGSAGALHLRAPPGHRRRR

SEQ ID NO: 147014 - protein, 56 aa, Triticum aestivum
  Clone ID: PAT_TA_41432.pep
SINTHMIYAVRIMRRLLLVRFIRERRTKTYCMKAKLDSSIQHVTFEICHPGLAYAR

SEQ ID NO: 147015 - protein, 62 aa, Triticum aestivum
  Clone ID: PAT_TA_41433.pep
TQKHSHPFTLSTPEIYTIYLERSPAHLYPISKDKTRLELAMTPNPDREVSHRAGRGGKILLP

SEQ ID NO: 147016 - protein, 84 aa, Triticum aestivum
  Clone ID: PAT_TA_41434.pep
TNYLDRSSNYCIDIRRHEAPAACNGSQQRSAGAPAGRERGKDTADGESRLGGDATGDSAVNEGGHQLHGEPREWAQPERGLHTL

SEQ ID NO: 147017 - protein, 101 aa, Triticum aestivum
  Clone ID: PAT_TA_41435.pep
GQSRPCFNTNQGWATKNQILGLLQNCPIFQLQQHEVSAITDEISRGAVLIIPESNVDELLMTLEYTSSGKILKEHGPFKLKVSGVTINKFCIKGNLWSRRR

SEQ ID NO: 147018 - protein, 48 aa, Triticum aestivum
  Clone ID: PAT_TA_41436.pep
VLDPILPAWLKKFILGIFRIGRTPPQIFCRAHRGMGYASNTLRVPTRG

SEQ ID NO: 147019 - protein, 57 aa, Triticum aestivum
  Clone ID: PAT_TA_41437.pep
RLELHDLQKRCVRSMREDFTWTYPFTGLLKKRWILPAGEYHTFQLTLTILSICSGSL

SEQ ID NO: 147020 - protein, 134 aa, Triticum aestivum
  Clone ID: PAT_TA_41438.pep
VTAAVLPGMLRRGRGAIINMGSASSEGISLPLHTMYSATKRYVAQFSRSLYVEYKSTGIDIQCQVPFFVATTMASGFAATWRPSALVPTADTYARAAVGWIGKGGPLCVPNLRHRLLGWYFATVPGGVQDWFCL

SEQ ID NO: 147021 - protein, 95 aa, Triticum aestivum
  Clone ID: PAT_TA_41439.pep
EFVVHRGVQTLGGSAMTERTRGKSSHALRQRTAQVQQQTRGKAAGLDMRTKVRRKSRVELRDFQKRWERAAREDRTWVDPFTRSRRKRRSRPAVD

SEQ ID NO: 147022 - protein, 56 aa, Triticum aestivum
  Clone ID: PAT_TA_41440.pep
NFVRNLMDKVCIAQSRQSKRYASSDCECTKPLACGSSRYTLVGVGPRLTSRLCCHS

SEQ ID NO: 147023 - protein, 92 aa, Triticum aestivum
  Clone ID: PAT_TA_41441.pep
VPDHDSIIGLGWFVDDCGCNPARRWSSDVDVAGSGTHESSFLSTETIEYASQWDSLRSGTRPPPETEPEREEKPTPRTVYKRACVAPRVFRG

SEQ ID NO: 147024 - protein, 132 aa, Triticum aestivum
  Clone ID: PAT_TA_41442.pep
PTRPIYAPFKSLLPMVNPDDLVFGGWDISSMNLADAMTRAKVLDIDLQKQLRPYMESIVPLPGIYDPDFIAANQGSRANNVIKGTKKEQMEQIIKDIREFKEKNKVDKVVVLWTANTERYSNVSVGLNDTME

SEQ ID NO: 147025 - protein, 58 aa, Triticum aestivum
  Clone ID: PAT_TA_41443.pep
RVLGMGRLTETPSVIKDTGICKIVERNIYARRLNWCTHRLGFCSRLCLSIHQICTINC

SEQ ID NO: 147026 - protein, 119 aa, Triticum aestivum
  Clone ID: PAT_TA_41444.pep
GRVGSSPPHARTRTESSDTPLRSDHPPPQLTPAAPPPPTPPPLPVDPICPDPTDRPPPDRIRPEGFWRLAHGSRWRREGPAAAAAGEFAGYPRAFCICGGGVGGSRGGGGKSAGSGGGA

SEQ ID NO: 147027 - protein, 35 aa, Triticum aestivum
  Clone ID: PAT_TA_41445.pep
MDFKGRLFSSWHKSFESSNPDGSNSPRTPTSVPGA

SEQ ID NO: 147028 - protein, 53 aa, Triticum aestivum
  Clone ID: PAT_TA_41446.pep
VSIASSICKHVRAYDGVAEHHNRMFVLNNTHANYSPYNIKCTKSCGIHERTRG

SEQ ID NO: 147029 - protein, 101 aa, Triticum aestivum
  Clone ID: PAT_TA_41447.pep
MVFKGRFFSSRHKSSESSSPDGSNSPRTPTSAPGAASAASPASSSASSRSDKKKPKSETPKKRDKLFGSAAVAVLSPRASPASSTSSPFDARKHHLRDCRP

SEQ ID NO: 147030 - protein, 55 aa, Triticum aestivum
  Clone ID: PAT_TA_41448.pep
KGNITHQQFTYILQRHHRSSSYNTAQVLDSKGNMAGQQHHTYPTMQSQIIQLYYY

SEQ ID NO: 147031 - protein, 135 aa, Triticum aestivum
  unsure (1)..(135): unsure at all Xaa locations
  Clone ID: PAT_TA_41449.pep
RWESLRRSRKYQNLVRWFXSVAVDYALEEVTSVYVGKRAIGKSPAPCLKEKMPGLKNTSGHEIDLPGAKVGEVCVRFAPEPSGYLHIGHAKAALLNQYFADRYKGRLLVRFDDTNPSKESSEFVENVLKDIETLG

SEQ ID NO: 147032 - protein, 124 aa, Triticum aestivum
  Clone ID: PAT_TA_41450.pep
SDRRSVRTQITKHTSSSTFVTKLKSTSSTFLHSPRRRQGRGRVAFYFQITTPTTKGRHKLGGRPPGKEAAGLLWSVVVVAAMMPRGRWTALVGWSSADELPLEESPLARHLIGAPEGVVPGVPR

SEQ ID NO: 147033 - protein, 125 aa, Triticum aestivum
  unsure (1)..(125): unsure at all Xaa locations
  Clone ID: PAT_TA_41451.pep
DAWADAWGPSERTFVSMDVAFRESEPFXGEKTDLGVMFEGLDPSQVGEIGQEGESNSTLAHVTPLTQALTYTGDVQVCAPTQIDSVPRGVPRWTTEQEEHLKVYSRKRGDDVVSAPIGSVPRWTR

SEQ ID NO: 147034 - protein, 73 aa, Triticum aestivum
  Clone ID: PAT_TA_41452.pep
FHESTHPRNTRNVFFLSDRSIIFTYNFEKRMLHFWSAPSLIGDPRTSFQVRLLITLSRVMVARPSPRYEPMPI

SEQ ID NO: 147035 - protein, 52 aa, Triticum aestivum
  Clone ID: PAT_TA_41453.pep
MACMKVGDRNKVVTHSEKATLQLLVYRIGLYLKKGLYTQRVRSGTPVYLNAD

SEQ ID NO: 147036 - protein, 58 aa, Triticum aestivum
  unsure (1)..(58): unsure at all Xaa locations
  Clone ID: PAT_TA_41454.pep
VLDPLKLHLPRPNLGSRTGPTLGPYLQTRTDREGYSNWRXRSQAAEPTPIRWLGEXVR

SEQ ID NO: 147037 - protein, 129 aa, Triticum aestivum
  Clone ID: PAT_TA_41455.pep
ASHRPPYRRASPSSAETSVAGAADRQLPSQQEMAHVSFKSKEVDSVPRWSEYLTAEESSPSASASWRTMGVDGPQPSSSGQRHLQMEPVVQLSKVAEGLLAKMYRLNSILDYPDPNTHTFSEAFWKTGV

SEQ ID NO: 147038 - protein, 33 aa, Triticum aestivum
  Clone ID: PAT_TA_41456.pep
AVVLVRPPPWTSCRSEIEKREPMQGKISKERHG

SEQ ID NO: 147039 - protein, 35 aa, Triticum aestivum
  unsure (1)..(35): unsure at all Xaa locations
  Clone ID: PAT_TA_41457.pep
TGVGKLLAHQTLRLNQXDYDRVQYINDNDVANFRD

SEQ ID NO: 147040 - protein, 47 aa, Triticum aestivum
  Clone ID: PAT_TA_41458.pep
YVTSIACYAWTCIEEPSFSPPLMQYRPCSSFACVVCAETEYVDLLKT

SEQ ID NO: 147041 - protein, 72 aa, Triticum aestivum
  Clone ID: PAT_TA_41459.pep
TYEILKCSIVMVTYTREPVLFSQIPRGPKHSGGRMLSVDSLVMNQIREGGRERCSREEFLPTRPPTRPPTRP

SEQ ID NO: 147042 - protein, 111 aa, Triticum aestivum
  Clone ID: PAT_TA_41460.pep
GRVGGRVGLRVEQGSLTGETNSVNKTVHAVPAEDADIQAKECMVFAGTTVVNGSAVCLVVHTGMATEIGKIHSQIHEASQEDDDTPLKKKLNEFGEALTKIIGLICILVWL

SEQ ID NO: 147043 - protein, 60 aa, Triticum aestivum
  Clone ID: PAT_TA_41461.pep
VLDLVPCASVHVITCGGVNRVAARVMQSVRPWSLLGSAHDNGCCVRAGHGRGRLGPRLPC

SEQ ID NO: 147044 - protein, 106 aa, Triticum aestivum
  Clone ID: PAT_TA_41462.pep
PRVRPRVRGRVGFSSIPDVILNGNSFLNGPAPTPPPLMPPPPRRPRSRSNRSGGSGNAPKGSESSTSQGGKNGLQTASLVGIIVGSILAALCVLLLLGLCIRKSRE

SEQ ID NO: 147045 - protein, 45 aa, Triticum aestivum
  Clone ID: PAT_TA_41463.pep
MDAEAGAAAAQQLPWRQHYRNLLLLAYQSFGVVYGDLNTLTLDWD

SEQ ID NO: 147046 - protein, 66 aa, Triticum aestivum
  Clone ID: PAT_TA_41464.pep
VRLRDGQVLDHLRHLIHLAPPPPRPETLARESADSYLPPPPPPRARLTREITRSLGTGTQENPRVR

SEQ ID NO: 147047 - protein, 104 aa, Triticum aestivum
  unsure (1)..(104): unsure at all Xaa locations
  Clone ID: PAT_TA_41465.pep
CPSGMMXKLQELIFLFLAQDLDGESCGGDWEEVAEVFSTAACSGRGTKSSKIFSVSSSRTVSRYFFTENEELHFFLEFFGLSPSSRLVLPIKAGTKIKQRRDLV

SEQ ID NO: 147048 - protein, 51 aa, Triticum aestivum
  Clone ID: PAT_TA_41466.pep
SLLLLWPLHYFATCWEKETRHRERIPSTITLSSPFCPSNLATKQHTTQLFG

SEQ ID NO: 147049 - protein, 45 aa, Triticum aestivum
  Clone ID: PAT_TA_41467.pep
VVNGMVAGSGKFTHRAWIRDKWFTHKICQLESGPVLRALWIAEFY

SEQ ID NO: 147050 - protein, 117 aa, Triticum aestivum
  unsure (1)..(117): unsure at all Xaa locations
  Clone ID: PAT_TA_41468.pep
RTRGEFFTRNGRWNIARKKLIRTSSVKRWSVVNFSARCDLRGLVQDLKRVATGMGLEYEDPHTVIEESPSLRRAPVARRVEEXFAQIKAKLPGAPLFLLCLLPERKNCEVYGPWKKK

SEQ ID NO: 147051 - protein, 111 aa, Triticum aestivum
  unsure (1)..(111): unsure at all Xaa locations
  Clone ID: PAT_TA_41469.pep
MKNTDKVTLGKVERSVXAVKTAVHMLESGADIEEATDVCSPYDLFQLAKWKNKLNIYLAPFLHGTRYTSYGRHFTKLDKLEKIVDKLQWYVQSGDTVVDFCCGSNDFSTLL

SEQ ID NO: 147052 - protein, 82 aa, Triticum aestivum
  unsure (1)..(82): unsure at all Xaa locations
  Clone ID: PAT_TA_41470.pep
GRVGRAYSHLHGNSRFFLVDCVAADGLXFQDAFGDSCGCVLNMTTFRLSYDREGNLQIKDRKTTSCCVSKQLSSFSPVAFWM

SEQ ID NO: 147053 - protein, 93 aa, Triticum aestivum
  unsure (1)..(93): unsure at all Xaa locations
  Clone ID: PAT_TA_41471.pep
GRVGQPSFLLVTNPTVVVSGRVATGGGGALDAPMATPAFRLFMSRIYESERRSLNYRLNWAKMTXVFGLXRPDSLSDATFRLRRNLTYLRVNY

SEQ ID NO: 147054 - protein, 113 aa, Triticum aestivum
  Clone ID: PAT_TA_41472.pep
LDYGTGTGVLGIAALKIGAALSTGIDIDPQAVSSARENMLLNGMDSGRMLVHLVPTGAEPSCFSSSIDKSEEEKPGSNLELKSSKGTYDIGAANILLNPLLELVEDIVGFAKT

SEQ ID NO: 147055 - protein, 64 aa, Triticum aestivum
  Clone ID: PAT_TA_41473.pep
TPAFVRLGCLSMCFGVHLIMLVVLCMGFPSDLVRKKCVLEYLCLAWWVSFWVIVCLYAIGRYSC

SEQ ID NO: 147056 - protein, 61 aa, Triticum aestivum
  Clone ID: PAT_TA_41474.pep
RTRGQTRVITTTSDSDAGGEMYQVTALFSHAEKVDKEIKENRAPSEADDQADKFVVQVKGY

SEQ ID NO: 147057 - protein, 59 aa, Triticum aestivum
  Clone ID: PAT_TA_41475.pep
LVLGSQSLGSGAVRFHSVRKGLVAVKRNAWRTSSIVGLWADYDDLSTTRHYRTPSTSTA

SEQ ID NO: 147058 - protein, 67 aa, Triticum aestivum
  Clone ID: PAT_TA_41476.pep
LTGSDDRSLFTCECGQLSHTLMWCSHFLRFINILLLEEIPVNLIAICWTKEGHTSLVPGSTLEGYIQ

SEQ ID NO: 147059 - protein, 35 aa, Triticum aestivum
  Clone ID: PAT_TA_41477.pep
LTSDTKQKRHVPPPYRAPPAIGLGARAVVIPLARA

SEQ ID NO: 147060 - protein, 82 aa, Triticum aestivum
  Clone ID: PAT_TA_41478.pep
PRVRRKPKPDPDAGLTPAPLPERARATPCRLSIWPPSKPLLAVGLPARASRSCSVCAFPTPDAHLRRLRVTPTTTSAQLCSL

SEQ ID NO: 147061 - protein, 130 aa, Triticum aestivum
  Clone ID: PAT_TA_41479.pep
MAPRAHLAFYQVCFVGKGCDRDDILAAIDDALDEGIDVLSMSLGADDAGDFAADPIALGGFSGVMRGVFVCTSAGNQGPSPATVANEAPWLLTVAAATTDRTFSADVKFGNGLVINGESHYQPSTYVSVQ

SEQ ID NO: 147062 - protein, 64 aa, Triticum aestivum
  Clone ID: PAT_TA_41480.pep
CTSCHNSFQHSCGHGRSNIPCQMTAQAGTPGRYSARSLASGGGEWIQPWMLPVTAPVRAPSVSP

SEQ ID NO: 147063 - protein, 117 aa, Triticum aestivum
  unsure (1)..(117): unsure at all Xaa locations
  Clone ID: PAT_TA_41481.pep
RTRGGNTLLVKGAVETLLERSSHIQLQDGSVVPLDEKSRKAILASLHELSTKALRCLGFAYKEDLGEFATYDGEYHPAHKLLLDPANYAAIETDLIXVGLAGLRDPSREEVFDAIED

SEQ ID NO: 147064 - protein, 59 aa, Triticum aestivum
  Clone ID: PAT_TA_41482.pep
ASGSVDGIISHVKMEIKQLEDEKFVKERVSDLKRHADEAFKKQDYSKCISALHTGTEDG

SEQ ID NO: 147065 - protein, 79 aa, Triticum aestivum
  Clone ID: PAT_TA_41483.pep
PRVRRRVRAEADGVWERRRSKRTKRGRPEKKGAIANETEQVAGENNTIFLQGQRKNYYLNELGWHAVQGVGGGCTGVRA

SEQ ID NO: 147066 - protein, 100 aa, Triticum aestivum
  Clone ID: PAT_TA_41484.pep
MRRLPLWILRSAAAGSLRSPAPSRGGCPVPRAPHLPAEAAAAPAELARWLPRRGYSRFASGFTPLEPKKLGSILDVERAKGLSPEHLVAAWDDYHLGRGH

SEQ ID NO: 147067 - protein, 31 aa, Triticum aestivum
  Clone ID: PAT_TA_41485.pep
TFTEHGRFFMQTYLARKQERRTVSYMAGRSE

SEQ ID NO: 147068 - protein, 98 aa, Triticum aestivum
  unsure (1)..(98): unsure at all Xaa locations
  Clone ID: PAT_TA_41486.pep
PYCEESLVCVISMYDFSSFLLKNVTGREVVWRRVRTDRRASGAETARGRRRARRAAAGDDGCVGGWRRGTEGEPAALPAPARXGRTPAEPPTRPPTRP

SEQ ID NO: 147069 - protein, 65 aa, Triticum aestivum
  unsure (1)..(65): unsure at all Xaa locations
  Clone ID: PAT_TA_41487.pep
GRVGTLGRRGGPTHLAILAQPGDTINGPLLLTVHGEVIEPSIMEEHXCFTALQRFTAATIEHVMC

SEQ ID NO: 147070 - protein, 44 aa, Triticum aestivum
  Clone ID: PAT_TA_41488.pep
RRHVGAHTLLVYDRAMPNITVGAGTVDVHLTPTENFADVPSTTV

SEQ ID NO: 147071 - protein, 92 aa, Triticum aestivum
  Clone ID: PAT_TA_41489.pep
TTSFLLALLIFFGEVLLLLVVLLDLEETSSSLDASLESSDWICFLDLGDFLGSISAPPDGRNRPTPPGLKNFDSASIHICRKERLQQEGRPH

SEQ ID NO: 147072 - protein, 120 aa, Triticum aestivum
  unsure (1)..(120): unsure at all Xaa locations
  Clone ID: PAT_TA_41490.pep
EIVRLEFSHYDIKSSKTISAKDFALSMVASADMNHINKLLDRVDDFDESPDVKDLRITFEEFKAFADLRRRLEPFAMAIFSYGKVNGLLTKQDLKRAATHXCXVDLTDKVGDVXFHVFDA

SEQ ID NO: 147073 - protein, 75 aa, Triticum aestivum
  unsure (1)..(75): unsure at all Xaa locations
  Clone ID: PAT_TA_41491.pep
MAATIQSVKARQIFDSRGNPTVEVDVCCSDGTFARAAVPSGASTGVYEALELRDGGSDYLGKGVSKAXDNVNLII

SEQ ID NO: 147074 - protein, 39 aa, Triticum aestivum
  Clone ID: PAT_TA_41492.pep
LLQGKYILSRAEPAAARDFCSTMIIVHLCVRVINLVMFF

SEQ ID NO: 147075 - protein, 96 aa, Triticum aestivum
  Clone ID: PAT_TA_41493.pep
GRLFLTESSHIYFLLFTNYFFFIFFFFLLTYFFFFFFIFSLFFIFFLSYLFHFYIFYFNYFIFFLSFFYFLLSVYHFILFFYYLFILSLISFSFIF

SEQ ID NO: 147076 - protein, 55 aa, Triticum aestivum
  Clone ID: PAT_TA_41494.pep
FRYSSGDATRPVSFRYRGSNLSFPTMPHHWAGIFTPKCRTLTSSLHRRGVESPIL

SEQ ID NO: 147077 - protein, 59 aa, Triticum aestivum
  unsure (1)..(59): unsure at all Xaa locations
  Clone ID: PAT_TA_41495.pep
LSLWQQAFRSVXDIHGLMTFVKRTLQPSVLVVQYFNLKGLSRISKIRLHHAYACLTLFP

SEQ ID NO: 147078 - protein, 74 aa, Triticum aestivum
  Clone ID: PAT_TA_41496.pep
KKLNLISDVCKNWIKKYCIMARGAGYISFFARCNARAFVLVKINRLVGMNLLGIYDSNASCTPVVFSCSSIALK

SEQ ID NO: 147079 - protein, 105 aa, Triticum aestivum
  Clone ID: PAT_TA_41497.pep
RTRGVDPPRPTSSTNQVSRLFHSPAHLCSPPPPPGRLQPVGLCRQVCCFKHRSPSPHVSISLSYNWLHKSHIDSLGKAEARWWIKLHSSLRFDHDLFTNRVPAVS

SEQ ID NO: 147080 - protein, 72 aa, Triticum aestivum
  Clone ID: PAT_TA_41498.pep
RTRGWTLTWYKQLDPYRSCLTHVLEGSAVVYLISAIPVYIYLGSFHQLYFYSLTRASIIVADITFSKMDMWN

SEQ ID NO: 147081 - protein, 89 aa, Triticum aestivum
  Clone ID: PAT_TA_41499.pep
MAGAPLLLLLAAVCLACFAPGANAAGRKMVGVYELSKGDFSAKVTNWGATVTSVVFPDSKGNLGDVGLGYDTIGEYVNGSSYFGALVGR

SEQ ID NO: 147082 - protein, 81 aa, Triticum aestivum
  Clone ID: PAT_TA_41500.pep
MLCLTSSSPSLLPRPSRPAADRPGPGISGGANVRLSAVPAPSPLRWKAKSDFSAPVSAPRDYTMATAEDGVGDLPIYDLDP

SEQ ID NO: 147083 - protein, 82 aa, Triticum aestivum
  Clone ID: PAT_TA_41501.pep
QHTGGLAFDSCAATKEMQPKSVPRRRKERPPHLVLATNIPNSEDDVHIHYCVHVEPLCTHNPTRPRTREVVASESPRPGPVP

SEQ ID NO: 147084 - protein, 123 aa, Triticum aestivum
  Clone ID: PAT_TA_41502.pep
PTRPRSAPRRSPLLPIRAAPASAPLLPSGPAMVLMSAAATAAVIYAYGKSVASVGLAAGTSARAFWVVGGFTKVLCPLCHEHVRQMKYERHTREHTFECPSCYDQVPFSELENHAQSHGYRCS

SEQ ID NO: 147085 - protein, 99 aa, Triticum aestivum
  unsure (1)..(99): unsure at all Xaa locations
  Clone ID: PAT_TA_41503.pep
RRATSPRSESDKAIVIDFHAQPIVHLPPNGIHPPTRSHLPSYNFSSAANNCLVLRPPLPRLLHQLTTLPAAPLCXPAGGGRIACFPASFLWGVWGDCDS

SEQ ID NO: 147086 - protein, 42 aa, Triticum aestivum
  Clone ID: PAT_TA_41504.pep
QSGMFDQPMVFTPGATRSQQLISLTLTVVAWKLSVRTVTCDR

SEQ ID NO: 147087 - protein, 118 aa, Triticum aestivum
  Clone ID: PAT_TA_41505.pep
HLIVKRALNEYFVFKCRWVLQLDSAGSIFYSTAPKWVRQSSIKDLPQCVDDTKDWCDHWKHCVWFTQGRGAPVMNEQTLSLRASHNLTSISYQLLNPNDEACNGSLKADNLTLLPERI

SEQ ID NO: 147088 - protein, 131 aa, Triticum aestivum
  unsure (1)..(131): unsure at all Xaa locations
  Clone ID: PAT_TA_41506.pep
PHPTLSSSLFCFLPPPRIGTSLVDWETWQDGWPLGLGTLKPGAGAVRSVDSSSSTAAFTPSHCVSSVASFDLDTESAWSLPHAGGGGGITLAALIGLVDAMESRCNTRWGERASMSGKLRALLLSLCXRSH

SEQ ID NO: 147089 - protein, 81 aa, Triticum aestivum
  Clone ID: PAT_TA_41507.pep
ELINRRRIRRSMRSTPPRDGVSSGVQIMTRSQSYVTLISMTMLRRRTQTLSLACLWRSSAPTGSYARSGPGRRSRTTATMS

SEQ ID NO: 147090 - protein, 41 aa, Triticum aestivum
  Clone ID: PAT_TA_41508.pep
PLAIESIQSGSPLIAVVKEESAAPCGPCPSWRPTAPTARAR

SEQ ID NO: 147091 - protein, 38 aa, Triticum aestivum
  Clone ID: PAT_TA_41509.pep
GKNAWSALLTNFFLCIFFLPVMEHSQIQNEEGPCQIGM

SEQ ID NO: 147092 - protein, 52 aa, Triticum aestivum
  Clone ID: PAT_TA_41510.pep
VCGCLQRHGCQGRLSLVYEDVVEFRKQDKSSTFQSTASFKARYAGKDAFSIQ

SEQ ID NO: 147093 - protein, 85 aa, Triticum aestivum
  Clone ID: PAT_TA_41511.pep
MFVEKRDGRTETVHFDKITARLMKLSYGLIQEHWDPVLVAHKVCAAVYKGFTTCQLYELACKTYVALTDYHRDYASLAARIAVSN

SEQ ID NO: 147094 - protein, 56 aa, Triticum aestivum
  Clone ID: PAT_TA_41512.pep
MFFVKRDGRTETVHFDKITARLKKLSYGLSQEHCDAMLVAHKVCAVVYIGVTSSLL

SEQ ID NO: 147095 - protein, 75 aa, Triticum aestivum
  Clone ID: PAT_TA_41513.pep
LEPSPLAVASPWRQQNLTPLPSRENLNPVDGVFGCQPAGHTRLQGDNFSRLAGPFETKPFKGWRPNLHYQKEPRP

SEQ ID NO: 147096 - protein, 146 aa, Triticum aestivum
  Clone ID: PAT_TA_41514.pep
GRVGQVVHGGSAVTENGALSSLELKRSASFQQCEAAEPLAKHLRVDQLLPENALRQRRIMSDAAGHSAQMSKSPVRAPLGIPFCSTSVGGSRKLLPPAVYAGEDHFSSCYEQGQLLNTEVLRKRMEKTAETLGLAGVTMDCAELLN

SEQ ID NO: 147097 - protein, 68 aa, Triticum aestivum
  unsure (1)..(68): unsure at all Xaa locations
  Clone ID: PAT_TA_41515.pep
MHRQMAVAAWALLLLLSEAASQCAVQALVPGVMIFIDSVEDAGYNNLLATLVRADFPPYXRDLPATHA

SEQ ID NO: 147098 - protein, 95 aa, Triticum aestivum
  Clone ID: PAT_TA_41516.pep
TYNSMTSLQHFRLPQVVTAIYATEGCPSNSINQTTPTLRWNHLTGIRLGSHYIMRGRIVLHYVVEVEEPSLYDSILASNIINIRIATRGAILRRP

SEQ ID NO: 147099 - protein, 124 aa, Triticum aestivum
  Clone ID: PAT_TA_41517.pep
DAWADAWATGGKAPRKQLATKAVRKSAPATGGVKKPHRFRPGTVALREIQTYQKSTELLIRKLPFQRLVREIAQDFKIDLRLQSFIVSALQEAGEAYLVGLFEDTNLCAIHAKRVNIMPKDIQL

SEQ ID NO: 147100 - protein, 91 aa, Triticum aestivum
  Clone ID: PAT_TA_41518.pep
MASPAARAASALLLLLALAVASVLSDGSDHRYKLGDPVPLYANKVGPFHNPSETYRYFDLPFCSPEKVKEKSEALGEVLNGDRVGDAPYKL

SEQ ID NO: 147101 - protein, 105 aa, Triticum aestivum
  unsure (1)..(105): unsure at all Xaa locations
  Clone ID: PAT_TA_41519.pep
DAWVPTSIKSSHSPTPRGGLLPRARTNHTARNSTGGXAPRKQLATKAVRMSAPATVGVKKPHRFSPVTFAHLEIRKYHKSSDLLIRMLPFQRLLLEIALDFNDRP

SEQ ID NO: 147102 - protein, 93 aa, Triticum aestivum
  Clone ID: PAT_TA_41520.pep
MGGSNYDDDWVLPSADITLVLVGKLGYGKSATGNSILGREAFVSEYSHASVTNTCQMGSTMLTDGRTINVIDTPGLFDMTVTPEDAGKEIVKC

SEQ ID NO: 147103 - protein, 60 aa, Triticum aestivum
  Clone ID: PAT_TA_41521.pep
YRHSHAPFHGKEEKDYQGRSWITPPKDAKATTERCYIPKRCVHEWVGHTKGVSTIRFSPK

SEQ ID NO: 147104 - protein, 151 aa, Triticum aestivum
  Clone ID: PAT_TA_41522.pep
HASAYGGPASPCRLPSSRLSTFPGLLRAARVRCSSSTSGRGRGRGSVSRFQRSRMAASCTEHAYNNILTSLPKPEGGEYGKLYSLPALNDPRIDKLPYSIRILLESAIRNCDGFQATKNDVEKIIDWENTSPKLAEIPFKPSRVLLQDFTG

SEQ ID NO: 147105 - protein, 59 aa, Triticum aestivum
  Clone ID: PAT_TA_41523.pep
KVPSASGGAVGVGRVGSAFGVGTFYDGPIGDPSIDFTPVDVTMPPTGGGGTGLNFAKPV

SEQ ID NO: 147106 - protein, 53 aa, Triticum aestivum
  Clone ID: PAT_TA_41524.pep
RVHLTPRSPPVHNRRPRPSSFQSPQRTDCSFTIVSLQALTWFDYSCRLVSPGS

SEQ ID NO: 147107 - protein, 78 aa, Triticum aestivum
  Clone ID: PAT_TA_41525.pep
ILKEAPNAANGKIEPGLNGPRQQTSSWGSQPCAPPRLFLPSLRLRWIKRPCMVAGARRNAGEEGIWLVIWNFCGGCSS

SEQ ID NO: 147108 - protein, 88 aa, Triticum aestivum
  Clone ID: PAT_TA_41526.pep
DALEVGVTNHVKGCLAAGDGEGVYERPCANQLDIIPDLLLGPAQRQRMRRLAGVHGVAHWSDAHEVLRSLGVLLSSRGSSCNCRAQRR

SEQ ID NO: 147109 - protein, 45 aa, Triticum aestivum
  unsure (1)..(45): unsure at all Xaa locations
  Clone ID: PAT_TA_41527.pep
KLVPFXPEYLDESVMWTESGDVGKGFRCIRMVNNIRLNFDALNGD

SEQ ID NO: 147110 - protein, 50 aa, Triticum aestivum
  Clone ID: PAT_TA_41528.pep
PCLTCSFLTLHLPSELCDYMEIYISAWQLLTLWKKLLIILIILLPLTVLY

SEQ ID NO: 147111 - protein, 99 aa, Triticum aestivum
  Clone ID: PAT_TA_41529.pep
STRLPLKYSRSMLAPTPMLPENPSAAVLLLRSDRPRGSLRSAVYLAPPGPASRLGAAGMEPQEMSCISTADARIRPPAITLCCASPASSSSPTRPRTRG

SEQ ID NO: 147112 - protein, 101 aa, Triticum aestivum
  Clone ID: PAT_TA_41530.pep
GFMSTPDGENCGLVKNLAVTAIVSSRVAQPLIDRFVSCGMNKLDEIPAKQIPKMDKIFLNGDWVGSCADPASFVMRLRCMRRGGLIDPQVEIKRDKHQSPG

SEQ ID NO: 147113 - protein, 42 aa, Triticum aestivum
  Clone ID: PAT_TA_41531.pep
SSVGGVHAERVATCLGLHAGAGPMRRAWPSSTRGRVLLSSVG

SEQ ID NO: 147114 - protein, 95 aa, Triticum aestivum
  Clone ID: PAT_TA_41532.pep
MDANWRPTQGPDPAAAVGDWRAQLQPEARSRVVNKILETLRKILPVSVPDELIELQEIARQFEDKIYTEATNQSDYVRKISLEMVSMETSRQLAS

SEQ ID NO: 147115 - protein, 44 aa, Triticum aestivum
  Clone ID: PAT_TA_41533.pep
MEGGGRKRGTADGAAVGGKRTRESESFQTGVGSKSKPCTKFFST

SEQ ID NO: 147116 - protein, 122 aa, Triticum aestivum
  Clone ID: PAT_TA_41534.pep
HASAAVSCAAAMDAATASRLRAFESWMREHGVVCSDALRLDASEAGGVYVRALAALREGDVVATIPRRACLTPRTFGAAAAIKDAQLGGTLALAGAVMYERARGADSPWHDYLRLIPDCEPV

SEQ ID NO: 147117 - protein, 71 aa, Triticum aestivum
  Clone ID: PAT_TA_41535.pep
QADRRFENKLVHNRLRPAPGADCGYCTKVCIHWRAGRCNRYPCPCLHSELAEAATTKRSNQQDGPCGHVWR

SEQ ID NO: 147118 - protein, 125 aa, Triticum aestivum
  unsure (1)..(125): unsure at all Xaa locations
  Clone ID: PAT_TA_41536.pep
DAWADAWFSSLTTSLRWDGALNVDVTEFQTNLVPYPRIHFMLSSYAPVIYDEKAYHEQLSVSEITNSAFEPSSMMVKNEPGHDKYMVCCLMYRGDVVPKDVNAAVATIKTKRAIQFXVDWCPTVF

SEQ ID NO: 147119 - protein, 73 aa, Triticum aestivum
  Clone ID: PAT_TA_41537.pep
PRVRGRVGQIPMCNEKEVYQQSIGAVCNLDWPRSNFLVQVLDDSDDAATSALIREEVEKWQREGVRVLYRHRV

SEQ ID NO: 147120 - protein, 83 aa, Triticum aestivum
  Clone ID: PAT_TA_41538.pep
MGFKPLEWYCQPVKDGAWSHAVESAFGAYTPCGIDTLVVCISYLTLFGVCFYRTWRTTKDYKVQRYKLRSPYYNYLLGLLVVH

SEQ ID NO: 147121 - protein, 63 aa, Triticum aestivum
  Clone ID: PAT_TA_41539.pep
GRVGGRVGLLCQLSLRWDVALNVDVTDFQTNLVPYPRIHLMFCSIGPVFWAKRASPQAVSVSE

SEQ ID NO: 147122 - protein, 122 aa, Triticum aestivum
  Clone ID: PAT_TA_41540.pep
RGGPDPRVRLRVRPRVRGRVGNNGGALSWALRAAREAESVAAAGCSGHGRVFLDGIVGEDGRPGCECNTCLEGPDCFVRTPDCTCYADRGDPMVREPLWIRHAEASAVVVFGWHRMSYRATD

SEQ ID NO: 147123 - protein, 86 aa, Triticum aestivum
  Clone ID: PAT_TA_41541.pep
MAGPGGCAASWVLYLSLAAKCGGDHPGRLAGLLAVCAAAFALTCLLHWCFPGGPAWGRWWLTRRLKGSLVSGPRGLPLIGSMWLMT

SEQ ID NO: 147124 - protein, 111 aa, Triticum aestivum
  unsure (1)..(111): unsure at all Xaa locations
  Clone ID: PAT_TA_41542.pep
PYLIAPMAGDPSPSPSPPGSPAXAPPPPGARRRGPRPRRLPEAPXAPPPSPPPFPPXPPSGRXQPPPPSAADGEDVEEGEILDDAGAGAGGAMEVDGGPRDDPALREPTRS

SEQ ID NO: 147125 - protein, 145 aa, Triticum aestivum
  Clone ID: PAT_TA_41543.pep
PTRSPTRPGEFGCSSKIRLVNDLLESIHFVASTEAMFIGVRAGIHPSIIYDIISNAAGSSRIFVEVVPKILSEDPLLIDFLKSLKKHASYVMDTAKAATFPLPLLAVAYQQLIHGSSAVIGDESASPLKVWEQLFGVNIIDAASQ

SEQ ID NO: 147126 - protein, 63 aa, Triticum aestivum
  Clone ID: PAT_TA_41544.pep
KTGFSSVNKQRNWHRVIATHSGHFRFSDSHNNKQNLGLGSRSMNYVMMSYVSDIQKFSHILGQ

SEQ ID NO: 147127 - protein, 48 aa, Triticum aestivum
  Clone ID: PAT_TA_41545.pep
HASAEMTDIFEGSIIRLVRRLDEFLNQLKAAAEAVGEVNLESLPAKSC

SEQ ID NO: 147128 - protein, 60 aa, Triticum aestivum
  Clone ID: PAT_TA_41546.pep
RKWRLEGLISRRQNVPQWQLHISMVTKTQIIARTSYCHLYCASYLAEVPDNCLPETILLS

SEQ ID NO: 147129 - protein, 126 aa, Triticum aestivum
  Clone ID: PAT_TA_41547.pep
HASAHASAHASGFVYTWGFGGYGRLGHNEQKDEWQPRLVEIFQKSNILGPNDIISAGSASSACTAGGRGQLYMWGKVKNSGDEWMYPKPVMDLSGWNIRCMAFGNMHHTGGADDSCISWGPSEYGE

SEQ ID NO: 147130 - protein, 59 aa, Triticum aestivum
  Clone ID: PAT_TA_41548.pep
VPFSMFQGPLPVSLHSTSAVMSTTCISMVIAVDNQGKYHKQITTLESLNSNRFLISFKR

SEQ ID NO: 147131 - protein, 104 aa, Triticum aestivum
  Clone ID: PAT_TA_41549.pep
YEHPLPSFDHGDDNDSLWNFGDKDGENGDSDLFFGPGGLPPIRTGGSTSASAFGKEQKPMFDSVPGTPMEKPFFDSVPGTPLQKSVFDYSVPSTPMQNSSFDYS

SEQ ID NO: 147132 - protein, 109 aa, Triticum aestivum
  Clone ID: PAT_TA_41550.pep
ACRTGNQPGPGCHAPSPPAPCPCARKIRPVKQPRRRPKVNTSKQADRAGGAPFRSPHRPPTCESAGSPWSTGEATGWSKSHSHWWEEEEEAGILCWSGVGGGEGSLVER

SEQ ID NO: 147133 - protein, 76 aa, Triticum aestivum
  Clone ID: PAT_TA_41551.pep
SKTSHSTAQFNKLVYTKKLVDNQIETTRLVSRLVMRLIIHGCYKNPICATTKQWSGRNKSWFPTFSDHPSALVLIR

SEQ ID NO: 147134 - protein, 103 aa, Triticum aestivum
  unsure (1)..(103): unsure at all Xaa locations
  Clone ID: PAT_TA_41552.pep
NTPTEVXLTIFAKGXVPADRVVVDFGEQMLSVXIELPGEELYHFSLFVFKDRPISAVYCVFSKVDCALKSXPVTWTXFFYTVVRTAPHKINVQVDSAYRPSYP

SEQ ID NO: 147135 - protein, 128 aa, Triticum aestivum
  Clone ID: PAT_TA_41553.pep
DAWASINEEVPTAIIASLVKDVVDGIEFARGGVNTTWGSVRAAMGHQQPFKLDYVSIGNQECWMLYYRGNYQKFYSAIKAAYPDINIISSCDKSTISASNPADLYDVHVYASSANMFSRTSMFDNTPR

SEQ ID NO: 147136 - protein, 92 aa, Triticum aestivum
  Clone ID: PAT_TA_41554.pep
MLESTNTCEHGQRFLCGAWLAPKAPQRNHAPQIPKLKFDRVEMSTKIRDIVEQLKPVCAMVSTILNLELLGSSRTLGQEAVMNRAKTTPEII

SEQ ID NO: 147137 - protein, 75 aa, Triticum aestivum
  Clone ID: PAT_TA_41555.pep
TMKFHDPGCDLLKMMDVLQSGVWHFGLVYEDYRFLWKIKIPPKIRMFLWLVLREKHLIRRLCWIGVEKCESGWLF

SEQ ID NO: 147138 - protein, 105 aa, Triticum aestivum
  Clone ID: PAT_TA_41556.pep
VTCRGTRQRIKKSAKSTTNYPSKHKLWLDKRRKITFHSFIDQYIIHQAQICPSMCSAAMASIWSVAMAIRSLSRNERSKNLATNAHILYTSSKLVRKPSETSTTS

SEQ ID NO: 147139 - protein, 51 aa, Triticum aestivum
  Clone ID: PAT_TA_41557.pep
LARVFVTSHSIIDEWNCALFTTGADDTHVTSLGNIIGASFSVLFAPLTEIC

SEQ ID NO: 147140 - protein, 36 aa, Triticum aestivum
  Clone ID: PAT_TA_41558.pep
SFKLGLWSSESGIATEHRDKHVFLYYSRVKKEPENN

SEQ ID NO: 147141 - protein, 56 aa, Triticum aestivum
  Clone ID: PAT_TA_41559.pep
RNVHILELCIAKKGLNVLCVSSHERLVILCGICIKLACGSLAPHCSLTTPTTACRQ

SEQ ID NO: 147142 - protein, 67 aa, Triticum aestivum
  Clone ID: PAT_TA_41560.pep
LLAPASCFPRPNVTAWWRREERIRSRHEASSAFPTSLINPSCSTNPTQLLSFLSFPFPFLLHPSRSY

SEQ ID NO: 147143 - protein, 120 aa, Triticum aestivum
  Clone ID: PAT_TA_41561.pep
QLPLHMHGGNGKVAYIGTEGTFRPERIVPIAERFGMDANAVLDNIIYARAYTYEHQYNLLLGLVAKMAEEPFRLLIVDSVIALFRVDFSGRGELAERQQKLAQMLSRLTKIAEEFNVAVY

SEQ ID NO: 147144 - protein, 105 aa, Triticum aestivum
  Clone ID: PAT_TA_41562.pep
IQTIYPTGINGTAHRQLDQPRTPPLASYALTPTCPPLPTDRSTHQLQVTVALEASTTSGSAVKISTVILLRFFLTESSASHGRGPTCYARRVMTNVLCSVVYYLT

SEQ ID NO: 147145 - protein, 140 aa, Triticum aestivum
  Clone ID: PAT_TA_41563.pep
PRVRGRVGGAAVGATFGGSAAYLINAAIPGSAAVAQPQAYALVGMAATLASVCSVPLTSVLLLFELTKDYRILLPLMGAVGLAIWVPSVVNQPNDGESSGFRAPTRGYSLVSLQDKNSSVWTRSDSVDDLELTISQSGLR

SEQ ID NO: 147146 - protein, 30 aa, Triticum aestivum
  unsure (1)..(30): unsure at all Xaa locations
  Clone ID: PAT_TA_41564.pep
PTRXLTLFLFCYSIKILIDRCLFKIGGYTL

SEQ ID NO: 147147 - protein, 82 aa, Triticum aestivum
  Clone ID: PAT_TA_41565.pep
PRVRGRVGVKEDQPEDEEGLPTYPYDRLRTSSSNPVTDIDSTRRETYLSSAEFREKFGMTKEAFAKLPKWKQNRLKIALQLF

SEQ ID NO: 147148 - protein, 127 aa, Triticum aestivum
  Clone ID: PAT_TA_41566.pep
NRLLNPCPRRDLRLRLSLPTDRPVVPVLNERSSPFQSRLRGMRKLADLADTRSIAAEAVTAAAACSERRRRQRRLASSRSRVSMRCPVASMDARMCADWRSTASCWRMSPSVMLAASPAPTRPPTRP

SEQ ID NO: 147149 - protein, 39 aa, Triticum aestivum
  Clone ID: PAT_TA_41567.pep
APRKTAGGLISRVIRLRNRARTLGSLSECAYAKRFRTRG

SEQ ID NO: 147150 - protein, 48 aa, Triticum aestivum
  Clone ID: PAT_TA_41568.pep
MVNAVAALTGSEGVKGTIFFTQEGEGPVTVSGSVTGLKEGLHGFMFTL

SEQ ID NO: 147151 - protein, 85 aa, Triticum aestivum
  unsure (1)..(85): unsure at all Xaa locations
  Clone ID: PAT_TA_41569.pep
RTRGVQGNLILQLRASKLLKSEEVKLQQLAKDVPKGHIPRSLTAHLTGELTRIAAPGDVVEIPGVFLPHAXFGFPAMLARLVADT

SEQ ID NO: 147152 - protein, 77 aa, Triticum aestivum
  Clone ID: PAT_TA_41570.pep
PTFLPWRPHMHPPILVAYTRKLEEMMGADNTPSSGEIVGAQQPPFPPPMVGRDHHAALLDTDASAPPISITYPDSTS

SEQ ID NO: 147153 - protein, 29 aa, Triticum aestivum
  unsure (1)..(29): unsure at all Xaa locations
  Clone ID: PAT_TA_41571.pep
MFRITSLLESPSPXLHSVPRVRPRVPNAW

SEQ ID NO: 147154 - protein, 111 aa, Triticum aestivum
  Clone ID: PAT_TA_41572.pep
GRVGLDPKFRLDYCKLWKALISLDVQKILELGEQFGVGKYAKYFPLIFTGRTIDSKSALGTQISGEEKTRIKQDLNSLGMDDISSFMESLPPDFLVILRTEMLFVISIQWT

SEQ ID NO: 147155 - protein, 53 aa, Triticum aestivum
  Clone ID: PAT_TA_41573.pep
WDWEEDTAFCLSLHDYASHHDGALFASVGIKVSTPATAGSTIPAEQRVHDPFC

SEQ ID NO: 147156 - protein, 91 aa, Triticum aestivum
  Clone ID: PAT_TA_41574.pep
LPLGLLFLLSGLVVNTVQAVLFLTIRPFSKRLYRQINVFLAELLWLQLIWLVDWWAGIKVQVYADPATWKLMGKELMPILPLGTDIISLFT

SEQ ID NO: 147157 - protein, 85 aa, Triticum aestivum
  Clone ID: PAT_TA_41575.pep
TRMGGNDALLDALLVHRSARTRGQGRAQVLRNISAHTDVGFTVRTTVFLPRSRHAHPRRQGLHHLQRRHLHDAPPGHRSPSLPIF

SEQ ID NO: 147158 - protein, 27 aa, Triticum aestivum
  Clone ID: PAT_TA_41576.pep
LCASSPPVTWSVKELLQFDHQPHRYRV

SEQ ID NO: 147159 - protein, 106 aa, Triticum aestivum
  Clone ID: PAT_TA_41577.pep
SGALASLPSPPLPSLGREVKRRGEERRGEEGLERRPWQGRGEEEAMAIAGLVLPAAARSPWLGFRRHGREGEGGQRHGWGRGGRRAGEAEWLGQRKSALELGSVGW

SEQ ID NO: 147160 - protein, 109 aa, Triticum aestivum
  Clone ID: PAT_TA_41578.pep
QLDMGHWLPFPHLLLHSLGRKVKRRGENSKEEEGLERRPWQGRGKKEAMAIAGLVLHDEDRSPWIGIRRHGREEEGGQRHGWGRGGRRAGEPQWMGQRKSALKLGSDGW

SEQ ID NO: 147161 - protein, 69 aa, Triticum aestivum
  Clone ID: PAT_TA_41579.pep
LGERGCAEVNVERPHSYLLNNYHQALCCGDIKNLPFYETIKCTWHVTDIYSRANQSGGDTRPNTRRCFK

SEQ ID NO: 147162 - protein, 51 aa, Triticum aestivum
  Clone ID: PAT_TA_41580.pep
RPHVSLRVAVAVVDSNTRRRGVTHGRFQVFLQTLTGIYITLEGGCFNTYRL

SEQ ID NO: 147163 - protein, 44 aa, Triticum aestivum
  Clone ID: PAT_TA_41581.pep
PTRSVRTLAMYPPIHQCSNGHTIWSGCKPRAHNRCPTCRSGLGF

SEQ ID NO: 147164 - protein, 90 aa, Triticum aestivum
  unsure (1)..(90): unsure at all Xaa locations
  Clone ID: PAT_TA_41582.pep
GWCYTVYKHPGFRGGISDAPKKVPFAHMDPESXHLCPRDIHILRRLDNPNVINLAGLVTLRMSCSSFLLFQYMEHDLAGLVGTPGVKIYI

SEQ ID NO: 147165 - protein, 104 aa, Triticum aestivum
  unsure (1)..(104): unsure at all Xaa locations
  Clone ID: PAT_TA_41583.pep
MASHPPPPSSPAPPEYPIPPAPTTISALDDDQLREIFLRLPDLPSLASADFTCRAFLGAVRSCRAFRRSFRALHAPPLLALFLTPYMRTVPTFPXLRPTAARFS

SEQ ID NO: 147166 - protein, 88 aa, Triticum aestivum
  unsure (1)..(88): unsure at all Xaa locations
  Clone ID: PAT_TA_41584.pep
MALPNQNTVDYPNFKLVIVGDGGTGKTTLVKRHXTGEFEKKYEPTIGVEGHPSDCTTNWGKILFYCRDTAGQEKFGGLRDGXYLHGQG

SEQ ID NO: 147167 - protein, 120 aa, Triticum aestivum
  Clone ID: PAT_TA_41585.pep
ISMEPSRCTAAMHEWVAPRVMPSTSSDRRRLSGTRKLDAVRGKKRKPRTSSASAARRAMDLAQIDLEHTSSVTIFRRGRRHVPRHHGEVFGVRSTQKMTCATYDTRFRLKLIFFAGTKIE

SEQ ID NO: 147168 - protein, 107 aa, Triticum aestivum
  Clone ID: PAT_TA_41586.pep
MLERPLIATLPLEARGKIGDFIKGVFAVFQDLDFSFIEMNPFTMVNGEPYPLDMRGELDDTASFKNFKKWGNLEFPLPFGRVLSSTESFIHELDDKTSASLKFTVLN

SEQ ID NO: 147169 - protein, 86 aa, Triticum aestivum
  Clone ID: PAT_TA_41587.pep
PRVRITPAADVAPRALLVPGANFAGNTTPPEETLLPHLVCHPDKTLGPPPPTSTTMAAQTPRPAAGPDSGPGPTPTSQVVNNAFVH

SEQ ID NO: 147170 - protein, 49 aa, Triticum aestivum
  Clone ID: PAT_TA_41588.pep
ARVPAPLPFSEPSSYSDHSCVHAGRGEHLREHISGNSCRRIKRAIVGES

SEQ ID NO: 147171 - protein, 85 aa, Triticum aestivum
  Clone ID: PAT_TA_41589.pep
GTPRPGRPSCVAANGRQPNRLPRPAMRRAGSGPTIQNRPRQRSIRIRDPLTRIGSPGGRPGPSLVTRRKRKKIWIRAVGVEQTSP

SEQ ID NO: 147172 - protein, 52 aa, Triticum aestivum
  Clone ID: PAT_TA_41590.pep
PKQGMLIHVPSFETIDDTLANMSLKFMRIIVQYSSSFHHHKIRIQFIRSKQN

SEQ ID NO: 147173 - protein, 96 aa, Triticum aestivum
  Clone ID: PAT_TA_41591.pep
VQVLLLSTSMQVVCKISIQYHHPAIPFRLSPSPMIIPWLSSIQSCWPRWIRLIRHGQASVICTGSVFASLSEYSSSMPVPVLRRACSVKVVCSRIT

SEQ ID NO: 147174 - protein, 52 aa, Triticum aestivum
  Clone ID: PAT_TA_41592.pep
PGPSQNKNGSALLLLLQVAWELPRPLLDNSSGSPHQPVLQMFSASSLLCIHC

SEQ ID NO: 147175 - protein, 87 aa, Triticum aestivum
  Clone ID: PAT_TA_41593.pep
RTALHCLHPVLARLEEPPGHQSGDGAQAVQRRGPEIGGAGLKLLGRVREHGCGASGSGPRGNPHPHIGDGGAGCWLLSVAQSGVWVS

SEQ ID NO: 147176 - protein, 59 aa, Triticum aestivum
  Clone ID: PAT_TA_41594.pep
GVKHLRSPVTNAEERAFNMLWPIQNQCPCRAICFHTVHDWNRRSPARPCRHPRVRGRVG

SEQ ID NO: 147177 - protein, 115 aa, Triticum aestivum
  Clone ID: PAT_TA_41595.pep
TTPSPPHLAAATAGNVGSSGRAVSAAPAATASASAKRSTAPYAGAPMAERLLCSSCSICCCCCSSAAADAADFLDLRRWLAAAVAAPASKLLGRGEGGVTIWCWVVRAFLPPSFV

SEQ ID NO: 147178 - protein, 65 aa, Triticum aestivum
  Clone ID: PAT_TA_41596.pep
GCSTTCLRTLLNPLYCSSILIYKTANCRNETTASVTRSDTTYNMTCTHCYAIVAVYTKGINTNED

SEQ ID NO: 147179 - protein, 70 aa, Triticum aestivum
  unsure (1)..(70): unsure at all Xaa locations
  Clone ID: PAT_TA_41597.pep
GRVGVITHYGCIDQITCSPGVYLSYSSKAAIGDCLDTAMVLLAYTENMSDPTFQSXNNIILMSRTDDAVY

SEQ ID NO: 147180 - protein, 87 aa, Triticum aestivum
  Clone ID: PAT_TA_41598.pep
ASFSLFSSSIRSVFSCLRAIVDLLQQLKNPLEPVTWQLVVLAAALPAAAAWESSPGSRHIVLSRVLECRSAGSLPRRGLRRRRACFL

SEQ ID NO: 147181 - protein, 112 aa, Triticum aestivum
  Clone ID: PAT_TA_41599.pep
MAAQTFIMIKPDGVQRGLIGEVISRFEKKGFYLKGLKLQNVEKSFAEQHYSDLSSKPFFAGLVEYIVSGPVVAMVWEGKSVLATGRKIIGATNPLACEPRTIRGDFSVDISR

SEQ ID NO: 147182 - protein, 60 aa, Triticum aestivum
  Clone ID: PAT_TA_41600.pep
LGPRSPVYRSVGTAHEDNIVLALEVAVRHVFCVGEEVHDRLKNGINCSLNSIRIVACLAN

SEQ ID NO: 147183 - protein, 39 aa, Triticum aestivum
  Clone ID: PAT_TA_41601.pep
SQTMKASTQITCSPGVNHSYSVKAAIGASLEMVMVPFAY

SEQ ID NO: 147184 - protein, 75 aa, Triticum aestivum
  Clone ID: PAT_TA_41602.pep
LFPCLILIKPPPFSCYSVKWYMCLRGSFPAIGMNVCWWIRRDCESVIEQSVESELKKQHSPHVVEGTMHNLQPYT

SEQ ID NO: 147185 - protein, 35 aa, Triticum aestivum
  Clone ID: PAT_TA_41603.pep
LLRPINVKLRTPVRVVRVYMRRTRRTPHWVLLPLL

SEQ ID NO: 147186 - protein, 54 aa, Triticum aestivum
  Clone ID: PAT_TA_41604.pep
ALLVKTNMHYLSYKNVYPNCCALLLLRGYISLMFANVCVLPDLIPYMLCFFWVA

SEQ ID NO: 147187 - protein, 33 aa, Triticum aestivum
  Clone ID: PAT_TA_41605.pep
MDGKEEDVRLGANRYSERLPIGTAVLGGCDYKD

SEQ ID NO: 147188 - protein, 126 aa, Triticum aestivum
  Clone ID: PAT_TA_41606.pep
FVDTRFTLHQTPCARLSSGELDALESSGLTSMHATDNSHSRFLHGFPNGSQTANSDRGSHVEKMNSGRVSTDYGTAGCVHGNDKVAPGPHILLPIDPFEAFAPQRSVANGASPVYQNENYDQFLVH

SEQ ID NO: 147189 - protein, 59 aa, Triticum aestivum
  Clone ID: PAT_TA_41607.pep
YHKTPEPVLERSTPKLRVRPCLACAMGKHTAETVYRQRRRRPETSSIRRGMKEKSCRLP

SEQ ID NO: 147190 - protein, 59 aa, Triticum aestivum
  Clone ID: PAT_TA_41608.pep
PTRPGARYTLLPYIIEHAGVSKPARRTYASAIVPEAKGCAMHCLSFIRHDYITEHDTSE

SEQ ID NO: 147191 - protein, 100 aa, Triticum aestivum
  unsure (1)..(100): unsure at all Xaa locations
  Clone ID: PAT_TA_41609.pep
RKPHPTKLRSTITPCTVLILLAGRYIEKRVLFLKQLKSGLIHITGPRKSTGVXAITRLSQAYNIATSTKVDICTXNEQKWDDKIFAREKKTRAQKTEGEL

SEQ ID NO: 147192 - protein, 57 aa, Triticum aestivum
  Clone ID: PAT_TA_41610.pep
LRFLLCLLSLHRTINKDREITSIVPNLVISSKRYCHLVLSVRPPLYMLGEKLTPPLK

SEQ ID NO: 147193 - protein, 32 aa, Triticum aestivum
  Clone ID: PAT_TA_41611.pep
CSLDRAIFLWRGATNYIGMHVFLASARLVHPT

SEQ ID NO: 147194 - protein, 87 aa, Triticum aestivum
  Clone ID: PAT_TA_41612.pep
MRECISIHIGQAGIQVGNACWELYCLEHGIQPDGQMPGDKTVGGGDDAFNTFFSETGAGKHVPRAVFVDLEPTVIDEVRTGTYRQLF

SEQ ID NO: 147195 - protein, 131 aa, Triticum aestivum
  Clone ID: PAT_TA_41613.pep
EASGIPRAGLWLTFGLAIFWTMPFPSWEALINIVSAALVLSYAVAPVSVAALRRTAPDLPRPFRAIAFGITGPASFVIAALIVYWSGWSTVSWLLGLQIVMFVIYLACRRWVPTAHLSLAEQVRSSAWLIA

SEQ ID NO: 147196 - protein, 127 aa, Triticum aestivum
  Clone ID: PAT_TA_41614.pep
VLAGRWRHAWRSIRRLHLSPEDWWDRGSPEHLKNFFDALLSPGGHDSILEEAQLDFDGLVEDCAHAEVWIRRILSGQAQVLDVSFATLENPPLVSRHLRKLELTEMILEGDVLDFASCPALEDLKMA

SEQ ID NO: 147197 - protein, 65 aa, Triticum aestivum
  Clone ID: PAT_TA_41615.pep
SQHLFYQVAFDGSISDPVVVKHAGAIKSLVPVVNDQILHWGDHAPRRTPGPVMDQDGGAHPGTCS

SEQ ID NO: 147198 - protein, 126 aa, Triticum aestivum
  Clone ID: PAT_TA_41616.pep
DAWALEEGRCMHTFVLRHGYEHHIHVRSSVVDMYAKCGAIDAAQRLFNVAPVKDVIMSTSILSGLASCGRIGDAKRVFDRMQERNLVSWNAMLTGYIRSSDLTGALHLFQQMRKETKELDDVTLGS

SEQ ID NO: 147199 - protein, 67 aa, Triticum aestivum
  Clone ID: PAT_TA_41617.pep
HASGSMRVLRLFALAGAGLMLDVINSGTATVSYMISQQYTCYFMLRDGHHSYWGYSRCLDCLFYTYD

SEQ ID NO: 147200 - protein, 104 aa, Triticum aestivum
  Clone ID: PAT_TA_41618.pep
MARASSLSLLLALVVAAATSAAGARVPVDAAGNATLSELRARRGRREALENGLGRTPQMGWNSWNHFYCGISEEIIRETADALINTGLARLGYKYVNIDDCWAE

SEQ ID NO: 147201 - protein, 125 aa, Triticum aestivum
  Clone ID: PAT_TA_41619.pep
GRVGGRVGNQVEAYEGSKKHMDCSPAKLPEENELLKKYLATINPEHIDTVLIERLLRKICTDSNEGAILVFLPGWEDINQTRERLLASSFRDSSKFLVLSLHSMIPSSEQKKVFKRAPAGVCKII

SEQ ID NO: 147202 - protein, 123 aa, Triticum aestivum
  Clone ID: PAT_TA_41620.pep
PRVRSKQRLMSLASSPSLGLSPPPSSTNVSAAEDAGAGKGKQPVTPSLEDNKLLRRLSIGPKAFFRRSVEKDEEQDKDGFFKRLLRDSKDKEEDDGDKEGFIKRLLKDSKEKENDEEEGDKDG

SEQ ID NO: 147203 - protein, 127 aa, Triticum aestivum
  Clone ID: PAT_TA_41621.pep
LGRDPDGGSLQPEWEVRRMTSSGRIQSMAAAQAKERFGTTAMESGGAPGRGRRCKARWPGFLLIAARGERREGRSAQEGGKRHMGERRGMVQSPWTRRLAWWASGARHRASCSIRRWELEGDGSTGA

SEQ ID NO: 147204 - protein, 83 aa, Triticum aestivum
  Clone ID: PAT_TA_41622.pep
AICILQILQQLFASNCRVTLYKGYGPLCYPSLRCHAVFYPTGRGALVLHRNLGNLCSGTNKRGKSKPSPTTWSPLSVSSISNT

SEQ ID NO: 147205 - protein, 83 aa, Triticum aestivum
  Clone ID: PAT_TA_41623.pep
EPCCMLRSLSYKCRCGTCQSVYTINRIGVRAIKACTVPLLFHHHNTQAASCSTLEATRLLLSSTISPVCAYIGIQPQCLSNTL

SEQ ID NO: 147206 - protein, 128 aa, Triticum aestivum
  Clone ID: PAT_TA_41624.pep
SSLGRFVLIIWLFVVLIINSSYTASLTSILTVQQLSTGIQGLDGLLASADPIGYQVGSFAKSYMMQELNVPESRLKELAIDDYAASLQLGPRNGGVAAIVDELPYVDLFLSTNCQFKTVGQEFTKSGW

SEQ ID NO: 147207 - protein, 56 aa, Triticum aestivum
  Clone ID: PAT_TA_41625.pep
RTLGVVLMSICYHSNPNSLKKDAPPGIVVSHCERRRLERYQVDTGWSWWTGTPDAS

SEQ ID NO: 147208 - protein, 120 aa, Triticum aestivum
  Clone ID: PAT_TA_41626.pep
GRVGTVIVAQKNHHTRCFQTNSPENVPPGTVVDKQVCHPKNFDFYMCAHAGMIGTSRPTHYHVLHDEIGFSGDELQEFVHSLSYVYQRSTTAISVAAPIAYAHLAAAQVGTFMKFEDMSD

SEQ ID NO: 147209 - protein, 41 aa, Triticum aestivum
  Clone ID: PAT_TA_41627.pep
TCLILFFLHYNSQSSVLTQELGWYFSEPASMLMKKYSCALP

SEQ ID NO: 147210 - protein, 84 aa, Triticum aestivum
  Clone ID: PAT_TA_41628.pep
SATGLLRPCVTCLNRMGCRRRGVTCRRLCPSRPWWTSRPILGTGRGFLQFQVKPNSLAWPSRWISCCSTWMCVVANGMAGSCCE

SEQ ID NO: 147211 - protein, 129 aa, Triticum aestivum
  Clone ID: PAT_TA_41629.pep
QQFPNQEKLDDPKLYHYALFSDNILATAVVVNSTVLNAKHPSRHVFHIVTDRLNYAPMRMWFLSNPPGKATIEVQNIDEFTWLNDSSSLLLKQLGSQSMIDYYFTAQSANSDSYLKYRNPKYLSMLNHL

SEQ ID NO: 147212 - protein, 69 aa, Triticum aestivum
  Clone ID: PAT_TA_41630.pep
SSDQSDFLTVGQAEWGMRPPLHRAIERYAGGVFTQVEGYNCHGPIILFVPKLLFLFLYVGQLPEVFFKA

SEQ ID NO: 147213 - protein, 127 aa, Triticum aestivum
  unsure (1)..(127): unsure at all Xaa locations
  Clone ID: PAT_TA_41631.pep
GPDAPDEDAHTPIIHRDIKARRILLDERWVSKIADFGMARLFPEADDGHSHVQTRVVGTNGYMSPEYLMHGHLSDKADVFSFDVLVLEILSGRKNYFFXQRPDPTPTXLLDYAWKLYKEERGLDLLD

SEQ ID NO: 147214 - protein, 81 aa, Triticum aestivum
  Clone ID: PAT_TA_41632.pep
MVIMALPKNIVGTRSTKAELQFLVGRIRRFLKKGRYTQRVGFRAHDYLVVVLEYLVDEVLELVRLAAKDNKKDACVPYLLC

SEQ ID NO: 147215 - protein, 78 aa, Triticum aestivum
  Clone ID: PAT_TA_41633.pep
KQHKKRWIRADLDGVIQFVMYLAFTSMGIAGLVEGEAIERRDGSHLIADGERSRGSRLGAKALSWERTSCHSRQWQWR

SEQ ID NO: 147216 - protein, 94 aa, Triticum aestivum
  unsure (1)..(94): unsure at all Xaa locations
  Clone ID: PAT_TA_41634.pep
MARMGRERKKAVTRSTKAGLQFPVGRMGRFLKKGRYSQRVGSGAHVYLAASLEYLAAXVLKLAXYAAKVNKKTRIXXRPLLLCIXNYQELGXLL

SEQ ID NO: 147217 - protein, 64 aa, Triticum aestivum
  Clone ID: PAT_TA_41635.pep
PTRSTSSCTTSSTPSKRAKKLVEKSLKQQHMLQHMLANMPPDMRAAIVATTLEQSLDVSLELKF

SEQ ID NO: 147218 - protein, 102 aa, Triticum aestivum
  Clone ID: PAT_TA_41636.pep
ELQRERPTRPLTRGPPHVSPSTERLKRTVMRSARLLRLSFCHVPSLLFQGPLSPSPSPDLDLGLSVARVVLVHLRCSAADAGYCRCKKVSSRLALAQHVMHY

SEQ ID NO: 147219 - protein, 54 aa, Triticum aestivum
  Clone ID: PAT_TA_41637.pep
DCKIYYIQSCSQTAWMSAWMIASISSSLWCGLKGVYNNIFPFRKALSSALRCRV

SEQ ID NO: 147220 - protein, 35 aa, Triticum aestivum
  Clone ID: PAT_TA_41638.pep
VFSSSNIGGDTEAVMSDQTLNKGFDSLVYMVMILD

SEQ ID NO: 147221 - protein, 89 aa, Triticum aestivum
  unsure (1)..(89): unsure at all Xaa locations
  Clone ID: PAT_TA_41639.pep
MADQLTDEHIAXFKEAFSLFDKDGDGCITTKELGTVMRSLEQNPTEAELQDMINEVDSDGNGAIDFREFLNLMARKMKDTASEEELKEA

SEQ ID NO: 147222 - protein, 50 aa, Triticum aestivum
  Clone ID: PAT_TA_41640.pep
MATPIQLENNSELGVDSKLTKAYSLPTLGGPDNLHSAFECVLATSIRAVN

SEQ ID NO: 147223 - protein, 53 aa, Triticum aestivum
  Clone ID: PAT_TA_41641.pep
YSWASTLVFLHRKANREPFCGAPASYCSVFVTSLLFYSEGPCPPPLARTWAWA

SEQ ID NO: 147224 - protein, 122 aa, Triticum aestivum
  Clone ID: PAT_TA_41642.pep
RGRVGESERGSVVARKGSTITGAAFSRSTATSGRCRLPSLASGGCESLVRRADSIMKSLSWSKAVPVTETAIRAVIGDNAVTSKAVRWLLKHKRGLRRAGTGGRPDPYVYMALLVLQSTSRE

SEQ ID NO: 147225 - protein, 54 aa, Triticum aestivum
  Clone ID: PAT_TA_41643.pep
PMYQKATCNCPNKYLNLTRPTMLDYCISVSFSTTDQIFTVGIRRSILRLKSICC

SEQ ID NO: 147226 - protein, 32 aa, Triticum aestivum
  Clone ID: PAT_TA_41644.pep
KKKNSVVLYNPSLLKKRCILRDLLYSHLNTIN

SEQ ID NO: 147227 - protein, 78 aa, Triticum aestivum
  Clone ID: PAT_TA_41645.pep
LLIVERKSRRAVDASAGDASSPVHAASPLCLHTQIRVLSVSLPHLWSATSVTMIAKWCDQGMAHIRCCRLLAYALVQE

SEQ ID NO: 147228 - protein, 66 aa, Triticum aestivum
  unsure (1)..(66): unsure at all Xaa locations
  Clone ID: PAT_TA_41646.pep
PSSATTACVRWSREPPSLLTAHRTAAIVAGLGDLGVPRKARVRRKPPPTRKXDGKNWCECGTTNPR

SEQ ID NO: 147229 - protein, 58 aa, Triticum aestivum
  Clone ID: PAT_TA_41647.pep
SLLFLKIFIYIPSEAKRRFISRSVAPAARRLARSGRWWRCMACCSRSPVSPAVSRVST

SEQ ID NO: 147230 - protein, 33 aa, Triticum aestivum
  Clone ID: PAT_TA_41648.pep
YFITIPLNNIDYNSSQAKSFCSSITRYQKERST

SEQ ID NO: 147231 - protein, 62 aa, Triticum aestivum
  Clone ID: PAT_TA_41649.pep
SYIIYVQIRPLGHWNFTIVSFRKSRLIHYLGQHREHIVYLHRDSTKVNYMCFITFINSPFFF

SEQ ID NO: 147232 - protein, 74 aa, Triticum aestivum
  Clone ID: PAT_TA_41650.pep
DAWADAWGKIQTNILGAHGYLIFDICFDLIKILNHFITLCQFLQELTILFQSSLINGIVFGPYFIYITIYIQSK

SEQ ID NO: 147233 - protein, 49 aa, Triticum aestivum
  Clone ID: PAT_TA_41651.pep
QHDIPNFIMISHMSTKIKIIYSNILALGNTKVTFFILPKLHKPFLSKKI

SEQ ID NO: 147234 - protein, 80 aa, Triticum aestivum
  Clone ID: PAT_TA_41652.pep
AGLAVLLQRRGCPVIACCDLVVSYHNCSHANKPFTKRGAHGGARCFHQVVASVDHGMELDPHKIGPLPLVGQHKYCPSPL

SEQ ID NO: 147235 - protein, 129 aa, Triticum aestivum
  Clone ID: PAT_TA_41653.pep
NTSPSHISSSCLITHLHPPIHDPSIHQRHQLQHHTTERPRAVALSFFLPSCFLLLLLHLPRYCSSTSLLLPRSAHAAFSNLPRLCCSSCPNLVAAPSLNILLLLRSAASSLTLLLLLSSGPLLLFSSAP

SEQ ID NO: 147236 - protein, 78 aa, Triticum aestivum
  unsure (1)..(78): unsure at all Xaa locations
  Clone ID: PAT_TA_41654.pep
ATVVGFLGSGFGTXGSVGQASGILLPMLNLFLGLDTKAAAVLFKCMIMGAAAWWVWYTLLVSDPTNVASLQDFMLVLF

SEQ ID NO: 147237 - protein, 91 aa, Triticum aestivum
  unsure (1)..(91): unsure at all Xaa locations
  Clone ID: PAT_TA_41655.pep
TEGASPTRILLWGPPVSRRSYGCGPGGAHIGGDDGGGWKGAWYCGGGGGSGGWRSXGKGWGGRGGGGQKGKWGAVQTGQRSLPAPAGKRHG

SEQ ID NO: 147238 - protein, 86 aa, Triticum aestivum
  Clone ID: PAT_TA_41656.pep
KVTVAGVYEGLHPRRVHEEATLSIPPWPSPTKNLPHSGRSSRSRRSPCPYKLLGSTPHQIEGSQVTPNQFKRIPSSKRTDAWSAPD

SEQ ID NO: 147239 - protein, 66 aa, Triticum aestivum
  Clone ID: PAT_TA_41657.pep
VFVLWINSCQGLQVTNISSRFLVSCDTSEAKKLQPFRKYSEPKKSFLLHLRNNMRFTVMAAAEPCS

SEQ ID NO: 147240 - protein, 95 aa, Triticum aestivum
  unsure (1)..(95): unsure at all Xaa locations
  Clone ID: PAT_TA_41658.pep
PRLRGRVDASKRSLKELKGLQXDPPTCCSASPVAEDMFHXYTTMMGSLGSPYAGGVYSDTIHLPPDYPFKPPKAAFKTQVSHPKIHSNGSICLDI

SEQ ID NO: 147241 - protein, 95 aa, Triticum aestivum
  Clone ID: PAT_TA_41659.pep
KSKRGYEGGSAWGGHRPPPRPGARSSLLERSPWQAGRVTSAAPPALHALGLSWICGLQGGSVRGGGSRLGWATRRQIFWGGSARELASPSRPRVR

SEQ ID NO: 147242 - protein, 95 aa, Triticum aestivum
  Clone ID: PAT_TA_41660.pep
PGVGRVLARCSKVKRVLAGRPCKRGVAESGRTLYVAMGRLEGPAGSRHLGLSVATRRRREEAGFRLGRSHGLKKWIGAGRGKRWIRRTRWRTRGR

SEQ ID NO: 147243 - protein, 49 aa, Triticum aestivum
  unsure (1)..(49): unsure at all Xaa locations
  Clone ID: PAT_TA_41661.pep
GASNQARGFCIHFSRVAVLRKVTMANIXSCYKHVIWMKWCLLLVAYLYA

SEQ ID NO: 147244 - protein, 48 aa, Triticum aestivum
  unsure (1)..(48): unsure at all Xaa locations
  Clone ID: PAT_TA_41662.pep
ETYAYLRRVLHNRRNKLEPLWNEVVLCGLKMDPKVYXKLLELVNMIGT

SEQ ID NO: 147245 - protein, 109 aa, Triticum aestivum
  Clone ID: PAT_TA_41663.pep
MRPSVMRSAAQLLRRRNYSSASGQQARKVAILGAAGGIGQPLSLLMKLNPLVSSLSLYDIAATPGVAADVSHINSPALVKGFMADDQLAEALDGADLVIIPAGVPRKPG

SEQ ID NO: 147246 - protein, 123 aa, Triticum aestivum
  Clone ID: PAT_TA_41664.pep
GCFAQTLGVLFAEAKSLRVILLSGASYRYVVEDVFRSLPRLIHLRYLRITPFARLNSNISRFYHLRVLDVEQYSVQLDFPRDMSNLTKLRHFLVRDIDLQYINSDVGKLELLQDLRSFMVKRE

SEQ ID NO: 147247 - protein, 58 aa, Triticum aestivum
  Clone ID: PAT_TA_41665.pep
DSEVTGEVATVITRTDPLVLSTRVLLTNYCPDLSCLSTAPAPVYSRRMYVSLWLVLAS

SEQ ID NO: 147248 - protein, 64 aa, Triticum aestivum
  Clone ID: PAT_TA_41666.pep
LTRTSSYAHSLSRRPHAVGFFADGVPHPSFFLAGGTPYPAGYLIIGAPHSALFYSVGAPYHAVL

SEQ ID NO: 147249 - protein, 83 aa, Triticum aestivum
  Clone ID: PAT_TA_41667.pep
RSVLTPLMPRVLTLSYSPVLPPRARFKVSASADVGATGRAAAASNGLLLFLPRAVERILDRSLPSPSQANTAQYPSQTVFSKS

SEQ ID NO: 147250 - protein, 130 aa, Triticum aestivum
  Clone ID: PAT_TA_41668.pep
KWCRLVNQLELLSFFLIELSLVDYKMLKFQPSMLAAAAIYTAQCTLNGCMSWNKCCELHTKYSEEQLMYGNTPLSFIQTNQLSVSDVICLCYSHGCLAHLFCRDCSTMLVELHQGAARGKLTGVHRKYST

SEQ ID NO: 147251 - protein, 130 aa, Triticum aestivum
  Clone ID: PAT_TA_41669.pep
VPVNIHRNLNFLLEACLPSGDIIAQKVLSFEPKLCNISQGSCELNGIELEITVAWSCLVSEKRDISVQGCVGDEEQDGDIASMEQQVPKIDSKLTSEVGPEAETESAMSLDTSELANESSTSMFISDKSI

SEQ ID NO: 147252 - protein, 92 aa, Triticum aestivum
  Clone ID: PAT_TA_41670.pep
HASVVSFQSPPSHLHRARSHHPLDLFIRPDREQKRLRALVPMNVLRRPTLFTDVRHRGTLHRIAAVLPCRAPPKPLTACATLHRRARAGLRH

SEQ ID NO: 147253 - protein, 76 aa, Triticum aestivum
  Clone ID: PAT_TA_41671.pep
FPFLYTQASSLPPSPRASGEPGPVDRLELPLYPEPQRRPPLTEAASKRTGAYQAPEQRVDRRRMMMDAVAVGTSIS

SEQ ID NO: 147254 - protein, 108 aa, Triticum aestivum
  unsure (1)..(108): unsure at all Xaa locations
  Clone ID: PAT_TA_41672.pep
DAWVAEDKPLPMYDELSSKDNVEYIAGGATQNSIRVAQWMLQTPGATSYMGCIGKDKYGEEMKSAAKAAGVTAHYYEDEAAPTGTCAVXVVGGKKSLIANLSAANCYK

SEQ ID NO: 147255 - protein, 60 aa, Triticum aestivum
  Clone ID: PAT_TA_41673.pep
PHLGSPSSPPEPAPPSPPPPLRPPPPRYHASPSNAAAPPTLTRPPSLLHRGSPGRPWRTA

SEQ ID NO: 147256 - protein, 102 aa, Triticum aestivum
  Clone ID: PAT_TA_41674.pep
MAAAVTRRANSLGVEAPDGNSESGRASLAADSPVAKRAADAKDDVWVAADEGDTSGAIAGDGNRPSLFRTFKVKGSILHSYRFMILIRLFAIGSFIAWRVKH

SEQ ID NO: 147257 - protein, 90 aa, Triticum aestivum
  Clone ID: PAT_TA_41675.pep
CSSSHCRRWHLARELHRLVALARRGHLQCSRTRGHRQRSRSKYAREGLGAVVGDLGAANQRRRRVAAEEEDDDEGCDVERSSMNRSSQIM

SEQ ID NO: 147258 - protein, 112 aa, Triticum aestivum
  Clone ID: PAT_TA_41676.pep
MMAEAWMDVLPPPAPYFAGQPCWAVQQERRGGGAWTLEENKVFEEALAAIDLDAPDRWEMVALMLPRKTVADVVNHYRALENDVGFIEAGLVPFPHYDSSSPSSGFTLDWDG

SEQ ID NO: 147259 - protein, 67 aa, Triticum aestivum
  Clone ID: PAT_TA_41677.pep
MRPYFDPEYENFNQRINPPRVCIDNNTCRDCTLVKVDSMNKNGILLEVVQVLSDLDLTILKAYITSD

SEQ ID NO: 147260 - protein, 45 aa, Triticum aestivum
  Clone ID: PAT_TA_41678.pep
PRVRPRVRFIFHVIVLVLLLISSKTEPSDTKVEINRRLSCRVYGK

SEQ ID NO: 147261 - protein, 132 aa, Triticum aestivum
  Clone ID: PAT_TA_41679.pep
GRVGFFFILNHTIPFPHGQFTIAAVQKVTHWTLQSLGKYSDSDTTIVVYGSVVTTTGDCEKRPTTTTALTLQATPACLAADGSVAEHGAAPLSVRPVAGEEPNPPTYRTLHRGDTRNRLKPKAFPLATYVRT

SEQ ID NO: 147262 - protein, 50 aa, Triticum aestivum
  Clone ID: PAT_TA_41680.pep
INTIWFKMQLLQVCLSNFCFPLDVDIRGSGLPLPYDTISFLIFVFHLMLT

SEQ ID NO: 147263 - protein, 132 aa, Triticum aestivum
  Clone ID: PAT_TA_41681.pep
RAPDLERIGRGVRPPLLDAESGTGHGDFRQGRGRQLGAGTPQMAGDARTWSLRRNHGGPGILGRFLRCTTRRRRGSRAQRRMGCEAEAMSAAGDGLGATTTNLAWLEAGDPWRSLLRLCSRAGGQPWDPRVR

SEQ ID NO: 147264 - protein, 77 aa, Triticum aestivum
  Clone ID: PAT_TA_41682.pep
CQGGSSFSAPTASGVVPSTRRRYGAIGARRRTCGACRLVTGWRIGRPHTPTPVGTPAQEIGARLCTGGCWKTIQRAT

SEQ ID NO: 147265 - protein, 117 aa, Triticum aestivum
  Clone ID: PAT_TA_41683.pep
PRVRGRVGKRRVCSARVRSFCPSSRRPFSSRVTALATGRTSWWAKPCQCGGGGGVFLLTPAGTTVAGSKIGRRLRAFLKPREQQPAAETRAADGRVNALTHAAARWATAALTLSMCG

SEQ ID NO: 147266 - protein, 82 aa, Triticum aestivum
  Clone ID: PAT_TA_41684.pep
MYFLFMYVLTNTWTGNLVKAVIPRPDPSGAAVPGVGKVFLEYADIDGSTKAKVGMHGRKFGGNQVVAVFYPENKFADGDYDD

SEQ ID NO: 147267 - protein, 77 aa, Triticum aestivum
  Clone ID: PAT_TA_41685.pep
MAMASSVAAASLRALAGASPAPLPKPFLVLLFPAPPRRLGLGLRAGRPSGPFAPVGFFDFFFETFAAVNVAEPDDQA

SEQ ID NO: 147268 - protein, 60 aa, Triticum aestivum
  Clone ID: PAT_TA_41686.pep
GEKASTWLENIMAAGPQYGFLHMLRTDIGLNGRMNLYCRQEHRPVVASDGEEQRVGPRVG

SEQ ID NO: 147269 - protein, 128 aa, Triticum aestivum
  Clone ID: PAT_TA_41687.pep
MGARDKRSILLSLSDSEAEDNDRTTISRGSQNKEVPKRRGRSIFNEEQEKLIRDLHEKYKDDRKCSHLIAEALDPSGKVSSAQISRKLTQLGLRSVTRRTKVPEASLSAEDLVTQPQNNVLDDPKPES

SEQ ID NO: 147270 - protein, 71 aa, Triticum aestivum
  Clone ID: PAT_TA_41688.pep
MTKDEDFKLVKIQTHVLRVNIHCDGCKHKVKKLLQRIESVYSVAIDVDNHKVTVTGSVDSETLIRKLTRGG

SEQ ID NO: 147271 - protein, 134 aa, Triticum aestivum
  Clone ID: PAT_TA_41689.pep
RTRGQEKEMKTLQEAELRLLEETAAREAALEKQRQEEEEQRKMQLEKEELESNLAAKEASLPLEPPSDKEGVITLVVRMPDGSRQGRRFLKSDKFKSLFDFLDVGRTCKPETYRLVRTYPRRAFTTADGDQSFT

SEQ ID NO: 147272 - protein, 56 aa, Triticum aestivum
  Clone ID: PAT_TA_41690.pep
FFVYYTRSTFQLGHANPKVWHMQVSFDHNVALIYKPLKALLNKKQVNEARGKDKHN

SEQ ID NO: 147273 - protein, 135 aa, Triticum aestivum
  unsure (1)..(135): unsure at all Xaa locations
  Clone ID: PAT_TA_41691.pep
NPHCRAPCAGRPPPGALPNCPTFSGAPAPPSPPPRXASSPPCDAXPEGHSFRANPPAPPWSRPPSRPTPERRVLAVDMDNHHSGLARSPPSPDAHGSMVAPPPPDVCWSEVAGELPPPSVGRLHGQGKNNRGLPG

SEQ ID NO: 147274 - protein, 38 aa, Triticum aestivum
  Clone ID: PAT_TA_41692.pep
STQQLNEAKSFEQFYTPPDIHPPTVNASDKIRPNLFSV

SEQ ID NO: 147275 - protein, 75 aa, Triticum aestivum
  Clone ID: PAT_TA_41693.pep
DTLAWPLDSKVHEAFGGVVARLEIIYKHAVAMNGYPRFMNRTDPAMFPYILFFPNSFYHTFQAVVLTVMCIPNSI

SEQ ID NO: 147276 - protein, 75 aa, Triticum aestivum
  Clone ID: PAT_TA_41694.pep
RRRRILLANTTIGPPPIPCCCGLCPYSGHEKSNDLRSTRRQAYNVHWGRSSWAVDTFYKTKDKRNAQHNQATSML

SEQ ID NO: 147277 - protein, 113 aa, Triticum aestivum
  Clone ID: PAT_TA_41695.pep
MASTGAVPCSVLLLLLLCASPLCQGQAGRHNITETLAAASPDFAQFSAALAAANLSAEIDGRSPVTVLAVDNAAVARLGERRLQPDALARVLSLHVLLDYLGDARLRTLDGGF

SEQ ID NO: 147278 - protein, 128 aa, Triticum aestivum
  Clone ID: PAT_TA_41696.pep
RTRGEKFLSYFKPCIIPEEGGIASGFRHTEINEREHVTRLFVCRGKHTVHVKEVPFARSSLNHDDIFILDTKSKIFQFNGSNSSIQERAKALEVVQYLKDTNHEGKCDVAAVEDGKLMADADAGEFWG

SEQ ID NO: 147279 - protein, 128 aa, Triticum aestivum
  Clone ID: PAT_TA_41697.pep
ASQLPTPPPPDADDPPSAPNSDAPPSPPQLQVSLPNDILEEILLRLSTAADLARASTSCTSFRHVVAPRSFARRYRSLHKVPVLGFLRADFYAAQSPHPSAPAANALAQAADFAFSFLPNPACWSPRD

SEQ ID NO: 147280 - protein, 85 aa, Triticum aestivum
  Clone ID: PAT_TA_41698.pep
RETVQLLRTCAKNSVLGFAVISRSRLSQHISHLDKSDLNTFFPKFIKTLTLAFLIPQHPSNHSLFQIIHFFAVLIRGTVFLQGMA

SEQ ID NO: 147281 - protein, 83 aa, Triticum aestivum
  Clone ID: PAT_TA_41699.pep
MSRQPEVLWAQRAEKVYLTISVPDAEDVVIKTEPQGIFSFSAVAHGESFSLALELFDSVLPEGSKTKTKVGSRNIICSIQKDK

SEQ ID NO: 147282 - protein, 79 aa, Triticum aestivum
  Clone ID: PAT_TA_41700.pep
PIFFSLKEAFLMPFTTVSSKIHCQGLLPLYPVTSSDALSSTSTPASIAFYKVYVLFGDFFQQTNGPDVNILIAYFHVFL

SEQ ID NO: 147283 - protein, 92 aa, Triticum aestivum
  Clone ID: PAT_TA_41701.pep
MVVALGPGRFYGGGLPRPRVFPGDRVDPPAPVTDALLCWARDAHWSMGGLGAKRLRLQGRIEGNLVKLRRTARRDARVSAKSAKAKVRAAGH

SEQ ID NO: 147284 - protein, 125 aa, Triticum aestivum
  Clone ID: PAT_TA_41702.pep
HASGKTDVHVKSCTTSVPSRTKVQHRKKKNVEFSAVYMAQEIRAHNGLIRVMKFSPSGWYLASGGEDCVVRIWQITEVDAHSKMYGGENHPHEHVEKIKILKPKLAEGQSRALAVMPSKGFHITE

SEQ ID NO: 147285 - protein, 49 aa, Triticum aestivum
  Clone ID: PAT_TA_41703.pep
LTPSLLLNTFPLNITPLTLYNMSSSHSLFLYYAFTLLLPLYLYNYALHL

SEQ ID NO: 147286 - protein, 66 aa, Triticum aestivum
  Clone ID: PAT_TA_41704.pep
LQMGRRAFFCFFWTESRRLIKNQYRVPVLVVTWENVSFLQRPLYICKNTTRDPLFYLIQTSSFHPR

SEQ ID NO: 147287 - protein, 48 aa, Triticum aestivum
  Clone ID: PAT_TA_41705.pep
QTRGQTRGLSRGHDALNLSRAPVGRELLGGPPWDFGRTGLVNGSGPWG

SEQ ID NO: 147288 - protein, 72 aa, Triticum aestivum
  Clone ID: PAT_TA_41706.pep
LKVAALTLPQEEIGLLQQILLVELEVPHPTSVCGCEQGVGVDGENGDGGARFHQERVRRRTDWRAHASAHAS

SEQ ID NO: 147289 - protein, 96 aa, Triticum aestivum
  Clone ID: PAT_TA_41707.pep
GSSHSSLHSHLSPSQSFCTTEGRRFPGYSMLYVHLDHGGDAMATAATATVEAVKTLDADGWLEHASAPSRGTGRHRRSRRAWGGTDHHPHASADAW

SEQ ID NO: 147290 - protein, 124 aa, Triticum aestivum
  Clone ID: PAT_TA_41708.pep
HFGLLEKSVDSSILCGATDIFGEYAKISKNLSDKPQSSYTVDTDQDNGLLPSVIPIGAPWQQIHLLARKQKKVYIELFELTPVKLTFSFTSTPWLNRNEGVSDPSTSFNNSTAIQRGLMALIDV

SEQ ID NO: 147291 - protein, 95 aa, Triticum aestivum
  unsure (1)..(95): unsure at all Xaa locations
  Clone ID: PAT_TA_41709.pep
MDTAALNLLVLDIYGLNLNDVIIVIVAPSLLQLLNRALDRPGLIDXQGHALFPDLAGLRQMLXVYMRNVSSSLDAVARTIQRGAPGFSGAAHANL

SEQ ID NO: 147292 - protein, 70 aa, Triticum aestivum
  Clone ID: PAT_TA_41710.pep
SHLDKITCRELYNVLTEKTMAVPILISLENTPLISAVSSRQEGRTHRPYEHVHNLNDECHAPCSAALCSA

SEQ ID NO: 147293 - protein, 118 aa, Triticum aestivum
  Clone ID: PAT_TA_41711.pep
GRVGEIILTRYKEAFTELAVLSKTAICCRVTPSQKAQLVKLLKSCDYRTLAIGDGGNDVRMIQQAHIGVGISGREGLQAARAADYSIGKFRFLKRLILVHGRYSYNRTAFLSQYSFYK

SEQ ID NO: 147294 - protein, 54 aa, Triticum aestivum
  Clone ID: PAT_TA_41712.pep
SLMCYFFFCKQQHHYFFKHTGSTILTNIVTSYCQLHTEHHHRFVKTTTMKPRMR

SEQ ID NO: 147295 - protein, 78 aa, Triticum aestivum
  Clone ID: PAT_TA_41713.pep
DKPPDEPHRQGDRRDDGRNHPRRRCPHQLPDELQGDDGEISTQLRAALHAENRALNITLSFNFYCIYYQINILPSLLS

SEQ ID NO: 147296 - protein, 122 aa, Triticum aestivum
  Clone ID: PAT_TA_41714.pep
MSQHFINKDKDGTANSRCTCVAWVPEREGIFVVSNADGNLYVYDKSKDGSADWAFPTVRDQNQLVISHAKSNKSNPTARWHICQGAINAISFSPDGAYMATVGRDGYLRVFDFAKEQLIFGG

SEQ ID NO: 147297 - protein, 109 aa, Triticum aestivum
  unsure (1)..(109): unsure at all Xaa locations
  Clone ID: PAT_TA_41715.pep
MFGFGHHGHHGQNPPAHAPAAAGGNQPTFKIFCKADEGYCLSVRDGNVVLAPSNPRDEHQHWFKDMRFSSQIKDEEGNPAXAIVNKPLASPSALARQSHPVSSCIQPEY

SEQ ID NO: 147298 - protein, 61 aa, Triticum aestivum
  Clone ID: PAT_TA_41716.pep
QEAPDQSGAPPAGPRGPHRVLRRAESTGAIVANAQRAFCREPVWCSQRASGRQPCYSSHAT

SEQ ID NO: 147299 - protein, 99 aa, Triticum aestivum
  Clone ID: PAT_TA_41717.pep
NSSPGSSNDVALARSSHQLQLFTFASSWMLQVHSSLCVPLASPRHHALSPPGSQGMSPRTLSACSGSCTSKNLKELSTKETMQVVGIIPSKSSIEYPIT

SEQ ID NO: 147300 - protein, 47 aa, Triticum aestivum
  Clone ID: PAT_TA_41718.pep
YLLCSSNTHRRSDVRSHQGPQCLSMWDSKEGSQARDEQQLQSALFMY

SEQ ID NO: 147301 - protein, 109 aa, Triticum aestivum
  Clone ID: PAT_TA_41719.pep
DAWGPLENAAAVVEGGVAAPVVPVVTAAAAGGGSYALLQCGEDSAYVRDAYGGYFEVFRALLAEDGERWQVYRAVRGELPSEEDAAGLDGFVISGSCSDAHGDEPWILA

SEQ ID NO: 147302 - protein, 126 aa, Triticum aestivum
  unsure (1)..(126): unsure at all Xaa locations
  Clone ID: PAT_TA_41720.pep
DAWANASQIQQITAHLAHYGRIEGKNVFYWFQNHKARDRQKLRRRLCXATTSSPAPTTTPPPTPASTTTSSSSSAPARFPLRCCSTSSSSSTTPPPAPAAATTSTCSRRPSQLPLMLLLLLGTPTP

SEQ ID NO: 147303 - protein, 127 aa, Triticum aestivum
  unsure (1)..(127): unsure at all Xaa locations
  Clone ID: PAT_TA_41721.pep
DAWEKGYETQVGRAGLALTDEQKIKISIARAVLSSPSILLLDEVTGGLDFEAEKAVQGALDVLMLGRLTIIIAWRLSLIKHAVYIAVMEEGHLVEMGTHEELLNLDGLYADLLRCXEEATKLSKRMP

SEQ ID NO: 147304 - protein, 62 aa, Triticum aestivum
  unsure (1)..(62): unsure at all Xaa locations
  Clone ID: PAT_TA_41722.pep
GRVRYRYALHAKEIAKIFHASARCAGAIIQANRHCKLRPNGSPTDAXCPYMKEYPAKLTGHT

SEQ ID NO: 147305 - protein, 62 aa, Triticum aestivum
  Clone ID: PAT_TA_41723.pep
LFGVHLSAAPVGAGSKRPPSPEEELPSTPPATKARLALESDDLSLSVAPPSQPYAASSPARS

SEQ ID NO: 147306 - protein, 120 aa, Triticum aestivum
  Clone ID: PAT_TA_41724.pep
MNLTSVYHVTLQVQNLTAAHVMKCDDDTFVRVDVVLRHIKMNSLGKPLYMGNLNLLHRPLRTGKWAVTEEEWPEDIYPPYANGPGYVISGGISKFVVSQHANQSLRLFKMEDVSMGLWVE

SEQ ID NO: 147307 - protein, 58 aa, Triticum aestivum
  Clone ID: PAT_TA_41725.pep
SHVRLNLYGCRRCHPRAGGRGGAVFVGVFLRLHLFNPLRGGLLSLGSQLGPRGRRSLL

SEQ ID NO: 147308 - protein, 83 aa, Triticum aestivum
  Clone ID: PAT_TA_41726.pep
APVPPAFSCNILLGMHCQPQAPSGQGVVYAMCHAGLVYVGLAIGRWSRLAVGDKSVNVFGTHTDGASFHPKRGTLVFNRYWPY

SEQ ID NO: 147309 - protein, 130 aa, Triticum aestivum
  Clone ID: PAT_TA_41727.pep
KDIPVLIACQGPSGRVTRAQVANNSRRCGVAHPALVPVRTEQKPTAKGKMKRGALDENTCVSAVAKAPHPKRRAVLKDVTNISCANSYRNCTAVTKLQSRPTERGGRNPSNNKQRSKVPKPPFSALSGTT

SEQ ID NO: 147310 - protein, 59 aa, Triticum aestivum
  Clone ID: PAT_TA_41728.pep
HTRRPPLGFYRSASPHAGHHQIPCALRSYRCRRWGDTGSSLCSRMGTSIYRASTRASCI

SEQ ID NO: 147311 - protein, 43 aa, Triticum aestivum
  Clone ID: PAT_TA_41729.pep
GTRGESTIRMSEAHAKRHLRSYESHEDGDKVIPVLIDSCHMNP

SEQ ID NO: 147312 - protein, 89 aa, Triticum aestivum
  Clone ID: PAT_TA_41730.pep
MDAGKLKKVAGKKFGGPRKKSVTRSVKAGLQFPVGRIGRFLKKGRYAQRVGSGAPVYLGGVLEYLATQVLELARNPAQDNKKRRIVPKH

SEQ ID NO: 147313 - protein, 102 aa, Triticum aestivum
  Clone ID: PAT_TA_41731.pep
MDAVICGAHEAPPAVVLVSAGASHSVALLAGNVLCTWGRGEDGQLGHGDAQDRLVPTVISGFDAPGITSVVGGADHTTVYFEDVHHVYSWGWGDFRWFVLLH

SEQ ID NO: 147314 - protein, 125 aa, Triticum aestivum
  Clone ID: PAT_TA_41732.pep
EKSSCTAEPELETRQKRRSLFSSVGPDVENEQHMEMDTSGGIKEEAMNDLNAAKVAAMKAAELVNKNIVGFGVGTGRLSTDQKKKLLWGNKKSNPPKTSTHWDSNLFSDRERQEKFNKLMGVKSS

SEQ ID NO: 147315 - protein, 119 aa, Triticum aestivum
  unsure (1)..(119): unsure at all Xaa locations
  Clone ID: PAT_TA_41733.pep
PRERYLKGWSIASGWHFVDVLMSAPDAYTRGRTKAYSRGWNIXNPDNWILLGEDHKVIELGPHSASSTIRALPMVRRGCPPKDLVGPKXPATIIHGGCXXDMEDMIMVLDAFLAAGPYM

SEQ ID NO: 147316 - protein, 46 aa, Triticum aestivum
  Clone ID: PAT_TA_41734.pep
SHHIRPSTSTMARTNTLSAEHIWLSRRRAQSSLGPLATDEACPRVR

SEQ ID NO: 147317 - protein, 102 aa, Triticum aestivum
  Clone ID: PAT_TA_41735.pep
QRSGKRENYKNLLASQDELEVLLEVMHRRHGTHKCSTKSERAGPSPSTIGPRNPYTTHFESMRASATNIRGSYALTWSMEPRHCSPPPLPMSQAPTASPPTV

SEQ ID NO: 147318 - protein, 85 aa, Triticum aestivum
  Clone ID: PAT_TA_41736.pep
ANPLAPGQLHKERPRTKIPVIPLGSYATLTRAVEVHIANGASPAIVLDLWTTYCLMLTWYNDRALIICEHQGHRTTLFDLGFYDT

SEQ ID NO: 147319 - protein, 82 aa, Triticum aestivum
  Clone ID: PAT_TA_41737.pep
RVRGRIGPLHIKQELAKMYWQNRRMPYCIHMRTGITIRYSRERSHCHRTMLRLLPRDYGDDSRCCQQKKGLGYLRYIMRRWF

SEQ ID NO: 147320 - protein, 101 aa, Triticum aestivum
  unsure (1)..(101): unsure at all Xaa locations
  Clone ID: PAT_TA_41738.pep
METDPREIIGASGSVSRSDLRADLERRGQDPESLDLGTNMMLHILYGYLPKPPVFPTATISPAGASRVPDGVDRISRLPDVVLLDIISRLPAKDAARTXGL

SEQ ID NO: 147321 - protein, 98 aa, Triticum aestivum
  unsure (1)..(98): unsure at all Xaa locations
  Clone ID: PAT_TA_41739.pep
KGGMGLGMGGAKRHRKVLRDNIQGITKPAIRRLARRGGVKRILGLIYEETRGVLKIFLENVIRDAVAYTEHARRKTATAMDVVYALXRQGRTLYGFGG

SEQ ID NO: 147322 - protein, 52 aa, Triticum aestivum
  Clone ID: PAT_TA_41740.pep
AGKACYHRRHWLRFLAVLPSSYGGSSHPKSQTVKSSSIVVLTDPIAQVWTAV

SEQ ID NO: 147323 - protein, 83 aa, Triticum aestivum
  Clone ID: PAT_TA_41741.pep
NRDVPANELKDRPKSGKWFHALGQHAGCHCCACGCTFIIGVIILWNGACTLGVAIWNRVKSDASMGWASAWAPASVGTLAWIG

SEQ ID NO: 147324 - protein, 105 aa, Triticum aestivum
  Clone ID: PAT_TA_41742.pep
MGKIKIGINGFGRIGRLVARVALQSDDVELVGVNDPFITTEYMTYLFKYDTVHGHWKHIDLKLKDHKTLLFGEKPVTAFRVRNTEEIPWGEAGADYPVECTGVFT

SEQ ID NO: 147325 - protein, 73 aa, Triticum aestivum
  Clone ID: PAT_TA_41743.pep
PTRPPTRPPTRPGAPPLPPAAGWPSPPPASPPPTSPPPYPALTRSPASLVPSWPHHPIGTVPPPRPTHPPTQC

SEQ ID NO: 147326 - protein, 66 aa, Triticum aestivum
  Clone ID: PAT_TA_41744.pep
SAHWVILLSCCLILIGQRSAFILYMSGLLPSVAAVPGPLGAAAAAASPGLRWSSLRTRGSPGLPGG

SEQ ID NO: 147327 - protein, 111 aa, Triticum aestivum
  Clone ID: PAT_TA_41745.pep
GRVGAAAAAASPSHSSPAPLRRPCCRRLSVARVVLPLPHASSPPLHWPSRPHPFRTPFLLSDRWIRSAAARPATAAAADSLLLRAPCAPRPHVQQQQQGQQRREGGAGQLH

SEQ ID NO: 147328 - protein, 40 aa, Triticum aestivum
  Clone ID: PAT_TA_41746.pep
GRVGSGQSIRLPHTYTGMRPVSFSIAAPILSQVAAASQAR

SEQ ID NO: 147329 - protein, 84 aa, Triticum aestivum
  Clone ID: PAT_TA_41747.pep
EEGRRRPSASCGKPPGASSAASTGAGGGQKRKCHDHAHSENVAGRKYGASGGRCHCSIPPHRAATIPSPSASPLPPFPNLGFGG

SEQ ID NO: 147330 - protein, 114 aa, Triticum aestivum
  Clone ID: PAT_TA_41748.pep
LSQSPCPLSPPSQSLCPLSPPSPSRRRRTPTLLVVALSLFSSPPTPSPRRRTRWAALDASPQRRAEGPATSSPASSPTTAPTTTHVIFLTDFCPSPPRLAAGWRKALFFGLILS

SEQ ID NO: 147331 - protein, 103 aa, Triticum aestivum
  Clone ID: PAT_TA_41749.pep
MERKQADYSNLDERYTIQGERYQGQQYSHIYYTRLHHMRTLLHALVPSRKPHLPVTTVLGLEEGKDCVLVGTLYKHMKPEPSILEEYSKERSAIPLVKPHNFM

SEQ ID NO: 147332 - protein, 57 aa, Triticum aestivum
  Clone ID: PAT_TA_41750.pep
RRNEIRMRHDRCCYNKERLGVPACLPLSRAEANRAEQSIRWPLSSPSPSRTKEGHMI

SEQ ID NO: 147333 - protein, 113 aa, Triticum aestivum
  Clone ID: PAT_TA_41751.pep
MIYIGLKKFRKALELLHNAVTAPMSSLNAITVEAYKKYVLVSLIQSGQVPSFPKYTSSTAQRNLKNHTQIYVDLSTCYGTGSYSDLETFIQSNAEAFQTDNNFGLVKQVLSSM

SEQ ID NO: 147334 - protein, 133 aa, Triticum aestivum
  unsure (1)..(133): unsure at all Xaa locations
  Clone ID: PAT_TA_41752.pep
VMIDVGTNNEKLLKDPLYLGLQEHRLEGEDYVEIIDEFMEAVFSRWPNVIVQFEDFQSKWAFRLLQRYRKTYRMFNDDVQGTAGVAIAGLLGAVRAQGRPMIDFPKQKIVVAXAGSAGIGVVNAASRTMARML

SEQ ID NO: 147335 - protein, 135 aa, Triticum aestivum
  Clone ID: PAT_TA_41753.pep
PRVRSSDMETRLHLHALAILLVVSARPPSVAGGLCRDSCGDVPVRYPLGIDDGCGSPYYRNMLTCADNTTLRLRTPSGTYPVSGADYADPHLVVTDPSMWTCARPFTYVHAAPFSLDTSTRFSLSPRNDHLFFNC

SEQ ID NO: 147336 - protein, 72 aa, Triticum aestivum
  Clone ID: PAT_TA_41754.pep
WRFLFVDMAFPFSFLKAIITPPLVLVQQSLYWSLRMSGIYLETKNMQRQRLHSVDHVPSTTLSWLMQNPVIL

SEQ ID NO: 147337 - protein, 134 aa, Triticum aestivum
  Clone ID: PAT_TA_41755.pep
QGNRPSLDGSDEDSMPLPNPMVGFNLPGYSGPSVTRMLSKLDTGPPFFYYENVARAPKGEWAKISRNLFDIQPEFVDSLHLCAAARKRGYIHNLPIENRSPLLPLPPKTIFEAFPHYKKWWPSWDTRTHLNCLQ

SEQ ID NO: 147338 - protein, 91 aa, Triticum aestivum
  Clone ID: PAT_TA_41756.pep
RPLVINNSGPLHYQPASPTTSSAVLCCAGTKNHNTPTTSRPDSQPPQTMENSSAEAKHHPSAACSAAEEEEERRRRWCTSRTPRRCSSSTT

SEQ ID NO: 147339 - protein, 89 aa, Triticum aestivum
  Clone ID: PAT_TA_41757.pep
GSVGRGGRNPSDGGCGGGVGGGRDGAFHRDARRRGRCREVTALDREAATARVLEGRVPRGGGARSRGRRERPRFRVGRGLKEARSRGGP

SEQ ID NO: 147340 - protein, 58 aa, Triticum aestivum
  Clone ID: PAT_TA_41758.pep
RTRGWSYPKCSIIPSWPTSQFNSTTTTLITTTTTSTLTRTMTTKSTIIFFPSTLTEIN

SEQ ID NO: 147341 - protein, 50 aa, Triticum aestivum
  Clone ID: PAT_TA_41759.pep
TKRFLCSTPCSPILWGSITRWRCLGFYLNVYSDQARSLRLRRVTTKKNIC

SEQ ID NO: 147342 - protein, 128 aa, Triticum aestivum
  Clone ID: PAT_TA_41760.pep
SPSSSESSSSSSSPSSSESSSSSSSESSSSSSSSSSSSSSAPSPPAASPDPDAARLASAPPPAGGAGAGAGAGASGGASPSTVSSSETSSTSTSSVAGGGGCDGEGGMGRRRRPRFGFRFRGGGNPRV

SEQ ID NO: 147343 - protein, 32 aa, Triticum aestivum
  Clone ID: PAT_TA_41761.pep
ALNSNSNPDQDKRVHHSIGLQATGHRKCLNSS

SEQ ID NO: 147344 - protein, 104 aa, Triticum aestivum
  Clone ID: PAT_TA_41762.pep
VSGGRDITTARHSSGALEAWSQERHTRPAPMRSSTAPSLAKTQVRASRGISDQSLADGPRAHISSNTCPRRRRRRAAGEERQPFSAALAWRQLTDRVAEAFSTL

SEQ ID NO: 147345 - protein, 70 aa, Triticum aestivum
  Clone ID: PAT_TA_41763.pep
HFYLAAHQHRHTWLKFDKMCSRSPFIRYCNNIPINTSHLHILQALIRRHSNMHMPKVPFLTSRLKIPIDM

SEQ ID NO: 147346 - protein, 76 aa, Triticum aestivum
  Clone ID: PAT_TA_41764.pep
AEDGAALASPLPPLPAHLADVCSSSETTSDDNTLDASDDGFFTSGSSSDEEADGELTDKSTALAMKPAGLFLEAIL

SEQ ID NO: 147347 - protein, 47 aa, Triticum aestivum
  Clone ID: PAT_TA_41765.pep
SMSGLRTRTACPRVVCHERRRSALSVESPQGWCRCSVSEQSKPKRPR

SEQ ID NO: 147348 - protein, 46 aa, Triticum aestivum
  Clone ID: PAT_TA_41766.pep
FVCFINACWAICQIGIFILGDKKNRLQQPCFSLCWVTALRLEKGII

SEQ ID NO: 147349 - protein, 116 aa, Triticum aestivum
  Clone ID: PAT_TA_41767.pep
GRVGGRVGFEIQHGNEETFREMLRINRTVAASRSQTHFILPEYLMQRDQRLNMDEAVDTLTRAGVPQDEMAALERQLASGPSPAPAAAPSTSTTPANRMMNFVSAGVEARAESSTQ

SEQ ID NO: 147350 - protein, 132 aa, Triticum aestivum
  Clone ID: PAT_TA_41768.pep
EKGHVEAVREVLKFCDGQSAGLKANNSFDAFHIAAKHGHLDVMQELLRAFPQVHYTSTSLNTTALDTAITSGHIGIVKFLLDTEPSLSRIAKGNGMTVLHSAVSMGNVEVVALLLNKDPGIAFRTDIKGQTA

SEQ ID NO: 147351 - protein, 92 aa, Triticum aestivum
  Clone ID: PAT_TA_41769.pep
MKTILASETMEIPEEVTVKVSAKMISVTGPRGTLTRNFKHLNLDFQLQEGGRKLKVDAWFGTRKTMAGIRTVIFHGQNLITGVTKGFRYKMR

SEQ ID NO: 147352 - protein, 126 aa, Triticum aestivum
  Clone ID: PAT_TA_41770.pep
FLGFGLSGHISLSHYYFLVSSPLFLSPPKLQKVTRGFPHRHLCSFMCPLFRRWSDRISNQTRRMNQRGRISAPRRPGGRGQKNSVEAASLLRRQEARRPWNWELWVEAWRMYGDGKRKWSERTPIA

SEQ ID NO: 147353 - protein, 104 aa, Triticum aestivum
  Clone ID: PAT_TA_41771.pep
HRLARRREGLPVLHAALVFRLLRHGPHLPPPHHQENQIERGGGSNPGGGEPIGGRAGDGAKGREGGSEGARWLETLGAGVKEQSFLSPLSSLALRLPLGVGGSC

SEQ ID NO: 147354 - protein, 138 aa, Triticum aestivum
  unsure (1)..(138): unsure at all Xaa locations
  Clone ID: PAT_TA_41772.pep
DAWVHAPPASAPPQPWGPSASPPPPSPTSPPRRLPTVPPSPPQLPPPRLRQPQPASPXTAKSAGRPLPRPSHSXPSGPPSPLPTAAPPATSSPAPGPDSPPRPPAGAASSALASARPPSLASSSSTSTRSAVMPMTAN

SEQ ID NO: 147355 - protein, 135 aa, Triticum aestivum
  Clone ID: PAT_TA_41773.pep
PSRRHFPNPTSGSSLIPSSTLFSLSLKSGPPLPSQSIDPSNHQPAAAPPCSIVCSRRPSTSCFSSSAETSTRTRPSPHRTLPLLLFCFFPYFFSFPHPGVFLSFFKEDQSLAGMGGLFRSKVGGLLKQPGPPTTG

SEQ ID NO: 147356 - protein, 94 aa, Triticum aestivum
  Clone ID: PAT_TA_41774.pep
MDLDKPANTAAAEEGTEKALFRALKTRGNTPKYGLIFHSSFIGRASTKNKGRMARYLANKCSIASRIDCYSDMSSSIFGEKLREQVEERLDFYD

SEQ ID NO: 147357 - protein, 51 aa, Triticum aestivum
  Clone ID: PAT_TA_41775.pep
INHAEVLPRSEKQDRICCNIITHNEVIVRMNIRKKRPMRIIELTRYQLSLH

SEQ ID NO: 147358 - protein, 54 aa, Triticum aestivum
  Clone ID: PAT_TA_41776.pep
LTPKIKIEISTYVTLFGRRDGLSNDRTLTKTVTRLGTTFSMTDSNSRAFLRSHF

SEQ ID NO: 147359 - protein, 61 aa, Triticum aestivum
  Clone ID: PAT_TA_41777.pep
ALLYLHLVHAKQREVDTSAVPCPLSHLLVVDSRIRYGLVSSPTSTAHVQYVRQLILFFQVY

SEQ ID NO: 147360 - protein, 92 aa, Triticum aestivum
  Clone ID: PAT_TA_41778.pep
TPDNRTPRPPTPNFQARENPILGSRRRPARLPTPSCQAPDADLPGPSTAADGTPDAALPGSPLHPHINLGGSCGYAQRHPYRSSSPSSPGLR

SEQ ID NO: 147361 - protein, 133 aa, Triticum aestivum
  Clone ID: PAT_TA_41779.pep
METYSDLGTDGGSPAPTKPAMEEPRADATGGPYIVGPDAAPAPQPGTAAGARKRKAPTTATAKAARKPRIPQVEEPIQMHVYYGLGEMFDSVQGDDLVEDSLDTFVENNCAHVIGELPLQPESMSLVDLQLLI

SEQ ID NO: 147362 - protein, 57 aa, Triticum aestivum
  Clone ID: PAT_TA_41780.pep
IRRRDNHAAIVTEGPCIDGPNTTTAHYTTTYLDKRNRKAPSTATANTARKPCISQVA

SEQ ID NO: 147363 - protein, 82 aa, Triticum aestivum
  Clone ID: PAT_TA_41781.pep
QLLPPIHNKGRSFELTPVQNRDTYFGSGGVASNQLMLRLLKTQPGRRICHAEYYFSGGEVSCLKLNFESSLYLSTTPIMHIV

SEQ ID NO: 147364 - protein, 125 aa, Triticum aestivum
  Clone ID: PAT_TA_41782.pep
DSRETKDGPIVNKSSCNLLAPAVTRYFASDLIVSRRSLEGKGRAVKDKCTPLLPDPPSGELDEGASPMPRPGRGDPITALHQAANTALASSGGLIQGSASSCNGGKVTNISCICSFYPNFLFFWW

SEQ ID NO: 147365 - protein, 74 aa, Triticum aestivum
  unsure (1)..(74): unsure at all Xaa locations
  Clone ID: PAT_TA_41783.pep
MAGKEIYHKMKDMVKDALTSSXPETGKGKTKLLCRRVKHGYHLVKGESNHSMVDYLLAEYSQVEEHDFGLFAIF

SEQ ID NO: 147366 - protein, 68 aa, Triticum aestivum
  Clone ID: PAT_TA_41784.pep
ADIHMRLHMVATLAETIAHIFGLILRMVTTVVTSAKFDTDLDTVLVRHFGRHMGGYKVVSIEESIHDT

SEQ ID NO: 147367 - protein, 76 aa, Triticum aestivum
  unsure (1)..(76): unsure at all Xaa locations
  Clone ID: PAT_TA_41785.pep
MGRRPARRYRQIKNKPYPMSRYCRGVPDPKIXIYDVCMKKKGVDEFSHXVHLVXWEKENVFSEALEAARIACTKYM

SEQ ID NO: 147368 - protein, 111 aa, Triticum aestivum
  Clone ID: PAT_TA_41786.pep
KMAGVARKGRSKWDTQESSPDIVEISEDDSPPKNTDDRRKDVIPTQDLTNDNGKRLGESSNLKPDAFMHQGSTEYEQERTDGLNKDVKERQSKASSERSHAPRMAEEGHKK

SEQ ID NO: 147369 - protein, 124 aa, Triticum aestivum
  Clone ID: PAT_TA_41787.pep
RKRETEGYISRRGSQLALKHLCEKFGSSLFEKLPKLWDCLTEFLEPIKIEDDIHKDDPSITHLGRSCEDKDPQSLINNIQVVRSITPYLPEPLRPQLVRLLPCIFGCARHSHVAVRLAAARCIT

SEQ ID NO: 147370 - protein, 139 aa, Triticum aestivum
  unsure (1)..(139): unsure at all Xaa locations
  Clone ID: PAT_TA_41788.pep
GRVGGRVGEKDEEQDKDGFFKRLLRDSKDKEEDDGDKEGFIKRLLKDSKEKENDEEKGDKDGLFRKLLKDHKDQDFELTPNLDGLVKKLFPDKKDRPGHHYQKGGFFRKIFKGXNEERRESMHGRLGDEERVCKSLEDD

SEQ ID NO: 147371 - protein, 45 aa, Triticum aestivum
  Clone ID: PAT_TA_41789.pep
PTRPPTRPAGKRYVKLRLSTKALKTIEKHGLDAVAKKAGIDLNKK

SEQ ID NO: 147372 - protein, 79 aa, Triticum aestivum
  Clone ID: PAT_TA_41790.pep
FIKFIEGSRYVPVRPAPCGFILLRDTQPSEAEELVLTDAPATVATGTGNNAAAAAAGQGSAAMAVDDEPQPPQPFEYSA

SEQ ID NO: 147373 - protein, 127 aa, Triticum aestivum
  unsure (1)..(127): unsure at all Xaa locations
  Clone ID: PAT_TA_41791.pep
RTRGRTVGPRATSSPPTPTPTPSSRWLPTVTVHLFPVTGTSRSQGEEREERPLSLLHFHSRRKKHREIGRSKTQAEEEFIVDACASMRIRGLAMSGGREVAISAVFTALLVVYILXLPSVLLTSGRL

SEQ ID NO: 147374 - protein, 92 aa, Triticum aestivum
  Clone ID: PAT_TA_41792.pep
MMSMSRAARPDPVLIRRMGTADHLGSSSPHCPPACVRTAAQLLKKWIVYQLKVSREGPGIWFLLVWSFLGLLSRSSFLACPPFFPHESAHAS

SEQ ID NO: 147375 - protein, 58 aa, Triticum aestivum
  Clone ID: PAT_TA_41793.pep
MYTNQLQELAQRSCFSLPSYVCTREGPDHAPRFKATVTFNGETLHGPTCCTTLRQAEH

SEQ ID NO: 147376 - protein, 144 aa, Triticum aestivum
  Clone ID: PAT_TA_41794.pep
ASSYWRSVKVGWDESTAGERPPRVSLWEIEPLTTFPMYPSLFPLRVKHPWYSGVAGLQDDSNALMWLRGVAGDGGYQSMNFQSPGIGSWGQQRLHPSLMSTDHDQYQAVVAAAAAASQSGGYMKQQFLNLQQPMQSPQEHCNLN

SEQ ID NO: 147377 - protein, 60 aa, Triticum aestivum
  Clone ID: PAT_TA_41795.pep
ITRFQLNFRTFLTRNRHPTACTSTLTRLYTCQPSELPATIYYKLRLPAFTLDLVFLTSDS

SEQ ID NO: 147378 - protein, 120 aa, Triticum aestivum
  Clone ID: PAT_TA_41796.pep
MGRRPARCYRQIKNKPYPKSRYCRGVPDPKIRIYDVGMKKKGVDEFSHCVHLVSWEKENVSSEALEAARIACNKYMTKHAGKDAFHLKVRVHPFHVLRINKMLSCAGADRLQTGMRGAFG

SEQ ID NO: 147379 - protein, 50 aa, Triticum aestivum
  Clone ID: PAT_TA_41797.pep
IQSMYELALHITSDHFSVFATGLKNHIADACRYGYEHLIVYGNRKRRTSV

SEQ ID NO: 147380 - protein, 103 aa, Triticum aestivum
  Clone ID: PAT_TA_41798.pep
TAGHTDPVLHLYEKTQRFVRTHFGARMQNRRYLAAHKEHWRDQEKLADEILIYLLPSRIYNVCAVRPTFMDKALERHFILYCCGRCPHSGTNIILSAITAHCI

SEQ ID NO: 147381 - protein, 82 aa, Triticum aestivum
  Clone ID: PAT_TA_41799.pep
ARVRAGAAAKTKAKTIATTLATTPTITDIIMDFVVSSVASAVAMAAASGLTYILTYIRIYGLELALELGEGPGEGQHVGNHY

SEQ ID NO: 147382 - protein, 65 aa, Triticum aestivum
  Clone ID: PAT_TA_41800.pep
FYMTRLPLLQSAEQRKEQHLARTMDTRLNRPESLTSDRPPETPGTKTPAYSHPGRTNQTLPQENK

SEQ ID NO: 147383 - protein, 71 aa, Triticum aestivum
  Clone ID: PAT_TA_41801.pep
SPGAWSGSLMPAFISLDSASTTTASMAAAGCSRGAPAPRRRRREVRALGFAPRIFDIFGPRGKGMERFCSI

SEQ ID NO: 147384 - protein, 70 aa, Triticum aestivum
  Clone ID: PAT_TA_41802.pep
SAFVWGASNILDFTMTGAHTFRMLPHIFQRGLLLNTQPHAGNYNTAITPTKIAPGETLSDSKAKTSSIDL

SEQ ID NO: 147385 - protein, 52 aa, Triticum aestivum
  Clone ID: PAT_TA_41803.pep
LMKKHMPDKKVIDFLTIHTSDFRDVSNFLNLYVCSHRIIKFHLASFHANWCV

SEQ ID NO: 147386 - protein, 80 aa, Triticum aestivum
  Clone ID: PAT_TA_41804.pep
ARALMYLNHSGYKLQHHPLTHLSDILMIEELELEDLCRICGLEISRSGDTKAFAPKQTTFSLPTPLSKSSGIYISREIKR

SEQ ID NO: 147387 - protein, 113 aa, Triticum aestivum
  Clone ID: PAT_TA_41805.pep
GRVGGRVGSPAAGARVWGFALSEGSSSQRLVGLIKVFISRALSPSGLNSEQTDGLVIASAKLIKSLSDEGSNLVALRECFANAKLKLLFKTAVSDGAQAALLSMVPVVSPDDL

SEQ ID NO: 147388 - protein, 82 aa, Triticum aestivum
  unsure (1)..(82): unsure at all Xaa locations
  Clone ID: PAT_TA_41806.pep
GYSSWAVHLYPPTMGKEKTHINIGVIGHVYSGNVTTTGQLFYKLGGIXDKRVIXRFETDTSEMNKRSFKYSWVLDMLKADRE

SEQ ID NO: 147389 - protein, 108 aa, Triticum aestivum
  unsure (1)..(108): unsure at all Xaa locations
  Clone ID: PAT_TA_41807.pep
FGSHNLEQWLHGDVXPVSPLTWEHRMKIILGTAKGLMYLHEGLEPKVVHRDVKASNILLDKHWNAKLSDFGLAKLLGPERSYVTTRVMGTFGYVAPEYAGTWMLNETS

SEQ ID NO: 147390 - protein, 50 aa, Triticum aestivum
  Clone ID: PAT_TA_41808.pep
YKNIFQSLKNVLILSDRGSSSIAAPLPYLFQLTLLGTRSVTNVRRFLCPM

SEQ ID NO: 147391 - protein, 108 aa, Triticum aestivum
  Clone ID: PAT_TA_41809.pep
HASANAQLEHAKASVAAFAEQQGMLKSTVSDMEHMIEDLKGKVSKSETRALNAESKCALLADTNLELSEELSFLRGRVERLESSLHEANHVKVATIKDISLRTKVITG

SEQ ID NO: 147392 - protein, 118 aa, Triticum aestivum
  unsure (1)..(118): unsure at all Xaa locations
  Clone ID: PAT_TA_41810.pep
PTRTRTRGVSSYRNHVHALYMGVPSSPVIAKLFSNANRCSRGQGGSMHMCSEPHTLLGGFNLIDEGIPVRTVTNFSAKYRHXVLKQCSPVGLDVTLEFFGDGTCNISQFFESLDMDHL

SEQ ID NO: 147393 - protein, 83 aa, Triticum aestivum
  Clone ID: PAT_TA_41811.pep
PTKVLFHSHHGGCDYTCRVCVLYIHSELLPVPLSIWPPHLLHPHFFFENIYYIHMSTSLATCAVTCHTLHQAQGTRGHSPHAS

SEQ ID NO: 147394 - protein, 35 aa, Triticum aestivum
  Clone ID: PAT_TA_41812.pep
WLGSNLRRMLYEKEMGVVLKWNDLFKRVIWEHYIS

SEQ ID NO: 147395 - protein, 35 aa, Triticum aestivum
  Clone ID: PAT_TA_41813.pep
LGVALAEQVVSRHAPRCKLASLSSSSGWGATCLSF

SEQ ID NO: 147396 - protein, 62 aa, Triticum aestivum
  Clone ID: PAT_TA_41814.pep
GHLLMTSFPLSSPVGGTLTIICLIPISRQIFNNHDNYYFPRILLFSTLLFNLLHLLLHGLLK

SEQ ID NO: 147397 - protein, 58 aa, Triticum aestivum
  Clone ID: PAT_TA_41815.pep
PGGGRHASVHEFHKQLTALNVWPGEKTKPMQLFVVLVEQFVIAGSTICVSLYITIFAA

SEQ ID NO: 147398 - protein, 100 aa, Triticum aestivum
  Clone ID: PAT_TA_41816.pep
LLKTGHLSQILSKILEISALLMPFVCDSPSFLSWFAQASCKEMFLKGSALPPPHAYSASTAYSLSRATASMDLCMTPHFLRPREPSMGDSPAAEPPVTPF

SEQ ID NO: 147399 - protein, 93 aa, Triticum aestivum
  unsure (1)..(93): unsure at all Xaa locations
  Clone ID: PAT_TA_41817.pep
HSFFFAKANTPTWGGALSVEKTSSGREYKVKDLSQDSLGXLELELREVEMPGLMDCRTEFSPLQPLKVARIFGXLHMTIQTADLMETLTGLGT

SEQ ID NO: 147400 - protein, 94 aa, Triticum aestivum
  Clone ID: PAT_TA_41818.pep
VLKFDLPHCNGPLWSCSCRPLIHSSKSSISLWSPPPTCVSCLSVVKGQEVQAGQGDGHLQLWQCKPPLDGPLHNIIHPRVERLELLILEAPTRP

SEQ ID NO: 147401 - protein, 77 aa, Triticum aestivum
  unsure (1)..(77): unsure at all Xaa locations
  Clone ID: PAT_TA_41819.pep
GRVGNEIRTQPLKPSLFIYXSTVESVTLWHVHTGICILIFAGGGGHRNEVLSVDFHPSDIYRIASCGMDNTVKIWSM

SEQ ID NO: 147402 - protein, 45 aa, Triticum aestivum
  Clone ID: PAT_TA_41820.pep
MVKYSRDPSNPTKSAKACGRVLRVHLRTPPRPGLVFGRMLWARVK

SEQ ID NO: 147403 - protein, 52 aa, Triticum aestivum
  Clone ID: PAT_TA_41821.pep
WPVMAPHCPLYVPAPILRSGDHIVVIFELRGPNPERTIHLVKDPDFTCGPNQ

SEQ ID NO: 147404 - protein, 65 aa, Triticum aestivum
  Clone ID: PAT_TA_41822.pep
KERTYRRFFIISSKVVNHHPPSARKNTRGVCVPRDTTECPGLLCWVNRHSAQRRWTHSDAWADAW

SEQ ID NO: 147405 - protein, 40 aa, Triticum aestivum
  Clone ID: PAT_TA_41823.pep
KYNIGHALSYFRTPKYYCNPSDSPRHRGLNKTDGFRVATT

SEQ ID NO: 147406 - protein, 95 aa, Triticum aestivum
  Clone ID: PAT_TA_41824.pep
MRECISIHIGQAGIQVGNACWELYCLEHGIQPDGQTNGDKTIGGGDDAFNTFFSETGAGKYVPRAVFVDLEPTVIDEVRTSAYRQLFHPEQLISG

SEQ ID NO: 147407 - protein, 101 aa, Triticum aestivum
  Clone ID: PAT_TA_41825.pep
VIYRTEYTIRCGALHQKETKKSSRYFSIRLYPREAMNMNRYGSTSMKMLAIRMSYRNDPFGATYQDVRSNKRVTYGVVRWSEAHRSSPITNVSRKTCSYAS

SEQ ID NO: 147408 - protein, 113 aa, Triticum aestivum
  Clone ID: PAT_TA_41826.pep
PTRSRTRGVGNDGLFSHKEITVLFVPNLSECVPSMDIWRDNWIAYRKSKIEREQLIMKKEKSPGDPKEQKQVVEEPSDAKSTNDQLKEGDGASKDGKIGSWYENKEGGCAAKN

SEQ ID NO: 147409 - protein, 47 aa, Triticum aestivum
  Clone ID: PAT_TA_41827.pep
MQHQPWGVCEKMISSGCFPDGEKAGEIVTFFCKGKKVTEAHSVYLAA

SEQ ID NO: 147410 - protein, 56 aa, Triticum aestivum
  Clone ID: PAT_TA_41828.pep
EIAKMGQEYFTGQQMIHSKGQDSSHDPGNSLLQLPTNSVLTKHAMFTSYMLPIYWT

SEQ ID NO: 147411 - protein, 94 aa, Triticum aestivum
  Clone ID: PAT_TA_41829.pep
MAAMAEGAGEPELVSIPVTPRGLSTPEGMSTPPVRRGGAATSGAGTPVRRVVEGLRGYLEEVGHLTRLNPQDAWLPITESRSGNASYAAFHSLN

SEQ ID NO: 147412 - protein, 47 aa, Triticum aestivum
  Clone ID: PAT_TA_41830.pep
DYVAKHVAPYKKVRRVAFVNAITKSPAGKILRRELVQQAMSMGASKL

SEQ ID NO: 147413 - protein, 40 aa, Triticum aestivum
  Clone ID: PAT_TA_41831.pep
AHVVYHYNALEQLNQGGACQSCENAQSHSWAHCPGRPGAL

SEQ ID NO: 147414 - protein, 94 aa, Triticum aestivum
  unsure (1)..(94): unsure at all Xaa locations
  Clone ID: PAT_TA_41832.pep
MGIGEHLEGVKQYWARNFFCLDYFKKGYGRYQALPKWSDAHVEXFIASDPVYXPQIKAMRESRKFVLGGAMAGAAHLGGVDFKYFKSPYGVLLA

SEQ ID NO: 147415 - protein, 102 aa, Triticum aestivum
  Clone ID: PAT_TA_41833.pep
GERGFESLSESGSIQRVRRVLSPGGGYVHGSRRPGRRRGPHSERRRAMYTPSCASAARSIKRRRGPPRRLHENNGQEQEQKLVRKQGPRTAEQALHALSAVA

SEQ ID NO: 147416 - protein, 60 aa, Triticum aestivum
  Clone ID: PAT_TA_41834.pep
KLQLRTCAAGSIYVASMSPRFRPLADVDRQTILVYFASTSILDLVNKLQLLLPRPSPLVS

SEQ ID NO: 147417 - protein, 110 aa, Triticum aestivum
  Clone ID: PAT_TA_41835.pep
GTSWVNSARSCLPEEGQKWGFLIWLLFSYCGLACIACVAVGKWLNRRHALRLRAQQGIPVSEYGVLVDMIRVPDWAFEAVGLELRGMGQDTAYHPGLYLTAAQREAVEAL

SEQ ID NO: 147418 - protein, 62 aa, Triticum aestivum
  Clone ID: PAT_TA_41836.pep
PGKLVEASATICQCGFQFYILFLPCLYQIEDIHLQLDCAKSAEHALVIFVRSLGNWQSFSYS

SEQ ID NO: 147419 - protein, 68 aa, Triticum aestivum
  Clone ID: PAT_TA_41837.pep
RGRVVVGRWLLWLTLTRVSLVQRRCRCLLILRRVVRGLLTVVRRVVNHRIPGSLIKCVLKALLVAPPL

SEQ ID NO: 147420 - protein, 110 aa, Triticum aestivum
  Clone ID: PAT_TA_41838.pep
CKIQNASKLESINRWGGQDTAGAVHENFSQSTWALALIRKIGHGALDILIKTKGPGRVNDDVGRARRALPAWASRVRAARIQARRSRRGQPWACRVHPPHQRPAGRPGQN

SEQ ID NO: 147421 - protein, 49 aa, Triticum aestivum
  Clone ID: PAT_TA_41839.pep
RGRVGRAGPVRSSPRRAIPWPPRRRGSSSWSSTTSSLQGSGGAWTPSKI

SEQ ID NO: 147422 - protein, 68 aa, Triticum aestivum
  Clone ID: PAT_TA_41840.pep
DAWADAWADAWADAWADAWDPNDPSIDSSTTTTTTTSLSMGDQSVASIDSDGLTPSAVFSQIMNPKGR

SEQ ID NO: 147423 - protein, 91 aa, Triticum aestivum
  Clone ID: PAT_TA_41841.pep
MAQKDAANGNGATTRPAATSFPIRFSKFFQANMRILVTGGAGFIGSHLVDKLMENEKNEVIVADNFFTGSKDNLKKWIGHPRFELIRHDVT

SEQ ID NO: 147424 - protein, 132 aa, Triticum aestivum
  Clone ID: PAT_TA_41842.pep
NTPLLQSKLPHLKNLEIRLKAVLPKGFPPSYDFFSLVSFLDASPALESFTLHVNEYVMTHYPVVGDNDECPRQKLDLSHNRLRHMTITGFCSAKSLVELTVHILESTHSLERLTLDTTYDYNRCIQGPGTIG

SEQ ID NO: 147425 - protein, 130 aa, Triticum aestivum
  Clone ID: PAT_TA_41843.pep
GEEIKKKDTHIQHTKRGRNKEEKNRQLNKSTAKVVERHWTAETKPGHCTIDAIKRRRASESTQRRDTTCAVGCNRKDTRAETTPRHLCATDKAEGHHLVDQTKTLHRRRNRKTPRNRDCPTPRHHLCRGA

SEQ ID NO: 147426 - protein, 125 aa, Triticum aestivum
  Clone ID: PAT_TA_41844.pep
ARFQALACHAPGVSATQRAKLFVGGLPDHIRVDVKLRDPPDLQTAMYYARAFEQRAQALQQPAGRGGHLPSRPAPSPGRPPPASATTSSATTRTFRRLSPAEQQERRRQGLCFNCDEPYSPTPRV

SEQ ID NO: 147427 - protein, 103 aa, Triticum aestivum
  unsure (1)..(103): unsure at all Xaa locations
  Clone ID: PAT_TA_41845.pep
LPRPEAALERPAQPNGVCHARGGAHTSTHLSQSLLRQVAPPVGHRDQRADGRRLFLINNTLYSHKEKVLRELIYNSSDALDKIRLVSLTDKSKLDSXPELFIH

SEQ ID NO: 147428 - protein, 100 aa, Triticum aestivum
  Clone ID: PAT_TA_41846.pep
MSVCHFLARNMSLSVVKSMPQKFVRTFIPEVIGKEIEKATSGIFPLQNVYVRKVKILKAPKFDLGKLMEVHGDYKEDVGVKLDRPADGDEVIPAAAPTRP

SEQ ID NO: 147429 - protein, 68 aa, Triticum aestivum
  Clone ID: PAT_TA_41847.pep
EDLLDGVTGVVTERKPQPICKLVAMSGRTCYLSNETLGKMGVWMGSPSPETSPFGMRRVLNYDLTTRA

SEQ ID NO: 147430 - protein, 116 aa, Triticum aestivum
  Clone ID: PAT_TA_41848.pep
GNPRSLGLANERRRRRQDPSTTRHHTPPSSGQSSARQLEAKHRHAPACTSTLRPSGGGDDDRARHPLLPGSRLSLKASLISGEDDGHRSSSSFSSRSRDLLSLFEVCTLTPSEQLY

SEQ ID NO: 147431 - protein, 90 aa, Triticum aestivum
  Clone ID: PAT_TA_41849.pep
RRPLFWQCGPRDTTGIFSFRSWGGGKKQATGRAKQGRLGLVSKFTPSGSFLFRDHRGGKRGTPLHEGAHSCGGLWDPPSGFYTLVSQAHC

SEQ ID NO: 147432 - protein, 132 aa, Triticum aestivum
  Clone ID: PAT_TA_41850.pep
PRVRGRVGGTHVAATAAGSPVPGANLLNFSRGDATGTAPKAKIAIYKVCYRSPGGCPDWAIVAAVDAAVSDGVDIISMSLGAGPTPFYDDVVAVATFGAVRAGVFVVLAGGNAGPNAFTVSNAAPWMTTVGA

SEQ ID NO: 147433 - protein, 86 aa, Triticum aestivum
  Clone ID: PAT_TA_41851.pep
TPKQHDHDIRTYILPLFQTKCHGFSTRHMNASILLRSCSYLASADQTSQCNGARIRQHRAVPPSPRHNQTQGNGAAVAGGTVAVGN

SEQ ID NO: 147434 - protein, 56 aa, Triticum aestivum
  Clone ID: PAT_TA_41852.pep
GGQPTRPRKSAHFTTTSSSLKRAFPDMNMLISILNTPNHPLLQELHHSTLISHDLL

SEQ ID NO: 147435 - protein, 66 aa, Triticum aestivum
  Clone ID: PAT_TA_41853.pep
PYRTALTTKAGFCSLGSCRGRPLLGLFMAAKWLMAAYKAHLVCQLTDQTCTQVKYSLLDTFLYMKL

SEQ ID NO: 147436 - protein, 133 aa, Triticum aestivum
  Clone ID: PAT_TA_41854.pep
PRVRAHHAASSLAAAPFLIPNTPAPSRGHKRRPDHPHVGVGHAMTVSLHSSRRHWPRSPEKEHWQRPAISAPDRGPGNLWSRSSGHGHPILLLSRHLPRILSLPGISSDRAKSFEKQKHGPPVARRHRQAQAP

SEQ ID NO: 147437 - protein, 113 aa, Triticum aestivum
  unsure (1)..(113): unsure at all Xaa locations
  Clone ID: PAT_TA_41855.pep
GRVGHQSNRTRAARGKNLPPPLPLPPSPPTPQPTMXPSSPPTTPRTSCRAPPPTHSTTPRTTRAPSWPGPTAVPESTPTVVIAGTDVFAGNGLQEDVGDEQGDLACDGGADSV

SEQ ID NO: 147438 - protein, 126 aa, Triticum aestivum
  Clone ID: PAT_TA_41856.pep
MNMMQTGTSLNDECGSAYGRFEQHKRNGTHHGVGAAYIPFSSCASDGPSTKRVFGVTLDEPQASQLSKEKGSHVVKLAPDLPPVNLPPSVRVISQMEFHQNAAQDLFPVPPPTFTECVYTQLNLFP

SEQ ID NO: 147439 - protein, 82 aa, Triticum aestivum
  Clone ID: PAT_TA_41857.pep
FRFSRPWPFCRPAVSAQTDYLLAISTSSITTNPLPIDSVIIIINHNTRSVEHHMINHTLSLHNPLTFFSNASPFKYIYKKLS

SEQ ID NO: 147440 - protein, 71 aa, Triticum aestivum
  Clone ID: PAT_TA_41858.pep
LFTFSSVWMSLACLVYARRYAKCKNGFLGTSYFFLLGTNELFVRERSLHRTFLFDLGEELERTIHPRPPCK

SEQ ID NO: 147441 - protein, 86 aa, Triticum aestivum
  Clone ID: PAT_TA_41859.pep
GRVGLSIQDLLALVYFGSLFYVKSPDEFITTMVARKHERSSCITYGYVWDDTVDLLTENDLDAVSAVAALATARPAFGGGVSHHDA

SEQ ID NO: 147442 - protein, 64 aa, Triticum aestivum
  Clone ID: PAT_TA_41860.pep
SAVQARDNLLQIDTRGILFLGRESIQSELATLTETHHRGNAVYIRSNRSASVGHSYKRLLDAHI

SEQ ID NO: 147443 - protein, 123 aa, Triticum aestivum
  Clone ID: PAT_TA_41861.pep
MAAVLKVYADRLSQPSRAIIILCKVNRIDFQELTVDLAKGQHRAPEFAKINPMAQVPTIVDGRFKLFESHAILRYLATVFPGVPHHWYPADLFTRAKLESVLDWHHSNLRRGAATYVLHTALG

SEQ ID NO: 147444 - protein, 107 aa, Triticum aestivum
  Clone ID: PAT_TA_41862.pep
EIILCVNADTTRNGGIDRTCRLCSLTIWIGNFFSTTWASTSAYMLHARSGRTAPMIHAREAVWTVASTPDAKIMLDNQTRGDCRRFLNLSTGASACFDREELLCHQL

SEQ ID NO: 147445 - protein, 58 aa, Triticum aestivum
  Clone ID: PAT_TA_41863.pep
VPRETSTAYLGTVFETSVNISLTFSRNLLQFYLYAHTRLVHFVLNLQLIRSVCVFHTA

SEQ ID NO: 147446 - protein, 67 aa, Triticum aestivum
  Clone ID: PAT_TA_41864.pep
FRVFLYEGFLSHMECDHLVSMAHGKIGSSVLVNDGATNISQNNIDAGLIFSLADSKVSIHTAFMIFS

SEQ ID NO: 147447 - protein, 65 aa, Triticum aestivum
  Clone ID: PAT_TA_41865.pep
MAAKEPMRVLVTGAARQIGYALDPMIARGVMLGADQPGILHMLDIEIAAAALKGVKMELIDAAFS

SEQ ID NO: 147448 - protein, 91 aa, Triticum aestivum
  Clone ID: PAT_TA_41866.pep
MGRVIRAQRKGAGSVFKSHTHHRKGPARFRSLDFGERNGYLKGVVTDVIHDPGRGAPLAKVTFLHPFRYKHQKELFVAVEGMYTGQFVYCG

SEQ ID NO: 147449 - protein, 106 aa, Triticum aestivum
  Clone ID: PAT_TA_41867.pep
LQQQLLAPQHRVWQELDSAGYLTKKCLFPSSSPLERQLFFLLTCCLRQRACFSSPLSPRFPARFGSLGFSSGEEEEEWRTSSTAASSAASPGPPTTSSSRTPSPST

SEQ ID NO: 147450 - protein, 130 aa, Triticum aestivum
  Clone ID: PAT_TA_41868.pep
DAWVPGSAAMQGQYNTIAPSGVTHSEGQYSYGGPGIPPSQPPPQHNMQRQQLPPPGQGSFGPPPGKGGYPPQYAPQGHPQGYNTSYGSYPPTGPSAVQAAQMPPGSSQHHMMRGHPYGDMIEKAITMGYS

SEQ ID NO: 147451 - protein, 114 aa, Triticum aestivum
  Clone ID: PAT_TA_41869.pep
DAWADAWANAWDRRSGARRACLLRRVDGAHHRGVQRGRLAANGRGVAEAPRVRHGLWVRAAGKGGRRVGGEDRRDVRAEARGGGGGVEVGIFLPAGAMERFNECFADAIACLLA

SEQ ID NO: 147452 - protein, 93 aa, Triticum aestivum
  Clone ID: PAT_TA_41870.pep
RLLFRTQRAGGYPCFGHHTGTCHIRTIRANINSFWLAGSNCNIYRDPPCKDAGLMRGFFGDFVYMLETPAPGPIWLQLSKARGPFSSGGEEED

SEQ ID NO: 147453 - protein, 84 aa, Triticum aestivum
  unsure (1)..(84): unsure at all Xaa locations
  Clone ID: PAT_TA_41871.pep
MAKAKPSSSAKKQAAKSQGAQQGGGAGHAAPSGLARYLDPEAPWDKDQLLDARHWIRHAVALACGLLWXAXDEGEDSFPNVAGN

SEQ ID NO: 147454 - protein, 62 aa, Triticum aestivum
  Clone ID: PAT_TA_41872.pep
SIFARGNRDRLALFIYLCDESHQLLCMFNGEERPLQLHFLEEDAHHTKCLTSHLFIARQKRK

SEQ ID NO: 147455 - protein, 71 aa, Triticum aestivum
  unsure (1)..(71): unsure at all Xaa locations
  Clone ID: PAT_TA_41873.pep
SRVVVGVKQLPSMNGGGMXXIFRWYNDLLYYSKCCLLQKIKKNIKILHXRTSTDGRSLYRIQAYILLAWNG

SEQ ID NO: 147456 - protein, 86 aa, Triticum aestivum
  unsure (1)..(86): unsure at all Xaa locations
  Clone ID: PAT_TA_41874.pep
TPSPLCVASLNPSKKYLLVTDPLDPNHISGSXIQTLSFIADNLMTWMSFFSKEILGCGGTEDTPPIXPSEVEANKMLTDWAKFSFS

SEQ ID NO: 147457 - protein, 110 aa, Triticum aestivum
  Clone ID: PAT_TA_41875.pep
PHAAAARPEKEPWLQHLTSVDPVANGLHGDRSDRGRRSPSAWRSSAARSHLGDGDGLRRRCCRVGAGHGGRWFSGDKAQLAGDEEARAFLGMAGAWGRAALSSGVAAAVR

SEQ ID NO: 147458 - protein, 51 aa, Triticum aestivum
  Clone ID: PAT_TA_41876.pep
MRNGMAAPRFRPIEECATEGRSRQTVAADLDGTLLLSRSAFPYYLLIALEA

SEQ ID NO: 147459 - protein, 75 aa, Triticum aestivum
  Clone ID: PAT_TA_41877.pep
AHLGTLGGLRQHHRPASGTGEALLAFLQIRTGEDPVLSTGGPKEGGKPGMGCCRRRRVLSCAILWAPCDDAGGAA

SEQ ID NO: 147460 - protein, 53 aa, Triticum aestivum
  Clone ID: PAT_TA_41878.pep
MEVHLFVKKVILENVGYLVVYHVVVVIVEQLNKTSLEQNASQKHFYQTRYRKG

SEQ ID NO: 147461 - protein, 92 aa, Triticum aestivum
  unsure (1)..(92): unsure at all Xaa locations
  Clone ID: PAT_TA_41879.pep
PHSRPLPRLPRPARPPFPASTTRQTPPRRPASTVPLAVLSPHPSRAPXPIXADSYCDRSSLLLHPTPNPSSSRCRCCLLRPNCRTASVHFPG

SEQ ID NO: 147462 - protein, 95 aa, Triticum aestivum
  Clone ID: PAT_TA_41880.pep
MAPIKIGINGFGRIGRLVARVALQSPDVELVDVNDPFITTDYMTYMFKYDTVHGQWKHHEVKVKDSKTLLFCEKEVAVFGCRNPKEIPWAGAGAE

SEQ ID NO: 147463 - protein, 61 aa, Triticum aestivum
  unsure (1)..(61): unsure at all Xaa locations
  Clone ID: PAT_TA_41881.pep
YKFTQANXHIKTKKKILYTHDTHKYDFTNFNGLPAKVYQGYHLVFFGLLYQEVKDPLAPSK

SEQ ID NO: 147464 - protein, 59 aa, Triticum aestivum
  Clone ID: PAT_TA_41882.pep
AYMPFSGRKYKDEKHTALHLFKECHYNKKKGYTDIVQLQSAILSQGSRSDNHITVLTFF

SEQ ID NO: 147465 - protein, 112 aa, Triticum aestivum
  unsure (1)..(112): unsure at all Xaa locations
  Clone ID: PAT_TA_41883.pep
MDAVAFSPAPNPNAAPFPSASPSSRARRFSIRGPRRRRPLPALRSSAFPFASHHDVVVVGAGIVGLSIARHXXXHTPLSVAVADAAVPCSGATGAGQGYVGMSHRTPGSDTW

SEQ ID NO: 147466 - protein, 81 aa, Triticum aestivum
  Clone ID: PAT_TA_41884.pep
RNWYVRFWVLHRDAWSLGSGFGTLVWLVQHLFNSNCCLTHATSQRMPDKFAKVLAGREPREVKLREAGSGRPNLWDVKVVL

SEQ ID NO: 147467 - protein, 92 aa, Triticum aestivum
  Clone ID: PAT_TA_41885.pep
RATQIDRHATGAQAGVHKKQVRCWVPIWSRGCVVTLPTPPRLTRRRAVPQAPHKGLAADSHAARGCARLPMGCAACREPRHSSLTHTLWFPF

SEQ ID NO: 147468 - protein, 71 aa, Triticum aestivum
  Clone ID: PAT_TA_41886.pep
GSWIEPPLQESVPVVRSFSKSVIESAVGTDVIRGDQPEQQFSEGNLLALSSYEYFRSVYFKVVKTDVSAKA

SEQ ID NO: 147469 - protein, 35 aa, Triticum aestivum
  Clone ID: PAT_TA_41887.pep
HNMTTSINNKYHARIYLQCYHASTHASAHASAHAS

SEQ ID NO: 147470 - protein, 80 aa, Triticum aestivum
  Clone ID: PAT_TA_41888.pep
ARYSTSSIRASIYPWSEHVWITGVFEMPDAYVLRSIHSTNLIGCELTTRIFSDRGVVRVYRWDHDVRRMPLGTDQVERVP

SEQ ID NO: 147471 - protein, 54 aa, Triticum aestivum
  Clone ID: PAT_TA_41889.pep
DYGRDSLKLLNTHRQTPSEVYTPHQQHQQEYIERGAYERRTMRKSTGAEHICIV

SEQ ID NO: 147472 - protein, 49 aa, Triticum aestivum
  Clone ID: PAT_TA_41890.pep
HNLCSSAALEYPGVAAHTGRELHHLHLIRKFNLLDLISLPKLLSKTIVL

SEQ ID NO: 147473 - protein, 91 aa, Triticum aestivum
  Clone ID: PAT_TA_41891.pep
AGTAHRLVLRMQSAYVGESREPSLPCGCYIRTTSHQKQGKRNASDAFSWNQTLLLARLLHTPLGREGIRSTINPGNLPCTHHWAHASADAW

SEQ ID NO: 147474 - protein, 126 aa, Triticum aestivum
  Clone ID: PAT_TA_41892.pep
HASADAWGSRPSASRLRCRFLSALAAGGTPPPPRSGLVYGFGDNSHGAVGQPAPAADVYVPTPVPSLPSSVDAVAAGHYHSLAVSSAGEVWAWGRNEEGQLGRGLQAPRNTWSNPEQVRGLENVQV

SEQ ID NO: 147475 - protein, 126 aa, Triticum aestivum
  Clone ID: PAT_TA_41893.pep
PSTQAPPSGAASKTPQKKPSAGQKKPLEAIGSSPPPSGKKQKGSGGFHDQSIDQLNDVTAVSGVNLREEEEQLFSAPKEESRVSEAARKVVQLEEERLILQKGPLTKKLAEIMRKYNLKSIGCDVE

SEQ ID NO: 147476 - protein, 41 aa, Triticum aestivum
  Clone ID: PAT_TA_41894.pep
RSDCSCREASEHGNIVYEKNPRRTNNLLLLGSIYCKFMTWC

SEQ ID NO: 147477 - protein, 125 aa, Triticum aestivum
  Clone ID: PAT_TA_41895.pep
RTAGGRVGNVQSSLSSSSKSPLTTSMIQDDVDDSNNDFIEQFAMVSGSHSSTLDRLHAWERKLYDEIKASENVRKTYDEKCNLLRHQFTRGLNAELIDKTRAVVKDLHSRVSVAIQAVDAISKRI

SEQ ID NO: 147478 - protein, 114 aa, Triticum aestivum
  unsure (1)..(114): unsure at all Xaa locations
  Clone ID: PAT_TA_41896.pep
ILWSSFLTLCLQPSQCMFTLRTWVWILTSLKSSSLVIFADHRRFQVAVQALFGEEGRMDGEXDGVCVCVCGREGQWLVEEWGSDGAGAGSCTVAGGGGGGEEATPPCLHLRMCR

SEQ ID NO: 147479 - protein, 85 aa, Triticum aestivum
  Clone ID: PAT_TA_41897.pep
NHAVCGLTISSRISTQDRLCSVPMLNAECGLTISSRILTRARLYSAGYIASKMVLLKDNYTNIHSAPALSRGNQGWGGFSFENLS

SEQ ID NO: 147480 - protein, 61 aa, Triticum aestivum
  unsure (1)..(61): unsure at all Xaa locations
  Clone ID: PAT_TA_41898.pep
MTQTAELSCEENVYISKLAXKIRGTXDIVEFIVKVNKTADFVKPTLKEHTLVLVAYKNFNG

SEQ ID NO: 147481 - protein, 62 aa, Triticum aestivum
  Clone ID: PAT_TA_41899.pep
LCSASMLSAECGLTTASSVLTRARLYAAAYICLKMVLLKDNVSNVHRCGWPFLLGKQVMGRF

SEQ ID NO: 147482 - protein, 78 aa, Triticum aestivum
  Clone ID: PAT_TA_41900.pep
TRTRGARPEGVLIQRRGERRALYSSPPLSMGQRWRSVLTTHLICRTMVVSTSLDSDYLRCFVLKAVVFLGQAMRGAEA

SEQ ID NO: 147483 - protein, 98 aa, Triticum aestivum
  Clone ID: PAT_TA_41901.pep
HASAKEITWTRGEEVSVKLRHNSHFDKHNKLFTSFDTLSCVESITKSLLKVNRLLLVLTHSQLPWFQVIRCMWFLSCQYTTIQIECTVYAKIPSTFIL

SEQ ID NO: 147484 - protein, 45 aa, Triticum aestivum
  unsure (1)..(45): unsure at all Xaa locations
  Clone ID: PAT_TA_41902.pep
KTSNNTKYYYVLGVSNTTTPVXFNKAYPKAPIKNHSVYGGNPEMF

SEQ ID NO: 147485 - protein, 124 aa, Triticum aestivum
  Clone ID: PAT_TA_41903.pep
ILCRRTKNCAALVGEAGVGKTAIIEGLTQRIASGKVPASLAGARVVEVDLGAMLAGTSLRGMFEERIKDVIKSAEDGDGKVILFIDEMHMLLGAGDDVSGTDAANLLKPALARGLIRCVGATTL

SEQ ID NO: 147486 - protein, 81 aa, Triticum aestivum
  Clone ID: PAT_TA_41904.pep
MYISFIILANYLCLPRAVGTPRVSPLYLRKLLCNSLLKFLNYDIGSKRDSRCCDEFVLWGCVIQPDYRYVLMKHGFLQVLF

SEQ ID NO: 147487 - protein, 126 aa, Triticum aestivum
  Clone ID: PAT_TA_41905.pep
PRVRGRVGTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKW

SEQ ID NO: 147488 - protein, 126 aa, Triticum aestivum
  Clone ID: PAT_TA_41906.pep
RTRGLFFSLGGASSLPASIRLPSASPAADLASSRMREAELHALYLLRSQRSGLLSLFNRTAAPEPTNSSTAAPVSLSDLQAALLSQIKINREIQESLLSTHHSGTGNATEDALDLDLPGPVCRRRE

SEQ ID NO: 147489 - protein, 92 aa, Triticum aestivum
  Clone ID: PAT_TA_41907.pep
RTRGPNPSSMATVAMDISKPPPAASGDESAKGARGGGEGLRQYYLQHIHDLQLQIRQKTHNLNRLEAQRNDLNSRVRMLREELQLLQEPGSY

SEQ ID NO: 147490 - protein, 49 aa, Triticum aestivum
  Clone ID: PAT_TA_41908.pep
MESKGGKKSSSSSSLMYEAPLGYSIEDVRPAGGAKKFSAAYSNCAKKPS

SEQ ID NO: 147491 - protein, 80 aa, Triticum aestivum
  Clone ID: PAT_TA_41909.pep
FNTWDSNHCVGRMIQFWSIQGVNISFMRSHKYSHSGSSNKKIDVNFFQAQIYLNKEISYIYPCKEKKVAAPDIEGYMETG

SEQ ID NO: 147492 - protein, 113 aa, Triticum aestivum
  unsure (1)..(113): unsure at all Xaa locations
  Clone ID: PAT_TA_41910.pep
SNNPECSCRGWTLLVQCYIKCRRXIERGGGSIKVLARYVHQLKYSLDTAYQLMFAPHLCGTQTNELHLILPYQGQHYPNRXDLNXQTELLAHRDTFILMPDACYSLLVDYPER

SEQ ID NO: 147493 - protein, 60 aa, Triticum aestivum
  Clone ID: PAT_TA_41911.pep
MLVNPPLPVYSLLSADDEILVREVLYDALILVDYSFLNGAEVDQADSSLLPIFVSRLVIT

SEQ ID NO: 147494 - protein, 30 aa, Triticum aestivum
  Clone ID: PAT_TA_41912.pep
KSQRPIMTHSCMIKECKTYYTTLVDEGMLD

SEQ ID NO: 147495 - protein, 123 aa, Triticum aestivum
  unsure (1)..(123): unsure at all Xaa locations
  Clone ID: PAT_TA_41913.pep
SSPSISDAAEGASAATAETGEGSRARCRHRRGAGAAALALLVXGXAARSGSGSGREGRARGARRLEREFILVCCIPRAAGKGPLVWIAARRSRSRERLARSPVVQLTYVARSLSLPTRPPTRP

SEQ ID NO: 147496 - protein, 98 aa, Triticum aestivum
  unsure (1)..(98): unsure at all Xaa locations
  Clone ID: PAT_TA_41914.pep
PSCVLSVRPMWFGGNRFKGLSKALXXRGSSEWWLPNKXXCYVQMKLISPLKGNFALXNXNKSYVTEKGIIHCIWMKHVCEKLPRGIGKNERPCTHLVL

SEQ ID NO: 147497 - protein, 76 aa, Triticum aestivum
  Clone ID: PAT_TA_41915.pep
MRECISIHIGQAGIQVGNACWELYCLEHGIQPDGQTNGDKTIGGGDDAFNTFFSETGAGKYVPRAVYVDLEPTVID

SEQ ID NO: 147498 - protein, 59 aa, Triticum aestivum
  Clone ID: PAT_TA_41916.pep
VPISSKYSYKTSLHSLGRLCSLSSIPTIIHLSSSSKHRKLSILWIPKLSQLFKCLPTFI

SEQ ID NO: 147499 - protein, 65 aa, Triticum aestivum
  Clone ID: PAT_TA_41917.pep
MDPKLVEVTQLIDRFKAAFKASNFDVCSTLLSQLKVLLTKFPSLPPVFQQTPNAVEELKLAREIY

SEQ ID NO: 147500 - protein, 36 aa, Triticum aestivum
  Clone ID: PAT_TA_41918.pep
PSLQTLSPSTYISHPGFPICNLCSYCTSSAPPPPIT

SEQ ID NO: 147501 - protein, 47 aa, Triticum aestivum
  Clone ID: PAT_TA_41919.pep
LYFFQHPKGYRICLLSTPSTKPAALLTQLTRLIVGKTDNCHRHSLGG

SEQ ID NO: 147502 - protein, 84 aa, Triticum aestivum
  Clone ID: PAT_TA_41920.pep
LFHFHFLREDLALPHLTCSEAPTTSFFSKTPKRSLRSPLDRGIGEWVRVIMPASVPPTGGWRPCSPAAAGHGAWRWPRRLSCGC

SEQ ID NO: 147503 - protein, 88 aa, Triticum aestivum
  Clone ID: PAT_TA_41921.pep
MLPWIFSRKGASGFSWASTADQVTAGISAAGLTAIVTGASSGIGAETARVLAARGAHVVMAVRNLAAAETVRQAVLAETPGASVEVME

SEQ ID NO: 147504 - protein, 94 aa, Triticum aestivum
  Clone ID: PAT_TA_41922.pep
RSPHRPISTPPPATLCLRPPAPHPARPSPPFPRPAMSWWWAGAVGAVKKLQDQRAAAAEPTFQSVGLILGFTGIVGTFLLDILPRGDTLGGLWE

SEQ ID NO: 147505 - protein, 39 aa, Triticum aestivum
  Clone ID: PAT_TA_41923.pep
QFTLFKRASYKAPVKLSVLSKMTIPRSMIRSLKCNRTRQ

SEQ ID NO: 147506 - protein, 97 aa, Triticum aestivum
  Clone ID: PAT_TA_41924.pep
APPTGRSSRHRRTPGVFVRQRDTPSDRAPLFPNPRLACGGRARWARSKNGRTSGRRMLSPPSRAWRSYLGFTGMVGTYLLVILSRDYTIFCPWIVFF

SEQ ID NO: 147507 - protein, 70 aa, Triticum aestivum
  unsure (1)..(70): unsure at all Xaa locations
  Clone ID: PAT_TA_41925.pep
PRTRFLNFFYVIPIPLGQALANSEGQDKAAPSLKPIIETPTIKSFIQRTLTGIALXIYLILLPRVLMVMS

SEQ ID NO: 147508 - protein, 89 aa, Triticum aestivum
  Clone ID: PAT_TA_41926.pep
PTRPRTRGCPSGGWSTGQRSGRDGVELRRRGRRLATGNRAREEASGSCGCGRWLREGLRLEQQEQGARGSSGLWLLTDCDSGHATCYEG

SEQ ID NO: 147509 - protein, 46 aa, Triticum aestivum
  Clone ID: PAT_TA_41927.pep
EIPISSPESLPWGLRSLLPKELTYPPPVVMIHPPPPFKPNPLMGSP

SEQ ID NO: 147510 - protein, 122 aa, Triticum aestivum
  unsure (1)..(122): unsure at all Xaa locations
  Clone ID: PAT_TA_41928.pep
PRXRVGWDESTASERRTRVSIWEIEPVATPFYICPPPFFRPKLSKQPGMPDDEGEVDSAFKRAMPWLGDDFALKDVQSQLFPGLSLVQWMAMQQNSQMLPAGAPAVQAPFLNYNAMAFHDGM

SEQ ID NO: 147511 - protein, 40 aa, Triticum aestivum
  Clone ID: PAT_TA_41929.pep
SLITTRDISFSHQGDRLIKVQNWWLVVYWYQHYLVASWWL

SEQ ID NO: 147512 - protein, 86 aa, Triticum aestivum
  Clone ID: PAT_TA_41930.pep
VGSRGKEVFWACVGLAGVGHSCKWRGVWPDPYYSRFIWDVLSGVGSSWYPPLLVCWVSKARIRNSRGPRRADLPTGILTLPRTLNV

SEQ ID NO: 147513 - protein, 118 aa, Triticum aestivum
  Clone ID: PAT_TA_41931.pep
NPSPRRRMSGEREWKGRPVEKREPVVLASDRRRRGLAVVGVDGNAGVGAHEVLRAVSVYRLRLSSAVCSEKKPREASRRRRRSRTDGSGWPVGSNSAAEGEEWPGRCLISRSATSHAS

SEQ ID NO: 147514 - protein, 116 aa, Triticum aestivum
  Clone ID: PAT_TA_41932.pep
LKAAAASDSRSGSGGRLSLGPFPPAGPLGLRHSPPRIRPSRLLLRPPLQAPSALRQVSISSGWKWSGDREARRLEAKKAQPAGEAKSSKRPHQPPTNRPRPWRRRRSRPSGSAAWR

SEQ ID NO: 147515 - protein, 97 aa, Triticum aestivum
  unsure (1)..(97): unsure at all Xaa locations
  Clone ID: PAT_TA_41933.pep
PTRPGAVLVMVEELLIRKIDDEPESYKAKAATALANIVESGIDPDTTVVNKEGHVLTSKYCIYNFVCMLKCFVPDDFNLSXXRLLLALTGFRKPLDV

SEQ ID NO: 147516 - protein, 87 aa, Triticum aestivum
  Clone ID: PAT_TA_41934.pep
APSKAELHVSRHFLFLLTKVSLDDSNIECTPRQAKMAGQNFIFYPVDQQNCFLWSILPVSERLGTGLFRRIRSSSPLQQVAHRFCAG

SEQ ID NO: 147517 - protein, 100 aa, Triticum aestivum
  Clone ID: PAT_TA_41935.pep
RTRGPCAPQSSLRACRSSPPPHHLLPGTTALLPPRAGDQPLPGPPDHLFPWTTTPPHSPCRGNTPSPRRRTIFSQAPPHHLTLRAVAPPPSRAVTPSSTT

SEQ ID NO: 147518 - protein, 68 aa, Triticum aestivum
  Clone ID: PAT_TA_41936.pep
MALSASAASAGRGARAEKVRRIFERFDANGDGGLDRAEMAKLVVAVNPRVKFSDDQISAILDEVFRTY

SEQ ID NO: 147519 - protein, 42 aa, Triticum aestivum
  Clone ID: PAT_TA_41937.pep
MGRPLMYEIVEKPASSGVIAVCSLIWFLIQKRGIGYADVGLS

SEQ ID NO: 147520 - protein, 97 aa, Triticum aestivum
  Clone ID: PAT_TA_41938.pep
MSRGRSALGGQSSLGYLFGDGEPAKPAAAPAAKPAPAEKPSPAGADVTKQIPAGIPGSRANNYYRADGQNTGNFLTDRPSTNVHAVAGGGSSLGYLF

SEQ ID NO: 147521 - protein, 120 aa, Triticum aestivum
  Clone ID: PAT_TA_41939.pep
DAWGITDNFSEERIIGRGRHGLVYKGVQDNGVCIAVKKLHLMSGLDDEEFKNEFNNLMRVRHQNTIPLVGYCNHTAQVLVEHNGKHVSARIEERYLCSKYLEGGTLDKHLSNEPCAFVWH

SEQ ID NO: 147522 - protein, 52 aa, Triticum aestivum
  Clone ID: PAT_TA_41940.pep
EVRDQFSISIPVPLREGPRLASDMATGAWVIKCKAPVSWKAGNPLSMKKVKV

SEQ ID NO: 147523 - protein, 80 aa, Triticum aestivum
  Clone ID: PAT_TA_41941.pep
RMHPTDSWEVAREHSFVPGTSGARASSHTLMEYGFSQGHVFLCHSGYCLIGVTSKWVNCPHYCYCCNSYHRNVLLYCIKR

SEQ ID NO: 147524 - protein, 51 aa, Triticum aestivum
  Clone ID: PAT_TA_41942.pep
KGAGGLWTGHLQMIIHIGKFLNPEVFDLTEEDLRNKLSSGVYMVASLFLAI

SEQ ID NO: 147525 - protein, 123 aa, Triticum aestivum
  unsure (1)..(123): unsure at all Xaa locations
  Clone ID: PAT_TA_41943.pep
PPTRTTTNGAGGREEGRSQQVTIVFRSGVSARRVVADARHHMLGRLASIVVKELLNGHRVEVVRFEEMCIYGRLVRHKMNVLRSLRKRMNNKHLGGDIHFRADXGIFWRKRRRMIPHKTPRGE

SEQ ID NO: 147526 - protein, 99 aa, Triticum aestivum
  unsure (1)..(99): unsure at all Xaa locations
  Clone ID: PAT_TA_41944.pep
GGGPRLRGRVGGHAHLPFSDCSTKEYEDRAVXLATNPAKLQALXKEVKEGRRSWCLLDTARWVRNLDRAYFKMWNIYCSGRHPEPFKVKEDDSEFPYDR

SEQ ID NO: 147527 - protein, 57 aa, Triticum aestivum
  Clone ID: PAT_TA_41945.pep
MVSAVLRTILVTVGAGYIGSHTVLQLLLQGFRVLVVDSLDNASEEAIRRVRQLANAP

SEQ ID NO: 147528 - protein, 118 aa, Triticum aestivum
  Clone ID: PAT_TA_41946.pep
RTRGRTRGVESLHQLKHLRYLALLNTDISVLPENIGKMKLLQYFDLIGCKNLVNLPNSIVKLSQLRLLILPTSSIVPRGFSGLTNMRRLSGFRAHMDSDSCNLDEVGPLSQLKFSNLT

SEQ ID NO: 147529 - protein, 72 aa, Triticum aestivum
  Clone ID: PAT_TA_41947.pep
RTRGRTRGHRVRFWRDHTTHTPTRGHVPGGGGGHFAVLLLGAEAAARARRRRGAISVVPRVPYSRGDAWCWR

SEQ ID NO: 147530 - protein, 110 aa, Triticum aestivum
  Clone ID: PAT_TA_41948.pep
AAIRDGVGLSDRELGCDSARSATAHKQHFGPTNKMQSASQCSDSFAGHIQEETSGAPHDSPRHEHRTNSPLRGVSSAQSGGGKETRAQHVRSGVICQRRQGSQLTAPDAT

SEQ ID NO: 147531 - protein, 47 aa, Triticum aestivum
  Clone ID: PAT_TA_41949.pep
RQHGVTQLNPLEAHSTDASLNDTVEALADQLSQQVLPLTGQWDATCS

SEQ ID NO: 147532 - protein, 106 aa, Triticum aestivum
  Clone ID: PAT_TA_41950.pep
MAEHAARHLRRRGPVAGWCCSFAGVPPSPDHRLPHRTLSHAAAPQGPAAGSVCTGGEGPRKQQPPPKSPSSFHGSPSSKLAGLIDYPRRILSPGRVSPIDPGAHPP

SEQ ID NO: 147533 - protein, 65 aa, Triticum aestivum
  Clone ID: PAT_TA_41951.pep
VCVCVCVELTRNSAAGSWLGGRSIDGRENRIEMMLKDLAAIHKYQEHKNWPWPTQEHVRPNTRLH

SEQ ID NO: 147534 - protein, 131 aa, Triticum aestivum
  Clone ID: PAT_TA_41952.pep
GRVGKNARLRSPRRDGSLRPSHHSRRRTVTSADSAGTGIRSLNPRLIVAGNYVMNYLAARGPKLQNFVTISLIQLACRITKFGWFDDDRFREIFKEATDFLALASQDHYLIGLKILNFLVMEMNQANSAMP

SEQ ID NO: 147535 - protein, 107 aa, Triticum aestivum
  Clone ID: PAT_TA_41953.pep
TNSHTSRTDKEDRDRARREEKLPARLLLRKLTTLAAPYIHREERAGGGRTTGGRQRPHLPTYISIYLSKPTEWTRSTASRAWPPQAILRGAAGARTSGEDGRAGHGL

SEQ ID NO: 147536 - protein, 69 aa, Triticum aestivum
  Clone ID: PAT_TA_41954.pep
LLEVSLTDNTRNSMLVLLTKNSVHDSGPILTEMITIEVTKLSNSRIRRVFSVFFPPISFHINMTFIVYS

SEQ ID NO: 147537 - protein, 79 aa, Triticum aestivum
  unsure (1)..(79): unsure at all Xaa locations
  Clone ID: PAT_TA_41955.pep
CRSRIGVSAYTYAYYLMIKGXVCAHKKRVVTLRQSLLKQTSRVALQEIKLKFIHTLFKFGHGRVQTTDERQTFYGRLKA

SEQ ID NO: 147538 - protein, 58 aa, Triticum aestivum
  Clone ID: PAT_TA_41956.pep
LSYGQPYRSDTRADGKKRSSIIEVRDQTEHRDLVRGATAVDDVGQDGSLVGGGVLPLI

SEQ ID NO: 147539 - protein, 27 aa, Triticum aestivum
  Clone ID: PAT_TA_41957.pep
DAEVSDCTVPMVDCSRINELNNSEKPT

SEQ ID NO: 147540 - protein, 85 aa, Triticum aestivum
  unsure (1)..(85): unsure at all Xaa locations
  Clone ID: PAT_TA_41958.pep
RPGGTHASGTTDLNLLVHAPTIFGGVNKYGDDXLNIRYKNCCTRRCPRPMYAPRSLLTKPLLDLRLLLFQLLVWQLKTKRSFSVL

SEQ ID NO: 147541 - protein, 58 aa, Triticum aestivum
  Clone ID: PAT_TA_41959.pep
KKVRVCGQEFNSLAEAYDFYNLVKILFYLLGKGSPGKWLSLSRRCTKKPRIEPKCSKC

SEQ ID NO: 147542 - protein, 119 aa, Triticum aestivum
  Clone ID: PAT_TA_41960.pep
RTRGSAQKMKKGWKRRDCLQQQARQERLESNRSRLCENDIDEMAVNMTEDDMENRPVMKDIVEESSAQDLKETSSISEDLSCIIDYDSNGLIKDSGMMLQDQYDDGKTGINMRRWYDNN

SEQ ID NO: 147543 - protein, 81 aa, Triticum aestivum
  unsure (1)..(81): unsure at all Xaa locations
  Clone ID: PAT_TA_41961.pep
RITTSYKSNTLQLVLRLRRGMQMFXQRLTGKTITLEVATYDTXDSVNATIQDKEGINADQQCRRFDGKQLEDGRTLSDYNI

SEQ ID NO: 147544 - protein, 42 aa, Triticum aestivum
  Clone ID: PAT_TA_41962.pep
CMCKQSLDGDFYRVGPLFCVKQKNCRLLLSHWLLVRQTVVFI

SEQ ID NO: 147545 - protein, 50 aa, Triticum aestivum
  Clone ID: PAT_TA_41963.pep
RGALVMSAVSRLENRVKEDKVVEVHAGFSEKRLTEGSTPNFFGVVFPNRH

SEQ ID NO: 147546 - protein, 126 aa, Triticum aestivum
  Clone ID: PAT_TA_41964.pep
GRVGELSGAVPAILADLKLSYLNLSNNRLDGPVPPGLAISAYGESFQGNPGLCANNGAGFLRRCTPGDGGHSGSTARTLVTCLLAGMAGLLAGLGVAIFIKKRPQDVEAAAMAGAGKLLFAKKGSW

SEQ ID NO: 147547 - protein, 87 aa, Triticum aestivum
  Clone ID: PAT_TA_41965.pep
MEGQSGKTMQSLPDTLSSLKGFNKYLTPSWIESVSHILKELTPTKPQKVMEEEAQNVFECDDTQLDIKGAKIQDEMVSLGAQLKQKT

SEQ ID NO: 147548 - protein, 111 aa, Triticum aestivum
  unsure (1)..(111): unsure at all Xaa locations
  Clone ID: PAT_TA_41966.pep
LFFVFFCSSSLFGVLXFSPCGLLACLLGVLCFFSLVSFRSARPLPLSFXLACAWASLSFPWGPXGGLSPWPSVRFGSLGFRAPPRVPRXLSLSSLACACRVAWVAPAVPVR

SEQ ID NO: 147549 - protein, 131 aa, Triticum aestivum
  Clone ID: PAT_TA_41967.pep
RRSPLFRQSRERWGRGEERTTAVERLGLGGSFEKMHGWSLSLVGPRVDVAAVKAPRELVSGGQSKLGPRVNNLERFRTQMCILKELGPSRHFWERIRTALAFYSQYYGIPENWLSLRTVQFFLNSIGPDAW

SEQ ID NO: 147550 - protein, 109 aa, Triticum aestivum
  Clone ID: PAT_TA_41968.pep
SRLDDPRTLNKILYMRPPANIVSHNELISMWERKAGRTFQIVRIPEAGLLKLIKEAAFPLNILLSLALSIFIGGVQANFEIEASFGVEATELYPDLKYTTIDEYLEHLH

SEQ ID NO: 147551 - protein, 140 aa, Triticum aestivum
  Clone ID: PAT_TA_41969.pep
NSRLDAYSITWNPRKSPGRYVSALSFTGCDFDMYVLEHGTNKTVGQCTATCPVKDITDTVAWQYCNGTGCCFTNVDAEFATGIEIKFVRHKIGQLKFQANSNRSSIWHTVDVTADSIIMWGIIVNEHGPLQNSTDYACLS

SEQ ID NO: 147552 - protein, 110 aa, Triticum aestivum
  Clone ID: PAT_TA_41970.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEE

SEQ ID NO: 147553 - protein, 125 aa, Triticum aestivum
  unsure (1)..(125): unsure at all Xaa locations
  Clone ID: PAT_TA_41971.pep
IPGSTFSVLLPCSGCSQQGPKLVTSNGIQNIGKKLVNSPDGPLTFGQPKMTIEKLPEYRHMLVQEHGNVKXFNLLTPYMNQATLGDAKQDAMKNGSLQGKRAQQGTLPVPARCNDQNAKKFYPNS

SEQ ID NO: 147554 - protein, 155 aa, Triticum aestivum
  Clone ID: PAT_TA_41972.pep
VDWDYIKENEDHYPGVHDSFKACGVDEFVAQKLTKWNDELIMQFYSTTHFYLDGRIVWMSEGTRYQSTVAEWAKLINAPKESEDDLDVYANRKKDHNTMAHMYKEIPHAALETHKFGSVHYLLSGLPTINWILRHTLFPKSGDHKMIRGHAINLL

SEQ ID NO: 147555 - protein, 147 aa, Triticum aestivum
  Clone ID: PAT_TA_41973.pep
VATFKWIFDEFVKMMGGKRPITILTDQARAMEVAIEDVYPDATQRWCKWHILKKAKESLGSNYTKKSDFRAEFHKLVHEMLTIEEFEDRWAALLEKYSLTKNTHLTQIYETRQKWAKPYFAGKFCARQNSTGRSESANHMLRQYVPT

SEQ ID NO: 147556 - protein, 109 aa, Triticum aestivum
  unsure (1)..(109): unsure at all Xaa locations
  Clone ID: PAT_TA_41974.pep
VDYRNTQYHGVIGLGTPLQNFTVRFETGSSNLXVPTAKCYFTRAXVVPCQIEIEHVRHVIAYGEICXYIWGSRTYTGLFSIEKVLVGDTDVVNIGTLITTVNICPFALS

SEQ ID NO: 147557 - protein, 88 aa, Triticum aestivum
  Clone ID: PAT_TA_41975.pep
VRNIRVDLKRVFPDKKIGKIIETSLSANQERAAMEKKRLKWKVAGPPPKENVVRGGPVDPSKLVVELAPMEIRTFVINFDHRLAAHPI

SEQ ID NO: 147558 - protein, 154 aa, Triticum aestivum
  Clone ID: PAT_TA_41976.pep
SGFPGSTGVWAELCVFNSGANDWRIITEVFADELPDLWWSDDVFAFDGRFLCWVDYFCGVVLCDFSKNVDSQVLHFVPFPGGIKYPFDARFPRYFPGRFRSASISQGMIRYIHIDNDFHETTHSDWQVMIPPKRSQRRQQQLPHKITIWTLNSK

SEQ ID NO: 147559 - protein, 100 aa, Triticum aestivum
  Clone ID: PAT_TA_41977.pep
CPYSPEFGRLVRGLLPGPSSSSSPSPSPYIFRVGAGHVIKGPDEGILSMKVGGLRRLYIPGQLAFPKGLTSAPGRPRVAPSSPVVFDVNLLFVPGLDDDG

SEQ ID NO: 147560 - protein, 76 aa, Triticum aestivum
  Clone ID: PAT_TA_41978.pep
VGGKMGICKRQAWELLLQGFGIAFVTHLVFWGGLLAVSWHNLRLRPVNSNLSSYMETPDSKYWCSHPLIATSLRRF

SEQ ID NO: 147561 - protein, 52 aa, Triticum aestivum
  Clone ID: PAT_TA_41979.pep
ECAGSVDVLFPACGLVDASGLNVRFDCQVCLVLGQDYQHPFINWIGVSTDTA

SEQ ID NO: 147562 - protein, 62 aa, Triticum aestivum
  Clone ID: PAT_TA_41980.pep
LLKVFRILKKCSHFIQCPDISKSVYVLNICIPLNFYQSSTLRCLLKYTGPLIVSLIAVCSSG

SEQ ID NO: 147563 - protein, 131 aa, Triticum aestivum
  Clone ID: PAT_TA_41981.pep
NSRVDDLSNMLDFGSKDIDGMDEMQEKNRNHCPQGAGLPPHHMIYTWWTPPKKAMAIRQRRIIPSRSNLSTDVISAIAKVAIPAQETITLRIVPKTKTMPSSQPSSRRMGKLALRNRRQMENQKMTVTYPS

SEQ ID NO: 147564 - protein, 123 aa, Triticum aestivum
  Clone ID: PAT_TA_41982.pep
VVLIVAVLLQRKAEEAGCSDPYIRARTYLGQLEPETRQSTRQPDHKKQALVLPFQIPTPHANSLPRSRTDGDMLATGELQPLATQPDFLELAELLRRKVAGEPLPIFIHEVNAYPAVWQIHVN

SEQ ID NO: 147565 - protein, 106 aa, Triticum aestivum
  unsure (1)..(106): unsure at all Xaa locations
  Clone ID: PAT_TA_41983.pep
QAMAMWPDLSLLVEDWKQNTRIVSLSTTRMWLLIKSRRMYLWFLPILTQHVVTGNQWCILPPKIGXSAWKVMPNCTVNPWSLVGINMVVMLVIINSEMEVAQMDNN

SEQ ID NO: 147566 - protein, 63 aa, Triticum aestivum
  Clone ID: PAT_TA_41984.pep
NTVFSSFGTVSSYNPSYLKKMTATSMESFLRSQQLELDSKLPGFIIVSSHLSLYNITISYGKE

SEQ ID NO: 147567 - protein, 71 aa, Triticum aestivum
  Clone ID: PAT_TA_41985.pep
KDAPRKRSAASPTRFHKASSVSSTKPRSTFYQSPADVVSVQSQQAVHILTAGPLLSPWTHAWTSSVTSAGE

SEQ ID NO: 147568 - protein, 38 aa, Triticum aestivum
  Clone ID: PAT_TA_41986.pep
NYIRRNPVAPVLKMVVTHVYKSASIMYLKKTTTEVNSS

SEQ ID NO: 147569 - protein, 80 aa, Triticum aestivum
  Clone ID: PAT_TA_41987.pep
VVIQHYSSEYGLVACGCGSLIYPAGVLSEDCAGPVGDSDLGCVLDGTSGFRSQVWLQGLCGMMLRYYQLDNSYDRCQPTL

SEQ ID NO: 147570 - protein, 116 aa, Triticum aestivum
  unsure (1)..(116): unsure at all Xaa locations
  Clone ID: PAT_TA_41988.pep
SSGLANPETVHSSVTCEPSRDARCSPPLEQSVDSAPARHPSVTRNLLVQHSRGHGGITMGXNXHVSIXRSKDLVIVNDTPCALCTLCLGPYXPDDITLMITTRSSGLIIMILNRTA

SEQ ID NO: 147571 - protein, 126 aa, Triticum aestivum
  unsure (1)..(126): unsure at all Xaa locations
  Clone ID: PAT_TA_41989.pep
RNSRVDPHIQNVGTATSLMGFLMNDVTRYTSKRIYHFHKTDFNWTIXMQPAKMEIDTAVMDVDHHIVMLGDKVDELCDQLMYQINDVIGIDSCSDPDQRSRKLRRQSHWSVNHTCCSCSCRLSRQS

SEQ ID NO: 147572 - protein, 107 aa, Triticum aestivum
  Clone ID: PAT_TA_41990.pep
SDADVIRRLRRLRACVVMLLMVMIFRVLSRCVSRIGSRRIVGFSSFTGVMKLFVFITLVHSWFSELDLDLHDRRHRRAVHAMLSGVQRSDVEVVNYFVQRHGRPWNF

SEQ ID NO: 147573 - protein, 73 aa, Triticum aestivum
  Clone ID: PAT_TA_41991.pep
LLPLQYNSQRLIHGDEKTTICFDHHRICENSNVDPTPQHLSPPSSSHLMTVLFRSKIPHWLVDLEFSERYGQA

SEQ ID NO: 147574 - protein, 71 aa, Triticum aestivum
  Clone ID: PAT_TA_41992.pep
RDHGSANYGEINLNRSLAPYRPGRHLGWLFITVRSLLVIEYRRGSVVCMDAMDRTCHNTRDSMSMCIYDSV

SEQ ID NO: 147575 - protein, 51 aa, Triticum aestivum
  Clone ID: PAT_TA_41993.pep
SESYYSKELVSKRVRGVFSFFLLFFFMERNIRKPLVSSSYGAEYCPITIVA

SEQ ID NO: 147576 - protein, 101 aa, Triticum aestivum
  Clone ID: PAT_TA_41994.pep
RGPSLLPILSRIRLHVSTTWCGRPSRWAQCIKARPDVLCSAWGSPLASPWTSRSLLLQTLSPKDFAAFGLLLVMICNEVCSKRTTTSGTGHYISRLVTGML

SEQ ID NO: 147577 - protein, 111 aa, Triticum aestivum
  Clone ID: PAT_TA_41995.pep
ISVRRVVQTYFFQQTSDKRVWPCGSLDNIHVELQHPGPSKTLSGPHTFILIILSPSLFLSCLRRCSIIPDATPQPCQNSTSPSPPAFQPASTPLLLRRAFHPDTSISYSPL

SEQ ID NO: 147578 - protein, 25 aa, Triticum aestivum
  Clone ID: PAT_TA_41996.pep
CFKSNLLRWQIFNLCYLENIIYDSL

SEQ ID NO: 147579 - protein, 86 aa, Triticum aestivum
  Clone ID: PAT_TA_41997.pep
QRHLILVTAACYGGAVVHRLRATAEWYYLVGHIDTVPRGNGKRVVSYGMMKEHLAVAGAGDLTGCSGWCCVQRAGHWSGPTASRSA

SEQ ID NO: 147580 - protein, 91 aa, Triticum aestivum
  Clone ID: PAT_TA_41998.pep
STTANPARPASRTAGTGTGHHRLLRASMLGRLGRNSYGCPWTCSRRKSKCWYQRRREAFLSLSSLSCGHSSVTKGYTQVAQYQCKHPCSIK

SEQ ID NO: 147581 - protein, 79 aa, Triticum aestivum
  Clone ID: PAT_TA_41999.pep
ESKLSVYIELSQWQIGFERIFILPLAPCGFDTPYLSLPPLEISTMIPCTWGLSSSFLASLLGSNSVGLIFLCMLVCFLH

SEQ ID NO: 147582 - protein, 64 aa, Triticum aestivum
  Clone ID: PAT_TA_42000.pep
RVPFLAQFKTIFMEIKIKPLHLYTLQPRCLFSRVCTLHTLSTIYMHAGASELVIEAKVSRLSMR

SEQ ID NO: 147583 - protein, 132 aa, Triticum aestivum
  Clone ID: PAT_TA_42001.pep
TPTHPPTTSNFKPRALSSSTPTDETVKTSSFKCFTCRGRGHESYECTNKRTMILNDDGTYDSMSEGEMDGLEQVAMHWQVNYEEEQVFCDEDSSLALVVSKVLTLQHNQEEDQKCHIFHTKAGITVRSVKVI

SEQ ID NO: 147584 - protein, 97 aa, Triticum aestivum
  Clone ID: PAT_TA_42002.pep
CGHKPDGRAWFPRSPMMSCAHHWVRLEYFRRCTSHRPVKSVCKLDYYTTSCSFTCISLECYVIHFASYDFLNYVRSVLFLSSYIVSSSKQLYFQIHS

SEQ ID NO: 147585 - protein, 61 aa, Triticum aestivum
  Clone ID: PAT_TA_42003.pep
RSKTRGSTVIAIMSRIITEIYHTEQPTACLRTNVFQQTHHTRSDSSQIQVGYWSQQVQSSF

SEQ ID NO: 147586 - protein, 82 aa, Triticum aestivum
  Clone ID: PAT_TA_42004.pep
RFSANFKKKAAVNGDVDSCRRVTVTHSSRVTTHLRNAPSSAKLASPVAYVVVWPIHCWLAGAYGYCCSARGRVYARYNMTHY

SEQ ID NO: 147587 - protein, 146 aa, Triticum aestivum
  unsure (1)..(146): unsure at all Xaa locations
  Clone ID: PAT_TA_42005.pep
MPYIESYNPVKTTYTSAKLAKIYMTKIVCLHGVPRTIVSDRGSQXFTSRFWQQLHETLGTTLEFITAFHPQTDGQSERVNQILEDMLRACALDYGSSWDDNLPYAEFSYNISYQTSLKMAPFEALYGRMCRTPLLWDEVGDRQLFG

SEQ ID NO: 147588 - protein, 74 aa, Triticum aestivum
  Clone ID: PAT_TA_42006.pep
SVRRSIQQIFDCAKSLKVAKANKLAGIDERYIYPAYETVKYAPGRLRLPLTHVHVPEGGGCRSGCEFLNAIGCK

SEQ ID NO: 147589 - protein, 57 aa, Triticum aestivum
  Clone ID: PAT_TA_42007.pep
KRDPLVENASVIHAMHRDNAPAHACIGMHKNAPPINERDAIEVLGKKTSHVIKPIWG

SEQ ID NO: 147590 - protein, 87 aa, Triticum aestivum
  Clone ID: PAT_TA_42008.pep
GSTINTSLMWSKSAPRVSIDALWTPHEASRSHEKFVRAIMVELPPTEIAASRHMPAQSQSRYECCTSHPLPLWLLCPYALSIRWRLT

SEQ ID NO: 147591 - protein, 80 aa, Triticum aestivum
  Clone ID: PAT_TA_42009.pep
CCVHRRAPLHHATDTRGHCSSRWNTVPPQDHSSQHLLQNDGPIRGNNIEDIDIVLSGDPHLRDETTTIMPPHRNNVSDFV

SEQ ID NO: 147592 - protein, 65 aa, Triticum aestivum
  Clone ID: PAT_TA_42010.pep
SQLTKVSRIKRQTREPRIMEPNETHNKEKEIEMKHKTHESGSERTPSRVKTEPEPKTKNERNRRH

SEQ ID NO: 147593 - protein, 80 aa, Triticum aestivum
  Clone ID: PAT_TA_42011.pep
GRSRCLDHFHAEGLKLLAERNAIHLSESSNKHISRTKRRARRHAAAVALHHGSRPYTALYGAVIFFPLRRSLPFCYYDSV

SEQ ID NO: 147594 - protein, 95 aa, Triticum aestivum
  Clone ID: PAT_TA_42012.pep
ERESWTVIIVLMRFMLPIKSPTTQVISGQPRNTYYFRREIFPVYHARLKLGRSRLQVKLLFFPLFSNYQCKYMSVSTLSVSNCNSRIRFCWVFLL

SEQ ID NO: 147595 - protein, 81 aa, Triticum aestivum
  Clone ID: PAT_TA_42013.pep
HNVHIRVSQSSFLIQACSLVPRLQVIVYNRVRGCNHIYVRSQDGQDVFSWLALSPRQIERVADFLCGILLKYCWLSSAACT

SEQ ID NO: 147596 - protein, 66 aa, Triticum aestivum
  Clone ID: PAT_TA_42014.pep
MLSFIPLPGPRRTRSRCGVGGYDGRAPCDYRWLHFGLQGTLNDSCIGVLLPSRCIERLTKYSIPNI

SEQ ID NO: 147597 - protein, 51 aa, Triticum aestivum
  Clone ID: PAT_TA_42015.pep
NSGSTMYSNIVNLVFSKRYQAFEKMSNVYRKNANQTFEKMLNVYIKKLIMY

SEQ ID NO: 147598 - protein, 100 aa, Triticum aestivum
  Clone ID: PAT_TA_42016.pep
SRQRVRCTRPVKELPYAVIQMHARAPCIVSVQKFKGPKLNGYTHTSGFTHAPFSSLLSSSPTHRPINGVPLFLSHSPPKRQIHSLQLQKPKRPSPLQATK

SEQ ID NO: 147599 - protein, 55 aa, Triticum aestivum
  Clone ID: PAT_TA_42017.pep
YNILTHYHFKINKLTNKCIISFTVFQPNIKSLKKNINTKQLLKHHHHINTKISLK

SEQ ID NO: 147600 - protein, 63 aa, Triticum aestivum
  Clone ID: PAT_TA_42018.pep
KKSKNHIAPDYARSRPLDSLKFNIMPMLKAVLIFVYSGGSIYPRIPKDSHQTGHQPGPPNKKL

SEQ ID NO: 147601 - protein, 76 aa, Triticum aestivum
  Clone ID: PAT_TA_42019.pep
VFLRVLVAWMYIRVAEVLILLCPEEGLLLIFVHNFYLTFYQHQRPQWDGSSSQDLECGRAAPWGRSVRRKGRQMRN

SEQ ID NO: 147602 - protein, 72 aa, Triticum aestivum
  Clone ID: PAT_TA_42020.pep
FDSSAELGDITGFYMIDEEGTLSSVDVSAKFVNGKPAAVEAKYVMRTPRDWDRFMRFMERYSQANGLQFLKK

SEQ ID NO: 147603 - protein, 150 aa, Triticum aestivum
  Clone ID: PAT_TA_42021.pep
HTARPTQCPFCKTPNYAVEYRGVKTKEERSIEQFEEQKVIEAQMRVRQQALQDEEDKMKRKQSRCSSSRTIAPTTEVEYRDICSTSYSVPSYQCTQQETECCSSEPSCSAQANMRSFHSRHTRDDNIDMNIEDMMVMEAIWRSIQEARSI

SEQ ID NO: 147604 - protein, 50 aa, Triticum aestivum
  unsure (1)..(50): unsure at all Xaa locations
  Clone ID: PAT_TA_42022.pep
PPPQNRCRRRSKKPRARNRXLVLVLVVSPSSKQKVIGVRVAVYAHMHASK

SEQ ID NO: 147605 - protein, 98 aa, Triticum aestivum
  Clone ID: PAT_TA_42023.pep
DHASAALLGYLGDVLFVDRVPAWMPFVYSLASFVLGSLLVADASVSDEEWDEWVGRRQRGGDLSFLESEEVLRRTARRKPEGGLSRSSKHTFACMRQL

SEQ ID NO: 147606 - protein, 96 aa, Triticum aestivum
  unsure (1)..(96): unsure at all Xaa locations
  Clone ID: PAT_TA_42024.pep
SSKPYAGGGSSQRGESPFIPIHSRKAYVQHYYQTYDSNRAQLVRLYQXNSCSPSRSRXFASPAIITCKLVSLPFHHCQYXINTFNCQSSKPHCYRP

SEQ ID NO: 147607 - protein, 63 aa, Triticum aestivum
  Clone ID: PAT_TA_42025.pep
STPRPKKIYTSRRGGGRLKRGNGRRGGVLNGNGDGVFFAAHFQHFAGGVGVQVPHKRGVCPRP

SEQ ID NO: 147608 - protein, 77 aa, Triticum aestivum
  Clone ID: PAT_TA_42026.pep
KKPQWRSGPEGAKTLCNAFGVRFKLGRLLPEYRPACNPTFVGNLHSNSPPKVLEMRRKKEPVPVAIKAAPAPAVASF

SEQ ID NO: 147609 - protein, 71 aa, Triticum aestivum
  Clone ID: PAT_TA_42027.pep
VYAKRIPYHTTTTADSTTDKTGPPTTRTIKTPNQSTMTIPIHAATRPGLQNVAHYIHWTATSLHTFSANSA

SEQ ID NO: 147610 - protein, 59 aa, Triticum aestivum
  Clone ID: PAT_TA_42028.pep
HHPNVATGALVGGPFKNDSFVDERQNVMQNEATTYNSALIVGLLSGLLTTSSVAQSLSS

SEQ ID NO: 147611 - protein, 69 aa, Triticum aestivum
  Clone ID: PAT_TA_42029.pep
RHATETPETRSRAAFFSNYLAKQGGRPQADGNQNTRKHNQRTIFSRKGNPNTSPPKTKPAHNSNPLSQD

SEQ ID NO: 147612 - protein, 54 aa, Triticum aestivum
  Clone ID: PAT_TA_42030.pep
LHLHPTQSVFFYPNYILKAGFLNDGADFSHLPDFLHLPDHISSLRPTPHLAAEI

SEQ ID NO: 147613 - protein, 48 aa, Triticum aestivum
  Clone ID: PAT_TA_42031.pep
QGGSPTLHHLSSHSTLEWPRRTGSKLLRAHGQRHYICQPSSQNVTPGL

SEQ ID NO: 147614 - protein, 135 aa, Triticum aestivum
  Clone ID: PAT_TA_42032.pep
MASVVVLAAAACCCILLAASVSPASSEPAVYSVGDGRGWAVPAGNGTETYNHCAKKNRFQVGDVLDVKYAGKDSVLLVNHDYYKMCSTVTPLTRFADGDTKLKFDRTGFFLLDSGMPGHCEVDQPMIVNIARHST

SEQ ID NO: 147615 - protein, 106 aa, Triticum aestivum
  Clone ID: PAT_TA_42033.pep
DSTSVQFSSASRGHAPAPPGVHLISGIFFLKRRTMVTRLAMRVCCLQPSRGWPHRVHPTRALRCSLYVCLIGARVPPPHCCSSVGILLQLLIMVCWRIHAVLRACV

SEQ ID NO: 147616 - protein, 77 aa, Triticum aestivum
  Clone ID: PAT_TA_42034.pep
QCYLFLSVGNKRNIANSCVLSKRLKSEGFMYKIICNNSSMPCLEMSRPWHIKTLFGDESLLLTPWSDRRVGRINNRF

SEQ ID NO: 147617 - protein, 47 aa, Triticum aestivum
  Clone ID: PAT_TA_42035.pep
SFSNVPKVVPVTSHLRNIPVQMQVTLVAQSFSSFDHALLQSELVTKM

SEQ ID NO: 147618 - protein, 101 aa, Triticum aestivum
  Clone ID: PAT_TA_42036.pep
RQKNSMRRFYLLQGNKIELTKQNMIHTKRLPRKKKKGQHEKKDHLWRSDTRPATTISDNPIHRRRALTFILFGDHDNITQSRRTNVDIYYMIYKHHPPDDD

SEQ ID NO: 147619 - protein, 83 aa, Triticum aestivum
  Clone ID: PAT_TA_42037.pep
AKFKLCDVMSFQFGQKGIPYLNTYDGRTIRYPNPLIKANDTIYLDLETNKIVDFIKFDVCNVVIVTGGRNTWRFCLIKNKEKH

SEQ ID NO: 147620 - protein, 88 aa, Triticum aestivum
  Clone ID: PAT_TA_42038.pep
TDGGVGRTSRTQQHNLHLRGIQFGERCFNELLNRGLIQPGKIDVYDNVKRCRVHDTILDFIISKSIKKNFVTIPGVPILTIGNQNKGG

SEQ ID NO: 147621 - protein, 48 aa, Triticum aestivum
  Clone ID: PAT_TA_42039.pep
PSIKFVPCTTTLLSLQLSHKSITISLLSILITTLTYYFLILLSQYYNV

SEQ ID NO: 147622 - protein, 121 aa, Triticum aestivum
  unsure (1)..(121): unsure at all Xaa locations
  Clone ID: PAT_TA_42040.pep
GAGRRRSSEGRRRAPGTTPQGRGTTAGQARXPTTGXSTGTTPRQPTPRRRRPXXQAARGQATGQGXXKSTTRSSGXXXEETPAKATGTRSRRXAXERESHRAGEAXAGEKTXXXKERRAHA

SEQ ID NO: 147623 - protein, 147 aa, Triticum aestivum
  unsure (1)..(147): unsure at all Xaa locations
  Clone ID: PAT_TA_42041.pep
EQXSLQQDPNGRFSLEKGLIRCDRIIWLGGGMQIRQRIICTFHDILMEGHSEFPVTYHRIRRLFAWPKMKTHILQYVRCCQICQQAKPDXAASPGLLQPLRVPSQPWEMISMDFADGLSQSSKFNCLLVIVDKRTKFAYFLPLAHPY

SEQ ID NO: 147624 - protein, 141 aa, Triticum aestivum
  unsure (1)..(141): unsure at all Xaa locations
  Clone ID: PAT_TA_42042.pep
RSTHIEYGEEAADVEQQALLPSVKDPKLWMVKCAIGHERETAICLMQKFIDRTDLQIKSVVALDHLKNYIYVEAEKEAHVKEACKGLEIYASAKIXLVXKKMADVLYVESKNVDLARHTWVRITXVYKGDXAKVVDDDNVR

SEQ ID NO: 147625 - protein, 91 aa, Triticum aestivum
  Clone ID: PAT_TA_42043.pep
PPRSGHPPPASDVAPSAPRPGVQDQDVRVVAERQLRPRALQLRPRHGRAPPAPLLPAHLPAPPRRIRWHSYWLSFDLIAITNLLDSTAARG

SEQ ID NO: 147626 - protein, 73 aa, Triticum aestivum
  Clone ID: PAT_TA_42044.pep
PNVRIWNARMLPPLLQAKLRHLPSAACVRQSRHQAPTISRLQRSEARGEAAAARDRRRGASVGEGGVRADAGW

SEQ ID NO: 147627 - protein, 81 aa, Triticum aestivum
  Clone ID: PAT_TA_42045.pep
SGCRCLIHESFRDSHPSIVGFFLSFFLSFLEVPWIHPFIGRACGLDQNGRRLLLLGRARIQFPTTTTSTLVFYCSKSEICL

SEQ ID NO: 147628 - protein, 41 aa, Triticum aestivum
  Clone ID: PAT_TA_42046.pep
KSLPCKIINGGSTLLGLLFLRLHAFPKAWWWQLSIHYGLTT

SEQ ID NO: 147629 - protein, 147 aa, Triticum aestivum
  Clone ID: PAT_TA_42047.pep
VLKCLTKAPRVPAIDWGVIVRRCMKVEAQIPQKSTNHRDPTLLREECLYFSLAHADHISPLLQFLDDLTDLPRFRRLEMNVQSVLLQYLSHLMKLFSDSRSKKLYEDLAVYFCSHLSSHLDYSSEQRSMLRMSFWKGICKCLMEVVS

SEQ ID NO: 147630 - protein, 100 aa, Triticum aestivum
  Clone ID: PAT_TA_42048.pep
LQQTLLLTGGVPRAYGPTPDDRHGDRHVLRTGRHKRRDDRIANRIPDPLHRLSLTLRAPIRARSIIGSALRGSTLLHRVPREDHRVVHSVTHASPAESRD

SEQ ID NO: 147631 - protein, 56 aa, Triticum aestivum
  Clone ID: PAT_TA_42049.pep
TNQKKQTILTLCNCTHMSAPKNWLRKKREYSGVAFMPNGRTIVSSYSSFRPPSLNW

SEQ ID NO: 147632 - protein, 70 aa, Triticum aestivum
  Clone ID: PAT_TA_42050.pep
PPEKLKIEAKEGIRSLEPSIPRVHGDATAAAALLRRISVLARGEGMGPAAHGAGEGAEACEKRVRRPDTW

SEQ ID NO: 147633 - protein, 74 aa, Triticum aestivum
  Clone ID: PAT_TA_42051.pep
RAPGRSSGSRASLGRRRRRSARSRGSWEGASRGRGRRAPSPPGREIRARIRGGLRRWRCFPRYSSTLAWRPRVR

SEQ ID NO: 147634 - protein, 62 aa, Triticum aestivum
  Clone ID: PAT_TA_42052.pep
LNVTIYKNCDYKTLISSNNKRLSHLNFAHKLNIIPRTVTLSQNTSLKLSQLHIKPFVHHILT

SEQ ID NO: 147635 - protein, 149 aa, Triticum aestivum
  Clone ID: PAT_TA_42053.pep
SPRGIAPKPAITGTAPLPAITSHRRPPPHMESTASPPSQPLPPPSTTAATIAAGTVVAATDQQGSDANYWRRLSQRRFFFYLGAASHSSLYLSLVVSLYLLLTRTHTPTYETLHTHATKEKTSWCFAKRLSSSVEQETTLSIFPAPDAW

SEQ ID NO: 147636 - protein, 68 aa, Triticum aestivum
  Clone ID: PAT_TA_42054.pep
GLLQLAATGSVPPAPPPAPVLEPQDILQQQLPVCPNDPMFRTFRCRLGPKETPTGKPEYNINMASLDD

SEQ ID NO: 147637 - protein, 65 aa, Triticum aestivum
  Clone ID: PAT_TA_42055.pep
IVRPNQDKIYGQTKQRDIFLSYNTFDKSIIQAHSLAMPLHIISERHSSSFLKKSSVSFVVEPMKQ

SEQ ID NO: 147638 - protein, 129 aa, Triticum aestivum
  Clone ID: PAT_TA_42056.pep
NPPPPSPIPFPPPQETTEARTSSHLGASPPSLYAPRLPRHLAAFAMYRAAASLASKARQAGSSARQVRGFALLEFLFAVAWCSSLVVLGRVASLGSSGDSVALFSGFGSACESETMWWSVRGSVESRQA

SEQ ID NO: 147639 - protein, 42 aa, Triticum aestivum
  Clone ID: PAT_TA_42057.pep
NFIYSPLNVLHLTYCAIHFSYSIHVYPTGLSCSTSRTLKLSL

SEQ ID NO: 147640 - protein, 124 aa, Triticum aestivum
  unsure (1)..(124): unsure at all Xaa locations
  Clone ID: PAT_TA_42058.pep
SNLKAAASEFIVPHXNSLRRVNHPFSITIXLRFSPVVEHLTERRSGLITLIHEVDPIYVDXQKWKILQVRWEDGTYCYIQTTLSPYYIQIFAGSPSIAQSLSAYSSKPTTLCPEGTVNAPTLSG

SEQ ID NO: 147641 - protein, 76 aa, Triticum aestivum
  Clone ID: PAT_TA_42059.pep
ILFFSPVFHFHTPFLLILILPHQFQMIVLPMIVGLPPELNKLDSLLHPRCIYQCIHYILQHTTLDSTALFTSKDFI

SEQ ID NO: 147642 - protein, 39 aa, Triticum aestivum
  Clone ID: PAT_TA_42060.pep
TNACFIEQNMNVANTDDNPNYSIFLTRLKPMQLYTPFHP

SEQ ID NO: 147643 - protein, 105 aa, Triticum aestivum
  Clone ID: PAT_TA_42061.pep
MAEANSYEEQRRRQIEENRRKLDELRLHHLSAAVREAAARPKPNPKPRPKRKAPEPGELRRSGRVAGLPEQPKYVEGAEQRGYRGVYEAYAVWKGPTDEERAGAI

SEQ ID NO: 147644 - protein, 102 aa, Triticum aestivum
  Clone ID: PAT_TA_42062.pep
MWQRASFLLLGRRTALTMRSAPGISRSTVGTSTSSPCIFSTLKAEQAKTPVEEVKPIATVHEPEEIEAQLERTNRFDMDTPEGPCGPKEDPVLFHAHCHKRV

SEQ ID NO: 147645 - protein, 55 aa, Triticum aestivum
  Clone ID: PAT_TA_42063.pep
STRKEETKYLYAFKYKAHSKKNYIYLLRANINQHPIYYQKILRCNRVLLFVRCPR

SEQ ID NO: 147646 - protein, 93 aa, Triticum aestivum
  Clone ID: PAT_TA_42064.pep
LTPPNLCFPEFDHPRPWSIFGWSHFAGSNKVARTFPDSFAELQSPSRMVICVPSVPAHSVNGTFILSANLSSKPNPSRTSVNGFIFRCTLPQH

SEQ ID NO: 147647 - protein, 156 aa, Triticum aestivum
  Clone ID: PAT_TA_42065.pep
KFVEDKHKAHLPANFRKILWVQLKKLVASGKLTKVKASYKLSAAAAKPKPAAKKKPAAKKKAPAKKTATKTKAKAPAKKAAAKPKAKAPAKPKAAAKPKAAAKPKAKAAAKPKAAAKPKGRPAKAAKTSAKDAPGKKAPAVAAPKKAAARKPPTKR

SEQ ID NO: 147648 - protein, 140 aa, Triticum aestivum
  Clone ID: PAT_TA_42066.pep
PKNRTPAGSTYQAASSRHAPPVPPPPGRGRPPRRRGGSSARRAGNAPSGVGGRNGRRAGSAPSGGGGRNGRRDASAQSGGGGRNGRRDASAPSGGGRSARRAGSAPGGGGGPAGQAVARFLQPDVPTGRADHRRGGPVEA

SEQ ID NO: 147649 - protein, 47 aa, Triticum aestivum
  Clone ID: PAT_TA_42067.pep
LKQGLLFIALLSRGYYLSCSTRAGDIGRLDECSSSAGELGNDTGCVV

SEQ ID NO: 147650 - protein, 103 aa, Triticum aestivum
  Clone ID: PAT_TA_42068.pep
GLVNPTTGQAHDRRTKQLSSYMRCLSLLLLARATLLAVKVAVVAQPGPKCPKRSAWQEWAPGRECPKRLRRLEWAPQHKCPKRRLLLEWAPGRKYPKLLWQEC

SEQ ID NO: 147651 - protein, 44 aa, Triticum aestivum
  Clone ID: PAT_TA_42069.pep
KLSKIIIYSKFSYFKPLVTHGTKTFTKTGAFIHCSTSINSLIQK

SEQ ID NO: 147652 - protein, 155 aa, Triticum aestivum
  Clone ID: PAT_TA_42070.pep
IDCYTEAIALCPGVAVYWVNRGLCHFRRKDWARVEEDSRRALALDDASVKGHYLLGCALLEKEDCALAVKEFEKALDLLKSSNSRDKMAEDIWQVLAKAKYQDWEKHSTQRVWKMQSLREACENALQEHHFLSGTLSEDSEGTTNEYPEQCKLLS

SEQ ID NO: 147653 - protein, 137 aa, Triticum aestivum
  Clone ID: PAT_TA_42071.pep
IACYTEAIALCPGVTVYWGKRVLCHFLLKDWTMVEEDSKRALALDNASIKGHYLLMDALLEKEDCALTVKEFEKALDLLKSSNSKDIMAEDIWLVLAKAKFQDWEKHSTQRFRKMLSFREACENALHEHHFLSGTLS

SEQ ID NO: 147654 - protein, 40 aa, Triticum aestivum
  Clone ID: PAT_TA_42072.pep
PILPTLKERLYISSILPPIFNLLTLNFTTSILPKLLSNPT

SEQ ID NO: 147655 - protein, 35 aa, Triticum aestivum
  Clone ID: PAT_TA_42073.pep
FHIAILQQHPNSYCKSFPPFQIIYLNILPTITFFN

SEQ ID NO: 147656 - protein, 68 aa, Triticum aestivum
  Clone ID: PAT_TA_42074.pep
ALDWFVRATDSWLYKERIGFTMEPGVHGCQRILLLNQNTVSRDNPEIPPDFATVYVGNSRVLGCGRVG

SEQ ID NO: 147657 - protein, 143 aa, Triticum aestivum
  unsure (1)..(143): unsure at all Xaa locations
  Clone ID: PAT_TA_42075.pep
MEKLLLLAVASHDHETVLGRCPFLLPHGATRARVAAPSSDLSGGRDEVRRTVLRAGKVFGFFQVVNHXVPERTMRELGTACGEFFRLPAADKAALYSESEDTERTNRLFSSTMCVSGGQTYWRHCLRLACHPVESTKPGWPEK

SEQ ID NO: 147658 - protein, 66 aa, Triticum aestivum
  Clone ID: PAT_TA_42076.pep
IQLLPHIQHSISATFYGEEFESLLWLLRLRHPMTYLCKTHHHCRWLSHNKTGDALHLTSKAHPTGT

SEQ ID NO: 147659 - protein, 100 aa, Triticum aestivum
  Clone ID: PAT_TA_42077.pep
KGGLLKIKSHNFTQWPPFFLLPPFLTRSFPALLLLSVPLISITCPPFSIFLSEKTISFPNLIVFHYFLFLSVGLILNWPYPFLPFKQLFTFFGDSFPPFF

SEQ ID NO: 147660 - protein, 66 aa, Triticum aestivum
  Clone ID: PAT_TA_42078.pep
LDPRHSDERPSPPPAPPPSSGAPPASIGTGGQPGRRLAARPLTGRHARSLTVVRASVKDIGFDQAS

SEQ ID NO: 147661 - protein, 70 aa, Triticum aestivum
  Clone ID: PAT_TA_42079.pep
LCIRSLNHQQTVENSVCISHKHASPSRRQYIYSRFKFPQFQATLVMFLEHSFMLFINGTLQYIRPMLAAE

SEQ ID NO: 147662 - protein, 48 aa, Triticum aestivum
  Clone ID: PAT_TA_42080.pep
RILQMLQIGKSSVQPTVRDKVPRYEKHIISILNSQRKPVHHNTTQFST

SEQ ID NO: 147663 - protein, 52 aa, Triticum aestivum
  Clone ID: PAT_TA_42081.pep
STHILLPPPCSIEAAKTLAESFFPADRDCRLFPLLGHAGCIREARASRSQSP

SEQ ID NO: 147664 - protein, 56 aa, Triticum aestivum
  Clone ID: PAT_TA_42082.pep
ERYFRVVQILISEMFYKMFGVHKKDIYSAVDDRELGVIRHIKSNEVFNASSSCGRT

SEQ ID NO: 147665 - protein, 117 aa, Triticum aestivum
  Clone ID: PAT_TA_42083.pep
ASSNSLMLYYRAQLKAHQFLPTIIHWILYNIHLWNLTELAVLRGTVQDGHFGCTGNFETAWNKISNLVLAVPMFQKPISFLPSSKQYILFGYIAYRAYNLHKGGNDLLLNSQGIVRT

SEQ ID NO: 147666 - protein, 56 aa, Triticum aestivum
  Clone ID: PAT_TA_42084.pep
AARGVARPAQAVRQAQGREKAARETAEAMPVATGTGRAFRKLGESAFVVMRAREGD

SEQ ID NO: 147667 - protein, 65 aa, Triticum aestivum
  Clone ID: PAT_TA_42085.pep
INAANLIADTIYIMNFFESCPKVPPYVSVSMVNRCIIRWCNAWSRFAKGTILVAFSFCVETRDMY

SEQ ID NO: 147668 - protein, 55 aa, Triticum aestivum
  Clone ID: PAT_TA_42086.pep
SPTLPITHNIFSSSYFFLPLYLITDKFIISLTLPKFNLFKTIIKTNLYSILQITI

SEQ ID NO: 147669 - protein, 118 aa, Triticum aestivum
  Clone ID: PAT_TA_42087.pep
GSGRGGRCVSRYFLLAHRSLIRAPRRLRRLPPAAGADPSTRRAGAFVQAGGASPSSAPGQNKPPAAIGPVLGRPMEDVRIIYTVGKELGRGQFGVTSLCTHNATGQKFACKTIAKRKL

SEQ ID NO: 147670 - protein, 60 aa, Triticum aestivum
  Clone ID: PAT_TA_42088.pep
IIPVPTHTSSYPTTLTTTFILPLYLLNPKKFYPPYSPNQTIPHQSNKSQPKPHPTTSTQP

SEQ ID NO: 147671 - protein, 81 aa, Triticum aestivum
  Clone ID: PAT_TA_42089.pep
ILQMVPVEKSSSKTCPRTANKNSKPYQEITVVAPQQQVTENVQLDCSRARGSQCWIQSEDGCTWLPYKYCSSKQVINNKQL

SEQ ID NO: 147672 - protein, 124 aa, Triticum aestivum
  Clone ID: PAT_TA_42090.pep
YYSSQNVQSLLLLLTQRPAIGISLMPPHKQTKRKRNLLSSTKKQQNRLGNINQSKLEEEEEEEEEEKGGGRRSSIKMAGVVCLYARLWVHVADVLCLGVLALGRCGAGALELEVEVLEHDALAR

SEQ ID NO: 147673 - protein, 58 aa, Triticum aestivum
  Clone ID: PAT_TA_42091.pep
VPRRPTKSFIWSSHLDIPFRGHFLGNNLPWKKYSLLLIGFLWGNGTYWGEEGQFFIFP

SEQ ID NO: 147674 - protein, 100 aa, Triticum aestivum
  Clone ID: PAT_TA_42092.pep
AVVQHRLVGEEVFFFLSRQKVWKTHGKGALPPCGFCLVTPVGGGVYFFPCCGVWYGLPVNKLSLGPCGKKRANTVGKKIIIMSRDRWGQNESIKTFFFCF

SEQ ID NO: 147675 - protein, 55 aa, Triticum aestivum
  Clone ID: PAT_TA_42093.pep
IRQMPYSSVKYVCLLYVLKIRLLQSVLQYVCLVLTMALYEVSLELTVEDTGPRVR

SEQ ID NO: 147676 - protein, 50 aa, Triticum aestivum
  Clone ID: PAT_TA_42094.pep
RESKGWGTRYQVHGKVGIFGLSRDRKRFCKTFREFLVDFSCELENFLGNF

SEQ ID NO: 147677 - protein, 49 aa, Triticum aestivum
  unsure (1)..(49): unsure at all Xaa locations
  Clone ID: PAT_TA_42095.pep
WYSHLVCISRKDVAFDESFMVKDALYEKCYQNIGRRHKKWKKEALXKSG

SEQ ID NO: 147678 - protein, 152 aa, Triticum aestivum
  Clone ID: PAT_TA_42096.pep
HASAHASARLKHFSAMNKLKKMALRVIAESLSEEEIGGLRELFKMIDADNSGTITFDELKDGLKRVGSELTEHEIQALMDAADIDNSGTIDYGEFIAATLHMNKLEREENLVSAFSFFDKDGSGFITIDELSHACRKFGLDDVHLEDMIKDV

SEQ ID NO: 147679 - protein, 55 aa, Triticum aestivum
  Clone ID: PAT_TA_42097.pep
SNDILKISFLCCFRIYIEALRLYSYPQPIEQMEIAIWWTTYRLLTLQNPSHPLNF

SEQ ID NO: 147680 - protein, 87 aa, Triticum aestivum
  Clone ID: PAT_TA_42098.pep
PNSKPPNQRKFTPIQSPQRGGFQNPIPSHPIKITNPSLFFYMTVFCSPSGLIYIDLYNDALPLILYIFLALFTYLMVFCKNIKPLHY

SEQ ID NO: 147681 - protein, 78 aa, Triticum aestivum
  Clone ID: PAT_TA_42099.pep
KKGERGHLKKNLGGLKNKNKFWGKKTHFKVVLVGPQGVVGKIKSNPGKALNVFSIKHIVFKKKNLVLSGGIEEMANEV

SEQ ID NO: 147682 - protein, 44 aa, Triticum aestivum
  unsure (1)..(44): unsure at all Xaa locations
  Clone ID: PAT_TA_42100.pep
GYFYITSHRSFFLFGINNRVEFSFKGXFLIYIEAHDVVLISTTH

SEQ ID NO: 147683 - protein, 87 aa, Triticum aestivum
  Clone ID: PAT_TA_42101.pep
KSAGDRSGGGSDDRSAGMVGQVEGHVDENGMGRITRVRRGAWDGRCSEQDQTTGERTECDGRTGLLLNGFAGRNGTPNGGKRSRLRT

SEQ ID NO: 147684 - protein, 36 aa, Triticum aestivum
  Clone ID: PAT_TA_42102.pep
SLRFRYTGPHILEISPPDTKVVGSQQSIYSLYTHAS

SEQ ID NO: 147685 - protein, 76 aa, Triticum aestivum
  Clone ID: PAT_TA_42103.pep
LDASGPPVLDLKMFDALLVWRCLLSSRLGGFSCVFFLFGLSIPCLSALGSMLIPSCVHVMFCNPPLYSILFLLSMK

SEQ ID NO: 147686 - protein, 34 aa, Triticum aestivum
  Clone ID: PAT_TA_42104.pep
LNTKKKTLFPNNFISFIPKIYKSFSIHLILSSNL

SEQ ID NO: 147687 - protein, 130 aa, Triticum aestivum
  Clone ID: PAT_TA_42105.pep
MVNLPYHDRSRLCARDPPGVHPDALSIFSPKINLTPQPGPVVNVVVSFTLAKDQLSTLKRISGGDGVSTFSAMSAHLWQCMCLARQLPPDATTHLMFSANIRRIMRPPLPGGYFGNAIINPNVGDKAYAI

SEQ ID NO: 147688 - protein, 143 aa, Triticum aestivum
  Clone ID: PAT_TA_42106.pep
MGSLFSSPAGRDCLPVSKKYIGRSIRSKEEDVALRISTLVDIAIEHYNSNNPGAEFEYPEYPPQSTTEMKAACIGFRGTFWYHLCFSAHPMDATTETQHFFAELYFDRQYLELAVETCIILEKPLCRFSSSCAFCPDESNILH

SEQ ID NO: 147689 - protein, 37 aa, Triticum aestivum
  Clone ID: PAT_TA_42107.pep
CSRLEDLYQSAVGMTSLGSGNTPSRKEPRKTILRKRG

SEQ ID NO: 147690 - protein, 64 aa, Triticum aestivum
  Clone ID: PAT_TA_42108.pep
FSVLLQILFTRALCEHIKIVHASMCTWVYAKVSGYDRCINIGIMIGDEFSAASINIVQLLELSF

SEQ ID NO: 147691 - protein, 41 aa, Triticum aestivum
  Clone ID: PAT_TA_42109.pep
PWVIISNLHHYETFMSWFLCKQLRSIQWYEHECLSVVRFFF

SEQ ID NO: 147692 - protein, 130 aa, Triticum aestivum
  Clone ID: PAT_TA_42110.pep
GFQDRTSGRGLVTTGWVPQMNILAHAAVGGFLTHCGRNSLIESLLFGHPLVMLPIYGDQGPNARQMEAKQVGLQVARNEDDGSFDRHGVSTAVRAVMVDEEARRSFVAGAAKMQAVVADTHLHDRYIDEF

SEQ ID NO: 147693 - protein, 55 aa, Triticum aestivum
  Clone ID: PAT_TA_42111.pep
NSLKLATRYLVRMQQRIIRSCPIDELRNRDKPFFFKTCLEPWYMRIYEAVFVLMI

SEQ ID NO: 147694 - protein, 113 aa, Triticum aestivum
  Clone ID: PAT_TA_42112.pep
PAERHKFQIQPITLHHSTVETKTPTAEPDESTLHLELRLRGGMQIFVKTLTGKTITLEVESSDTIDNVKAKIQDKEGIPPDQQRLIFAGKQLEDGRTLADYNIQKESTLHLVL

SEQ ID NO: 147695 - protein, 119 aa, Triticum aestivum
  Clone ID: PAT_TA_42113.pep
KIRLFVRPRRRSCGGAYVRRKYLCPLPFSCFFLISGDRHGSVSRLDNNKGHKSDLKPDLSTESGSSLEINSHAVLRLGTMPDMVGRSFLANFTQHRAICATCFNACSCHDVGSGTGRLS

SEQ ID NO: 147696 - protein, 123 aa, Triticum aestivum
  unsure (1)..(123): unsure at all Xaa locations
  Clone ID: PAT_TA_42114.pep
MTTSSMLRHNSSIIAPKNNKLLAVVQQRDCXNNGVTKHNNLVAHHPFVSWCHNKEEGTNRRSXQQLSLHDEXYAPCCSASITAGVVVTPSMTTTIVSSVVPAASAAFPPFLVTMVGCSRQAVK

SEQ ID NO: 147697 - protein, 135 aa, Triticum aestivum
  unsure (1)..(135): unsure at all Xaa locations
  Clone ID: PAT_TA_42115.pep
NTSSRSRRCKLTTSSFLRQGCSIIAPTNNNLPAVVQHRDCXNHAVTTLNNLVAHHPFFSWCNNKEEGTNRRSXQQRSLLGEXYAPCSSASFTAAVVVTPSMTATLVSSLPAAPPDNFSSFLATTVGFSRQAVFRG

SEQ ID NO: 147698 - protein, 42 aa, Triticum aestivum
  Clone ID: PAT_TA_42116.pep
EESKQKEAFLEGELANIWTLVAKLRKAEGNCEDDSDAIHTIV

SEQ ID NO: 147699 - protein, 112 aa, Triticum aestivum
  unsure (1)..(112): unsure at all Xaa locations
  Clone ID: PAT_TA_42117.pep
DADVIFVPFFVSLSYNRQGKAVPTEKVSIDTFLQEKLVRYLEAQPEWKRSGDANHVIFAHHHNSLFHFRSALFPAEIVLSDFERFHPRVVSLXKDLIVPYLLKAKTVLKDTA

SEQ ID NO: 147700 - protein, 53 aa, Triticum aestivum
  Clone ID: PAT_TA_42118.pep
QPQTILLGHALPFPPHKSLREFHPERQYPLANRSINPYRHELPQPVCHKRDPS

SEQ ID NO: 147701 - protein, 86 aa, Triticum aestivum
  Clone ID: PAT_TA_42119.pep
CTHNSFLLIFFKKFNLLKEEIHIRNILLLLHTTSIQNPTKTHQKPYSIHCKHFKQKLYILTTLLNTYTTLTSICFNNHISLLTKKI

SEQ ID NO: 147702 - protein, 125 aa, Triticum aestivum
  unsure (1)..(125): unsure at all Xaa locations
  Clone ID: PAT_TA_42120.pep
NVEKNLYTFNSFTIPILTIAKTPFLIKNNSKDSYHASRFSTFYHXDLPNFTTVADFFYDPYDRIHTTTIFSLDFNRDHVLPYLXIDSNISGLYSESRRHYEQEMETYHFTASETFVERLKSVIIN

SEQ ID NO: 147703 - protein, 47 aa, Triticum aestivum
  Clone ID: PAT_TA_42121.pep
VVSLKFHLEMHIFPVMQLQLSAIMVKAPPLCNICPHQHARADIAHAW

SEQ ID NO: 147704 - protein, 133 aa, Triticum aestivum
  Clone ID: PAT_TA_42122.pep
EVEGSAVLAAASWLSHHSLIFAAVFTPVALILVGATGVRSAYNTRKDIKDPPKTLHQVAQMMLKDPVIVGALVLLVFLPLISHEDLVVGLLPVKESQREHVRSVLTDVGSLGVSAVFCFIMLPTTVLRQWRMK

SEQ ID NO: 147705 - protein, 69 aa, Triticum aestivum
  Clone ID: PAT_TA_42123.pep
DRPYCSSQRPLKAQLPLKRIAHHHIAPSNSSASLNRLMAPALSRHIKRSLCGSYPHLVHYIYQTSNTRS

SEQ ID NO: 147706 - protein, 43 aa, Triticum aestivum
  Clone ID: PAT_TA_42124.pep
RLVVYHHAASKVYVFCAITGGEVFDNGPDPLNSHRLRNCRCEP

SEQ ID NO: 147707 - protein, 142 aa, Triticum aestivum
  Clone ID: PAT_TA_42125.pep
VEHQIMVDHSTGRSRGFGFVTFESEDSVERVISEGRMRDLGGKQVEIKKAEPKKHGGDHSSNGRSSHSGGGGYRSSYRSGGAAGGGGSSSGGGGGGYGYGAGHRSAAAGSYYDSTGYGYGRGGYGAAAAAAAYGGNAGYGSG

SEQ ID NO: 147708 - protein, 56 aa, Triticum aestivum
  Clone ID: PAT_TA_42126.pep
VGDLSKAISSHCFIRSLPRSFSYPITDITIVLSFYYVPTHYRCLLPQPLFYLTWPL

SEQ ID NO: 147709 - protein, 85 aa, Triticum aestivum
  Clone ID: PAT_TA_42127.pep
GREALRAPHTCGKTPWIRNARLPRYSGVELITEPLGADSYSVQLSAPLCFPLLPFSFFATRRINGPYFSGHDQQALGVEALQWDI

SEQ ID NO: 147710 - protein, 39 aa, Triticum aestivum
  unsure (1)..(39): unsure at all Xaa locations
  Clone ID: PAT_TA_42128.pep
KSGVYSEKAYTGRQGVGXNFSSIGKSVRPLRSKFTGKKS

SEQ ID NO: 147711 - protein, 148 aa, Triticum aestivum
  Clone ID: PAT_TA_42129.pep
RPRRPLPARRATHDQRAPSHLHQAPRLSSARGATARPSGTRRRPLRPSGAGARVLRRSPSSTGPLLPHGGARCSTGRCGALRWFSRVARSQEAQAQLVFGRRLLLRRGRARSRSPWRWLTPSCSHYCCRDVPGHPRGATSCSRDPPRA

SEQ ID NO: 147712 - protein, 130 aa, Triticum aestivum
  Clone ID: PAT_TA_42130.pep
ESYDVLDPLYIKKCAHPPSRERDEAIAWKLHGALFNCSTEFYAGWPTSNEESGSCVVHIACHCDRDKLMLPLTKMYSPSKVGISTRVPEAQGKLLFRHHALYMEHSCAVGLCVRPLIHSYYRNMSGCPDS

SEQ ID NO: 147713 - protein, 101 aa, Triticum aestivum
  Clone ID: PAT_TA_42131.pep
VQDGCHHQPARVHTSNFEELRRHGRMYHRARRCGNLYRSCRCRAGLVDAAGLVLRTHRCRSHSWCHPLLSLMCMTVVRACRRRRGQGAIRIGVAVLETTTP

SEQ ID NO: 147714 - protein, 128 aa, Triticum aestivum
  Clone ID: PAT_TA_42132.pep
MIQQKVENLKISLEHFCNIKGDISEVLRVAEEQLKMRNQCRIINQQASLWELKDIVKRENKRDVILNYRNLLLQRIILNLSDMSTIFVSNSLMGTKIEKAFPNLKATVAFNFVFKAEENQRLSDLRSL

SEQ ID NO: 147715 - protein, 74 aa, Triticum aestivum
  Clone ID: PAT_TA_42133.pep
KQIAIVENDITLIFPFTNVIQLQERCFLVNDTTLISHLQLLFSNREHFTNITLNVEKMFYRNNQVLHHQLYHPP

SEQ ID NO: 147716 - protein, 61 aa, Triticum aestivum
  Clone ID: PAT_TA_42134.pep
VKEIGERSPACLCAVLLSKIVRRVGVKPEVAITIPKRCDLADRPIGYKCGEYTMPSLQLKD

SEQ ID NO: 147717 - protein, 70 aa, Triticum aestivum
  Clone ID: PAT_TA_42135.pep
FPQMKRVEAPSRVKKTSFSTPTARLCFLCIMESSFFFETTISSWFLIISVVCYYMYKYNNYYNLYKGFKE

SEQ ID NO: 147718 - protein, 144 aa, Triticum aestivum
  unsure (1)..(144): unsure at all Xaa locations
  Clone ID: PAT_TA_42136.pep
PTRPPIRAARRRILLXGPAXAPAGLMTAAATAAXISTYANKITVVAGAATSAGTIGWMAADYFRKVPCPSCTKMVRVRDFMDHARGHTFQCPSCQEHVKFSDLEKHAQHHGFRCPACYDVVPLADFGPYLERHRRQADDERARQ

SEQ ID NO: 147719 - protein, 51 aa, Triticum aestivum
  Clone ID: PAT_TA_42137.pep
TSSYMSAHIHPQHHVQHNVALIWGISLTCTLRCTLSSALPTDSIIKLILNL

SEQ ID NO: 147720 - protein, 88 aa, Triticum aestivum
  Clone ID: PAT_TA_42138.pep
QKRDDQASSSFCHHQSQFFFSFEGIQSLQHKSAMWGTKMGQFYQHGRQSLSAMDVAPLVHNHAAALRIHASGDRHRWHAAPLPRRFGS

SEQ ID NO: 147721 - protein, 147 aa, Triticum aestivum
  Clone ID: PAT_TA_42139.pep
EDVWRFLVQLGGQVLIVVRLRGRVKVFKYDDAEPVPVESIGRHAIFVGHHRCLAVDADRFPSVEADCVYYIDRRGLSAHICVYSLRDGKEERVSAGAVDFVKPHKLFVLVADRPFTVIQLLCSYTINARDSQLPLKEDAGNVDKKWF

SEQ ID NO: 147722 - protein, 97 aa, Triticum aestivum
  Clone ID: PAT_TA_42140.pep
MKKKQKLVQQPSPEIPDSALVEILSRVPYRSLCRFKCVSKPWLALCSDPDIRRRCPQTLSGFFYNRSGCGLSFRNLSGRGPPLVDPSLPFLRGRYER

SEQ ID NO: 147723 - protein, 65 aa, Triticum aestivum
  Clone ID: PAT_TA_42141.pep
HRGVRARVIGDEHAPHVQLYADEDLVALLDLNTDYLVHMLPGHARRLCTRGMKSKPMALEKKLRM

SEQ ID NO: 147724 - protein, 56 aa, Triticum aestivum
  Clone ID: PAT_TA_42142.pep
SALSCWKQMIWCKTRAWVNKVRHRTLPFQLELHHVPSKSLVNIYRRHAVLIRLMIS

SEQ ID NO: 147725 - protein, 67 aa, Triticum aestivum
  Clone ID: PAT_TA_42143.pep
IIFLSWKNIQLQLLLPSLFVQYIFYRAWFVCVGRCILLLVCVAHAVAYLLVVTQPSFYRFIISKVWS

SEQ ID NO: 147726 - protein, 68 aa, Triticum aestivum
  unsure (1)..(68): unsure at all Xaa locations
  Clone ID: PAT_TA_42144.pep
PVAVRRLGGGGGGAERCKEVRAEARAMGRVRHPNVVRLRAYYWSPDXEKLVVTDFVGNGNLATALRGK

SEQ ID NO: 147727 - protein, 106 aa, Triticum aestivum
  Clone ID: PAT_TA_42145.pep
QVKLYSNQRTKRKNISKTTARSLAEGWWRWWAHPTASVQPGDAAVERWWAQPRSRLLQGCRADEVVGAASWSRSRMCFDLDLSHAVDSVAGNKVGRKHVVQQVQSG

SEQ ID NO: 147728 - protein, 143 aa, Triticum aestivum
  Clone ID: PAT_TA_42146.pep
GTISNMVTQAAVVHMLAECVGLSWFEDWGTKTLAELGLPLMKTSRLVKVCEDDPALKAFRQMRRRGVGGIPVVDGAGKPVGSIMIKDVKHLLTASESTGHYRTLTAREFIASARQSSGEKQMSIITCRREDNMKEIILKLDAE

SEQ ID NO: 147729 - protein, 48 aa, Triticum aestivum
  Clone ID: PAT_TA_42147.pep
RTSGARSRQNVQSRAYNHLKKQCKEWMTAGWLCSVSLNDKWETRKIHK

SEQ ID NO: 147730 - protein, 67 aa, Triticum aestivum
  Clone ID: PAT_TA_42148.pep
MGRGPTYQILVRLLDGRTICLLLSTPTVFGAVLLQTDSSILFVPEIVLCIVTGRFYFSYINVLLFNF

SEQ ID NO: 147731 - protein, 91 aa, Triticum aestivum
  Clone ID: PAT_TA_42149.pep
SHRYMELTLFISSSQCWTASVTINYLLRSLALSNMYESSPALLLKHMVGSFCGGVSVRSRVSVVFFIKSLHQSLITVYVNQKKINKGLSLS

SEQ ID NO: 147732 - protein, 42 aa, Triticum aestivum
  Clone ID: PAT_TA_42150.pep
DFLGCRLGAMYLNRKLVFYCYSGALNVPQCKQDRSSGKEPSQ

SEQ ID NO: 147733 - protein, 51 aa, Triticum aestivum
  Clone ID: PAT_TA_42151.pep
LIITLNIEPGAIFHMYNYKIKKCTNTFTITNTFNLFNRHNHGNIKGIMMVF

SEQ ID NO: 147734 - protein, 57 aa, Triticum aestivum
  Clone ID: PAT_TA_42152.pep
RRDPRVRTFVSYVSLCKIKRIASYYRGCGVYSDGFITYIDVCSHSVPVSYNGVTYTL

SEQ ID NO: 147735 - protein, 145 aa, Triticum aestivum
  Clone ID: PAT_TA_42153.pep
EILVCFKEAAAHTLVVFDKIVKMMQNIEIPERNESYSEAEKYSDPDIEDEEEANMETSSYAIVKMKNHMSLQLVIVQVLQTLCQFNSMLIDLYITSSFVNFVQYSALIAHPNKIGIRTNKIQQEFCLHVLCSDMPIVILRSHSPF

SEQ ID NO: 147736 - protein, 142 aa, Triticum aestivum
  Clone ID: PAT_TA_42154.pep
SNPTTGEIAVPYGLAVWGTGIGTRPIIMDFMKQVGQANRRVLATDEWLRVLGCDNVYALGDCATISQRKVMEDVDSIFRVADKDNSGTLSVKNIKNVLGDIYQRYPQVELYLKTNQMRGFHDLLKDKETEELNIEKFKKALA

SEQ ID NO: 147737 - protein, 90 aa, Triticum aestivum
  unsure (1)..(90): unsure at all Xaa locations
  Clone ID: PAT_TA_42155.pep
WWRAGLPPRAVRALFLGXARXSLAGVAGPGXSVVSPXLXSLSCSXSLFXPASSVVLPSCWSPVRRLFLLCCFCXAVFVSFXFALRPXXXS

SEQ ID NO: 147738 - protein, 116 aa, Triticum aestivum
  Clone ID: PAT_TA_42156.pep
PPLAREDTPPCSSSMMPTPPGTGAPPRSRREPPSSTKISRLWPHHRSPCDVPPPREGGPSGRAANTRRLRRPGVAATAGAGGGSGRGKEIGAFFLGFGGPPEPHARATREEGEMLF

SEQ ID NO: 147739 - protein, 135 aa, Triticum aestivum
  unsure (1)..(135): unsure at all Xaa locations
  Clone ID: PAT_TA_42157.pep
SHVQLLTSILSWQPRALYFPQFATAEQCENVVKTAKARLRPSTLALRKGESEETTKGIRTSSGTFLSAEEDPTGALAEIETKIAKATMMPRSHGEPFNVLRYEIGQKYASHYDXIDPAQYGPQKSQRVASFLLYL

SEQ ID NO: 147740 - protein, 105 aa, Triticum aestivum
  Clone ID: PAT_TA_42158.pep
SQWSLMSSAQHVDDRRCRLVTLIAAFAVGFNKRRTSNAFTTSWLPATHLVDDSGMDGELLAAGGTTYRAACPPSIVTQLDLDREPDLHTQGPCGSRAASNLAHST

SEQ ID NO: 147741 - protein, 76 aa, Triticum aestivum
  Clone ID: PAT_TA_42159.pep
ATAAAHRVYGNARRITCASAQSAAIAVCQYSTLASVALEPGRELRTVFRTVLLEGDSGRGRARAGRVLARRSRGFA

SEQ ID NO: 147742 - protein, 50 aa, Triticum aestivum
  Clone ID: PAT_TA_42160.pep
QLAKLRTVIINYTYGRTGFEPGTPQNYQTTAAWRSRESIYTMCTKQTGLI

SEQ ID NO: 147743 - protein, 58 aa, Triticum aestivum
  Clone ID: PAT_TA_42161.pep
MIHRDVFSSSRERTVQSEVQYVIIKCKRWQEYVVCISVCVLMKCIDRSCCYNKLDDFL

SEQ ID NO: 147744 - protein, 74 aa, Triticum aestivum
  Clone ID: PAT_TA_42162.pep
INELKAIVRFPTPLPPSGFYEWYKSQALFFNFPEKPGGCTIEFLVISGMSQVNERLNVWSDAFGGPDCFLVIFH

SEQ ID NO: 147745 - protein, 39 aa, Triticum aestivum
  Clone ID: PAT_TA_42163.pep
LTTIEKLHLLYISHLNTHYLLFTLFFTNMHSMMLSLLHD

SEQ ID NO: 147746 - protein, 115 aa, Triticum aestivum
  Clone ID: PAT_TA_42164.pep
EPSVINLVPFFYYYKQVDPDLNLVKGRGGALLREKMVEAASGKFVVVVDETKLVTGLGGSGLAMPVEVVQFCWKYNQVRLQGLFNEKGCEAKLRFDEDDKPYFTDNSDYIGDLLL

SEQ ID NO: 147747 - protein, 65 aa, Triticum aestivum
  Clone ID: PAT_TA_42165.pep
SGNPRTGGRHGSIIITTKSCPFNSVLLKKKKKPPARISPVPASHFIRMNLINFEKNSHFQKKNPQ

SEQ ID NO: 147748 - protein, 146 aa, Triticum aestivum
  Clone ID: PAT_TA_42166.pep
LHRAAERDGVPRAAPFLGRRSPSPPPTRTRCCCRGGSILQLAFSPRLRALPPLLDQDGFQMLSLLHDLERRRPPPWSSRRWPRASLWSHVAPLLREAAACDRAPALFLPSVLLFTPIPCQPQECCPSTTKPPDHLRVLVGEFPSLH

SEQ ID NO: 147749 - protein, 107 aa, Triticum aestivum
  Clone ID: PAT_TA_42167.pep
MIKSPPPIDDFAFRALISTWSMMHAQKMWTTLAGQRQSHTRLIEWTVEAKAAKRLKAKDEDIERIRSMNWALEERLRNLLMEAHMWRDVAQSHEATVNVLRGDLQRA

SEQ ID NO: 147750 - protein, 98 aa, Triticum aestivum
  Clone ID: PAT_TA_42168.pep
HASGGFPAGARPPTTVAGTFQGILGARPPAPAVPHAHHATTAATPSPHWDQAALIAALNQMALHPPSAPGGEWVFDSGASSHMSSGSGSGHQDGASPM

SEQ ID NO: 147751 - protein, 151 aa, Triticum aestivum
  Clone ID: PAT_TA_42169.pep
SRGSDFHLVISRKRARKERKMSMWKSFNGEHASAVTHGPNEKYTGRSSRQMIKELNTKEWSHRPDQVGSIQPQHGVALKRSIKNFIHRRSNEVPLKNFETGASHNHFTSPKENINSKSNGDFDKEQNIDLNKKLPNAVYCNESSSCEMLSN

SEQ ID NO: 147752 - protein, 75 aa, Triticum aestivum
  Clone ID: PAT_TA_42170.pep
MNTAGAATAKEAAAVGQVKAELDDAVKAAGRTVAVAAAPALSPLSETLWQKNAAVDFLGDVSMRLAWLDLTVTVA

SEQ ID NO: 147753 - protein, 105 aa, Triticum aestivum
  Clone ID: PAT_TA_42171.pep
APASTGPTYPVSTHTQAKSLGRLHETQAYIENKGKSRLPQCIQEKENGSCPTFLQPNALSKRNWYSLWQTERKEYVFLLLLELHHSLSSIASKQLKQLQWPIMHI

SEQ ID NO: 147754 - protein, 136 aa, Triticum aestivum
  Clone ID: PAT_TA_42172.pep
WGEVNFFGEGGGHPCLGPKKKKKRGRGWYFKKGVIFGLRPPPGGGEKIILPGSPGAATEEKLGAISRIPGAHQVGSVDEGSTLVGGGNAKDSGLPKKSSELDEGRHGERLKPMEGKLERDGGGGGNGERACALGFK

SEQ ID NO: 147755 - protein, 107 aa, Triticum aestivum
  Clone ID: PAT_TA_42173.pep
DFMVLLDDVNWIVEETPDNGDDYMNEGLIYLETLVSTASEILPLEALYKVVSGAVGHILDSIMTTLLSDGVKRVTMSAGLSLDMDLKMLGAFADEKFHITGLADMGK

SEQ ID NO: 147756 - protein, 49 aa, Triticum aestivum
  Clone ID: PAT_TA_42174.pep
TTRPLVVHAKVTFKIYNRTRGGCMRWGINALKTLLLTKTVSSYKSCASK

SEQ ID NO: 147757 - protein, 98 aa, Triticum aestivum
  unsure (1)..(98): unsure at all Xaa locations
  Clone ID: PAT_TA_42175.pep
HASDDVASGCVCALTVGWCVWQSSSSPEIQGAVRAAGGVCAPGNLVSSLSCFFLVSGDRRGSVSRLDNNNWYQSLXSWACLPCRKRGSDGGARRRLRV

SEQ ID NO: 147758 - protein, 119 aa, Triticum aestivum
  unsure (1)..(119): unsure at all Xaa locations
  Clone ID: PAT_TA_42176.pep
TIGDCSTTILQRHASGHLSSLSSLSGERPAMPSGPGAAAGPSEGPSAGESXAGASXERASXAFSSLSWRPFLALANGATARATRRSAARIRAVRRAMAQLRRLLHFLAVLVLLLCVVIF

SEQ ID NO: 147759 - protein, 70 aa, Triticum aestivum
  Clone ID: PAT_TA_42177.pep
RAFAHSSLKKNPNAEKRVPGTDGWANTMKKKANMCVQTYKIYILEVLNLVHVDIGMCSNAMSIMNSCFNN

SEQ ID NO: 147760 - protein, 56 aa, Triticum aestivum
  Clone ID: PAT_TA_42178.pep
KFLPVSVRFKFSIRFVCLVMYVPTKLAWADLIWCILPWLAWLHSRSLCFMGYKQCF

SEQ ID NO: 147761 - protein, 105 aa, Triticum aestivum
  unsure (1)..(105): unsure at all Xaa locations
  Clone ID: PAT_TA_42179.pep
HTVPLSDYTTWIVEETPYNGRDSMNGAPIYLXTLVSTVADIIPLADIPKVASDACCKISDSIITTLVSDGEKRLTMRAGXGLLMHLKMLDACSDEKLHITALADM

SEQ ID NO: 147762 - protein, 98 aa, Triticum aestivum
  unsure (1)..(98): unsure at all Xaa locations
  Clone ID: PAT_TA_42180.pep
MQCRSCWEDLVHWEATIIGPPDSSYAGGVFLENIHFPSDYPFKXPKVSFKTKVFHPNINSNGSICLDIFKEHRSPALTISKGLLSICSLLTDPNPDDP

SEQ ID NO: 147763 - protein, 64 aa, Triticum aestivum
  Clone ID: PAT_TA_42181.pep
PSLNDRITIATLLFYRDKTWGGFNTTYNFSWLKDNNPNALIYSYHGKEKAPVRPENLHLLFQVK

SEQ ID NO: 147764 - protein, 58 aa, Triticum aestivum
  Clone ID: PAT_TA_42182.pep
HAYAYTPTTKKFAAAALLIPSPPAAAKLEARFRLWCRAQGHWPTGGRRSLTLHTHMTN

SEQ ID NO: 147765 - protein, 132 aa, Triticum aestivum
  unsure (1)..(132): unsure at all Xaa locations
  Clone ID: PAT_TA_42183.pep
PSLNDRITIVRQLWDLTRDVVVLLEPGTPQGSKIISQMRSYILWMEKRKCRKSGKSTAAAPSKMKSMVLQEDLLKDGAFVVAPCPHDGRCPLENSNKYCHFVQRLERTSSQRIYKRSKGVPLRXFEDEKFCM

SEQ ID NO: 147766 - protein, 95 aa, Triticum aestivum
  Clone ID: PAT_TA_42184.pep
KKSVCGWGKKKVFPPKFAWGILANLEVVKPLWLILFIKAKKPRRRFSMAEVARVALKTPFLPGFNFQHRPFSNAEAKGSSISSPRNKNKYNWSPP

SEQ ID NO: 147767 - protein, 52 aa, Triticum aestivum
  Clone ID: PAT_TA_42185.pep
MGAADRRGPEQEQSCKATDDFYSDKSSPFRIGDVRSVVPAHCWLKSPLRTLS

SEQ ID NO: 147768 - protein, 126 aa, Triticum aestivum
  unsure (1)..(126): unsure at all Xaa locations
  Clone ID: PAT_TA_42186.pep
KNFISFALGSRKSHPPLGPFPIMLHYRVSSLLQASIFQIGTLRAWPSNCFFMIRCLMISPYLXKAPSCTFLSLVGSAYGLLKHAPGTPSLPWISIPFYRTPILCYPPPFLSSLPPTPPMYRAVTVA

SEQ ID NO: 147769 - protein, 136 aa, Triticum aestivum
  Clone ID: PAT_TA_42187.pep
MGAYKFVSELWRRKQSDVMRFVQRVRCWEYRQQPAIVRITRPTRPDRARRLGFKAKQGYVIYRIRVRRGGRKRPVPKGIVYGKPKHQGITQLKFQRNKRSVAEERAGRRLGGLRVLNSYWVNEDSTYKYFEVILVD

SEQ ID NO: 147770 - protein, 54 aa, Triticum aestivum
  unsure (1)..(54): unsure at all Xaa locations
  Clone ID: PAT_TA_42188.pep
RPNLYTGTYNFGGYQDSRCDIFKIHLRRXNLMRVIVLKKIEGKMNGVSGAELKA

SEQ ID NO: 147771 - protein, 104 aa, Triticum aestivum
  Clone ID: PAT_TA_42189.pep
MSHAGKRTSQHRDHDREDRDQKRRPAHTQETSSKDELVVYRILCPDKAIGSVIGKGGKVINSIRQQTNAKVKVVDPYPGADKRVILVYCYVKHREPKHSDIDAD

SEQ ID NO: 147772 - protein, 62 aa, Triticum aestivum
  Clone ID: PAT_TA_42190.pep
DSCFMRTVTSVRGYDQVRWSQIYYIDFCPSRGGNFNKILSQFRPSQGGEATNYTMVLSLTRR

SEQ ID NO: 147773 - protein, 63 aa, Triticum aestivum
  Clone ID: PAT_TA_42191.pep
SAQNGGNGKLERSIKFSFLKESEMWKHRVLFLPTFFHDMTLLCFVRCLGQEDISSEWGKWSSI

SEQ ID NO: 147774 - protein, 101 aa, Triticum aestivum
  unsure (1)..(101): unsure at all Xaa locations
  Clone ID: PAT_TA_42192.pep
MVTMKLGSKPDIFVLEGLTWRCMTELESDVVVEVGDMSFYLHKFPLLSRSGVLQRLISEYQPPSDGSGGGGMCTLQLDDIPGGAKAFELAARFCYXVKIEL

SEQ ID NO: 147775 - protein, 88 aa, Triticum aestivum
  Clone ID: PAT_TA_42193.pep
MPRDARTKTDGCYEQQHTDEKLKDDMPRGVEKHREEKYRDDRSKAQDRHKSNKHKDDRHKDEELHRDERYKEERLRHEDRHRDVKYKG

SEQ ID NO: 147776 - protein, 51 aa, Triticum aestivum
  Clone ID: PAT_TA_42194.pep
LTGRSGAQPALHACMRCDVRRRIVLHAYMHRPGQSILNLFCLWTYAPRHEA

SEQ ID NO: 147777 - protein, 49 aa, Triticum aestivum
  Clone ID: PAT_TA_42195.pep
QSNSLYHGQDPSTGLGRQARAHRWLVMLIGPSATVPVLILLVPFHFLSD

SEQ ID NO: 147778 - protein, 118 aa, Triticum aestivum
  unsure (1)..(118): unsure at all Xaa locations
  Clone ID: PAT_TA_42196.pep
MTEVCVKAAVGHPDTLGDCPFSQRVLLTLEEKKVPYQMKLIDVSNKPDWFLKINPEGKVPVYNGGDGKWIADSDVITQVIEEKYPTPSLVTPAEYAXVGSKIFSTFVTFLKSKDARDG

SEQ ID NO: 147779 - protein, 80 aa, Triticum aestivum
  Clone ID: PAT_TA_42197.pep
TRSTLTNKAKNCGSVAAKAPGSYSKSASNKKSAPGDSTQPAGSSRKRARKGWTTLKQIAEKAELERKEKMDNFVIPFFMQ

SEQ ID NO: 147780 - protein, 143 aa, Triticum aestivum
  unsure (1)..(143): unsure at all Xaa locations
  Clone ID: PAT_TA_42198.pep
ILLPSWANGLGSMGSISVSYGEDGPVFCGLSSDGSHLVTCSGADASVVYGAPLRIPFLGLTAGDGFACGLLLDTSQPYCWGSNSYVKIGVPQPMVEGVEYSLLSAGDNHLCALRMPDKGIPHGVNPDTLVIECWXYNMTATHV

SEQ ID NO: 147781 - protein, 104 aa, Triticum aestivum
  Clone ID: PAT_TA_42199.pep
TEVQTCKFYNRAVSYTCNSQHGHGKNKKIVTAFAKLQVNFSRTATVDFSETFFLSKVHIFFALWNWKIHFMRETQFYFFWLPGSDSCSKFNFFLGAWKNSTSLF

SEQ ID NO: 147782 - protein, 118 aa, Triticum aestivum
  Clone ID: PAT_TA_42200.pep
MREILHIQGGQCGNQIGAKFWEVICGEHGVDPTGQYTGTAPEQLERMDVYFNEAGGNRYVPRAVLMDLEPGTMDSLRSGPIGAIFRPDNFVYGQSGAGNNWAKGHYTEGAELIDSVLD

SEQ ID NO: 147783 - protein, 146 aa, Triticum aestivum
  Clone ID: PAT_TA_42201.pep
LVVNDAVAAPDTTVHHLVVVDTVAAPDTTMHHLVVVDAVTAPITTPSSSCGIAPQPATGGIAPPMAFISHGRPPRHMESAVSSSPPSLPRIDKALMPIVGAASPRSATSSSTLSCLTQLSISLKLLFSSVASHKNTHTHTTHAYTK

SEQ ID NO: 147784 - protein, 90 aa, Triticum aestivum
  Clone ID: PAT_TA_42202.pep
VVWKSTQPWQLSKSAGTHTGAVDTTVVEFRADLMPAARSKSYSAYKNLVALYAGGQHPGSDTIAEMKAYFIYYARDGSLFVMPSIDFYDD

SEQ ID NO: 147785 - protein, 23 aa, Triticum aestivum
  Clone ID: PAT_TA_42203.pep
QRGSCYRELNSMPILLTVYICRD

SEQ ID NO: 147786 - protein, 45 aa, Triticum aestivum
  Clone ID: PAT_TA_42204.pep
SIGIVFTFSQQIPGLHIGVLHFNEVSSMMSHVIPVILLKVFGEVS

SEQ ID NO: 147787 - protein, 85 aa, Triticum aestivum
  Clone ID: PAT_TA_42205.pep
LCLLRSLPKFVRSQPRPRLPVGSPQPSRADGGGAPQASPTGAAAARIGYPLRRLRHNNGFNCCSTGRKYKWEPCTKCGLTFQPRC

SEQ ID NO: 147788 - protein, 49 aa, Triticum aestivum
  Clone ID: PAT_TA_42206.pep
ILFFFIAGGYTYINTLIVNTTRTTQETTLVAQCSTQRNIYPPPHISYIS

SEQ ID NO: 147789 - protein, 103 aa, Triticum aestivum
  unsure (1)..(103): unsure at all Xaa locations
  Clone ID: PAT_TA_42207.pep
TWRVHDDTQIVNPVTDEKSSSISSHANGVSLGEPNLKEPXXPTSTGESVQSYVAQPKPVKKCSLRAKVPFEKGFSPMDCLKLTRTHADLAGLKAQSNWRLISL

SEQ ID NO: 147790 - protein, 64 aa, Triticum aestivum
  Clone ID: PAT_TA_42208.pep
NQLFIYSGMVKLGGYLMSLKQTIYLQTKNLNTNLVTTPYNSYESPIEKNQFNQPPRVSMAYKRG

SEQ ID NO: 147791 - protein, 83 aa, Triticum aestivum
  Clone ID: PAT_TA_42209.pep
MTGGKMAAATAAKWAEGYPWKEKLAKYKGELSKVVWGYWELGAWKPLGINGRQRAPLLKEVLLAGEDWAYHPPRGEIRTKRKG

SEQ ID NO: 147792 - protein, 62 aa, Triticum aestivum
  Clone ID: PAT_TA_42210.pep
EKKEWVLKKKNLRKFFFCGGWLKKNNKGVGAPRWAVNLSNQAPFSLSFPRFKCKSGPYMGAF

SEQ ID NO: 147793 - protein, 124 aa, Triticum aestivum
  Clone ID: PAT_TA_42211.pep
MHDSLLLQHNDIFTGIPVGQHYALSTYSRIMNQAFQIMQQMRTDTALLTKEEGGSPIRNPPTAAEDARLASLISLDNILKQVKEVIKQSSTRPLRKSKKKALLESLDDLLAQMPSLFDIDHPCA

SEQ ID NO: 147794 - protein, 36 aa, Triticum aestivum
  Clone ID: PAT_TA_42212.pep
LSQKTIKNSKNNNKLDSGLNLIPPIIHSSTHYVENQ

SEQ ID NO: 147795 - protein, 66 aa, Triticum aestivum
  unsure (1)..(66): unsure at all Xaa locations
  Clone ID: PAT_TA_42213.pep
PRVRFEDQVIKHLDLWKTTHGLGLEQVFLFHCAVETFLFLSSLRTETSLKNNELEGQSKVSLDKXX

SEQ ID NO: 147796 - protein, 34 aa, Triticum aestivum
  Clone ID: PAT_TA_42214.pep
LVIMVALQGCSIDKEVILPRKKERKIRSNPSALN

SEQ ID NO: 147797 - protein, 133 aa, Triticum aestivum
  Clone ID: PAT_TA_42215.pep
PYPHPASGAPCKPKYLIFLHQTTHNPNPNLATLSPNLVLLYRLNEFLPYPYLRRLCGYRRPQTRNAITMIEQLMEYLHTFKAPSAIHEPPKPFLLHILEPPLSDPLPASYIGLNSLLIYTTDKNLFTLYAVWY

SEQ ID NO: 147798 - protein, 61 aa, Triticum aestivum
  Clone ID: PAT_TA_42216.pep
EHPPDPRLRNPIFHSTLTHSIFFPLNKSGINYLGIYNITFISPKSINQSNLSKHIYKYPYN

SEQ ID NO: 147799 - protein, 81 aa, Triticum aestivum
  Clone ID: PAT_TA_42217.pep
CKLTGAQKAGRQRGAPGLGGQTNKPPPPQFSPPQGFFPNPRMGFGGGALNKIKPPFVFRNFVCPPRVCLTKNVLPWAPPFN

SEQ ID NO: 147800 - protein, 132 aa, Triticum aestivum
  Clone ID: PAT_TA_42218.pep
VREPRLQPCYSLGFLPEKTTIAARQAMIVQVCCLRPRCCGHTARRARTWSPPPCMQFGAPLCVVNRSTSSTAVAIVAVLLPFFAVPVIWTASLPPCGLPAHPCSTACVSAVLLEPDYSLCGKGWSSPLGCSG

SEQ ID NO: 147801 - protein, 120 aa, Triticum aestivum
  unsure (1)..(120): unsure at all Xaa locations
  Clone ID: PAT_TA_42219.pep
GRTDASDLYKMTSRPKGFYLVTVRQIGGQHAXELYVTSMVENQEGFVNFEDMLRETAGLXWARGVLGMKKPAKKIFPEQNMMMNKCHLAGKHGLSATQRLTPMTMYCTSLGAAATYDSNA

SEQ ID NO: 147802 - protein, 96 aa, Triticum aestivum
  Clone ID: PAT_TA_42220.pep
GIEFFFFIFFFYGKKIVFKKQNSKMFTGGVKEPHLYKKIQALKVDLLGFIGNKGVFLEQQLFFGHQKFFLEKPILICHAKGEIIKRFLRKQRIGFF

SEQ ID NO: 147803 - protein, 51 aa, Triticum aestivum
  Clone ID: PAT_TA_42221.pep
FLLISFFSLGNIYIPTKHISSSEPIPFQKHLSHILYNPSLRSPITNLHPLL

SEQ ID NO: 147804 - protein, 133 aa, Triticum aestivum
  unsure (1)..(133): unsure at all Xaa locations
  Clone ID: PAT_TA_42222.pep
MAVSKRWTRVRTLGRGASGAEVFLAVDDASGELFAVKSASAACSAALRREQRLMSGLQSPRVVYCIGGHGARDGSYQLFLEFAPGGSLADRVAIDGGLDERAVRSYAADVAAGIAYLHATGMVHXDVKAQNIM

SEQ ID NO: 147805 - protein, 48 aa, Triticum aestivum
  Clone ID: PAT_TA_42223.pep
AHAFIQFLSRITKSNAMIVVMQRWKWVHTSRHPTIMALSLFAFDHLSY

SEQ ID NO: 147806 - protein, 62 aa, Triticum aestivum
  Clone ID: PAT_TA_42224.pep
VYFYPLKRRRFGEVMENLDRCFGCFFIPLLEFEEARLLLVFDTPLVSIIDFCVPFILEPHFL

SEQ ID NO: 147807 - protein, 148 aa, Triticum aestivum
  Clone ID: PAT_TA_42225.pep
HASALRAHAESVNATIHDGEVIDVIDSMMQSRDSGLVDGIPSDFPFQILKEEGLKDITLTRSLNGEQIEVMVSMLKPDGDEEESSDSRYTSDEDEGDNSIPLRVTVSKADGSNLKFTCTAYPDNDNIFIDTLSVRHPPSRAKEHEEDI

SEQ ID NO: 147808 - protein, 127 aa, Triticum aestivum
  Clone ID: PAT_TA_42226.pep
CYPPSSPTAAATPVGARINSRSNPRSPRSWRHYTSHYTNLAVGPPVAVRATERVNKDCHRHWRGHVDDELEDRQPGQQGGAAGRLAAGLAPIREWIRQWLRLPLRPGEGCGEACAYARTGACIVDWV

SEQ ID NO: 147809 - protein, 74 aa, Triticum aestivum
  Clone ID: PAT_TA_42227.pep
LMLYTNRAAVLGDYDHRVWTYHTFFYPMSFYTLTIIPVLKEEMRKGLLPLVMSQEHYQRVLRTYKRRYFLYNSS

SEQ ID NO: 147810 - protein, 46 aa, Triticum aestivum
  Clone ID: PAT_TA_42228.pep
RVRYVISIYYICTITCYTHSFARVGLKRKLIIQSASSFCSYRHANR

SEQ ID NO: 147811 - protein, 54 aa, Triticum aestivum
  Clone ID: PAT_TA_42229.pep
PTRTLTHKFAQIDKFIYNHLRGAFHGPYIITQFLDRLSHLLTHLLVRMYQCINY

SEQ ID NO: 147812 - protein, 146 aa, Triticum aestivum
  unsure (1)..(146): unsure at all Xaa locations
  Clone ID: PAT_TA_42230.pep
RVDAARPVDDYLKRSNYCVGLGSNYYGRSDFMPTFYSYSKQLTPXRYANDLIRRYRTQLNALYNYGAGKLALSAIGAGGCRPNALRRQPDGRTCLDRLNXANQSFNNKLRSLGDQLNNNHPDAKVIYINADGIFQDMNTYSGRFGF

SEQ ID NO: 147813 - protein, 57 aa, Triticum aestivum
  Clone ID: PAT_TA_42231.pep
CKCSMLSLSTHCSEPLNQGGILKDLRFLLLPTGAETVQSYDILIKHYGQRILAFYED

SEQ ID NO: 147814 - protein, 81 aa, Triticum aestivum
  Clone ID: PAT_TA_42232.pep
WPASNSPPTRPGESLLLPIAAGTSARPPARVVSVRSSTDVAPNQLATRAVPPVVLIPSVSSMRPIGRPGDRSVISRGRSGR

SEQ ID NO: 147815 - protein, 107 aa, Triticum aestivum
  unsure (1)..(107): unsure at all Xaa locations
  Clone ID: PAT_TA_42233.pep
GRSYFMPSIYSYIRQFTPQQYPNDLXIRRYRTQLNALYNYGAXKFALNGIRPVGSSPNALASSPDGRTCADRINLANQIFNNKLRSLGDQLNNEXPDAKFIYINAYG

SEQ ID NO: 147816 - protein, 104 aa, Triticum aestivum
  unsure (1)..(104): unsure at all Xaa locations
  Clone ID: PAT_TA_42234.pep
RPVAGKLRRCIYFVGLGSHDYGRGDFMRTFYSSITHLTPEQYPKALMRRFSTQLNAXYKYATLSEALNGSGSGSFSYNALVGSPDRRTCLDRINSANQIFSIKR

SEQ ID NO: 147817 - protein, 64 aa, Triticum aestivum
  Clone ID: PAT_TA_42235.pep
MASTAVGEETGPAFDILIKHEGSRRKAFLKDPEGRVIFVTTRADFLERLWELRPRFFSGRGFFF

SEQ ID NO: 147818 - protein, 77 aa, Triticum aestivum
  unsure (1)..(77): unsure at all Xaa locations
  Clone ID: PAT_TA_42236.pep
KQFHLLNQVRPIPGFSSTCGFISFAXEXXXQTKWIKASIQAEDGTQQRLTDSMSFISSFAQTQYVKGNKMDQSFYSG

SEQ ID NO: 147819 - protein, 70 aa, Triticum aestivum
  Clone ID: PAT_TA_42237.pep
RNCVSPSLLFSMFSLTRSRRHFGSSFAHTHCCRRARHYRLTTPSFMDQGCYVFCALEELGNVELENFCCD

SEQ ID NO: 147820 - protein, 59 aa, Triticum aestivum
  Clone ID: PAT_TA_42238.pep
GLIKRTGGVILRGGDILWHPSRFSRDKHTRRFTQTTISLATWAWLELGHDTTQAQGYRT

SEQ ID NO: 147821 - protein, 64 aa, Triticum aestivum
  Clone ID: PAT_TA_42239.pep
LLYHLLYLKADFERYIFFPVCVIFLDNWLVILVHIQCFTEPHIQVIVFWSVIGDMYCCHSFLSL

SEQ ID NO: 147822 - protein, 67 aa, Triticum aestivum
  Clone ID: PAT_TA_42240.pep
FMLVFIILFVFVVFALRRSNTQPFPLIEIKGVHHNLGRFKKGARSLPLTIHMGPTAGDTKVIKREHG

SEQ ID NO: 147823 - protein, 44 aa, Triticum aestivum
  Clone ID: PAT_TA_42241.pep
WIFENTGFEFNKRGVGIIPLEVVLGLERPPRTSYICFSCRLCIP

SEQ ID NO: 147824 - protein, 55 aa, Triticum aestivum
  Clone ID: PAT_TA_42242.pep
QKLWPASPGQHKTYFLGDAVTRDFSLPFACTPPQKKIITLIWSDSLTISSTDTHA

SEQ ID NO: 147825 - protein, 146 aa, Triticum aestivum
  Clone ID: PAT_TA_42243.pep
PRVRGRVGTESNEEYTEWTTVIRQVITENCQPTDDGEMPFDYGMYSSAVTSDVTTSKDMTTKLLFCLWWGLANLSTLGQGLKTTIYTGESLFAITLATFGLILMAMLIGNIQTYLQSLTVRLEEMRVKRLDSEQWMHHRLLPMELR

SEQ ID NO: 147826 - protein, 94 aa, Triticum aestivum
  Clone ID: PAT_TA_42244.pep
MLCLVQHELCGQDFRRDYLQRHDHEAPFIGLKVTSQLEYARPWAQDNHIHRGGAVRHHARHLKTHPKGHAYRKHLIVFAIADRTAGRDAGEAVV

SEQ ID NO: 147827 - protein, 89 aa, Triticum aestivum
  Clone ID: PAT_TA_42245.pep
RRMLAHVSLNPLNRPPIFFFFDIKVNFKFLLFNGSQTQSFTTAINFKIQHHKPEYITEKQYKATIGSSRSSSSSSTISVRSKKSDHPQQ

SEQ ID NO: 147828 - protein, 57 aa, Triticum aestivum
  Clone ID: PAT_TA_42246.pep
APPPGFGYGKRPTFRVPWILRGGGKAFRAENMFHSLLTRNLFFTMYGSVFSTLFICN

SEQ ID NO: 147829 - protein, 155 aa, Triticum aestivum
  Clone ID: PAT_TA_42247.pep
PVCLDSNAQVDPRDNFLIAENVDSLMPDALLSRGMGSGKDICNLPSGQRDHREVDNELSSAAFSSQSFGVPDISFKPGCSGDIAVNDGGMPSQGLWNNQTQRMRTFTKVQKRGSVGRSIDITRYTNYDELRHDLACMFGIQGQLEDPYRMDWKLV

SEQ ID NO: 147830 - protein, 57 aa, Triticum aestivum
  Clone ID: PAT_TA_42248.pep
SVYFDSNAQFNPRDNFLIGGNVDALMPHSLFSIGMVFEKDIHNLPSGQRDHRNAENV

SEQ ID NO: 147831 - protein, 79 aa, Triticum aestivum
  Clone ID: PAT_TA_42249.pep
IAARHQPCLLCLLFSDLSSQFRTLLLNKALNLARKKKNRHFGHFAPDSRYSCIVLPLLLLTLHISLTYISLIKVKLCKF

SEQ ID NO: 147832 - protein, 81 aa, Triticum aestivum
  unsure (1)..(81): unsure at all Xaa locations
  Clone ID: PAT_TA_42250.pep
DTDRQRPTVPIMASKIKKGGILGTGEYILSYVNTYCMTFLNKMGKNVIXAYKIQGFVTALTLHRKRALIAYKSTRVAYNKL

SEQ ID NO: 147833 - protein, 53 aa, Triticum aestivum
  Clone ID: PAT_TA_42251.pep
YSTYTLTRERDLESSILIRRRWSGSSNHGNDYNMHAGQMSNVRFLPGLLPSTH

SEQ ID NO: 147834 - protein, 78 aa, Triticum aestivum
  Clone ID: PAT_TA_42252.pep
PYPADVLYCHRPNNVGSVRVELVGQDDLTLGATAIAVCHEDTSGWDAEYFATLNGSRGEPICHYMPEKYVVWVGGEIH

SEQ ID NO: 147835 - protein, 146 aa, Triticum aestivum
  Clone ID: PAT_TA_42253.pep
DAWAAHGHGCWSSVPRQAGLQRCGKSCRLRWINYLRPDLKRGSFSQEEEALIVDLHRVLGNRWAQIAKHLPGRTDNEVKNFWNSTIKKKLISQAVGSLHSDLYYNILDGAGQGIAAAGCASLNGLDNAAQAVATQPPPSSAAWLNF

SEQ ID NO: 147836 - protein, 81 aa, Triticum aestivum
  Clone ID: PAT_TA_42254.pep
DACAAHGHSCWSSFPFLGGVGTCSATCKIIWMNYLRAYLKRGILPLEVVSIIADPDKVLGNRCAQIANLLPGPTGKVVENF

SEQ ID NO: 147837 - protein, 51 aa, Triticum aestivum
  Clone ID: PAT_TA_42255.pep
KHHQGRQVCRPDCHRAFQQPKAQRRKRADGRRVTDNATASVALPFPSPATL

SEQ ID NO: 147838 - protein, 113 aa, Triticum aestivum
  unsure (1)..(113): unsure at all Xaa locations
  Clone ID: PAT_TA_42256.pep
NSYLERRQAVLHSVTIQGLNTGTLDLTSIGWXHIASLDSERKQALTATGGEVHGIPMGLQQALTWYRRRFDRRTVVSRLLIDMNPMAEAFCSSLLMSGALLELVHSRAGAVAD

SEQ ID NO: 147839 - protein, 43 aa, Triticum aestivum
  Clone ID: PAT_TA_42257.pep
TSLWNPEHVSFKLLGTKPGGTPVCHLMPYGHIIWAKNVKRSTA

SEQ ID NO: 147840 - protein, 126 aa, Triticum aestivum
  unsure (1)..(126): unsure at all Xaa locations
  Clone ID: PAT_TA_42258.pep
LAYTLIFSIKRGLPGQGYXIDPRVSLVCKKKMVTSWDMLCTFCPPPIKQVLESGTYMKFDEEPHCTKLMLLFERLIESPALXRPINLFGXLKEGQKRGRLLANHEEYDQXRRKLGLWSPSLQWILV

SEQ ID NO: 147841 - protein, 42 aa, Triticum aestivum
  Clone ID: PAT_TA_42259.pep
HILFVVDKRITSCYQINKHSAQATYNARQIFTKAFLEHRAIH

SEQ ID NO: 147842 - protein, 111 aa, Triticum aestivum
  Clone ID: PAT_TA_42260.pep
PRVRWVPRRRRLSLLSYGARRDPFARRLNLLFPCTLRSGGSGDVWPVHTVRVLQLRVFTHRRGQLGATSERHRRRRLCCASSLDPWMSKRRLTYWRSHVTTELPGMPSFNC

SEQ ID NO: 147843 - protein, 87 aa, Triticum aestivum
  Clone ID: PAT_TA_42261.pep
KTREPKEENVTLGPAVREGEHVFGVAHIFASFNDTFIHVTDEGVVEGGEDMRTSFQVSTDTCLLFIPRHSKNQNMKNNGWRQFVVSL

SEQ ID NO: 147844 - protein, 154 aa, Triticum aestivum
  unsure (1)..(154): unsure at all Xaa locations
  Clone ID: PAT_TA_42262.pep
WISTASGRPKSLSRERQCHQQSRAQAVVLTPTTFLGQTKDXSFNPLRDXMSFYGSPKYTMGNDLWYGPDRVKYLGPFSVQTPSYLTGEFPGDYGWHTVSLSADPECFDKNRAVEVIHGRWALLGAYGCITPEVLQKWVRWDFKEPVLVKAGSQI

SEQ ID NO: 147845 - protein, 105 aa, Triticum aestivum
  unsure (1)..(105): unsure at all Xaa locations
  Clone ID: PAT_TA_42263.pep
MTDQLPNELKSGIQYWSLERKACQALSRNDKISIGDVXEAIHFKSFDYSVLNLMMYRLTGQQGNDLHMEFLSASEFLVEICDDPYDYEDDVXTITFNNPRMFAAI

SEQ ID NO: 147846 - protein, 33 aa, Triticum aestivum
  Clone ID: PAT_TA_42264.pep
KIHGGGEMSLPDMLYSLDNFLQCLRVNDRSIAK

SEQ ID NO: 147847 - protein, 100 aa, Triticum aestivum
  Clone ID: PAT_TA_42265.pep
TDVLLGKRPKEVLPAGAPEKRMKVVRRRLPQSLVEHIVAKPLPDGRSPRRRAGQGNQLLPRVVRRTQAHSRQDRRLPAGHHRPVQVLWLRGGGYRGHRRR

SEQ ID NO: 147848 - protein, 41 aa, Triticum aestivum
  Clone ID: PAT_TA_42266.pep
FIFFFFFFFFFFFFFNIYFFFFFFFFFFFFFFFFFFFFFFF

SEQ ID NO: 147849 - protein, 65 aa, Triticum aestivum
  Clone ID: PAT_TA_42267.pep
RKTRRKLRYKPYRGNTRTIWLQQRQTVHRKFKDMASPIFAESLKKKNLKPSPDLILAKFQKGPAA

SEQ ID NO: 147850 - protein, 72 aa, Triticum aestivum
  Clone ID: PAT_TA_42268.pep
PGFFARKHFLECQGSYSRFAIKGTVAQGGHSFDMYRLCYLELSNVLGRALLASTSKLVFCSPQVKVEFHPLF

SEQ ID NO: 147851 - protein, 95 aa, Triticum aestivum
  unsure (1)..(95): unsure at all Xaa locations
  Clone ID: PAT_TA_42269.pep
TSGKPLHYKGSSFHRVIPDFMWEGGYFTKGNGTGGYSIYGEKFSDEKFVHKHTXPGILFMANAVPNTNGSQLYICTVPCNWLDGKHVVFGEVVKG

SEQ ID NO: 147852 - protein, 100 aa, Triticum aestivum
  unsure (1)..(100): unsure at all Xaa locations
  Clone ID: PAT_TA_42270.pep
KCDPRHGKYMACCLMYACGVVREDVNSTLSTINTKRSIXFVDWFSTGLKCGINYHPPGVVPGVYLVKDHLVCVMIFISSCVVWVFFCIDHYFDSMYSKCA

SEQ ID NO: 147853 - protein, 60 aa, Triticum aestivum
  unsure (1)..(60): unsure at all Xaa locations
  Clone ID: PAT_TA_42271.pep
PRVRVIRGKKGAXGITIKKGGGALVVGAYKEPITPGQCNIVVERLGYYLAEQGMYVTPSI

SEQ ID NO: 147854 - protein, 108 aa, Triticum aestivum
  unsure (1)..(108): unsure at all Xaa locations
  Clone ID: PAT_TA_42272.pep
DSVLPCIPIALRERRLYNEAXDMKDFLVLLNQTISTLNSSSSVILEDVFPTIASQMSEILKQDAFFDXPARITEEMRELXELYRTLYTFLHGMETHDLFAVLRAPTCR

SEQ ID NO: 147855 - protein, 84 aa, Triticum aestivum
  unsure (1)..(84): unsure at all Xaa locations
  Clone ID: PAT_TA_42273.pep
MVKLTMIARITDGLPLAEGLDDGXDLKDADFYKQQAKLLFKNLSKGQHESSRLSIQTGPTPLCAVAECDKKGRRGRERTENDLD

SEQ ID NO: 147856 - protein, 40 aa, Triticum aestivum
  Clone ID: PAT_TA_42274.pep
SKASRHDDCLMYCYICWGEGNCVPSHTTHYKDDCPVLPHT

SEQ ID NO: 147857 - protein, 47 aa, Triticum aestivum
  Clone ID: PAT_TA_42275.pep
RYRALTIRRGLSTVFINGGRRTEREHYSFIIVFTVILCGCVCSPSLA

SEQ ID NO: 147858 - protein, 45 aa, Triticum aestivum
  Clone ID: PAT_TA_42276.pep
SFFHNLTIYVHDSLTLHNFLILITHVLTNLIFLHHIFLSTAVIIS

SEQ ID NO: 147859 - protein, 145 aa, Triticum aestivum
  Clone ID: PAT_TA_42277.pep
DDNIRLISAWLNNSIDSIDGNNKKGEVYWKNVTEDYNKNSPPTRRRNSKNCKDHWGKTNRKVVAFHGVYCRLKDAYASGQCDLQLVQKALAMYKKEKNQNFTLLYWWEKVRVHQKWSRHSEEGKGKGNGTIQTQMEKETRPDGTK

SEQ ID NO: 147860 - protein, 111 aa, Triticum aestivum
  unsure (1)..(111): unsure at all Xaa locations
  Clone ID: PAT_TA_42278.pep
GSSEATHCTYTCRRTTLVMKALSFPRHTRICIAIGEIYDGXRLTASNTKFPNIAXCTRMPLSDGELHLFQKXSTQMEALDYLVSGIGEGFIPCSEGNMAKVGQGHHMPVYL

SEQ ID NO: 147861 - protein, 36 aa, Triticum aestivum
  Clone ID: PAT_TA_42279.pep
NGVQRFGVGRQTCMPTPGSGLTATEYMEKTVGTSNV

SEQ ID NO: 147862 - protein, 49 aa, Triticum aestivum
  Clone ID: PAT_TA_42280.pep
PCERLIKHCMRLCCFNIDPTKSTTVIVFVSSFYLCIHRVPAIAMPIYSF

SEQ ID NO: 147863 - protein, 49 aa, Triticum aestivum
  Clone ID: PAT_TA_42281.pep
PKKSLLKNKKHVFFKGGKKFQQVYVVGNNKKARLNSFSLPISHVSLKKI

SEQ ID NO: 147864 - protein, 39 aa, Triticum aestivum
  Clone ID: PAT_TA_42282.pep
SVWKAISPAVLETAFNTTPEMEKLFRSKRLDSEIFFAPN

SEQ ID NO: 147865 - protein, 43 aa, Triticum aestivum
  Clone ID: PAT_TA_42283.pep
TSPITTELTGSPPSPSPGSGLSYTTSPSSSNLPTSISPPTTTT

SEQ ID NO: 147866 - protein, 45 aa, Triticum aestivum
  unsure (1)..(45): unsure at all Xaa locations
  Clone ID: PAT_TA_42284.pep
PWRSSCPXGXWXGXXGAXSSPRPAPCAXCXRXARCPXXPSSGRVG

SEQ ID NO: 147867 - protein, 109 aa, Triticum aestivum
  unsure (1)..(109): unsure at all Xaa locations
  Clone ID: PAT_TA_42285.pep
GRPLLPGVLPXGFCAVVAXVVSGGXRRGVXXASLGVVVAXRXGXRCWALAAVXXRAWAXASAFSXXPLLXXXXWFXXXRRWPWGXXXCRSPXGAPXXCGLLPRVRXRVG

SEQ ID NO: 147868 - protein, 135 aa, Triticum aestivum
  unsure (1)..(135): unsure at all Xaa locations
  Clone ID: PAT_TA_42286.pep
NTEEERRRERGPPPPPPPRXTXXXXAXXXXXXNPRRNPXARXHRPTXANRXKNHGRRXDDXXDPXXXRDXKEAXXRRPREGXDARHQXXKRAXDXXRKHQNRPDDXRAPQTPXKSXGSDRXXXEKKEAAEPKAPG

SEQ ID NO: 147869 - protein, 72 aa, Triticum aestivum
  unsure (1)..(72): unsure at all Xaa locations
  Clone ID: PAT_TA_42287.pep
VDSAPKIIHSIFDXXVRVSTYVHALQITRALISQRTSNVIVVLGIVIPPGWTCALNIIAIVLILSFGRAWSP

SEQ ID NO: 147870 - protein, 34 aa, Triticum aestivum
  Clone ID: PAT_TA_42288.pep
FYTEFLLVMRVRYLIDCLLYSMQGFQNPLTYRFC

SEQ ID NO: 147871 - protein, 51 aa, Triticum aestivum
  Clone ID: PAT_TA_42289.pep
VHIGVSFALPLDLDHENDSDAQPICKLFCNVCIRDVRPAFFNCKNPASFGF

SEQ ID NO: 147872 - protein, 94 aa, Triticum aestivum
  unsure (1)..(94): unsure at all Xaa locations
  Clone ID: PAT_TA_42290.pep
MEAASAETATMVFVYGTLKRGFPNHPRLAVFDCPFAGAATTAAPASLVIGPYSVPFLLPAPTPSSGRLVSGELYSASPXXLADLYLLEGTHLGV

SEQ ID NO: 147873 - protein, 108 aa, Triticum aestivum
  unsure (1)..(108): unsure at all Xaa locations
  Clone ID: PAT_TA_42291.pep
LPQVEGIQGIMSAYTSALRNVSLAGPTLFGPLLSTVTAIAGHSFTSNQQKYLXLVIRTGGVMTDFQETIGAIIKAFQFSLAINGGGGGGADSKGMEILDPNKGGRLES

SEQ ID NO: 147874 - protein, 66 aa, Triticum aestivum
  unsure (1)..(66): unsure at all Xaa locations
  Clone ID: PAT_TA_42292.pep
SDFLSSWIRTMFQGVHLADTSTMHLXKHIRRVRLRCATTTNIRLLWCXDGDNDLRLHTPTSDYSMR

SEQ ID NO: 147875 - protein, 113 aa, Triticum aestivum
  unsure (1)..(113): unsure at all Xaa locations
  Clone ID: PAT_TA_42293.pep
GRVGPRVRLVAPAVTDAVVRGKRQADQLVTPVITDAVVRGKRQANQLVTPVITEAIGNRRTRQTSQPVAPXITEAIGNXATQVNQFVAPVVTLPRQQLQNNXQQKLSMITLPT

SEQ ID NO: 147876 - protein, 152 aa, Triticum aestivum
  Clone ID: PAT_TA_42294.pep
PTRPPTRPPTRPRNCTTDRRNAQPQRDQTQPHRPGGAGVSFLPRSTVAARRWTPTTPAATATSPPASPPRPPPPSPPWTSAAATRRRSSTRRPPTGPHGPDRSSAPSDRATGKGKVSLDGGGQTSKRGKKTVAFSRMVRLHRTGCGLGSFLS

SEQ ID NO: 147877 - protein, 52 aa, Triticum aestivum
  Clone ID: PAT_TA_42295.pep
LLFGRNDSTVIDMGPPADWVKINVRRTKDCYEVYALVPGLLREEVHVQSDPA

SEQ ID NO: 147878 - protein, 109 aa, Triticum aestivum
  unsure (1)..(109): unsure at all Xaa locations
  Clone ID: PAT_TA_42296.pep
SRIVFSVGLHRRKTARQCSGGARARSRRPPRRRSASPPPPPSTSRRAPRRPRPTRLPSRATRRRPSTAWRPAPPTRXRPPPGAPSSRSPSRRRTRSCSPRGSSCSGPPA

SEQ ID NO: 147879 - protein, 98 aa, Triticum aestivum
  Clone ID: PAT_TA_42297.pep
NRFIFQGSRFISKIIVLQAEHVLAKHQHERGLLMVLGLMLLGTMSMSLPMKTRMLTGCSLAIFLRIQQVVSQSCKFCHKDEIVRMVQNFYVIAVVPVN

SEQ ID NO: 147880 - protein, 115 aa, Triticum aestivum
  unsure (1)..(115): unsure at all Xaa locations
  Clone ID: PAT_TA_42298.pep
MSSFAGVDLCPPCAGSACETSADCGYHLLVVQDYSRAKEKAPTGXSIISRPFRVGCHTWQIELFPNGNNPSCADFVSLYVCRLDDYLNNAVDAKFSLSFVDQAEKQKPVYILGTE

SEQ ID NO: 147881 - protein, 93 aa, Triticum aestivum
  unsure (1)..(93): unsure at all Xaa locations
  Clone ID: PAT_TA_42299.pep
RGPPSNRPPCRFAPPPHTRNREKNHTHHPLARLAAPVNQPSSQPTNHPHPPPHLAWINGSPPRPALPLTXASAARYSADRHADSRSRADGHGA

SEQ ID NO: 147882 - protein, 91 aa, Triticum aestivum
  unsure (1)..(91): unsure at all Xaa locations
  Clone ID: PAT_TA_42300.pep
MKSXRLQGVPAQPNHRYEQQRHHLPVLRLQATVVAAGPPRSRWSCSMSRSAAXLQRQPPRWSPKCRRPPTPXGFSLMYEXXGERNGMRTMN

SEQ ID NO: 147883 - protein, 91 aa, Triticum aestivum
  unsure (1)..(91): unsure at all Xaa locations
  Clone ID: PAT_TA_42301.pep
MQQPTSDDNWFCKDDHHQICLFVYFLQKMLINLSPLYCINALFTFFRSSPRDQTVPXPENQLERDVLIGIKGSHEAFLQEELCVHPGMVCI

SEQ ID NO: 147884 - protein, 123 aa, Triticum aestivum
  unsure (1)..(123): unsure at all Xaa locations
  Clone ID: PAT_TA_42302.pep
LKXWGLXLAVKRPSPFGQNNXSLLRTCAPAXXFIHXTVSWRIIRXXIVLLERSXXLSFXXMSRXXSMGGLXXIXRNXWRHGLASLKIQXSFLXEVRXHXRSEILLXLGFVLTXXRITXXNIXN

SEQ ID NO: 147885 - protein, 127 aa, Triticum aestivum
  Clone ID: PAT_TA_42303.pep
MMGRTKQGGGQSTGCKAPRKQLATKAARKSVPATGGVKKPHRFRPGTVALREIRKYQKSTELLILKLPFQRLVLEIAQDFKTDLRFQSSAVSALQEAAEAYLLGLFKDTNLYAIHSKLFTIMPKDIH

SEQ ID NO: 147886 - protein, 89 aa, Triticum aestivum
  Clone ID: PAT_TA_42304.pep
RTRFLKSQATFCRLNLLHRASYYRGIGPSINSFLPPTRPPYPTNRAPNRVPLYFYSSPHPTQPTFVEPQAHTDSNRITLSDNISFLISA

SEQ ID NO: 147887 - protein, 160 aa, Triticum aestivum
  Clone ID: PAT_TA_42305.pep
MAEESQSEAHDSAQSLSDDWNKVVFSVSDSMKQMHIRPESISKLNLQQLDMLGDMLGKVHVARTYKRLPAAVRMQDPRLAEAMTLHGKLSYEKAKLQINRVKLDKLRNKAQLCQVGIQECRYLKSKISQLRRPTMGAAQMKGGPYTENLINTCDRLEGNA

SEQ ID NO: 147888 - protein, 127 aa, Triticum aestivum
  unsure (1)..(127): unsure at all Xaa locations
  Clone ID: PAT_TA_42306.pep
MARSKQTARECTGGKAPRKQLATKAARKSAPATGGVKKPHRFRPGTVALREIRKYQKSTELLIRKLPFQCLVREIAQDFKTDLRLQSFGVFALQEAAMAYLVGLYEDTNLXGIHTQRGTMMPMVMQI

SEQ ID NO: 147889 - protein, 159 aa, Triticum aestivum
  unsure (1)..(159): unsure at all Xaa locations
  Clone ID: PAT_TA_42307.pep
RTRGRTRRLPYAYPLPRHPPIPPGTGCPLPPPPPPPHPXTSPPPPALPPLRETASPSRTTSSPTATSPSRRPSRPPRTSPTSSPPPTPTPSSHSSTASASPPRRSPPTSPPTRASSAPASSAPSRPSPRSSAPSASPPPKSPTSPRSPTPTSSTTTSSP

SEQ ID NO: 147890 - protein, 114 aa, Triticum aestivum
  unsure (1)..(114): unsure at all Xaa locations
  Clone ID: PAT_TA_42308.pep
MFATAARWAAKKGKPKMAPIELTTAPEQAQSITRTIFDVVKEHGPLTIXDVWEHVKDVGLRGLTSKRQMKIMLRWMREKQKLRLICDHDGPHKQFLYTTWFTNPKNAPQRPKRE

SEQ ID NO: 147891 - protein, 71 aa, Triticum aestivum
  unsure (1)..(71): unsure at all Xaa locations
  Clone ID: PAT_TA_42309.pep
CEIVVMEGWAGLGGGRSRSRGEAGLGICWWGRAGGAGEEMSLLKARYRGKRWRVEEAAPXEQWLVVLAHES

SEQ ID NO: 147892 - protein, 170 aa, Triticum aestivum
  Clone ID: PAT_TA_42310.pep
MLLIVVRARFPPAQAGGNMGSSQESTFSSASTAAQVNALGLLPVYAKELIAGGAAGAFAKTAVAPLERVKILLQTRTQGFQSLGIVQSLRKLWQYEGIRGFYKGNGASVLRIVPYAALHYMTYEQYRCWILNNAPSVGTGPVVDLFAGSTAGGTAVLCTYPLDLARTKLA

SEQ ID NO: 147893 - protein, 68 aa, Triticum aestivum
  Clone ID: PAT_TA_42311.pep
AMVCPIVCSILVLCVRVEFNMRRTISYYGPLTKTWFATWSSAPCLFGTLAFMAALTSGANQCTLPWIA

SEQ ID NO: 147894 - protein, 180 aa, Triticum aestivum
  unsure (1)..(180): unsure at all Xaa locations
  Clone ID: PAT_TA_42312.pep
FPEHGLQKSSVLQHMTTIIQPVLEKGIVEYSIVHMVISEYLTIADKLXDVIRQLIPHLIQGSSVLDEDVIGQLIPHLTPTKSKAQKKRSKAKKKRSSELLLIRIMQTKEGLKLGLACLKHGLEKDRKRIIKSLKGHIRKLALNDYGCLFVICRLSIVDNTELITEVVVDELTKHLKELIF

SEQ ID NO: 147895 - protein, 115 aa, Triticum aestivum
  Clone ID: PAT_TA_42313.pep
DTDEGCRGVQPTGRGAQQSGPIGFGADNYKLEDMSLLLNETKPTLQGSAYINQQPWWVQPGKFIIAAADGLLTEGGLKGKIFPLRKAESEDLFSGGKLEVRISYWWQYRILRSVN

SEQ ID NO: 147896 - protein, 71 aa, Triticum aestivum
  Clone ID: PAT_TA_42314.pep
VKTISYSLAFYSYSYPPYIYYSSTSSTMDVLYPLTSAYSRIRRRKRNLGLLYVPLRQVFQVVQLSVPYYCD

SEQ ID NO: 147897 - protein, 177 aa, Triticum aestivum
  unsure (1)..(177): unsure at all Xaa locations
  Clone ID: PAT_TA_42315.pep
GNKSTGDNFDFVPNIDHTRAFVRKDXSEWLIWLRETIGFQDFRFDFTKGYASKFVKEYIEESKPLFAVGEYWDSCEYAPPDNRLSYNQDKHRQRIINWIDSTGGLCAAFDFTTKGILQEAVKGELWRLRDPEEKPPGVMGWWPSRSVTFIENHDTRSTQGHWPFPSDHVMEGYAYIL

SEQ ID NO: 147898 - protein, 204 aa, Triticum aestivum
  unsure (1)..(204): unsure at all Xaa locations
  Clone ID: PAT_TA_42316.pep
PRVRVYRALLFVNPSPYMGXVHARGWVLVXSSPEILTKVEKGKVINRPLAGTTRRGKTEHEDKLQEEQLLSDQKQCAEHIMLVDLGRNDVGKVSKSGSVKVEKLMNIKRYSHVMHISSTVSGKLDNRLXSWDALRATLPVETFKGAPKVKAMELIYQFXVTRRGPYIGGLRGILLYGDMLIGLSLRTIXFLTTSNHNTIYLIQK

SEQ ID NO: 147899 - protein, 75 aa, Triticum aestivum
  unsure (1)..(75): unsure at all Xaa locations
  Clone ID: PAT_TA_42317.pep
TLISNQLCDQSNSTLQLRTTYFSXRHSHLAPGSRGSRGLPSEPGQWKSKFRTVFVIHNGYVLLIQTMAGKNTELN

SEQ ID NO: 147900 - protein, 112 aa, Triticum aestivum
  unsure (1)..(112): unsure at all Xaa locations
  Clone ID: PAT_TA_42318.pep
PPLPREPAVVLLPVPNPVAEALSPRDAAAAXPPPPDPAAAPPPSMNPTGAPPFPPDPISPPVSLRVVGVDQLSAASTPRSMLEVHHLFASDLPCSSPRILLCPLSPKATHFE

SEQ ID NO: 147901 - protein, 120 aa, Triticum aestivum
  Clone ID: PAT_TA_42319.pep
MDSSKSPQPLKKSRTSLSGTDGHQFENDELQAETASDKTPGLKFETGDKAQDEFGEDSAPLQQSAASNVAYRGSACIGACTIQCARCLKWRLIPTKEKYKEIREHMIQEPFELQKAREWK

SEQ ID NO: 147902 - protein, 161 aa, Triticum aestivum
  unsure (1)..(161): unsure at all Xaa locations
  Clone ID: PAT_TA_42320.pep
MIGAAGVPQXPXSSVKPSTPVRRMKPVDSPSTNLKTAERSFGQRDIQLLSRTGMAINSSITKKAPPTESVAVKDIYTTSQAVSVPVVVPRDILEDKSAGSIHRGIGGRTAFPDDFYSPVHLRKRLPSGGTSDSVSSIKSMLTXPDVCSDGLSGLKFSFETN

SEQ ID NO: 147903 - protein, 196 aa, Triticum aestivum
  unsure (1)..(196): unsure at all Xaa locations
  Clone ID: PAT_TA_42321.pep
REFPVAGASADAWAPSASSSFSPATHPVPGRWTPTTGPPRPPNRPPPKPTSSTSQMPSPLPLPLPHPTPRPPPPXPAPAAPGQNPDAXPTTPSPPRLPAHPSSPGSMSPTRTRTGPRPSLIPIPPAPAPSPRAMSPTRARPSPIPIPIPIPARAPARPVPPLPSRRRWTIRMRSRRPPRRMWTRRILSRRPPRRMW

SEQ ID NO: 147904 - protein, 68 aa, Triticum aestivum
  Clone ID: PAT_TA_42322.pep
KRNAAKGGFWHDDGKKGGDRGGRGGIPYLSGRGGGEAAHVCTHRVGRAALHTEEVEPRRCDRKCEKTE

SEQ ID NO: 147905 - protein, 167 aa, Triticum aestivum
  unsure (1)..(167): unsure at all Xaa locations
  Clone ID: PAT_TA_42323.pep
GRVGCGPDLVVEQQRPRRGACVVADARHSDRDQDAVAGERXRLTRPGVTAMKISTPTTRLRSTAPCFSASPPASITFFSARTAPRSLVNRCISVLWWRAGFRSSGIWRMHGLELGNSSGFLQKTIGRVWIFFRRINLIWMRLISTSCGPPIEICGGNFPSIHLLIRF

SEQ ID NO: 147906 - protein, 61 aa, Triticum aestivum
  Clone ID: PAT_TA_42324.pep
LRGGAYDRHPHHIPIFHSPHLTNFHINYHRFICIYRHAHGDNSTSSFQLATQCKGRNLKFF

SEQ ID NO: 147907 - protein, 100 aa, Triticum aestivum
  unsure (1)..(100): unsure at all Xaa locations
  Clone ID: PAT_TA_42325.pep
RKTRGRATPTPRTXGPDFFYKPSEKGGGNEGGRGGQKPXQXXXLXPKTXKEKQALAGRQKDKQAVMRGQRPDGETLQGEFAPTEATEALYEYSGGSIKAN

SEQ ID NO: 147908 - protein, 109 aa, Triticum aestivum
  unsure (1)..(109): unsure at all Xaa locations
  Clone ID: PAT_TA_42326.pep
HASAPASLKNTRAFSSISHTIPPPLFAMAGAKYTVRKSTGGNAPLKQLTTKAARKSAPATGGVKKPHRFRPITVALLXIRKYQKSTELLILKLPFHRLVLXISHDFKTD

SEQ ID NO: 147909 - protein, 123 aa, Triticum aestivum
  Clone ID: PAT_TA_42327.pep
MADPDADESPDLWQLFCHYDRLYFRGELDAAAFAVEWAYPRMRTTTCFGSCSFGDLNKIILYEPMLQWRTNADMKNALLHLMIHAIIFVKHGMKNLGHGPVFRDWMDAINTCTAEDLMRPTGG

SEQ ID NO: 147910 - protein, 59 aa, Triticum aestivum
  Clone ID: PAT_TA_42328.pep
QAEAAAATGHSAIPASSKGGRFPVRRGKASAGTRCLVKANHLIAQLPDKDLNHYHVSIT

SEQ ID NO: 147911 - protein, 98 aa, Triticum aestivum
  Clone ID: PAT_TA_42329.pep
MVWRNSQRFRRSWRSYSSLILSERTLGLDRKTEEWKTHLIDKVDKILTNHYHNGVKVKTLKLDIGPCRDIKASYLDRWLRIIKPGIQEFNLLLPLVVN

SEQ ID NO: 147912 - protein, 99 aa, Triticum aestivum
  Clone ID: PAT_TA_42330.pep
NGLVIALNSHFTVVWKAAVGAPIFGGACISYALPSQVLIPSRDGSLYSFDITSGDLLWSYDVGNPIPASAFVDEVLASRPSGASNRFACICTSSGKVRI

SEQ ID NO: 147913 - protein, 106 aa, Triticum aestivum
  unsure (1)..(106): unsure at all Xaa locations
  Clone ID: PAT_TA_42331.pep
MASLLEIFVGSCSSSAPPVDWEAEAYPEYADYAVLPLLLAFFPALRLLLNQFLFEVLARRLIFGKGYDKLVETDERRKKINKFKXESAWEIVYYLSAELFSLSVTY

SEQ ID NO: 147914 - protein, 110 aa, Triticum aestivum
  Clone ID: PAT_TA_42332.pep
GRNRNKRARSGSGLPYNFSQEPLVNVLMESKGGKKSSSSSSLMYEAPLGYSIEDVRPAGGAKKFFCCILELREEAILISFLASPSRSLGFLCNFILTLFSHQSLWLAASR

SEQ ID NO: 147915 - protein, 99 aa, Triticum aestivum
  Clone ID: PAT_TA_42333.pep
PPPTPTPLPLLLPPSGGLVLSVSCWGMRSGSDCDLILLLILPPYKSKQIPCVKDPDPPCRSKATTKPHCIRRLRMMRRRRRLCGTGGKPSSTSSPTWST

SEQ ID NO: 147916 - protein, 154 aa, Triticum aestivum
  Clone ID: PAT_TA_42334.pep
PARTPRGTGADELARSPGWATERCRLRRTVDGRSTAAETLATSKGSRRASDSGRGGSSRPRGRRGRRAADLAVVELRGGEREARRRAMGEQRRRCGWRQWETMGNRQDGAPCIEARTRAPASKTATPGPVSSFPRLAWGDGGNGSGSGESPRVR

SEQ ID NO: 147917 - protein, 116 aa, Triticum aestivum
  Clone ID: PAT_TA_42335.pep
PTRTPTRPICFWQFDMLDGLIAGESGGWCADGCTAIVDSRTSLLAGPTTIVAQVNHAIGAEGIISTECKEVVREYGEMILELLVAQTRPQKVCSQIGLCVFDGRYSVSNQIESVVD

SEQ ID NO: 147918 - protein, 153 aa, Triticum aestivum
  Clone ID: PAT_TA_42336.pep
KLAKSSKDYDVAIETFQKALTEHRNPDALKRLNDAERAKKELEQQEYYDPKLADEEREKGNEFFKQQKYPEAVKHYTEALRRNPKDPKVYSNRAACYTKLGAMPEGLKDAEKCIELDPTFSKGYTRKGAIQFFMKEYDKAMETYQEGLKHDPS

SEQ ID NO: 147919 - protein, 58 aa, Triticum aestivum
  Clone ID: PAT_TA_42337.pep
NSEILVMELLQIGGTDGVLEDGREPANPVRELKPAVAEYFVKPGLHIHVCWNGVVKSH

SEQ ID NO: 147920 - protein, 99 aa, Triticum aestivum
  Clone ID: PAT_TA_42338.pep
MDQARGIDCSKAKNVAANKFGGPRKKSVTKSIKAGLQFPVGRIGRYLKKGRYAQRVGSGAPVYLAAVLEYLSAEVLDLAGNASKDNKKTRIVPRHLLLA

SEQ ID NO: 147921 - protein, 79 aa, Triticum aestivum
  Clone ID: PAT_TA_42339.pep
HSFVHSLLVASNAAHSPLHGALLVGERGPTPRTSPGTRRVVLYLSLNCSPSDGRPLLFALFYVLVRVLLGVPDRVVLVR

SEQ ID NO: 147922 - protein, 54 aa, Triticum aestivum
  Clone ID: PAT_TA_42340.pep
IYSSTNLTLIKLLFTLSYHLLFLNHLFKINSYFSSLYFYSYHISYYISLIIFYN

SEQ ID NO: 147923 - protein, 44 aa, Triticum aestivum
  Clone ID: PAT_TA_42341.pep
ALSGQRAGWRDEGGHPPPARRCNADQATPLGASGAYPPKKVQGG

SEQ ID NO: 147924 - protein, 76 aa, Triticum aestivum
  Clone ID: PAT_TA_42342.pep
NPSANPSANPSFHSSVHACGRVNPLSRRRVIFTNLEMYNTDELRNLYIDRKPATITLQNTSLSCGTSILTNVHLSC

SEQ ID NO: 147925 - protein, 85 aa, Triticum aestivum
  Clone ID: PAT_TA_42343.pep
FALLLVAFRFGVSVSVLVRRCLLWCLFSFLPSCCLFWGSALLLLLSFFVFGWACGRPLVGCGVPFPRGLGCRLRWCPGLPFSLSF

SEQ ID NO: 147926 - protein, 55 aa, Triticum aestivum
  unsure (1)..(55): unsure at all Xaa locations
  Clone ID: PAT_TA_42344.pep
RTRVRYSCILTLPPTTTIEVTFXPGLGVDLIHFLPFHQSFQFAKIPSISNCPINL

SEQ ID NO: 147927 - protein, 78 aa, Triticum aestivum
  unsure (1)..(78): unsure at all Xaa locations
  Clone ID: PAT_TA_42345.pep
NTEEVLVQQAGIKDECDAMPMEGGPHDAEVSNENTEENQVQQAELSQELDSVMIHPXEHVHEQCVEEKISLAELKQEL

SEQ ID NO: 147928 - protein, 155 aa, Triticum aestivum
  Clone ID: PAT_TA_42346.pep
VRDREAAILDTGIFVLRMTDRSKIIWESLASPTDTWLPGMNITLGNLLKSWKSYDDPATGDYTFGFGPSISNPSASQFIIMWNRISFWTSESWNGDTNSLIPVLKSMGIIPVSFQCDNLTCMYTPNPADIMTKIVLDQSGSLNITQFNSEAKLWT

SEQ ID NO: 147929 - protein, 155 aa, Triticum aestivum
  unsure (1)..(155): unsure at all Xaa locations
  Clone ID: PAT_TA_42347.pep
KVVALAVLERARKXQSSRITLLKEGDAYTRFFHLRINRQRRKNFIHRLRHNQGWVTNHDDKKAIVHEHFSTVIRKGPARSKDFTWEAIQTQPCDLTDLDLPFIEEETKAAIFSLPSDKAPGPDDFTGILFKECWDIIKRDLMAVVNGWRASPPRV

SEQ ID NO: 147930 - protein, 147 aa, Triticum aestivum
  unsure (1)..(147): unsure at all Xaa locations
  Clone ID: PAT_TA_42348.pep
LGLDYLHNPADDAQALGPGVELWGRHLEFVVRRLLESERQLCAKVFGQHKDDASVCFAEIASRASVLDFLRFGRAAADAKKDPIKLLRLLEVFDSLNKLRLDFNRLFGGKVCADIQCQTRDLVKLLVDGSVEIFEEXIVQVELQRHM

SEQ ID NO: 147931 - protein, 55 aa, Triticum aestivum
  Clone ID: PAT_TA_42349.pep
SCRFLRWRHCQCWVGVLGLYKDATLGPLRFKLIFFRMQLFRKDTFCISISAELKL

SEQ ID NO: 147932 - protein, 89 aa, Triticum aestivum
  Clone ID: PAT_TA_42350.pep
TGNITLRELLEWLKEKGLNAYSISCGTSVLYNSMFPRHKERLDRKVADVAREVAKMEVPSYRRHLDVVVACEDDDDNDVDIPLVSVYFR

SEQ ID NO: 147933 - protein, 129 aa, Triticum aestivum
  unsure (1)..(129): unsure at all Xaa locations
  Clone ID: PAT_TA_42351.pep
AHASDATSITEMMQVYIIRANSXXXKDSVLIPLASTIATTACKLFLRFSALVLNNSSFQKTKSFFFCYITNSFYYEALCPKLNDSFLHLNFQHVFEQHSLLYSRFEEEILAYYPSLSLDDPSLADVHNS

SEQ ID NO: 147934 - protein, 88 aa, Triticum aestivum
  Clone ID: PAT_TA_42352.pep
LAPASSSIKSSSSASSPMSWSWFTASSLAPASASLGKASASLFAASSLFASCSSLSPSAASRSGICGGALPAAAAATSAPTGTRGAWL

SEQ ID NO: 147935 - protein, 108 aa, Triticum aestivum
  Clone ID: PAT_TA_42353.pep
MARTKQAGRKSTGGRAPRKQLATKAARKSAPATGGVKKPHRFRPGTVALREIRKYQKSTELLIRKLPFQRLVREIAQDFKTDLRFQSSAVSALQEAAEAYLVGLFEDT

SEQ ID NO: 147936 - protein, 68 aa, Triticum aestivum
  Clone ID: PAT_TA_42354.pep
ILPGHILKYGGQNKTTIFTTFHYSINPQIISSPLTTTILTAHFLPPLTLTLPYPLNKSNQIPHLYFPF

SEQ ID NO: 147937 - protein, 62 aa, Triticum aestivum
  Clone ID: PAT_TA_42355.pep
RPVMILLFSKTCLSIKLAGLVRQCVNVCSTRNSFQSRHGWHSRQSMCYQDNSLKAHIKWTHH

SEQ ID NO: 147938 - protein, 185 aa, Triticum aestivum
  Clone ID: PAT_TA_42356.pep
MGLNLNISRIIFSTLKKFDGICTRELTVPEIKQIAGRAGRYGSKFPVGEVTCLDAEDLPLLHSSLKSPSPIIERAGLFPTFDLLSVYSRLHGTDFLHPILERFLDKAKLSPDYFIADCEDMLKVAAIVDELPLVLHDKYVFCQSPVDVRDDISIQGLTQFAKNYAKKGTVRLKEKFTPGTLGVPT

SEQ ID NO: 147939 - protein, 85 aa, Triticum aestivum
  Clone ID: PAT_TA_42357.pep
SLPPHFTNQRGGKEKFINHVEKIQNAAPLYLPEKDTFTLLDVGSRGRFNVVQAPMPADGDAKEGRMGKMIMELSRIWQNAGRVAR

SEQ ID NO: 147940 - protein, 73 aa, Triticum aestivum
  Clone ID: PAT_TA_42358.pep
VLSDVTPGRLMALLIQSRALSRAFVLKLKKKIYIGNSSPPDSSTRQPSVDPGVALRLRFSDPRLLHLYRSFVL

SEQ ID NO: 147941 - protein, 29 aa, Triticum aestivum
  Clone ID: PAT_TA_42359.pep
PKTSYICLQREYNAVRTTARQAFNMWSSS

SEQ ID NO: 147942 - protein, 158 aa, Triticum aestivum
  Clone ID: PAT_TA_42360.pep
MGNGGSSSRARLGKAHVVPDSEWRMQDFGKTHVPDLEWRINDFSSLLETGAKSAKSDAFHCSGYNWYLQVSPMHKEIGSETPYVALCLKISQASMVPGHTVHVVFELSIYNHTKGMYCGCKDTYNFHFKNTYSKEQCLIPLQELLKSSAILVDDSCVF

SEQ ID NO: 147943 - protein, 96 aa, Triticum aestivum
  Clone ID: PAT_TA_42361.pep
GEMGLAFGKLFSRLFAKKEMRILMVGLDAAGKTTILYKLKLGEIVTTIPTIGFNVETVEYKNISFTVWDVGGQDKIKPLWRHYFQNTQGLIFVVDS

SEQ ID NO: 147944 - protein, 155 aa, Triticum aestivum
  unsure (1)..(155): unsure at all Xaa locations
  Clone ID: PAT_TA_42362.pep
ASGLIDLYTSSSYMKPEHIIMWRHAISDRHLXNSHNIKLNKILEAYKFLDENCNLKITLIFTHKNHHTKLFIPGSSDNFLPXTVVYNTVCHPMNNDFYMCSHSAIITTTTPTHYHILHDNIHYDEDYLQDLVHSLSYLYXRSTTHISFLSPICYA

SEQ ID NO: 147945 - protein, 92 aa, Triticum aestivum
  Clone ID: PAT_TA_42363.pep
MADRGGERGGDRGGQRGGFGRGFGRGGRGDRGGRHRTRLGPRQEEEKRVLLTKLGRLDKESLYNTREELYLHSLPINEYLIGDHLYLGLKAE

SEQ ID NO: 147946 - protein, 152 aa, Triticum aestivum
  Clone ID: PAT_TA_42364.pep
DLLCSFHPSFFYHFDKLILSYFCGFADEALEGNCAFAHQILIGDGGRRLKEGDGDRKKRLMVAAVLLALLPLVVFTIMDGRQATSMPVQMALEWRRGLLCTFRTRRRGRPGPTTGARMNPSLPAPATGQRHGSQRRRLTVAVPRHACLIRGQ

SEQ ID NO: 147947 - protein, 116 aa, Triticum aestivum
  Clone ID: PAT_TA_42365.pep
QSSHTPPPRCRLAGFVLYQAPKACVVPQFCRWLGRCPASSPLRKPKQRPPQSASVMLGVGFGHLGGRAIGLSSARPRGRCGSPIGSSIEHLCVPGCESRHLAGRVVGSSGTRPQAW

SEQ ID NO: 147948 - protein, 117 aa, Triticum aestivum
  Clone ID: PAT_TA_42366.pep
GRVGSPRARTLLSSPSEAAAGRIKSRWQPRPPRRACVPPRTAATMEGSTGAGQAPGRWTRRIVAPLGQPLPPRWISWQPSLSEMAKLLYTGYGSELADAYCIQCSVASGATSKNTFF

SEQ ID NO: 147949 - protein, 189 aa, Triticum aestivum
  unsure (1)..(189): unsure at all Xaa locations
  Clone ID: PAT_TA_42367.pep
GGCSHSDAIRAFSFSADGALCASAXDGGLVKIWKTDSWRCIQTITSEKRVSAVAISKDGLYVTFADKFGVIWLVTVGGHGEGQVSSDNKPVSIYGHYCSIITSMKFSPDGRFIATADRDFKIRVTSFPKDPVKGAPQIQSFCLGHTEFVSSIAFTSLSGGSSFLLSGGGDSTVRLWDYINGCLLDTYEV

SEQ ID NO: 147950 - protein, 68 aa, Triticum aestivum
  unsure (1)..(68): unsure at all Xaa locations
  Clone ID: PAT_TA_42368.pep
LMCNKNVYLFWTQCVVKFVLYVLYWWVLFNRFNLKRLVFLICPNSFFFSHLKKKGRQKKSEXAWADAW

SEQ ID NO: 147951 - protein, 68 aa, Triticum aestivum
  unsure (1)..(68): unsure at all Xaa locations
  Clone ID: PAT_TA_42369.pep
NKCSLLSSGSCSSSGKDLRYEADPKMGPXHSKSARKEXKKTVQEAHIKARKPKQPKADKKRRKKMAQW

SEQ ID NO: 147952 - protein, 120 aa, Triticum aestivum
  Clone ID: PAT_TA_42370.pep
HTHKAHLPANFLMIMLTHIRRLVAGGGLTKVKASYKLAKAPAAPKKPKTKAPAKKKPAAKKAPAKKPAAKSPAKKKASAKPKAKAPAKTKAAVKPKAAKKPKAAAKTKAPAKTTNAAAKP

SEQ ID NO: 147953 - protein, 72 aa, Triticum aestivum
  Clone ID: PAT_TA_42371.pep
TTHKYLNLGILSAINILKCSNNLGSIFGQLRIFSNVPLNISRVFGNEIVFILFQYPEQEINKRKNKKDQSLT

SEQ ID NO: 147954 - protein, 57 aa, Triticum aestivum
  Clone ID: PAT_TA_42372.pep
IISSKDGTPLPLSSGIRFPGCSVRFYIFSYLRSIGVVIPNSSCSSIRSMLIVHVHAT

SEQ ID NO: 147955 - protein, 116 aa, Triticum aestivum
  Clone ID: PAT_TA_42373.pep
LICIIFNKKYLETTFIYVSNDLLLMRYITFLVSQIHPRTTRMSYAPRPREYWVFHPCTGKKHSSCPFPSPRLLAHCAGSRCGFCCDSSRWIGGRGAFPRRLPANLLNSFEERVDPG

SEQ ID NO: 147956 - protein, 80 aa, Triticum aestivum
  Clone ID: PAT_TA_42374.pep
KTRPPRVPTLHHCLHTIIPNKHRGISVFDEIQLTIQELFTEIDMDIIIMGGWSTQTQRIDISSEMQLTISVVACIASKKV

SEQ ID NO: 147957 - protein, 111 aa, Triticum aestivum
  Clone ID: PAT_TA_42375.pep
MSSCNFEKFKTMKHLLLLLFCAFIVQAQFPTDYDEGQDDRPKVSLGARGHRPYDKKKEEAPSLTPVPPPINRRGYRARPATATVGHKKVERKPPDADGCLHADPDLGVLCP

SEQ ID NO: 147958 - protein, 87 aa, Triticum aestivum
  Clone ID: PAT_TA_42376.pep
FGFRLKYSMFMNRSRTAYMCVQLSQLVSLLKIGTVFLLERTDMPVRCTMRTKYYVLVYHQSHNATVTCVQTIRSAVLYLRLSLMGNV

SEQ ID NO: 147959 - protein, 45 aa, Triticum aestivum
  Clone ID: PAT_TA_42377.pep
HLVGWEHDHGRVHHPHWGSWDEALLVHHITICPYALIPIPDSLSL

SEQ ID NO: 147960 - protein, 73 aa, Triticum aestivum
  Clone ID: PAT_TA_42378.pep
LFCCCFTHLILFKHFMHVWFFPHNYLCNIWFTPNILVLIFESFYCLPIFLNLNLNWFRTNSRLATINEVTWRH

SEQ ID NO: 147961 - protein, 60 aa, Triticum aestivum
  Clone ID: PAT_TA_42379.pep
RTINKSLCYQNKKVLPGSSTTTLTAQIHDEFVHLKHKTMTNAVHRRNKVVHTPTNAVHKN

SEQ ID NO: 147962 - protein, 46 aa, Triticum aestivum
  Clone ID: PAT_TA_42380.pep
AIIKNRFDSILLRLLKLQPRKWSAMCTMESHQYSLRRRIYGITNRW

SEQ ID NO: 147963 - protein, 83 aa, Triticum aestivum
  Clone ID: PAT_TA_42381.pep
FRSDDPNPPVPYIYRLPCPFLDQTVNIRSLVPSSQPPPPVLFPLGSSQIHFLQPAPEAVPPLPSCASSPPPPSSSSNQAVPPP

SEQ ID NO: 147964 - protein, 60 aa, Triticum aestivum
  Clone ID: PAT_TA_42382.pep
YVPDTERLIDHFMDDHQPICHFIYASTCWTHDSDTFSNFDVQDHSVVIYISRTINHSPNL

SEQ ID NO: 147965 - protein, 59 aa, Triticum aestivum
  Clone ID: PAT_TA_42383.pep
VTNTLVRIKCPENQRFPPNGITTDAYSGLKIRLKGIYDGQQVNNPVIPLVSHAGQRRLR

SEQ ID NO: 147966 - protein, 104 aa, Triticum aestivum
  Clone ID: PAT_TA_42384.pep
SFYSFYCRHDCGFYMFQFLQTWDGVRVAKFGVEHIGYIRKAMLYSWLTSRKCCLDFTSLLFFADKGCFIELCYPPFILCLVYCLVPLLYGQVSCIVLYMWAALL

SEQ ID NO: 147967 - protein, 63 aa, Triticum aestivum
  Clone ID: PAT_TA_42385.pep
DLLTKKVYLNLITRNIRLSQQEQLERAESRKKSILNPELIDVQHIKPSSPNPRRLHLNYAISV

SEQ ID NO: 147968 - protein, 69 aa, Triticum aestivum
  Clone ID: PAT_TA_42386.pep
AQQKLGISMPSRVEHIVRNPESESLLIGEPTGEFQDVILFFGIIDILQDYDLSKKLEHAYKSVLIRLTI

SEQ ID NO: 147969 - protein, 101 aa, Triticum aestivum
  Clone ID: PAT_TA_42387.pep
HLAGDASPATKRRSSSSSLMALTIEATVGTTCEHRPRLGPFQSIASSHGRILRRRPLVCDRDARLAVESLHCAGGMNRRDAGRPVSIVREIHSTADSTGVM

SEQ ID NO: 147970 - protein, 80 aa, Triticum aestivum
  Clone ID: PAT_TA_42388.pep
GRDTYDSAEDVVSCTNVDRDVRHDMLLSYYAHDLYVNSSDVVLPINTDAASIRGRLAVQTSSCRDLCARRARVLSRRRRR

SEQ ID NO: 147971 - protein, 59 aa, Triticum aestivum
  Clone ID: PAT_TA_42389.pep
GSTQTPDHPRLQLRTAHVAYDLARCSRVTKNSPTSPLAQLLYLLKYLHRGDFSKRWSSL

SEQ ID NO: 147972 - protein, 56 aa, Triticum aestivum
  Clone ID: PAT_TA_42390.pep
LPGRHNSPPLQEISSRDLRGGIRGKVWLRNPNESSQSWLLFSKRWTLEFRTRYRQA

SEQ ID NO: 147973 - protein, 70 aa, Triticum aestivum
  Clone ID: PAT_TA_42391.pep
PGRRDTYEQSSSSSETNPCTRSPCRPTTPDENRPMSLSAVASFYSLVNHTIHDIIRELTDIDGIDSTVNM

SEQ ID NO: 147974 - protein, 44 aa, Triticum aestivum
  Clone ID: PAT_TA_42392.pep
DYQYEHACFGHCVHMLVAEPAHVLALCYHSDANTTHFRVSRGPA

SEQ ID NO: 147975 - protein, 112 aa, Triticum aestivum
  Clone ID: PAT_TA_42393.pep
YENLLLDLAQIANLLIRHFITENQFPPGCVQELYASLTEPLLPAVPVPSPQAIQKFLKFMRNYPGLKHPRRTSTFISKVFQAARAMGAAQYASVMTAVSRVQVPQDWMNVTE

SEQ ID NO: 147976 - protein, 112 aa, Triticum aestivum
  Clone ID: PAT_TA_42394.pep
KKSEYFCGKHSQVSCGLANIYQEITFMEVVKTNDAPKMLVLKAFWSVDSFFPWCPRMSFHAEIYQAHKTFVKIYHKKHLHFFVFFTIFILLFIREHLSLRAEEHFPVKSVYQ

SEQ ID NO: 147977 - protein, 111 aa, Triticum aestivum
  Clone ID: PAT_TA_42395.pep
RDTDGGRGTNKVCVWDACDRTEDCQRERERDRGRRRGTNLVCVLDACDTTEHYQRQRERDGGRRRWTNTVCVLDACDRSEDYHRQRERHRERDPPRLCVGCVRPNRRLSQR

SEQ ID NO: 147978 - protein, 32 aa, Triticum aestivum
  Clone ID: PAT_TA_42396.pep
KIYHKGKGRINLSYGEYVDRALVLRFLKDQEL

SEQ ID NO: 147979 - protein, 51 aa, Triticum aestivum
  Clone ID: PAT_TA_42397.pep
FAGRPTRPPTRPPTRPLVRSPLTPSYLLNDYPYNSKISREEINGHMLLNYS

SEQ ID NO: 147980 - protein, 50 aa, Triticum aestivum
  Clone ID: PAT_TA_42398.pep
YTTDRSRNIATLSMILIRILCQVISRLIGVEDIYAIIPILFGCELSFMTQ

SEQ ID NO: 147981 - protein, 121 aa, Triticum aestivum
  Clone ID: PAT_TA_42399.pep
SRVDTRLYTESNNVLLVLFAACLSQAKINQDIHFDWVQYTGEIPENAIIGGSTADGDPTYVARSFLSADEDDENYSGSDYNGYVAGGVLPGKLSIDLCTPQSIYTLTKNIEILTVVNGTKI

SEQ ID NO: 147982 - protein, 83 aa, Triticum aestivum
  Clone ID: PAT_TA_42400.pep
TYPIQSSSLQLYKFGGIKDPPQDYGFTIRAGKTDYQIQVKVTDTSQVSTEESRNITTYFQTNTVEVNGINGWGISKWLYQNIE

SEQ ID NO: 147983 - protein, 61 aa, Triticum aestivum
  Clone ID: PAT_TA_42401.pep
VPPNDQIRGQKRTFTAATLCTQEIPSCGVIRSSAGGGINHGGLIHHHHSPSDEVNTTHFRV

SEQ ID NO: 147984 - protein, 118 aa, Triticum aestivum
  Clone ID: PAT_TA_42402.pep
HRSKSTRPQGNAPDLRDILEDKARQSRSIYGSRGRPMIRDDSRRAGHSKSGRAEQNRQSSFELRRDIAQYRGAARPLCFTDEVMDHQIPEGFKPVNIESYDGTTDPAVWIEDYLLQIH

SEQ ID NO: 147985 - protein, 120 aa, Triticum aestivum
  Clone ID: PAT_TA_42403.pep
TTPLSRLVQVCLLTCVLGDLCVVSYWIDTLVLKLMENLIFTLLHHPFLFKGKTNASSRSSGKNFWRRCRGDLCQVKTYQVPIINSHLLHYIIRHSPLIFLSPTYKKIIRLTIGFPIGPRV

SEQ ID NO: 147986 - protein, 35 aa, Triticum aestivum
  Clone ID: PAT_TA_42404.pep
PNARTAKIYAVVIIADDKDGILAVEKYPGSLIIRF

SEQ ID NO: 147987 - protein, 122 aa, Triticum aestivum
  Clone ID: PAT_TA_42405.pep
ADGAGTYCFHIATREWSIAGDWLMPFNGKADYVPELGLWFGIKQAIVPCAADLSCLLRGEELSPDKMRIWEPDDLPEEWQPKSLHNSCAVSLGSGRFIIVDVLDLMKFDKECNDMSPVKELA

SEQ ID NO: 147988 - protein, 63 aa, Triticum aestivum
  Clone ID: PAT_TA_42406.pep
VELSGSIFYLSFTCELDEYLLYVCLFVCNRIPGVRRLLLRVSRFRGSSASHTTHYRDPHRPTR

SEQ ID NO: 147989 - protein, 62 aa, Triticum aestivum
  Clone ID: PAT_TA_42407.pep
VLDAYSGYHYIFMAEEDEEKTAFITPCGTYCFVRMPFGLKNAGSPFARVVHEAFEPQLHRDV

SEQ ID NO: 147990 - protein, 83 aa, Triticum aestivum
  unsure (1)..(83): unsure at all Xaa locations
  Clone ID: PAT_TA_42408.pep
GKYGRVYGDAAEKAXRRLEGFKANVAFNESTNAGNSKFWLEANQFADITEDEFRGTHTGYKPVAVTNKGRSTGFRYANVIRLT

SEQ ID NO: 147991 - protein, 51 aa, Triticum aestivum
  Clone ID: PAT_TA_42409.pep
SSMAQATIISKCHCKYVYFIISRIRNDELIIVTKARDFEFIPAFLIPISPS

SEQ ID NO: 147992 - protein, 39 aa, Triticum aestivum
  Clone ID: PAT_TA_42410.pep
HSRTRYEVSLNAYVSLDHLGRRMHYARKPPSFNTTHFRE

SEQ ID NO: 147993 - protein, 54 aa, Triticum aestivum
  Clone ID: PAT_TA_42411.pep
QSPSYTSLDVVLHCHYRDNLVVTRLSALQHIVISQTRHCSIMAAPITLLNSSPA

SEQ ID NO: 147994 - protein, 49 aa, Triticum aestivum
  Clone ID: PAT_TA_42412.pep
EFYDLQLHNFTPASLLHIAGYVAICELFLGCEAHFGLWKKLFCIVPCNQ

SEQ ID NO: 147995 - protein, 60 aa, Triticum aestivum
  Clone ID: PAT_TA_42413.pep
GHPYSESYYGVSENMIHISANVCETSYTARVATRLSHSRAQSGNGLFTDLRVREVDLLGA

SEQ ID NO: 147996 - protein, 68 aa, Triticum aestivum
  Clone ID: PAT_TA_42414.pep
THRSWVSTITFCSRNSIWLAVASRTSSCVIYNFTTASLRRRPLWTSLRLLHVRQVLGFILLRIIRFLL

SEQ ID NO: 147997 - protein, 80 aa, Triticum aestivum
  Clone ID: PAT_TA_42415.pep
AVQNSMRNHHKLVGRVPCIGSSKIKITQSCPGFSPFSFPRWTPTLLQQALECASAKQCDVQCKVNQEWRMGRALKAATQQ

SEQ ID NO: 147998 - protein, 46 aa, Triticum aestivum
  Clone ID: PAT_TA_42416.pep
QLTKVSRINGNFTFRFPSYTGTVHFPRNIFVLLYFLYRLWGHGPSW

SEQ ID NO: 147999 - protein, 51 aa, Triticum aestivum
  Clone ID: PAT_TA_42417.pep
ISVSSLLMRSTLSRSQRSLIQERFGGADTLSLSQSRACRICETINPDSRFS

SEQ ID NO: 148000 - protein, 75 aa, Triticum aestivum
  Clone ID: PAT_TA_42418.pep
SYYYFGYGEIEKLSDDLADAYLTTMTQAKMKESAILKLWKSSLPKGIDVSKKDATEALKCRSFNVQLSIGNNSTI

SEQ ID NO: 148001 - protein, 78 aa, Triticum aestivum
  Clone ID: PAT_TA_42419.pep
ERSEHFLVLEYFKISKITRICVYFSLIHFYNVQTMFKFRKKLNSNSVFEFSNSQNFETSLSFTRIAFKKNCTCFKITF

SEQ ID NO: 148002 - protein, 87 aa, Triticum aestivum
  Clone ID: PAT_TA_42420.pep
ESYYRRSGLGLGSPPRGGGLPLRRRPLPCALVLATESELLSALRLTVVSMTRRVMLLPFGAAALLSLSCLLIIILRVLGTIGVGILH

SEQ ID NO: 148003 - protein, 78 aa, Triticum aestivum
  Clone ID: PAT_TA_42421.pep
VDEVCPSVRLGRRLCCIGNGNVYAINGDPIPILDRIVLGTLSYVIGVHRSRKIIGHAPHDISFASGELADHDRDPIVS

SEQ ID NO: 148004 - protein, 77 aa, Triticum aestivum
  Clone ID: PAT_TA_42422.pep
MKCYDVSCMLILVFYLFVLPFFFFFFFFFFFFFFFFFFFFFFKPKPKQGCRFVILAKFAHEIQKGNSATPLSVTCYS

SEQ ID NO: 148005 - protein, 61 aa, Triticum aestivum
  Clone ID: PAT_TA_42423.pep
LRFEPFGRPLFFFFFFFFFWFFFFFFFFLFFFFFFFFFFFFFFFFFFCFWSCKPAARTLFF

SEQ ID NO: 148006 - protein, 63 aa, Triticum aestivum
  Clone ID: PAT_TA_42424.pep
IEFGGPFGGVLSFLQGLLKFEPFGRPLFFFFFFFFFWWYFFFFFFFFFFFFFFFFFFFFFFSD

SEQ ID NO: 148007 - protein, 82 aa, Triticum aestivum
  Clone ID: PAT_TA_42425.pep
GVNPIQAGANYVSARKTSGRSKGSKPWYTCARRSRSTLLTEMAPRGAVDRQHNCCCIANFTKYTVCCSFFSRLVAPFFQHVV

SEQ ID NO: 148008 - protein, 46 aa, Triticum aestivum
  Clone ID: PAT_TA_42426.pep
NHLLVIIAEMSHPAEAYVTIPSTRASTASPAIYALSSRTLCGLIRI

SEQ ID NO: 148009 - protein, 101 aa, Triticum aestivum
  Clone ID: PAT_TA_42427.pep
KIEVVGFSPHAYNAGVFAEDAYSHLIQRLGPFKEVIAHRTRQPDYNALTLSLSQRSLTVGLIYSPWWLHTHPDSECVHAWPGNGPSLMRRNTEDSNRSSSG

SEQ ID NO: 148010 - protein, 100 aa, Triticum aestivum
  Clone ID: PAT_TA_42428.pep
ARPPLEYFVFFFSLLNPNKGLVTLYCANMSVSVLIIRYRQRLSSPANSVPERQANQSDVFPARTANWHVTSHRITCVSFHHIRRCATSGIYVVDPSSNGG

SEQ ID NO: 148011 - protein, 75 aa, Triticum aestivum
  Clone ID: PAT_TA_42429.pep
LFYQYNNACLLLLLVMQSSSVYHCLHGCTAPVGVLYNKCTPSKICFQFTLPKNINRASLEGCLVCQKKTKKNTRG

SEQ ID NO: 148012 - protein, 69 aa, Triticum aestivum
  Clone ID: PAT_TA_42430.pep
RFYNLCVCLIYSGDLCAHDNFTLETDLTLISTRSKLTLNSGNYRCSSSAVAAALELVDPPRYRVRHSER

SEQ ID NO: 148013 - protein, 77 aa, Triticum aestivum
  unsure (1)..(77): unsure at all Xaa locations
  Clone ID: PAT_TA_42431.pep
PPXCRNSARASFEFFFFFFNQQETKTTTIAQTWFILVYNANSSSRLAYAMQRETKDTHASRSINQSTYVHPLRSERQ

SEQ ID NO: 148014 - protein, 61 aa, Triticum aestivum
  Clone ID: PAT_TA_42432.pep
VMTISREKLIKCCVNMSKYRIMHVLVTGNSLGLGDLTDHEDRRQEVIRYRCAMIHVRSDHN

SEQ ID NO: 148015 - protein, 102 aa, Triticum aestivum
  unsure (1)..(102): unsure at all Xaa locations
  Clone ID: PAT_TA_42433.pep
GPTGKEVYINQKKKKKKKKKGGGPKGSRLTYPXRQRQTPPKGPPNFNSRAVVXKRRDGENPGVTKLNRLAENPPFATGRNTKKARTVGPSKNLPTLNGKWNP

SEQ ID NO: 148016 - protein, 52 aa, Triticum aestivum
  Clone ID: PAT_TA_42434.pep
GIQAQLRLQHRSSLFYNDTQYSMQFAIILIRPKCEYPCTYTTLSSFITFPIF

SEQ ID NO: 148017 - protein, 50 aa, Triticum aestivum
  Clone ID: PAT_TA_42435.pep
DYDDATMTSSDDLSQPPGVCTWKSLPRVRSETGSFQARGLMLLRLIRLTI

SEQ ID NO: 148018 - protein, 126 aa, Triticum aestivum
  unsure (1)..(126): unsure at all Xaa locations
  Clone ID: PAT_TA_42436.pep
PSDSLKRVVLGLMAGNRAPKRVNNYARIVGRIWAQIPFMCGSSMXSTIDYSLVTIHTTAVGLSMFASGTCITRKSLFVACGYTIASVSMVLTFLIGLVVMLLASLAICMHGTLLHIAVVHAVLALS

SEQ ID NO: 148019 - protein, 71 aa, Triticum aestivum
  Clone ID: PAT_TA_42437.pep
VVVFLLICFYFLLCISILSYIIYHLSQISLSYVTDIGLTTPKHVGCVNLLNFVYVRGTPALPPTGLLLWLT

SEQ ID NO: 148020 - protein, 58 aa, Triticum aestivum
  Clone ID: PAT_TA_42438.pep
LKRINPDNDGTFMPGYAMVMLMKHNLCAAISNPSSYVVVGESGRSNRASKVACRPATK

SEQ ID NO: 148021 - protein, 43 aa, Triticum aestivum
  Clone ID: PAT_TA_42439.pep
HRIIIVISICRFLCTHKYICLSRWTSTNHLAAQVNLFVVQSTG

SEQ ID NO: 148022 - protein, 46 aa, Triticum aestivum
  Clone ID: PAT_TA_42440.pep
NCELLGAHVGLMQTARPSASFAFASYSLSCLCSNQFNSNNNTYMMG

SEQ ID NO: 148023 - protein, 102 aa, Triticum aestivum
  Clone ID: PAT_TA_42441.pep
SESYYRQSRLPAPPSQAPVPTPNNGLCYKCGQRGHRARDCNQNQNQLALAASGRGNKQPRSNNAKSYRRAHAKYVDLNQAHYQPATVIGTLLVNSVPGTGPM

SEQ ID NO: 148024 - protein, 54 aa, Triticum aestivum
  Clone ID: PAT_TA_42442.pep
SNLAGEGVVHMNGHVHHAGAMHDEERVIHRSGMRLYTSSYLYDLSLYVLDMARS

SEQ ID NO: 148025 - protein, 40 aa, Triticum aestivum
  Clone ID: PAT_TA_42443.pep
PFHFESLRLRSDVQFALLDASVTFTFHMLCCVDPQSALSS

SEQ ID NO: 148026 - protein, 53 aa, Triticum aestivum
  Clone ID: PAT_TA_42444.pep
SIPVSHELRSNYGVQSNRKRVGRCALSYENLSSSRDSLWGSYGCEITPIYKSL

SEQ ID NO: 148027 - protein, 85 aa, Triticum aestivum
  Clone ID: PAT_TA_42445.pep
MGYANMQSVGSNIGDGTQCKVYNGKYGDHIVANRVLNSVGTVEELVTLDDRVNRDLDRICQVMHHKLVEFNDSCKDPCIVNATDL

SEQ ID NO: 148028 - protein, 72 aa, Triticum aestivum
  Clone ID: PAT_TA_42446.pep
QLYEHKRLQRSITYNCTSSNSNSDTENNSNGHSNSNVDDSNNNSNCSISSDSSSSSNNNNNNNSNSNNNNSY

SEQ ID NO: 148029 - protein, 56 aa, Triticum aestivum
  Clone ID: PAT_TA_42447.pep
LRLEPFGRPVFFFFYFFFFQVVFFSFFFFFFFFFFFSFFFFFFFFFFLQEQISWMT

SEQ ID NO: 148030 - protein, 83 aa, Triticum aestivum
  Clone ID: PAT_TA_42448.pep
TRLPRQPDHHGPYLPTLSPLKSPPGANPSSTSLFASIFAASTPLPVCSPPPPSQCQAPAVAKVTNEEYLALRIALQRSRVDSG

SEQ ID NO: 148031 - protein, 61 aa, Triticum aestivum
  Clone ID: PAT_TA_42449.pep
HLLLRLHVPRDIHIRLRDPLPEARYLRLLLIPVVSLLPLRLLGLHVPIVRLRFTRNTTHYR

SEQ ID NO: 148032 - protein, 78 aa, Triticum aestivum
  Clone ID: PAT_TA_42450.pep
GDSQERSDGVRSCKYALLYRDLNEINEIMLLFNRQKKKIKKKKKKRTHKMMKTDDTTACDIIALPYYQLNTHHRSSLN

SEQ ID NO: 148033 - protein, 37 aa, Triticum aestivum
  Clone ID: PAT_TA_42451.pep
SSLSYHHTLMMTMIMMTGACTCIEWHQLTNLPNLVTN

SEQ ID NO: 148034 - protein, 76 aa, Triticum aestivum
  Clone ID: PAT_TA_42452.pep
YSESYDKFQGYLSRERERLRQHDRAMMGKNYCRPGLTFDVSPCELYMERSISMRHIIQIIAAFQCHLLLLPPITYH

SEQ ID NO: 148035 - protein, 80 aa, Triticum aestivum
  Clone ID: PAT_TA_42453.pep
RFRWTRSYKSRLTMAELSLHPRLDNSPCWASALFVSSLPALSPSPVVTIEQEHYLAYVIQVAIQQCILTTSNPVGLIRLT

SEQ ID NO: 148036 - protein, 40 aa, Triticum aestivum
  Clone ID: PAT_TA_42454.pep
VVLQDGLLVWEQLWMQFRLVLISWLSRFYDEGMGLSELFV

SEQ ID NO: 148037 - protein, 60 aa, Triticum aestivum
  Clone ID: PAT_TA_42455.pep
YPELHCIISYHVTHQYITHVRRSCHLHRESSSPIYGVPPAHDRIVHRVSIRTDSYCNTTH

SEQ ID NO: 148038 - protein, 89 aa, Triticum aestivum
  Clone ID: PAT_TA_42456.pep
VVLHFPCGTQYDSLYRTDTIFQLKFERLRDSWQGCLHGYVRILCIPCVVSDTLIISGTLGQILRSAVPFECDRIFLCPRDLHRDAYAVT

SEQ ID NO: 148039 - protein, 44 aa, Triticum aestivum
  Clone ID: PAT_TA_42457.pep
YSESYYCLTLHVWELVQQYEHVPVVQWARTADLACLHNSLILSC

SEQ ID NO: 148040 - protein, 66 aa, Triticum aestivum
  Clone ID: PAT_TA_42458.pep
TVSDYGANRKCLYFTNHVCRDSLESVISPQFNCCFSKLCACLNLNVCYNFIHIHQVQTTNTTTHYW

SEQ ID NO: 148041 - protein, 51 aa, Triticum aestivum
  Clone ID: PAT_TA_42459.pep
SCRCHRTCSMANFMIFIHVALDSLHCPVNRPMHSYIVISCSSFGLLIRKSV

SEQ ID NO: 148042 - protein, 55 aa, Triticum aestivum
  Clone ID: PAT_TA_42460.pep
VHKLDKEKALMIFTSIQDVLYRHRSELAHFATYLGHFSYLIRLFSMQNLEVCFEK

SEQ ID NO: 148043 - protein, 69 aa, Triticum aestivum
  Clone ID: PAT_TA_42461.pep
PVYTLSSANLMSTPHLTTLSAFHRAALFALTTLVHTSLLSLTEHRCCPEILMNCHCHHFSMTQPLRLHD

SEQ ID NO: 148044 - protein, 81 aa, Triticum aestivum
  Clone ID: PAT_TA_42462.pep
IVSRIKTYDSRKGVLVTWLTHARVSEEIERTHTTSQDGFLGPLPGRSSLKSRQTRYPSHRPSPSHLQELPFASRLPHPHFT

SEQ ID NO: 148045 - protein, 99 aa, Triticum aestivum
  Clone ID: PAT_TA_42463.pep
PTLCCITLAPSRKTNASSRRSKKDFWQHCQRGLRASQDIAGTQQKPISLAFTLFAICLAFSSRPLQHCRFIEALFPNLRLSFRFPSFVCSFACLTLWAR

SEQ ID NO: 148046 - protein, 52 aa, Triticum aestivum
  Clone ID: PAT_TA_42464.pep
FFFHAIKYYCVLSLYSKTYFVILVSNRKFFMIILSAIKVSNKKFLYENSFFF

SEQ ID NO: 148047 - protein, 58 aa, Triticum aestivum
  Clone ID: PAT_TA_42465.pep
RCMMRIHKPLMRILVQTYISGTFSKVKKNETNIRKKNFMLMCRLFFLAKVSRSYYDSL

SEQ ID NO: 148048 - protein, 41 aa, Triticum aestivum
  Clone ID: PAT_TA_42466.pep
VIQRPCSTVMLQFSRELHYDFLIYKSKHICIIRRPLDMIQT

SEQ ID NO: 148049 - protein, 66 aa, Triticum aestivum
  Clone ID: PAT_TA_42467.pep
WDVITPTTSPAHGPHSFSARCLNSLLRCLARPQQPLVSHLSWSSPSGLPKARGATNVFVPVMIVSP

SEQ ID NO: 148050 - protein, 81 aa, Triticum aestivum
  Clone ID: PAT_TA_42468.pep
SPHSKISSLFCLRLGVGPLRHALAFATGSNICARTTAHRKFLVYALCKRLPLLPRMWCTYFGGNSKMQPKKLKININFICG

SEQ ID NO: 148051 - protein, 67 aa, Triticum aestivum
  unsure (1)..(67): unsure at all Xaa locations
  Clone ID: PAT_TA_42469.pep
PEILSHRGFQALCTATEEILGHIHPXPSCGTLPQIRELQDEXCDVQTAGYGLLKTYHANNEYCPFSD

SEQ ID NO: 148052 - protein, 88 aa, Triticum aestivum
  unsure (1)..(88): unsure at all Xaa locations
  Clone ID: PAT_TA_42470.pep
DIKVKLVTPRTTITESRLQRNRFKIQRCNKFTHKRQYAPISPEGMYRTSAFCTASDXISWTHRLSTAPAGEVRRASDKPLHRISNSRS

SEQ ID NO: 148053 - protein, 74 aa, Triticum aestivum
  Clone ID: PAT_TA_42471.pep
VSYGVELLTQCCFKPVTCSGRGLMDLPAVYPGVGEDGVVAIDMVGRVKSRSLGMIRERLLGRDPAILRLSIGWP

SEQ ID NO: 148054 - protein, 136 aa, Triticum aestivum
  Clone ID: PAT_TA_42472.pep
EDKFLHLDYLSHIEIPYPIHLEILVQLLQYRIQDVPSLHLLRFFLNYYSNWSSFITSMKSIFFLHKENQRLFRFLYNSSVSEYEFFLLFLRKQSSCLPLASSGTFLERIHFSRKMEHFGIMYPAFSRNTTHFRVSH

SEQ ID NO: 148055 - protein, 49 aa, Triticum aestivum
  Clone ID: PAT_TA_42473.pep
RYEHIGTSETDAVQRMHRCLHYDIERIYDGKHYTKCILSSMTGLLTKIE

SEQ ID NO: 148056 - protein, 65 aa, Triticum aestivum
  Clone ID: PAT_TA_42474.pep
YAEDAMTPISETFSLDINAKLDVHTVGTIMTRGHSRIPIYSGRPSNIIGLILVSKLTFSRINCID

SEQ ID NO: 148057 - protein, 143 aa, Triticum aestivum
  Clone ID: PAT_TA_42475.pep
PAACWLVRRIFRHAVTPRLRREGTSCSPSAHLIFIHICKGGGHRSKCVLVEVCAGSCGVLVRAACWFVRRIVRHGVTRRLRHEGTSCSPSARLIFINILKGGHRSKCLLVHAACWFVRRIVRHGVTRCLRSTTHSRVFQRPTR

SEQ ID NO: 148058 - protein, 49 aa, Triticum aestivum
  Clone ID: PAT_TA_42476.pep
TQTQSFTSVARTVYGHDLYTLYPIGYDQVEACVTLIVIRLTLGFPIDPR

SEQ ID NO: 148059 - protein, 74 aa, Triticum aestivum
  Clone ID: PAT_TA_42477.pep
RALARRRHVDTKLRACTATVELPAALQGTSLSPSTISNRCIGISLGAEWVIRQMATPTCDARRFPCVTLRNYHP

SEQ ID NO: 148060 - protein, 56 aa, Triticum aestivum
  Clone ID: PAT_TA_42478.pep
FTEVCVRVVLVYSSNLLAEVASHSLHADRPKVCIFEVKVAGDFTRADNHHFLIRLT

SEQ ID NO: 148061 - protein, 99 aa, Triticum aestivum
  Clone ID: PAT_TA_42479.pep
TVFVAAVDDYMPLRDADDFEGADLSCLELVLPTEGLPASRKPVLRPAGAWMVGDTVNLPRRVPLHGLERDLATLQESEACWKMKISFKRESVDLNTTHY

SEQ ID NO: 148062 - protein, 120 aa, Triticum aestivum
  Clone ID: PAT_TA_42480.pep
VVLREMTLEDFLVKAGVVADGHLTDPIDLPANMGAVGSSVIEAAAPSLNPGAHWLQQYLEPQHPRMAGPFMASHLGPQPLSVATGAIMEPIYPDGQITSPMLDALSDPQTPRRKRGASNG

SEQ ID NO: 148063 - protein, 67 aa, Triticum aestivum
  Clone ID: PAT_TA_42481.pep
ESYYTIHAYEHTNDELAHSSHVSPRSQFTSPPTATGTLATTLTMDNINHHATHHRYGNTGHNCHATT

SEQ ID NO: 148064 - protein, 57 aa, Triticum aestivum
  Clone ID: PAT_TA_42482.pep
ESYYCALLWQGSVVKPAFPRWFGVRKCQTEAAAKKVFLDTKVADYWDMAVNFTEDLS

SEQ ID NO: 148065 - protein, 78 aa, Triticum aestivum
  Clone ID: PAT_TA_42483.pep
PPLKLSLGTLFKGFGLPIRETKAGNFWGAPFFQGNFGVFCSILFLLRLYIFIILLMFFFFFFFFFFCFFFFFLFFLAR

SEQ ID NO: 148066 - protein, 40 aa, Triticum aestivum
  Clone ID: PAT_TA_42484.pep
VSRIRTAARTERSGCQGIGESKSYRIAAPQLNSDRGNDVR

SEQ ID NO: 148067 - protein, 45 aa, Triticum aestivum
  Clone ID: PAT_TA_42485.pep
AGTPGISLARPQSTQTQECKSINARDAAGRDEPAHRCLEHLIRLT

SEQ ID NO: 148068 - protein, 119 aa, Triticum aestivum
  Clone ID: PAT_TA_42486.pep
KVLVLHEPSNIEVSREKFRCLRPHGWLNDEVINLYLELLKERGIREPKRFLKCHFFNTFFYKKLACGKTGYDYKSVKRWTTFRKLGYELIECDKIFGPVHQNVHWCLASINIKGEDSSI

SEQ ID NO: 148069 - protein, 99 aa, Triticum aestivum
  Clone ID: PAT_TA_42487.pep
INSRSIGDGALLLVRRRQPSPPPQPALPRLESPFNRPAPPCLPPGPSLSAAVRRRPPRPPSPTAGLPPPRSLPPPPPSPTIGPRRLCAFSASPTTSHLN

SEQ ID NO: 148070 - protein, 93 aa, Triticum aestivum
  Clone ID: PAT_TA_42488.pep
HPSSPSPASGRCSHGPPTGSWLSHGAAMASTPCALGRSLPSPSSPPMISHLSSLLEMNRTKSCRDGKYLTRKNYRQFHLEVGQAVEIECIVKI

SEQ ID NO: 148071 - protein, 125 aa, Triticum aestivum
  Clone ID: PAT_TA_42489.pep
RRALIGPAAAPSLWLRPRWPTYAARNCYYQALQTFLVTASLQSYCTCCSSKKCSFLISNSINYESEIRLKQEQASLLYKFLNPYVKNISWPWRGPAAPPSTGGGGGWEGGKAPLLVRGPEREREG

SEQ ID NO: 148072 - protein, 83 aa, Triticum aestivum
  Clone ID: PAT_TA_42490.pep
HASGARSRSNERVGDLTVSGEAAPAPRELACISGTGYVGELKNPLLGARRALAHAVYLEAAKLETHREEAVPAVEARKSCIPA

SEQ ID NO: 148073 - protein, 110 aa, Triticum aestivum
  Clone ID: PAT_TA_42491.pep
YKYSVVMVQSQTRPTHMPDQETRPQHQIRFMLIFAASLKCDTFKIDASSFLHATSDWYATWATKARKTSERIGCVAAAPPSPHRAPRLFHKQEKMIIVQKEPPQMKETFA

SEQ ID NO: 148074 - protein, 111 aa, Triticum aestivum
  Clone ID: PAT_TA_42492.pep
HSLLKTSFSGVRLPAAARTPSCVATPRAGAICNSISSSTPPYDLNAFKFSPIKESIVSREMTRRYMTDMITYADTDVVIVGAGSAGLSCAYELSKDPSISIVIIEQSVSPG

SEQ ID NO: 148075 - protein, 70 aa, Triticum aestivum
  Clone ID: PAT_TA_42493.pep
DALDCRGMRPDWPKAYYRQGAALMSLKDYTNACVALLDGFKLDLENAEMESALREAMESLKISKGGAKAT

SEQ ID NO: 148076 - protein, 144 aa, Triticum aestivum
  Clone ID: PAT_TA_42494.pep
MPTAALAAGGEDSRTPRPPQAHTTTAPRRPSHRRRRRTAVAPGFSATPRPWVLTCANPTARADEDALPPPAPTGLCPAGPWRRRGRRREEGRGDRRHDLGFPSRSPRGGAMREGGGGTTTCSSSPRVRPRVRPRVRPRVRPRVR

SEQ ID NO: 148077 - protein, 115 aa, Triticum aestivum
  unsure (1)..(115): unsure at all Xaa locations
  Clone ID: PAT_TA_42495.pep
MNRKPGDWDCRSCQHLNFSRRDLCQRCGEPRSAADRGSVGRRXGGDYANFGGRGGGGSSFGTGFGAGSDVRPGDWYCTCGAHNFASRSSCFKCAVFKEEAAVNGGAGGFDGDMSR

SEQ ID NO: 148078 - protein, 56 aa, Triticum aestivum
  Clone ID: PAT_TA_42496.pep
TTAAAIDLRFTSFFTLPALGSYCCVVSLFALHLYNCIFLPLLGDSLNYSVRCSIPV

SEQ ID NO: 148079 - protein, 57 aa, Triticum aestivum
  Clone ID: PAT_TA_42497.pep
FERINMDWVEHIIKHLLFTVALHNDVLVLEFIFLISINSTYSRKDLHMVSHQFERVG

SEQ ID NO: 148080 - protein, 90 aa, Triticum aestivum
  Clone ID: PAT_TA_42498.pep
QNRRSIFSCCESRTSPFVKMQIFVKTLTGKTITLEVESSDTIDNVKAKIQDKEGIPPDQQRLIFAGKQLEDGRTLADYNIQKESTLHLVL

SEQ ID NO: 148081 - protein, 121 aa, Triticum aestivum
  Clone ID: PAT_TA_42499.pep
IPSRRSLTSLHRRNCKTLLAGNLPLRPSMATFTGAPLPPAGAGKEKPLARPAPATAPADLANPGKKTRRRVPMTDEDRWRIDRLKELHASGTEELHELMDIHKELRDYHDELLFQQRCLAA

SEQ ID NO: 148082 - protein, 76 aa, Triticum aestivum
  Clone ID: PAT_TA_42500.pep
MVTILLTICLSMSVFRIVVLTPALRPLITIFISSWVNSWVNIIVILRPISPPRRRGRRAGVHGAGYSACSSRSAWK

SEQ ID NO: 148083 - protein, 112 aa, Triticum aestivum
  Clone ID: PAT_TA_42501.pep
SYLPHPDKQKSRSGHEHAARGAVLVSLPSVASPDRLGSNSWKNSVCRRWRQRDCLFFKYPCPSSPSLQPFCCFLALLDQACPQSIRARSSSDQGDPIKMKEVEEVSYLRGSS

SEQ ID NO: 148084 - protein, 50 aa, Triticum aestivum
  Clone ID: PAT_TA_42502.pep
TGVGLFTIKLDSGLVKKVAESGVYFSVLPYMSFYTPDRGRFPSLAELTDA

SEQ ID NO: 148085 - protein, 76 aa, Triticum aestivum
  unsure (1)..(76): unsure at all Xaa locations
  Clone ID: PAT_TA_42503.pep
MAHVYYRCFEGGLDYDTVYQSFXNAFYNFGYNIITDMMTDRETGSSRGIWFFTXALHEAMHAVIEVMNDQHLDSRN

SEQ ID NO: 148086 - protein, 69 aa, Triticum aestivum
  Clone ID: PAT_TA_42504.pep
MARTKQTARKSTGGKAPRKQLATTIAARKSAPTTGGVKKPHRYRPGTVALREIRKSQKSTVLFIRKWPF

SEQ ID NO: 148087 - protein, 75 aa, Triticum aestivum
  unsure (1)..(75): unsure at all Xaa locations
  Clone ID: PAT_TA_42505.pep
GFLILQVAATTKKTPNSCTPNYPTXSLPSQLLCQVHNITMHADKDNDXVYAQMTLQPINSKYCRKGSLVKIFMTC

SEQ ID NO: 148088 - protein, 53 aa, Triticum aestivum
  Clone ID: PAT_TA_42506.pep
HDILACSSNRPFFHSFIAPCGSFSFGDGTHGPICAFGNHWKNMRRLGSQVQLS

SEQ ID NO: 148089 - protein, 142 aa, Triticum aestivum
  Clone ID: PAT_TA_42507.pep
RSLITNDKGRLSKDDIEKMVQDAEKYKSEDEEHKKKVDAKNSLENYAYNMRNTIQDEKIASKLPADDKKKIEDAVDAAIQWLDANQLGEVDEFEDKMKELEGLCNPIIAKMYQGAGADMPGGMDEDAPAASGGAGPKIEEVD

SEQ ID NO: 148090 - protein, 64 aa, Triticum aestivum
  Clone ID: PAT_TA_42508.pep
PPPLVLFFITISCLFFMLESGLRGRCLVSWIQPTRSGLNKSPVPLFPLSLPMSLLIIHIFKLLM

SEQ ID NO: 148091 - protein, 85 aa, Triticum aestivum
  Clone ID: PAT_TA_42509.pep
PPTTSVYTDHSPRRRWRYSVGASVPTSTCLSPGWLPSERPPNVLQKSSKMARKAQRSSLGGKRTRTWPSMEPHHSENGTVMQRTK

SEQ ID NO: 148092 - protein, 61 aa, Triticum aestivum
  Clone ID: PAT_TA_42510.pep
YTLTLYPTPSPRKRVLNVMRDYLFYDCLTHARAKDSLTHPLVRNRDRNPWPPPWSPLCWGV

SEQ ID NO: 148093 - protein, 39 aa, Triticum aestivum
  Clone ID: PAT_TA_42511.pep
MLTLTHVHDRVMLYIGYGTLLVRVSHPCSESKSEKWIGV

SEQ ID NO: 148094 - protein, 57 aa, Triticum aestivum
  unsure (1)..(57): unsure at all Xaa locations
  Clone ID: PAT_TA_42512.pep
MEEELTLVGYWSSPFALRAXFALNLKGLPYAYVEEVGLFDEKSPFLLASNPVHKRVP

SEQ ID NO: 148095 - protein, 35 aa, Triticum aestivum
  Clone ID: PAT_TA_42513.pep
PTRPSLSRSAIVTYSSRWMVERGLFSPSILGDRTP

SEQ ID NO: 148096 - protein, 84 aa, Triticum aestivum
  unsure (1)..(84): unsure at all Xaa locations
  Clone ID: PAT_TA_42514.pep
MEEEMRVAVVGAGVSGLAAAHELARAGGAARVTVFEAEXSLGGHARTADVYGVHLDLCLMVFNRVTYPNMLEWFEELGVEMEIS

SEQ ID NO: 148097 - protein, 77 aa, Triticum aestivum
  unsure (1)..(77): unsure at all Xaa locations
  Clone ID: PAT_TA_42515.pep
MGALMFEWELWRRKQSYLMRFVQLVRCWXYXQHPSIERITSPTRPDRARRLGFKVKLGYVIYXIRVRLVGRKRPVPK

SEQ ID NO: 148098 - protein, 108 aa, Triticum aestivum
  unsure (1)..(108): unsure at all Xaa locations
  Clone ID: PAT_TA_42516.pep
SGGQYSDSTTHRAEKSLDMHGDEILYVGDHIFTDVSQSXVHLRWRTALICRELEDEFDALIKSHAXKEKLVTLIXQKEIVGDLFNQLWLALXRRTNFKFLHRNAWLHT

SEQ ID NO: 148099 - protein, 37 aa, Triticum aestivum
  Clone ID: PAT_TA_42517.pep
LQFPHKIVGARNNLLGSAMVCRIMAAGNKLSSCESKL

SEQ ID NO: 148100 - protein, 32 aa, Triticum aestivum
  Clone ID: PAT_TA_42518.pep
GLVIIYLANRCRRRVRTYPNFQARAYVFVGSR

SEQ ID NO: 148101 - protein, 106 aa, Triticum aestivum
  unsure (1)..(106): unsure at all Xaa locations
  Clone ID: PAT_TA_42519.pep
MGGYGDLFEKAKPYIRXMFWLQIGYAGMNVIXKVSLNGGMSHYVLVVCRHAFCTVYMGPFALIFERKVRPKMTWASFLQIFVLALFGPVTDQNFYXYVGLKTTGPT

SEQ ID NO: 148102 - protein, 82 aa, Triticum aestivum
  unsure (1)..(82): unsure at all Xaa locations
  Clone ID: PAT_TA_42520.pep
MVRVVLVAVFAVLAALAVADMASGAVTCCDVTSAVSPCMSYSSGKALAPXGACCSGVRTLNANAFTSGDRKAVCNCRKNLAG

SEQ ID NO: 148103 - protein, 116 aa, Triticum aestivum
  unsure (1)..(116): unsure at all Xaa locations
  Clone ID: PAT_TA_42521.pep
IILRHAVRRLVYRAAVVCSGFMSRRALATAQAPAEAVEDPAFLEAWKKVTTFIEPPHTPMSAMNPXPPTPVSIPSKLTVNFDLPYKSVITDXDVDMVMGPVSFGLMVFMPGHVFQI

SEQ ID NO: 148104 - protein, 106 aa, Triticum aestivum
  Clone ID: PAT_TA_42522.pep
GALEKKPDKRGACDGHRGGVLPPPEDRSATGRPAAGQGQSVSPADRRNREGGACVRTCAAAEEGVEGPEVDARHWESASPWLTILVQRVGDEKSKEQKFGALRKRD

SEQ ID NO: 148105 - protein, 44 aa, Triticum aestivum
  Clone ID: PAT_TA_42523.pep
STRSHESSLNHFFRFDGQDHEHLICAIPCAAVCIHVRTGCFSCF

SEQ ID NO: 148106 - protein, 70 aa, Triticum aestivum
  unsure (1)..(70): unsure at all Xaa locations
  Clone ID: PAT_TA_42524.pep
SVYMAKLAEQAXRYEEMVEFMERVANATVGARPGGSYXLQERIRLFLADKNFIRARGSSWKIIFSILHMV

SEQ ID NO: 148107 - protein, 47 aa, Triticum aestivum
  unsure (1)..(47): unsure at all Xaa locations
  Clone ID: PAT_TA_42525.pep
SVGTNMYDSHSCGEREIHRTMLDLLNQLDDFYSRGVLXVILSTNRIE

SEQ ID NO: 148108 - protein, 77 aa, Triticum aestivum
  Clone ID: PAT_TA_42526.pep
RFLWEKVGVGFHTNAAAYSNTYHYPRQVYSYEQKHPRPTRHYNPLTARRASLARPPGIQTLAPTGDDVLLLPTHIPD

SEQ ID NO: 148109 - protein, 58 aa, Triticum aestivum
  Clone ID: PAT_TA_42527.pep
CEKVLDIHFGCLRAADDLDVGSAAPRIETVLAQCVCDNPMECKALVRSAAYDLVRLPY

SEQ ID NO: 148110 - protein, 38 aa, Triticum aestivum
  Clone ID: PAT_TA_42528.pep
CSSTLLTLSNSSAAVSQKFWCNHRQPTVRDWNSRRNCG

SEQ ID NO: 148111 - protein, 82 aa, Triticum aestivum
  Clone ID: PAT_TA_42529.pep
RLHSHQPGTTVCICTGTKTSIGTYICSNTYICSKAGANTSASIRTSASIRTNTNISTDRLLKPNISTDTLFKPNISTTVCPA

SEQ ID NO: 148112 - protein, 95 aa, Triticum aestivum
  Clone ID: PAT_TA_42530.pep
ADAWADSWFFSLSHAPHHQMKQTRTSFLRRTHRTAPSCVVRSKIPDPTPPVAMAGKELIEEQIALMREAFFLFRLTATVASPPRSLWYLCTSWGG

SEQ ID NO: 148113 - protein, 44 aa, Triticum aestivum
  Clone ID: PAT_TA_42531.pep
YLRKLLENCKSKRIDICPTMVDIIYESLLKFGRHRNKLWHLFRC

SEQ ID NO: 148114 - protein, 46 aa, Triticum aestivum
  Clone ID: PAT_TA_42532.pep
ITAFGCISFSDDIDLLKGSCGKLLAPSPQGCFYWNAVGGLKPYENS

SEQ ID NO: 148115 - protein, 75 aa, Triticum aestivum
  unsure (1)..(75): unsure at all Xaa locations
  Clone ID: PAT_TA_42533.pep
SRDPLWLAWHWSPRSPVLAALAVADMASGAVTCGDVTSSVAPCMFHAVEXASDPSGACSIGVWTLDANAFTPSVR

SEQ ID NO: 148116 - protein, 64 aa, Triticum aestivum
  Clone ID: PAT_TA_42534.pep
GASPGALPKGAGAMPFFSAYFLPLEREWPPPKPHQKGSHLNTAGHDVLVWLGLAGCIDPGCSAT

SEQ ID NO: 148117 - protein, 90 aa, Triticum aestivum
  Clone ID: PAT_TA_42535.pep
APEEECPHMHRHDHSKTVHISGLRCYKAQVELACGILENARVLDHMDVQQGSGSQYSGYADLKNVDGERRFLPGVLEWARLTSDRCGKAI

SEQ ID NO: 148118 - protein, 41 aa, Triticum aestivum
  Clone ID: PAT_TA_42536.pep
SPPAPRLRLYDVGDSTFGHIIIQSKRDRVVLTITGRVRMAV

SEQ ID NO: 148119 - protein, 106 aa, Triticum aestivum
  unsure (1)..(106): unsure at all Xaa locations
  Clone ID: PAT_TA_42537.pep
MEGSSGPRWPRRSSTQEVGSPGGGADLISALPDEVLLLFLARLPCASAAARTSXLSRRWRGLWALLRQIVFRDVPFPSLEAALGRLPPPHAVSLLEICAPEEQWTD

SEQ ID NO: 148120 - protein, 140 aa, Triticum aestivum
  Clone ID: PAT_TA_42538.pep
RTRGTNPPDLYARFIKALYNLLDGTSDNTKFEDDCRAIIGTQAYVLFTLDKLIYKVVKQLQAIATDEMDSKLLQLYLYEKSRSPGRLFDLVYHENARVLLHDESMYRIECCSSPMRLSIQLMEYGHEKPEVTAVSIEPNF

SEQ ID NO: 148121 - protein, 98 aa, Triticum aestivum
  Clone ID: PAT_TA_42539.pep
LAAVPVPPLNQLDLLGIVPPLNQVEEELTRVARYAHGIQRDELYRQELIGAVPQGLEVRMAEDEYADHLSLLSAAAATRRCGGGEEQMVVVSGGPTRP

SEQ ID NO: 148122 - protein, 113 aa, Triticum aestivum
  Clone ID: PAT_TA_42540.pep
SRALVSSDKIKFRSGFVEPELLEEFAASHGLHRIRNSDQHAGRQEGQNESEPEKFRASKRRLRVVQLAPLRLLQVEHLGLARECSRATQEPITEPAARFKKTRNGSKWIQLTI

SEQ ID NO: 148123 - protein, 143 aa, Triticum aestivum
  Clone ID: PAT_TA_42541.pep
PTRPDDSDNNKWEYTLHDVVRSFAQFMAKEEAFVVHKDRADIRNLLPENKLFCRLSIKSIHSELELTILEKQEKLRTLLLIGCKIKSGGSLANFANLRVLDISSEKSDWLVDSLSELRHLRYLSFSNTYICWLPGDIHKMGFL

SEQ ID NO: 148124 - protein, 61 aa, Triticum aestivum
  Clone ID: PAT_TA_42542.pep
HVDFLEIRILFPKAVSTSPQRPLFVPGSYNSYYSTLRILVEWLDLVRLLLEDCNSLFLLRC

SEQ ID NO: 148125 - protein, 143 aa, Triticum aestivum
  unsure (1)..(143): unsure at all Xaa locations
  Clone ID: PAT_TA_42543.pep
ALLPRDGLRKLHHCSLIKGGYCYGPLDPVSNIILNTIWYGTAFPMHQDFEFDFQVDMICTRTLMRIECCSLYGIVAFLRARFSSLSEHDALWHLLLANVDLRLAIEMVQQSGFLIGGTDLDAYKKAAVDSWHXDPDALVKFTT

SEQ ID NO: 148126 - protein, 63 aa, Triticum aestivum
  Clone ID: PAT_TA_42544.pep
HAYYNMEEKLLRELADMGFRQVDLNKEVLRQNEYDLHKSVDDLCGFHEWDPLLAELKELGFDD

SEQ ID NO: 148127 - protein, 96 aa, Triticum aestivum
  Clone ID: PAT_TA_42545.pep
KERGEKIQNYHGVKVGEVLGEDVVLAESMDKHEQADDGYEHGGEGAAGGLASDEDSPSPEGSSPSGPASRRLAPPLAVDIVTLLRCRRVGVWWVGR

SEQ ID NO: 148128 - protein, 80 aa, Triticum aestivum
  Clone ID: PAT_TA_42546.pep
VCGGFYSGIDGGFAPQCGGCPPAALCRHVGAHAGMRLPRGRCLHNGFVEAETPTLGRSHAQVRGTAERRDTGEEMGISGL

SEQ ID NO: 148129 - protein, 97 aa, Triticum aestivum
  Clone ID: PAT_TA_42547.pep
ATRSTTRPQLPNFNWITGVSLGGAVMSLSYSTIAWAASLHKAGKGGPGHVVDYSMTASTTPGKTFNFLSALGDVAFCYAGHNVVLEIQATIPFTPKK

SEQ ID NO: 148130 - protein, 50 aa, Triticum aestivum
  Clone ID: PAT_TA_42548.pep
QNSVNHSHTKKSVLLQRAEPLRKSSNIQVLYGLPILLSYMPINIGLNKAK

SEQ ID NO: 148131 - protein, 137 aa, Triticum aestivum
  Clone ID: PAT_TA_42549.pep
VVGDLRRSSMPRLAGRRTGRRRPALVQEQQREMVRGGAPEKKGEGREETVTCWWCPTAKGAPGNQGAAAEDRARSIWKPWGGAAGMGGSRERRWLTQGENEEGEGGLGWCGGEHEEGMDLDPEEDTVGGGGSTGQSP

SEQ ID NO: 148132 - protein, 133 aa, Triticum aestivum
  Clone ID: PAT_TA_42550.pep
VNLQKAHVPYDPEEIAIAGESFASELEETANLQDLYLNMNEWSSPRYLSHISSRIQEYQDLVMDLQADICKKDSEIGWLRPELDELERKNMELEEKIGRNGSCREGCFTTRKGVSTEVFMDLHERSSKCIHDF

SEQ ID NO: 148133 - protein, 110 aa, Triticum aestivum
  Clone ID: PAT_TA_42551.pep
PRVRPRVRGRVGRHQPALRTPAALLCPNPNPAAASIPPPPASSSSSAAAPAPHLLSLDPRDKVWGYGREGSISRDKVRGRPDPQWHHRALVYLALEVGHGGPARPMDGWG

SEQ ID NO: 148134 - protein, 87 aa, Triticum aestivum
  Clone ID: PAT_TA_42552.pep
IEPLTEPRQGGHHRNYRGRRGSGQEGGSQPSRSCLTWRLGHCHCHPASDVRSSPHQATTRCGFGHHHTKQLQGVGVMAHRRMLGCGQ

SEQ ID NO: 148135 - protein, 38 aa, Triticum aestivum
  Clone ID: PAT_TA_42553.pep
ILFKSHCIRAYTLHRPARKVGSSRTTPQHSLVLVTPCP

SEQ ID NO: 148136 - protein, 60 aa, Triticum aestivum
  Clone ID: PAT_TA_42554.pep
PHLGSPSSPPEPAPPSPPPPLRPPPPRYHAAPSNAAAPPTLTRPPSLPHRGSPGRPWRTA

SEQ ID NO: 148137 - protein, 128 aa, Triticum aestivum
  Clone ID: PAT_TA_42555.pep
MSDDWQPKSVGNTSGSVQQLPKYRRLRKCGDKIKRVSLLSLNERYNGSVGEQCDQMEHDVGNRRKAKRRMDIYIDEEVEVSEDADISLDEDDDRGEDKYEDSYIDDQTTPTGQFTQSEQGGEYSNTND

SEQ ID NO: 148138 - protein, 74 aa, Triticum aestivum
  unsure (1)..(74): unsure at all Xaa locations
  Clone ID: PAT_TA_42556.pep
HEPDLGSVLARSSMGGSALLGGXLALQLLHAARGEIKTTPIVSDSRSRILLEEFGFKPRGVAQVNVFGVLWSVP

SEQ ID NO: 148139 - protein, 97 aa, Triticum aestivum
  unsure (1)..(97): unsure at all Xaa locations
  Clone ID: PAT_TA_42557.pep
MSSSGAGEEGAAAPQGPLPVEHRKGANGLDKVVLREARRISREVYLDGGHVTSWKDEHGEELLFVSNKAIFKPSKAIRGGIPILLSXFSNFGQLEAH

SEQ ID NO: 148140 - protein, 96 aa, Triticum aestivum
  Clone ID: PAT_TA_42558.pep
HSQVDAMLHKLEKEIDDVYARIGNRWQVLDRDRDGKVTPEEVEAAAGYLKDTMGKEGVQELISNLSKDREGNILVEDIKKMASQTEENSKPEETAR

SEQ ID NO: 148141 - protein, 81 aa, Triticum aestivum
  unsure (1)..(81): unsure at all Xaa locations
  Clone ID: PAT_TA_42559.pep
LLTPSLRPPTRSPYTPFVDAIPKQRLMIPPLXDPARGRGTRDVATMVIPFLMETTFEQPSPNLASILYKNSIMYSLRIFLV

SEQ ID NO: 148142 - protein, 79 aa, Triticum aestivum
  Clone ID: PAT_TA_42560.pep
HSFGRLMLLIIGAMRLTVRPKLATVLAILIAMAVGRYLLHYVVYYTGAIACALFLVITDRMTDRPLSTAGARVREAAHN

SEQ ID NO: 148143 - protein, 56 aa, Triticum aestivum
  Clone ID: PAT_TA_42561.pep
HASAKSRNPKHATRKQSNREMRLPHMSSSDQDTGKTIVISRRTKRIKSYRGGSQQI

SEQ ID NO: 148144 - protein, 41 aa, Triticum aestivum
  Clone ID: PAT_TA_42562.pep
TIIYSCTRHTRSLVLRFIYITQSVLSRSVILVKLHHSHRVS

SEQ ID NO: 148145 - protein, 112 aa, Triticum aestivum
  unsure (1)..(112): unsure at all Xaa locations
  Clone ID: PAT_TA_42563.pep
MNSYSGDRSSSRPTTTSFDSYQFDFGANASRSSTSRPLRDQRPGGATNPSPRPTTTNTWSHQPVKTSWTHQPSPSAAAALGSGPVSMVGDISGRSWSXTAPSXGIGPPQSNN

SEQ ID NO: 148146 - protein, 121 aa, Triticum aestivum
  Clone ID: PAT_TA_42564.pep
LEALNEASFGTSRRHSGTERALNDPLRDNEGMLVDEYGSNTGFHLPNLICVKLLDEEGSSSEDRSFEAVTPEHESTGAEQGEGSQLDGAKHRLVFEEVNGDLEMEDVAPSFEAEATSACQQ

SEQ ID NO: 148147 - protein, 97 aa, Triticum aestivum
  Clone ID: PAT_TA_42565.pep
KASRMQFNISSFLISFFGLTVHLNPQKHTNINPSVQAPTHKKEDNLNTQHSCTYQQEWQIRSLRLGCTPQRTRGTRHIADVIISLCRASSIPPGRVG

SEQ ID NO: 148148 - protein, 145 aa, Triticum aestivum
  unsure (1)..(145): unsure at all Xaa locations
  Clone ID: PAT_TA_42566.pep
PTRPPTRAHAIISLLPKSFDAMRVKDFRPISLMHSIAKILCKLLANQLAPFLHILVPQSQSAFIKTRSIHDNFLYVKNAVRSLHKSKTAALFLKLDIAGAFDXVSWGYMFKLMTAMGFGHRWCDLMAVLWRTSSFRIMVNGGLGL

SEQ ID NO: 148149 - protein, 51 aa, Triticum aestivum
  Clone ID: PAT_TA_42567.pep
QVLTSKSLVCFVTSKKNLSGLWMKLSGTIEAFNPQLILNHAVIFSPFVPPP

SEQ ID NO: 148150 - protein, 39 aa, Triticum aestivum
  Clone ID: PAT_TA_42568.pep
NCTATMHSPGPALKSLQYRPPFGTDSLYLVILPLPPIIV

SEQ ID NO: 148151 - protein, 65 aa, Triticum aestivum
  Clone ID: PAT_TA_42569.pep
NSILESHSNGNPFLEVQLCHLIYFQIKWRSYTTLPFARQTYKPYSCMVPSAYTSQGSPNRRKVIR

SEQ ID NO: 148152 - protein, 40 aa, Triticum aestivum
  Clone ID: PAT_TA_42570.pep
AHRACEWTGRYRWGRRWCARGPGLRRLERYRHSTPPQHRG

SEQ ID NO: 148153 - protein, 72 aa, Triticum aestivum
  Clone ID: PAT_TA_42571.pep
HAFALVLAGSGHNFWSHGPPGTGMRLFVTCDPANIRHIFTTNYTNFPKGAKFASFFDIMSGGISTIDGEPFC

SEQ ID NO: 148154 - protein, 45 aa, Triticum aestivum
  Clone ID: PAT_TA_42572.pep
GLTLAITTAKFPIHKERTFAHTSCNVTGLDTGLSRCHPAWDGTGT

SEQ ID NO: 148155 - protein, 64 aa, Triticum aestivum
  Clone ID: PAT_TA_42573.pep
ESRTAMTISSSLSGGWATPAPDHRKSTLLSAAMLVALSGWSALPAQQVPHLTSSSLADRSPDLI

SEQ ID NO: 148156 - protein, 94 aa, Triticum aestivum
  unsure (1)..(94): unsure at all Xaa locations
  Clone ID: PAT_TA_42574.pep
MEILHLEEIPKHHIVKRWTRDARDILPDHXVQYQRDNSVNLSFTCRHATMYLKAMEVVRMGDASATCYDHVYAGLGSLLLSGAPLAEKRDCIVI

SEQ ID NO: 148157 - protein, 126 aa, Triticum aestivum
  Clone ID: PAT_TA_42575.pep
NKFLCSTRKCILVSCPISGDNIPFRPRFDKFLKRVLPLLLFPALTPRISTCSLFRSAIKSPDAHRSRTLKTTSSVLARQPAILAGNCPTQRTATRRIDAPRTTASLLVSPFTSLPVHGLPPPTLKM

SEQ ID NO: 148158 - protein, 63 aa, Triticum aestivum
  Clone ID: PAT_TA_42576.pep
ETLTFELWRVGIHWPSREEVNTCSPQCGDVTGVHVCVRYDDEPLIYSRSVTQLRVGLTGGWTE

SEQ ID NO: 148159 - protein, 53 aa, Triticum aestivum
  Clone ID: PAT_TA_42577.pep
RHQKTTSFIGAITKPAPPVILHQMKSSGREGIPYAPTACGRKSTVVKVSFGPR

SEQ ID NO: 148160 - protein, 145 aa, Triticum aestivum
  Clone ID: PAT_TA_42578.pep
PRVRSPIDACGCPLYDFTVGLSLYEAWTVGPPFSLPVLATPSPFRRRLSSASALRMRDHTITDNMAGSSGRAPDAPNLPYHARLWRERDDRLGHLPWSSEAPNKRQDRRRRKGARPRDGRLRITRPRCCHGSQTRGASGNAPSLP

SEQ ID NO: 148161 - protein, 97 aa, Triticum aestivum
  Clone ID: PAT_TA_42579.pep
HAFALFLEASSCPGEGLNFSAMKFLMQPISRISLIEEVDESTTPMDLVACGTGGVVPLAADVSVPVMNADARSVREKRLVRSGLKRHRRHPSSPPAR

SEQ ID NO: 148162 - protein, 146 aa, Triticum aestivum
  unsure (1)..(146): unsure at all Xaa locations
  Clone ID: PAT_TA_42580.pep
ERTKDLMKPHELERVETGCSIMTDAWTDKKRRSIMNLCVHCRLGTAFLESKEASADAHTSLYIFNYVVGCIEKIGAENVVQVVTDNASNNMGAKDMLKGKWPKIFXTSCATHTLNLMVEAIAKLKQFGPTITKARQMTIFLYAHYK

SEQ ID NO: 148163 - protein, 96 aa, Triticum aestivum
  Clone ID: PAT_TA_42581.pep
SNPPTISPRNLLRSKRSQGCLVPLLKMHIFVKTLTGRTITLEVESYYTIDIVKAKIQDKEGIPTDQQRLIFVGKQLEDGRTLADYNIQKESTLHLV

SEQ ID NO: 148164 - protein, 95 aa, Triticum aestivum
  Clone ID: PAT_TA_42582.pep
PRVRSNFVVPPGVITIPRAPPTPKMMSSVSAVAPSPAPVRSPFALIFPVLCPSLSLLRSYCGSRGGTSRPSSFSLFHLFCFFLFYWLFVIFNSFV

SEQ ID NO: 148165 - protein, 76 aa, Triticum aestivum
  Clone ID: PAT_TA_42583.pep
PLPLSKCTQNFHIIVLVSMQSPCDGTPQYTMHQTAVVNPLNGHNTSYYVLDIYGAIALATSPHPTFGFQPVHIFRP

SEQ ID NO: 148166 - protein, 89 aa, Triticum aestivum
  Clone ID: PAT_TA_42584.pep
PPPPRPPASLEPQRSTPPSTRSTSTTDSRARGWRPADPLPEPGRRSRRNASSRSRRSCSSSSCRGSSSSSGRSSRTRRCQLSRRPSSSC

SEQ ID NO: 148167 - protein, 111 aa, Triticum aestivum
  unsure (1)..(111): unsure at all Xaa locations
  Clone ID: PAT_TA_42585.pep
QIFVKTLTGMTITLEVASFDSIVHVKAYTQDGEGIPADQRRMILFGXLILDGRTSAXYKIRKGFTLHLGPMLQGGLQIFEETLTGLTIALEFEFFDTIDMVKAKIQDKEGF

SEQ ID NO: 148168 - protein, 85 aa, Triticum aestivum
  Clone ID: PAT_TA_42586.pep
LTSCLIQRLLVPVCEHASKVWCTISKMYKVFLIIQSTFQDKFLLPFGDESSEMVIVRYYWRAVLGFYFPGLVAECRERAVHHVRP

SEQ ID NO: 148169 - protein, 140 aa, Triticum aestivum
  unsure (1)..(140): unsure at all Xaa locations
  Clone ID: PAT_TA_42587.pep
PRVREEPSTTPLHLAKWELQKKNFFMQAPAKLTACDYHRDLDMVVVGFSNGVFGLYQMPDFVCHCQLSISREKITTAIFNSLGNWLVFGCAKLGQLLVWEWWPETYILXQLGHYFXVNRIAYSPDXSLLLPGADDNIVKV

SEQ ID NO: 148170 - protein, 70 aa, Triticum aestivum
  Clone ID: PAT_TA_42588.pep
LVKAHASAINKVRHGTIKSTNHPHAVLNQMHASDCEREREITMCITLIESPPCNARRRGRAEKERRWSEG

SEQ ID NO: 148171 - protein, 32 aa, Triticum aestivum
  Clone ID: PAT_TA_42589.pep
LVFIFSANKRHSTIVIMVVTSNSTYALGMTFW

SEQ ID NO: 148172 - protein, 66 aa, Triticum aestivum
  Clone ID: PAT_TA_42590.pep
ILNARSCSHSLGFLPILQFIATPYTFVTFYCAISNMVEIVPSLKGGGAFWFTDLTSSDALCIFPMI

SEQ ID NO: 148173 - protein, 48 aa, Triticum aestivum
  Clone ID: PAT_TA_42591.pep
RSSSRCFNRRSIWSRRPSRLSADGGTGRALMSTRRSDASSTSSARTRE

SEQ ID NO: 148174 - protein, 68 aa, Triticum aestivum
  Clone ID: PAT_TA_42592.pep
FTSMLLEVTMALFRLKFILLQITGRYFGSLMITVHLVQQRTIFLTDFICSTKLYIGYSLLLRIYLILC

SEQ ID NO: 148175 - protein, 95 aa, Triticum aestivum
  Clone ID: PAT_TA_42593.pep
ARRMMKALSELQDLKGSPPVQPHPQAGAGLLLADLGDQGGTTPGKGGRRIRGGLRHGGRSGQERGRRRTGLGQERKTACDSGPLGLACSCMLGAN

SEQ ID NO: 148176 - protein, 106 aa, Triticum aestivum
  unsure (1)..(106): unsure at all Xaa locations
  Clone ID: PAT_TA_42594.pep
RGHGLVSTPWGVYDMLLRQDLFPVNIKMFVLDEAGVMLSLCFKDHNFDIFLLLPGKIQVGVISTTMPSEALVITLXFMNKPLMILVKRDELILVGIKQFYVNVENE

SEQ ID NO: 148177 - protein, 85 aa, Triticum aestivum
  Clone ID: PAT_TA_42595.pep
LNLKSLMMSGFEEKDKVTNYIRLVMERAVGLKRIEMYGVHPCEKCDATDPTRSQVNEACRRGVKERLTHGSYSTVEILIMYYIVS

SEQ ID NO: 148178 - protein, 48 aa, Triticum aestivum
  Clone ID: PAT_TA_42596.pep
MGASAATGMQMVAPRPCIPACQRMLGSRSVVSAFRRALSTRTGFASCV

SEQ ID NO: 148179 - protein, 31 aa, Triticum aestivum
  Clone ID: PAT_TA_42597.pep
PAKEWTINFYNCNVGDHLYSDRSRRVIFYDL

SEQ ID NO: 148180 - protein, 53 aa, Triticum aestivum
  Clone ID: PAT_TA_42598.pep
SAVTPLACGLPLTTLGLETGGQPKVRLCLSPSPSSSFRPLSPYQSYSRVSRSS

SEQ ID NO: 148181 - protein, 42 aa, Triticum aestivum
  Clone ID: PAT_TA_42599.pep
MLSTATARSHDLYANGEIPQPASGKKLEAAKEPTKNLDRQGK

SEQ ID NO: 148182 - protein, 60 aa, Triticum aestivum
  Clone ID: PAT_TA_42600.pep
WTLRRHGRLLSGTASTLSLKLDLGNVAKMVLPIIYAKTAVFFSFLSGTRRISVLVGQLRL

SEQ ID NO: 148183 - protein, 57 aa, Triticum aestivum
  unsure (1)..(57): unsure at all Xaa locations
  Clone ID: PAT_TA_42601.pep
FIVPELSPSTNFLYASHKAVSEYNEAKALGVDTVPALVGPVXYLQAFKAAMGVEKSF

SEQ ID NO: 148184 - protein, 58 aa, Triticum aestivum
  unsure (1)..(58): unsure at all Xaa locations
  Clone ID: PAT_TA_42602.pep
HASAHAFAHASGLPDRQWRVSELQQQFEGKTVLLGVDDFDIFKGINLXLLAFENMLRT

SEQ ID NO: 148185 - protein, 51 aa, Triticum aestivum
  Clone ID: PAT_TA_42603.pep
KKISRARHGLIYSRPVSLAMAELIYYAGANLQRVRRSFCDDTQKAVGLAAI

SEQ ID NO: 148186 - protein, 64 aa, Triticum aestivum
  Clone ID: PAT_TA_42604.pep
QVRCGVPTPPWSPDSRSWSPAYATGVTNSTSTSTRRHRTSSKILLAEAVSAVPLVLRLQIRGAL

SEQ ID NO: 148187 - protein, 53 aa, Triticum aestivum
  Clone ID: PAT_TA_42605.pep
RVSERASAIHHSSFSCFQETLEFFLDWSCRRLVWLFMNVGWGSDICTVSEMML

SEQ ID NO: 148188 - protein, 106 aa, Triticum aestivum
  Clone ID: PAT_TA_42606.pep
NNPELHDFFAKVCSEMVGPNNVREKQPLMGAEDFSFYTEAVPKTYYYFVGMLNETRGPQAPHHSPYFTINEDALPYGAAMQASLAARYLLEHQPATAAKVEPRDEL

SEQ ID NO: 148189 - protein, 40 aa, Triticum aestivum
  Clone ID: PAT_TA_42607.pep
YIKHWHCCTKHYFIETRLPERLYKKTNINLSCSFLIIGRV

SEQ ID NO: 148190 - protein, 49 aa, Triticum aestivum
  Clone ID: PAT_TA_42608.pep
LLVSTKSSSPNKYQSFISMLEQGIKDSSGAAPSCRLLATRQTSTSPNKH

SEQ ID NO: 148191 - protein, 52 aa, Triticum aestivum
  Clone ID: PAT_TA_42609.pep
KKNRTERCPRRRPNRLRRQHGGGRGLGFVDGTTWCVSVLSGQGDGLLGRTRG

SEQ ID NO: 148192 - protein, 73 aa, Triticum aestivum
  Clone ID: PAT_TA_42610.pep
KLKQILVLSLIHTGVLLGTEEEVLGVISVLLLLGGNHMLLREGPDLSPQPLEVHRLRHTAPSPPRRPSRRDAL

SEQ ID NO: 148193 - protein, 78 aa, Triticum aestivum
  Clone ID: PAT_TA_42611.pep
SASSRYGWALRLRRPGPRRRRVGGQEVVGRACRHARTSSGARRRIEGGRAGGRVGAVGAAARRRRRRRAPWRTVRGLA

SEQ ID NO: 148194 - protein, 90 aa, Triticum aestivum
  Clone ID: PAT_TA_42612.pep
GETSPPKPERRPHIFPGYRVPLFTDLNVSPALPPGNPHMLVSTNSLHQEILYAVPPCKALLCVCKNFLLQVHLWCVPESVHPCISISHAW

SEQ ID NO: 148195 - protein, 100 aa, Triticum aestivum
  unsure (1)..(100): unsure at all Xaa locations
  Clone ID: PAT_TA_42613.pep
MDSALASAEAIVDQLQKNEQYRHILVYVILSSPPDMPQAMRFLNHMVSDEVPIVELWQLLYTFVLELGKLEPDSXREVAHYALTQIQSVVGFLVEHVVVD

SEQ ID NO: 148196 - protein, 80 aa, Triticum aestivum
  Clone ID: PAT_TA_42614.pep
YYTNIKRLMKIGVLVDEADIMVADELDVLYGAHTHKKRFMIVGILCVILGTIMYDYPLTIMGKVIKTKSVEYMPYTLSLG

SEQ ID NO: 148197 - protein, 73 aa, Triticum aestivum
  Clone ID: PAT_TA_42615.pep
LQRRPAILIQHTTPRKSLSSLLLLLLTSAGGHSTMAATLFDCAWEWQISNFSKFQLATVITFVLYESVFFQLR

SEQ ID NO: 148198 - protein, 43 aa, Triticum aestivum
  Clone ID: PAT_TA_42616.pep
MLVDGLSLQKADAHTGQLPPSGVLRHASVCERCHGRCSAFKVV

SEQ ID NO: 148199 - protein, 91 aa, Triticum aestivum
  Clone ID: PAT_TA_42617.pep
DWRRHLQYLHQIQHQFVAGKSPSSLNYITQSDPDFNIYSTGHRNYLCEISKKTKTFCKIPVICWNVLMKILVLVLFFYKISICAVSMLSLG

SEQ ID NO: 148200 - protein, 61 aa, Triticum aestivum
  Clone ID: PAT_TA_42618.pep
HTCLNLPSYIQADSYKAWGTKCFINLPHPGPNPGPKSFLPMKPMPPPGPSKGMPTPSLPMP

SEQ ID NO: 148201 - protein, 104 aa, Triticum aestivum
  unsure (1)..(104): unsure at all Xaa locations
  Clone ID: PAT_TA_42619.pep
MEVRANHPLVMHKYAEQVHLACNYLEGDRAHNILPFGPYNERRITTSSYMTDNLGISVPMMPYLPLFANAPAEKKGVKNFAXDLLMGGVSAAIGKIDAATIERD

SEQ ID NO: 148202 - protein, 52 aa, Triticum aestivum
  Clone ID: PAT_TA_42620.pep
SLTAGTCWTPPPCLPSPIIHGVLDGLIGIFCSQEVIDDHYHVQDLLVIVDKM

SEQ ID NO: 148203 - protein, 76 aa, Triticum aestivum
  Clone ID: PAT_TA_42621.pep
GCDRELVTTAELSWFVKRSRAYAAGVKASVWGDELELYQTKGDGHVYFLYKTDTDNAAKELAVVSDFVRRCRVCFI

SEQ ID NO: 148204 - protein, 111 aa, Triticum aestivum
  Clone ID: PAT_TA_42622.pep
TPYLPHVQSPCPHCFLPPRSLSLASRHWWETLAHYPNQHSRCCCSTFFLVPLLPSPQPQPRGFCVRFDEIHHLARFSSALGCEDATGGGVTFLLDWFGGGAQPARLLAVEG

SEQ ID NO: 148205 - protein, 62 aa, Triticum aestivum
  Clone ID: PAT_TA_42623.pep
RRRITSSGPVSGLSASIRRRAPAPTWPRSASLVSRTTLPTSVALRRWKSSRSLRDAPSSSSP

SEQ ID NO: 148206 - protein, 103 aa, Triticum aestivum
  unsure (1)..(103): unsure at all Xaa locations
  Clone ID: PAT_TA_42624.pep
NWKGICKCLVEVVSEETDAFXLYIKKCIECLLPWLNVWHEXSTQESEDEWTAAIKRLIEDDKSSSQDTLQLHSTTCLSEGIHEYPSRNIIIRTGLCFAVCLSA

SEQ ID NO: 148207 - protein, 36 aa, Triticum aestivum
  Clone ID: PAT_TA_42625.pep
HPIGVPYASDLHPLMLWLMTTPPCGDMLILADPKLP

SEQ ID NO: 148208 - protein, 84 aa, Triticum aestivum
  Clone ID: PAT_TA_42626.pep
RGEWIWLQNKYSLHVASSIKSGMNELPMCFKLAFKFGVWCLKTRAPSLINGLYWKSNITRFRSKLKLCIFYSSLSWFPVLTYLN

SEQ ID NO: 148209 - protein, 50 aa, Triticum aestivum
  Clone ID: PAT_TA_42627.pep
STYELKHFLAHPAIKNEDYSLEPTQWNDDPTSSAMPIMSITPLTIDTSPK

SEQ ID NO: 148210 - protein, 117 aa, Triticum aestivum
  unsure (1)..(117): unsure at all Xaa locations
  Clone ID: PAT_TA_42628.pep
HAFGNQELKSDLKDLYINTAIQMDVVGNRKAVVIHVPYRLRKPFMKIHVRLVRELEKKFSGLDVVFVVTXRIVRPLKKGSVVXRPFTRTLTAVHDGILEDVVFPVEIVGKRCRFLLD

SEQ ID NO: 148211 - protein, 58 aa, Triticum aestivum
  Clone ID: PAT_TA_42629.pep
VRFVDTRDPPQPAPTSIPMRVSPKTACATLAIACSPPRVLCHAGGDGGGNPSIGCGVR

SEQ ID NO: 148212 - protein, 66 aa, Triticum aestivum
  unsure (1)..(66): unsure at all Xaa locations
  Clone ID: PAT_TA_42630.pep
IISPHKRLGRXLNMFVFCCSYTHNDVLIGKMIVFVFADAETYNLESELKPGIDLLGSVDELIFVIV

SEQ ID NO: 148213 - protein, 73 aa, Triticum aestivum
  Clone ID: PAT_TA_42631.pep
VLEYWRSPFTGSGLGSLSKTSYLGQSRLSTGLLFKLLTNMLLSKLRTLPLLVISLWLLLISMSYLGLCLEFGF

SEQ ID NO: 148214 - protein, 60 aa, Triticum aestivum
  Clone ID: PAT_TA_42632.pep
SYHLGVVGIRIHVGKLGWKFNRHDNDHYDDRHKSSTKTKSDSATYVVSSHKSSIKISRKS

SEQ ID NO: 148215 - protein, 118 aa, Triticum aestivum
  Clone ID: PAT_TA_42633.pep
WATPSTPPDGNGWPQFSLPGNRASLTAGTRPRPQPYPWMASPWRTASGWPPRRSWACYTYTAAHPLICKPGRTAIPKICHAWSASVRRDGLNSIAPDYTDGTHSNIDCATPVSRLARR

SEQ ID NO: 148216 - protein, 130 aa, Triticum aestivum
  Clone ID: PAT_TA_42634.pep
IASNSSINSVNNMRCFSHHELVCVECSVIHLSILNHPRMPRMTPHAGLHREEDIWLIEYSILLAIMLLLACPARPPPSTPRGAPPAAPAGEPPSTADPDHIHCSTNPAASTQRCRTHHRSLPSPSEPDAW

SEQ ID NO: 148217 - protein, 40 aa, Triticum aestivum
  Clone ID: PAT_TA_42635.pep
PSLLGRQGGGIERTRSTKAPDPDKNAEKDKVLRLMLCGLS

SEQ ID NO: 148218 - protein, 111 aa, Triticum aestivum
  Clone ID: PAT_TA_42636.pep
PPCTAPRVGGRSSFNVVAQSDLPESRAPCTITTTLCCSALTTQSYGRRSESPTNTWSPERTSCLRRSSSPAFTIPTRPMGSTGSPTSTRTAKPGGARTEPVPSGSGGAQGC

SEQ ID NO: 148219 - protein, 56 aa, Triticum aestivum
  Clone ID: PAT_TA_42637.pep
AYQVEVGKNNQSIPPNYLTDWSCRTTKKRWANLKVSSIEMRGLRVPQEHLIKLLVD

SEQ ID NO: 148220 - protein, 113 aa, Triticum aestivum
  Clone ID: PAT_TA_42638.pep
GSIRLRLRADHIRRRRGPRGEGRRTVFLLHRPPRRPTRGKTPPPPCETPRQGRARSRCGQRGAARRRRRMCSQLAREEGSGYDIFMRGQVLCRSRAAATTNVELLKRIWPLVV

SEQ ID NO: 148221 - protein, 112 aa, Triticum aestivum
  Clone ID: PAT_TA_42639.pep
SVLSSLASFHRTMGLPALNRLMSMQRDRRLRPTQGRNGLVTSSLAKRKDSPCIHDENSRLDKKSRYSGPPLLEDIWHHITFSAFFARCCTCCLRVFIHLVSSWSCLPNLNFN

SEQ ID NO: 148222 - protein, 110 aa, Triticum aestivum
  unsure (1)..(110): unsure at all Xaa locations
  Clone ID: PAT_TA_42640.pep
MADRANHPSVMQKFGGQFHLAFSYSEGVRARNICPSVPSYERRVTTGSYMTHNLGISVPMMSSSPLFVNAPSXKKGVKNFXFDFLMGGVSAXISRLMQLLFERVELLFLN

SEQ ID NO: 148223 - protein, 39 aa, Triticum aestivum
  Clone ID: PAT_TA_42641.pep
VETLSILRYHGVHREELRKHGDPDAEDMHEDGEEKAPRT

SEQ ID NO: 148224 - protein, 36 aa, Triticum aestivum
  Clone ID: PAT_TA_42642.pep
SSSDQSYPVSIIFELGIRGSGLLCSWLLLWSYRAYW

SEQ ID NO: 148225 - protein, 87 aa, Triticum aestivum
  Clone ID: PAT_TA_42643.pep
RPSPQPALPPRLRHRPMPLPACPLRGGHLPTPPPARPPRRRPRSIFSSALPSRGERLTRPRWATVTLRRPCSPPSMALRRFPGRGRL

SEQ ID NO: 148226 - protein, 135 aa, Triticum aestivum
  Clone ID: PAT_TA_42644.pep
MAPPQSDEQLVDDPAMVDITPPHPDEHFGGEPAVEDTAPPRFSDEQQLGCVPQTTLMPYAAVDSSLRAMAGQAEGFGRHAIGGLHGDVYHVTTLNDDGPGSLRDGCRRQEPLWIVFDVSGTIRLAVGLARVVPQD

SEQ ID NO: 148227 - protein, 80 aa, Triticum aestivum
  Clone ID: PAT_TA_42645.pep
LDQIVSYNLPYDDFRLHGSTVYSVLQRFHRQVWLCRFLLSICSSGQFRAFVAITGATRNHHVFYIVLTTGLLQQVAIGHD

SEQ ID NO: 148228 - protein, 40 aa, Triticum aestivum
  Clone ID: PAT_TA_42646.pep
KWSLYERVCILLNHFFTWYPSKFCDMLRVFGYQKKNERVV

SEQ ID NO: 148229 - protein, 94 aa, Triticum aestivum
  unsure (1)..(94): unsure at all Xaa locations
  Clone ID: PAT_TA_42647.pep
MNWRTNDVGYWTRSFDQNLXRACKDHFWRGNSRIGFWMRSKEGALGPNLKRLYDEHIAPLIRKTDNRLILTDYDGTVMPQSFIIMARIRDVNFA

SEQ ID NO: 148230 - protein, 45 aa, Triticum aestivum
  Clone ID: PAT_TA_42648.pep
CKLLLRSTIVPTKYYVNLQYILREKVCNFFTQNVLEINIILCAFK

SEQ ID NO: 148231 - protein, 80 aa, Triticum aestivum
  Clone ID: PAT_TA_42649.pep
HRVGRAAVVASDSQGYDVNCWSHLSLQRRIFFIMKCLSQIESPSLYVSSNILTLREHTKPHMPLYTHTQPRRRPAGALPR

SEQ ID NO: 148232 - protein, 64 aa, Triticum aestivum
  unsure (1)..(64): unsure at all Xaa locations
  Clone ID: PAT_TA_42650.pep
DADIFLVNLSREVSLRLQGCGLQGRTITLMVKTRRKGAXVEPLKFMWCGVCETKSLFYHDYRCN

SEQ ID NO: 148233 - protein, 75 aa, Triticum aestivum
  unsure (1)..(75): unsure at all Xaa locations
  Clone ID: PAT_TA_42651.pep
HASGAYGVLVGANYLATGKMEVLSEHQLVYCDHECDLTXPDSCYALCNCGLMTSAFIYMLKXGVFEREKDYLYSG

SEQ ID NO: 148234 - protein, 75 aa, Triticum aestivum
  Clone ID: PAT_TA_42652.pep
DFSRKTMKISAVTRTQLSVPFGDTDRVVCFTIVSTTHSAGFCVGAGLFDLAEHRRFRVADHYVKDTVLDAFYDCI

SEQ ID NO: 148235 - protein, 142 aa, Triticum aestivum
  Clone ID: PAT_TA_42653.pep
STVHYTNCAFYLNGKSMGHEEAPAVNGYSNGHAEAVPANGNSNGHGEVVAVNCHAEATANGKSNGHGEAVVANGESNGHEVAAAVAAPEEAVEWNFVGAKGGVLAATGANICIRAIRYKISASVHENWPWSVLSLAHGDPFF

SEQ ID NO: 148236 - protein, 59 aa, Triticum aestivum
  Clone ID: PAT_TA_42654.pep
GKQVPKDVVDHDYLLVDDKLKTLGAEQLHHSNHVAVLLVLLLVLRIQRGLARTVEVRVG

SEQ ID NO: 148237 - protein, 42 aa, Triticum aestivum
  Clone ID: PAT_TA_42655.pep
NSHHLKLVVRSEGQTVSPSSSCTNGVFFLYSLKKSLSHDSGM

SEQ ID NO: 148238 - protein, 123 aa, Triticum aestivum
  unsure (1)..(123): unsure at all Xaa locations
  Clone ID: PAT_TA_42656.pep
LTRGLILRNRLKYALIYREVRSILMQRLIMVDGKVRSDKTFPVGFMDIFLIPKTGENYRSLYDTKGRFRFYSVRGVDANFKLCMVXSVQYGLNGIXYLNTYDGLTHPIPYPLIKANVTIKLDL

SEQ ID NO: 148239 - protein, 80 aa, Triticum aestivum
  Clone ID: PAT_TA_42657.pep
KLSKPTRINHDPRPALEDDHRPVGGVLKTLFIDLPVAPSLAGRSSSTDPAIARATTNGPTGQLGRPTQASVGEGMARRRR

SEQ ID NO: 148240 - protein, 125 aa, Triticum aestivum
  Clone ID: PAT_TA_42658.pep
VMENMFAALSIDSRVTSTASTRSGKGSFIILDDNILAGGNSDCTTSTDSSRPRSEVFIEMANDLLLRHDGTGVRVFEVCFDLNSTHAAHLDKWVQFALEAGAQDVKLSLCKNMTFCPEHLVTANR

SEQ ID NO: 148241 - protein, 121 aa, Triticum aestivum
  Clone ID: PAT_TA_42659.pep
IDLILLMFSPSGRPTICVGDKSPIDEVIAKYAQQTPQERAKRKLESLEALKKTFKKLDHDVNIQDFLGSGGQTVEELSSHPGALQCQMADVQKRLNYWSDPEKVGNIDHIRAMEQSLKESS

SEQ ID NO: 148242 - protein, 100 aa, Triticum aestivum
  Clone ID: PAT_TA_42660.pep
FLLSSFFNLTCLLSSIYRQAVRLSSACKLLLYQQSQPFNNGLCSCFHSCPSPGRRRGGAIRRSQGQEGQCREEGLSACALLQRARGRARRLLCSLRALRC

SEQ ID NO: 148243 - protein, 38 aa, Triticum aestivum
  Clone ID: PAT_TA_42661.pep
HALCRPWTSCTIDREACGYHIWDYIMVSSPCEPCRKPG

SEQ ID NO: 148244 - protein, 81 aa, Triticum aestivum
  unsure (1)..(81): unsure at all Xaa locations
  Clone ID: PAT_TA_42662.pep
IYLNTNKETRYPQKIVYVYITVLVNHMLNYKVRIWLPSHLIKITTFSIDFSLPSILCPNEWENAWIEAGQYRTGXPAGVPA

SEQ ID NO: 148245 - protein, 95 aa, Triticum aestivum
  unsure (1)..(95): unsure at all Xaa locations
  Clone ID: PAT_TA_42663.pep
MATTSAELLQAEAELVRHSLGYLKSMAXHSALKLGIPDALHRCGGAASLPDLLSTLALPCSKRPYLARLMKMLAVEGIFTAVAVDVDAPAPCEGE

SEQ ID NO: 148246 - protein, 111 aa, Triticum aestivum
  unsure (1)..(111): unsure at all Xaa locations
  Clone ID: PAT_TA_42664.pep
WSVTKHTDRKFTGGKAPRKQLATKAERKSAPTTGGVKKPHRYRPGTVALREIRKYQKSTELLIRKLSVQRLVREIAQDFKTDLCFQIHAVLALQEAAEAYLVGLVXDTNLC

SEQ ID NO: 148247 - protein, 43 aa, Triticum aestivum
  Clone ID: PAT_TA_42665.pep
VFWPYSLCNYRCHALYISHSTLQSILQNLILYSLLKPPMPFMS

SEQ ID NO: 148248 - protein, 78 aa, Triticum aestivum
  Clone ID: PAT_TA_42666.pep
MKPVRSDCDVALDTLGDAAGADTSPKLKRPCSNIETKRPGSRSAPEMPARPRSYGDLDYLVVGLVLDATATPHGSPEA

SEQ ID NO: 148249 - protein, 89 aa, Triticum aestivum
  unsure (1)..(89): unsure at all Xaa locations
  Clone ID: PAT_TA_42667.pep
GGGGGGGKDALFVELWKACAGPLSSVPLLGEKVYYFPQGHIXQVEASTNHLAELXGTPLYNLPWKIPCKLMNMDLKACPDSNEVYTHLT

SEQ ID NO: 148250 - protein, 61 aa, Triticum aestivum
  Clone ID: PAT_TA_42668.pep
LREKPPKIHKMVLKTGIRRRPWSIGLGRRSSTSKRAPDRAQRRPQGHRRGLGYTLRCGGRG

SEQ ID NO: 148251 - protein, 93 aa, Triticum aestivum
  unsure (1)..(93): unsure at all Xaa locations
  Clone ID: PAT_TA_42669.pep
MIIFKKNRNSDVXFFYKEGVLFAKKDYXNLVKHPQIDVPNLHVINLMHSFKFXEYVLETLFLDLFYWHFTNVGIDHLLIYLNLSFEIVPATLN

SEQ ID NO: 148252 - protein, 107 aa, Triticum aestivum
  Clone ID: PAT_TA_42670.pep
TRLYPGVVGEGINHIFLVHVHLKAALYKIMDLVEYFLASHGGSDSRLPLRPSLAALAAGSHCHLLSSLPGKGSSTRPSSCPASTGIPASLPACSVKRGDTGGWEGSS

SEQ ID NO: 148253 - protein, 143 aa, Triticum aestivum
  Clone ID: PAT_TA_42671.pep
LTRTYAYTAITCKDLAAAAVLPANQNSEGRVNPLTRANYLASPPLVDAYALAGTVDIGFEEEPIGVGKGGKAIFLRDIWASNQEIDEVVESSVHTHLFKKGYDSIMERNPRWNQLPVPKEALYQWDDRFTYIRKPTYLEGMSM

SEQ ID NO: 148254 - protein, 134 aa, Triticum aestivum
  Clone ID: PAT_TA_42672.pep
MEEDEDVDGDWEDDFEFRPDVRFRRGSTYSVRDLDLRKPAAAKNPPRRQFETTTAEVLKKADFRNVRFLSNFLTEAGIIIKRSQTRISAKAQRKIAREIKTARAFGLMPFTTMGRRPFFFGRSAEEHYSDDGYF

SEQ ID NO: 148255 - protein, 59 aa, Triticum aestivum
  unsure (1)..(59): unsure at all Xaa locations
  Clone ID: PAT_TA_42673.pep
NDFDFMPYVRFRRGSTYSVRHLHLRKPAADKNPSXICFXTPTVDELNKAYSRNVRFLFN

SEQ ID NO: 148256 - protein, 117 aa, Triticum aestivum
  Clone ID: PAT_TA_42674.pep
FLVRTGSKLVSYKAGMTRLSKSWRTWNTPELTFVSPIAVVGGQKISLILKGRNLSIPGTQIHCTSTGKYISKEVLCSAYPGTIYDDSGVETFDLPGQPDFILGRCFIEVENRFRGNS

SEQ ID NO: 148257 - protein, 64 aa, Triticum aestivum
  unsure (1)..(64): unsure at all Xaa locations
  Clone ID: PAT_TA_42675.pep
GLQHTWICELKVRRLTWKKLWQHQFRMDNNQNLLQKLFLMCYRAPVCSYAIWSSYRXQEKLRND

SEQ ID NO: 148258 - protein, 113 aa, Triticum aestivum
  Clone ID: PAT_TA_42676.pep
PPRKSIIHRQAVQVDVLCPACKSSSLLQLKPMQIEITHTVNTDQFIPEKPRPRPYSLGRIVSLTSYTGRKRFNFIRLLQRKYAAQTEDGRSSLRSSDLVQDHLRTRNLKVGRC

SEQ ID NO: 148259 - protein, 122 aa, Triticum aestivum
  Clone ID: PAT_TA_42677.pep
GETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 148260 - protein, 71 aa, Triticum aestivum
  Clone ID: PAT_TA_42678.pep
HIITICLLLLCKVRILLLFCSLLGCKAALSLLIGCSANCGTAKAVLMRCYAGTLVHASCLIGCLMHWHFGF

SEQ ID NO: 148261 - protein, 61 aa, Triticum aestivum
  unsure (1)..(61): unsure at all Xaa locations
  Clone ID: PAT_TA_42679.pep
MAHRLLRDAQADGWERSDFPIICESCLGDNPYVRMLRAEYDKECKICARPFTVFXWRPVRD

SEQ ID NO: 148262 - protein, 107 aa, Triticum aestivum
  Clone ID: PAT_TA_42680.pep
SISTHNRIISGTRPASYSEQGSRNEADVDKGQVTQSAPNCGSGIQDQQLSVDPDAGEWGRHPLSRQRRGTRSGSRPRRHRLDWSKSGHSRVETREQNKRPRMRGSRR

SEQ ID NO: 148263 - protein, 93 aa, Triticum aestivum
  Clone ID: PAT_TA_42681.pep
MGKPIPDVSDSHIQELGGWALGQAKHQKLAVDGLRFRRVVRGEQHVVSGMNYRLYVDAVDPAGRTVPYVAVVYEQVWTRTRQLGFLNPVPLAH

SEQ ID NO: 148264 - protein, 92 aa, Triticum aestivum
  Clone ID: PAT_TA_42682.pep
PTRPSQVANDALSSIRTVASFSAEEKVMDLYKKKCEGPLRTGIRTGIISGIGFGVSFFLLFGVYAASFYAGARLVEDRKTTFPKVFRVSTLW

SEQ ID NO: 148265 - protein, 116 aa, Triticum aestivum
  Clone ID: PAT_TA_42683.pep
PRVRDGIPLPAQTGLGAIRSIVPRVVKLVEDTTEHVLRFELPDMIERDRFSWFKDEEFARQTIAGLNPLCIQLLTEFPIRSKLDPEVYGPAEFAITKEILEKHMSGGAAMTVEQAL

SEQ ID NO: 148266 - protein, 53 aa, Triticum aestivum
  Clone ID: PAT_TA_42684.pep
VDVDDTYMGIPSLVIGLDENCSKFTRWCGNIGSCHTMLNARVFASKIGFWYKH

SEQ ID NO: 148267 - protein, 59 aa, Triticum aestivum
  Clone ID: PAT_TA_42685.pep
RSQSTPRAKTPISPRGWDCVGSVMLERHRFHRDADGDLPVVVTAPLIAHSPSSAEPWSV

SEQ ID NO: 148268 - protein, 141 aa, Triticum aestivum
  unsure (1)..(141): unsure at all Xaa locations
  Clone ID: PAT_TA_42686.pep
RSGGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYVXRQAAKSIVASGLARRCLVQVSYAIGVPEPLSV

SEQ ID NO: 148269 - protein, 139 aa, Triticum aestivum
  Clone ID: PAT_TA_42687.pep
GDGNSKKNHSPDVKKRRKRMKHVNTSTDRDVLNLQDNVSSVMARQCLHISSHRTSQSTSKHKGNLSHLLHNEVPIRMGERNNLTENSENDSLSDSFSEPQTSDTLCIEAQRKSSAPSSSLRQRTLDSLYEFGETSRHEP

SEQ ID NO: 148270 - protein, 104 aa, Triticum aestivum
  Clone ID: PAT_TA_42688.pep
GPLAEHLRYGIFFLDKPSNPSSHEVVAWIKRILRVEKTGHSGTLDPKVTGNLIVCIDRATRLVKSQQGAGKEYVCVARFHAAVPDTARVARALEALTGAVFQRP

SEQ ID NO: 148271 - protein, 54 aa, Triticum aestivum
  Clone ID: PAT_TA_42689.pep
ISLSRCNLHVSELLTSKHATTVSLCNLISCTIQYSVYICRNALQRSYYVGGSLL

SEQ ID NO: 148272 - protein, 130 aa, Triticum aestivum
  Clone ID: PAT_TA_42690.pep
MASSVAAAASTFLGTRLADPAPQNGRIVARFGFGLGGKAKPAPKKVAKTSTFSDRPLWFPGAVAPDYLDGSLVGDYGFDPFGLGKPVEYLQFELDSLDQNLAKNEAGGIIGTRFESSEVKSTPLQPYSEV

SEQ ID NO: 148273 - protein, 64 aa, Triticum aestivum
  Clone ID: PAT_TA_42691.pep
RLCAHPLHILIVVDYTTVFIFRLLMYVDNGLPARMGLDLGWQHIYAPFCGTIIVLSVQVLLLYP

SEQ ID NO: 148274 - protein, 114 aa, Triticum aestivum
  Clone ID: PAT_TA_42692.pep
MPLGASQVLLRCHLPSPLLPGLFKKLSLDKMGVQRYRFFCCGCGANAAADGRERDEDGGFGVSDGKAEKGVVAGPRWLSWAQVEAMTGVFTFAVVGEGGFSTRYLARLSGALVV

SEQ ID NO: 148275 - protein, 75 aa, Triticum aestivum
  unsure (1)..(75): unsure at all Xaa locations
  Clone ID: PAT_TA_42693.pep
MAVFSHQQVMAGPASLDPWRAEAVSKHVRALNTQFASWVQVHGQNHAXELCEDGLKDYILHACEIMEIFKDVVNW

SEQ ID NO: 148276 - protein, 113 aa, Triticum aestivum
  Clone ID: PAT_TA_42694.pep
SPTALRNPLPSVVIPAAVAAARRNLCLYNDRGRPPPSIIRTCVAIAPSTPATATRWFASGLAACDLEVTEPVGSMTTSVTPEEKMAAHHQAPALCSFSRPLRRIPISAGPLFL

SEQ ID NO: 148277 - protein, 88 aa, Triticum aestivum
  unsure (1)..(88): unsure at all Xaa locations
  Clone ID: PAT_TA_42695.pep
MWRIKTKDSKPAKSGRLSHEXRSLGSLMIXKKTKPFLAMVFHIIKIGKVVLFVTYLGSRLIINDLRLLIDSYHNAYITWTWMPLFSRF

SEQ ID NO: 148278 - protein, 140 aa, Triticum aestivum
  Clone ID: PAT_TA_42696.pep
RRTTIRFADIKQKRYSVPLVIGIGLLVLQQLSGVNGILFYAASIFKAAGITNSNLATFGLGAVQVIATGVTTWLTDKAGRRLLLIISTTGMVITLDIVSVSFFVKDNIAAGSHLYSVMSMLSLAGLVAFEIAFSLGLGAI

SEQ ID NO: 148279 - protein, 143 aa, Triticum aestivum
  unsure (1)..(143): unsure at all Xaa locations
  Clone ID: PAT_TA_42697.pep
PPHGTGVRVRAPLVESVSCYCRLDTGLKTVVEARKFVPGAKMCMQPEVKQNKRKSRGSKKEWCRTQAPLLPGLPDDLAIACLIRVPRLEQPKLMMGCKRWNRLLSGNYFYSLRKKIGVAEEWVYVFXRGPGRKNSWDAFYPLH

SEQ ID NO: 148280 - protein, 92 aa, Triticum aestivum
  unsure (1)..(92): unsure at all Xaa locations
  Clone ID: PAT_TA_42698.pep
MASTFAATSTGGLMAAPTGKNVRLHRRVNFRVRAAKELYFNKDGSAIKKLQTGVNKLADLVGVXTLGPKGRNVVLESKYFSPKIVNDGVTVA

SEQ ID NO: 148281 - protein, 70 aa, Triticum aestivum
  unsure (1)..(70): unsure at all Xaa locations
  Clone ID: PAT_TA_42699.pep
MMSWEAYVYELLMCEIXGQYLSAGVIVCHDGCVCSHFESFPELXPVEGAGFIKDFDEPGIFCPTVFFVGG

SEQ ID NO: 148282 - protein, 66 aa, Triticum aestivum
  Clone ID: PAT_TA_42700.pep
QLLPFSSAARPRYLIATMGPRGVSLALLAAALLQALAPALVAAAVVLRHGAWCGSALKNHPVVQNA

SEQ ID NO: 148283 - protein, 140 aa, Triticum aestivum
  unsure (1)..(140): unsure at all Xaa locations
  Clone ID: PAT_TA_42701.pep
RGRVGNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIIISCLVDKEGNAAXNGFLLVD

SEQ ID NO: 148284 - protein, 110 aa, Triticum aestivum
  Clone ID: PAT_TA_42702.pep
MASAKFGAAQQVENRGALSKRSRNDVSVREGDWNCPQCGNVNFSFRNVCNRGACGAPRPSPSPSPRMMSGPPASGYDRSPLFYGGGGGAPPSIPLGTGSFGAPYPHPGMR

SEQ ID NO: 148285 - protein, 63 aa, Triticum aestivum
  Clone ID: PAT_TA_42703.pep
PAPSLKHLSHMPHYHTWGTLHTIPCLTNRIFYFWHYAGVRHGLRNVSSQFFLRKNLLCFRSLF

SEQ ID NO: 148286 - protein, 94 aa, Triticum aestivum
  Clone ID: PAT_TA_42704.pep
LFCLVYHIDVRGDVIGGVPGVSKAQFAKLLKLVGSKFWLDHSGPVRFLSNNGDLMGNNSPFSQIPSNCLSMPPPQIPMIFGMKRTWSLWGDDIQ

SEQ ID NO: 148287 - protein, 91 aa, Triticum aestivum
  Clone ID: PAT_TA_42705.pep
ISMMTTVCANAPTSHVGITALCRSNSASGPSSQHMRPPKKIPSCNEKVDLHRAKPTTAIAGATVRREKQPGEDRYGIGYPEKARIMSWQLM

SEQ ID NO: 148288 - protein, 46 aa, Triticum aestivum
  Clone ID: PAT_TA_42706.pep
RIEWQGIVLYASCIGPVDRNLSTNGSIGYADKASACHSVGSNMPAA

SEQ ID NO: 148289 - protein, 90 aa, Triticum aestivum
  Clone ID: PAT_TA_42707.pep
DRLQLELLAPLQDAESQKDVGKGDKSRDKGTAEKFAIYQKHRSSLADTVQFMRPAAPTSSVNADIVGTSTLQSASLPKQEPSTATSKSYT

SEQ ID NO: 148290 - protein, 145 aa, Triticum aestivum
  unsure (1)..(145): unsure at all Xaa locations
  Clone ID: PAT_TA_42708.pep
GNTAYLYISVAFIQMLKALMPVATFIMAVFCGTDKLRWDLFLNMVLVSVGVRVSSYGEIHFNVIGTLYQVTGIFAEALRLVLTQVLLQKKGLTLNPITSLYYIAPCSXIGRTGAVTIRVAGVLKDWILIALLTIIFPESVLQVLT

SEQ ID NO: 148291 - protein, 74 aa, Triticum aestivum
  Clone ID: PAT_TA_42709.pep
VLRLRTEHYVYELPDAHPLLQQLGLDLREHDDPTPYLLAIWTPDGIKEITKTPKPCCDPQMGGDLCNNEMCHNC

SEQ ID NO: 148292 - protein, 148 aa, Triticum aestivum
  Clone ID: PAT_TA_42710.pep
RVRPIGIITATTNQTPGLNIITEYIMGYLYPGRPVANMCFKVYGYISMTQALAFLQDFKLGHYMKIPPRTMFMAQVVGTLIAALVYIGTAWWLMDSVPNICSTELLPADSPWTCPMDHVFYDASVIWGLIGPRRIFGDLGTYSAGNWF

SEQ ID NO: 148293 - protein, 55 aa, Triticum aestivum
  Clone ID: PAT_TA_42711.pep
KCGRAIRHSDGMERFGHGIEGDKRTDSIMSTFAPRSCVSAMKKKNRAAGLEYASV

SEQ ID NO: 148294 - protein, 129 aa, Triticum aestivum
  Clone ID: PAT_TA_42712.pep
CSRHYAGRRVASCLDARRPGGAPSWAAGLLHIIGARGAGGGLHSIPSLGCVAPNPIAWSSLLLPEVDGRLIVLVAAASAPEPQLERSPATSRRPAWSLRRHAPPRLGARRRRYYHNIKGSAFTPKSIAS

SEQ ID NO: 148295 - protein, 86 aa, Triticum aestivum
  Clone ID: PAT_TA_42713.pep
MAALEAVRSWAVSVIPPELAAAAGGDPLAALAASAAALVAGLLILAVWFRSGGGAPSKPVATPLRPPPVKVDAVADVDDGRKRVTI

SEQ ID NO: 148296 - protein, 56 aa, Triticum aestivum
  unsure (1)..(56): unsure at all Xaa locations
  Clone ID: PAT_TA_42714.pep
SXXTPLPVRVGSTQPLTAAVARLGLLCSCAGAGVTKYSECHTGKLSALQSILLIPR

SEQ ID NO: 148297 - protein, 106 aa, Triticum aestivum
  Clone ID: PAT_TA_42715.pep
RSLAGGIIGKGGANIKQISSVTGAKVVIQEDRHESDTSLKNIEFEGTFDQIRNASAMVIELFVSISGIGSNFKTKMCENFVKGSCFYGGKCHFAHGESELRKPAAC

SEQ ID NO: 148298 - protein, 79 aa, Triticum aestivum
  Clone ID: PAT_TA_42716.pep
MKKLHWLVRFLFGPWPVYFSALAILIVLTNAHFFGLVGVGVAPRTAKLAFSAPVVMRMNYCDIFRGEWVPDTVAPFYNH

SEQ ID NO: 148299 - protein, 93 aa, Triticum aestivum
  Clone ID: PAT_TA_42717.pep
LLCLVHCNLLPYYYCLHARLVGLDPSALLAGRWLADVMRRERDYDSEKRDPSQMQMLQLPPPPDRLPISSVAYIRVLSSAYYFKMEMKNRDRP

SEQ ID NO: 148300 - protein, 77 aa, Triticum aestivum
  Clone ID: PAT_TA_42718.pep
MDGFPKSVGGGGPNIPAGSHPAGGSQAAAGGGATQRTQYPYVTGNSVIALKYKDGVIMACDTGASYGSTLRYKSGER

SEQ ID NO: 148301 - protein, 39 aa, Triticum aestivum
  Clone ID: PAT_TA_42719.pep
YTKLILFIFYFFFKFFFFFLFFFFFFFFFFFFFFGDMAL

SEQ ID NO: 148302 - protein, 73 aa, Triticum aestivum
  Clone ID: PAT_TA_42720.pep
SPLSRVLGESRRITFLYCGHLDSTFLGTRLATLLHKRAHCGSVRVRVSGKANPAPKKVALTSSSSYRPLWFPG

SEQ ID NO: 148303 - protein, 55 aa, Triticum aestivum
  Clone ID: PAT_TA_42721.pep
YHVCNCSPQRAIREQKNILLDSEKLDSARKRLQENYQEAQNGKISMARSVYLALT

SEQ ID NO: 148304 - protein, 125 aa, Triticum aestivum
  unsure (1)..(125): unsure at all Xaa locations
  Clone ID: PAT_TA_42722.pep
MALHAPVLVLKDSLKRESGAKVHQANIQAAKAVADIIRTTLGPRSMLKMLLDARGGIVVTNDGNAILREIDIAHPAAKSMIELSRTQDEEVGDGTTSVIVLAGEMLHVAXAFIDKNYHPTVICRA

SEQ ID NO: 148305 - protein, 60 aa, Triticum aestivum
  Clone ID: PAT_TA_42723.pep
ACSLGRTSRISSFVFWLQKYSFHPLGRDYRWCGALLSLVFLLVRSYASGGSAGTPKAILG

SEQ ID NO: 148306 - protein, 135 aa, Triticum aestivum
  Clone ID: PAT_TA_42724.pep
SRIAGPILGASLPSPAGGEDAHRRRVSYFYEPSIGDYYYGQGHPMKPHRIRMAHSLVVHYGLHRLLELSRPYPASEADIRRFHSDDYVAFLASATGNPGVLDPRAIKRFNVSEDCPVFNGLFPFCQAFVGGKHWV

SEQ ID NO: 148307 - protein, 134 aa, Triticum aestivum
  Clone ID: PAT_TA_42725.pep
MLPRLDLPVPRVPTEGGGRLMGTGAGSARALAVAFAVSLLACSGAVAVARAQDTERIEGSAGDVLEDDPVGRLKVYVYELPTKYNKKMVAKDSRCLSHMFAAEIFMHRFLLSSAIRTLNPEVADWFYTPVYTTC

SEQ ID NO: 148308 - protein, 153 aa, Triticum aestivum
  unsure (1)..(153): unsure at all Xaa locations
  Clone ID: PAT_TA_42726.pep
RARKHPSEATTDGNRANGQPLLVNEQNKYKSMLIRTYSTVWMIGGFAFIIYAGHLYIWALEVGIQIFMARERFNLLTKWSVEKHPPGFRLLNWFCMVYLXTLKKKTYNYQFKQYAWTHMILVTVFAQSAFTVANIFGGIFWFLLPASLIVIND

SEQ ID NO: 148309 - protein, 152 aa, Triticum aestivum
  Clone ID: PAT_TA_42727.pep
SSGVSHLLERMAFKSTVNRTHLRLVREVEAIGGNVSASASREQMSYTYDALKSYTPEMVEVLIDSVRNPAFLDWEVKEQLQNIKSEIADASANPQGLLLEALHSVGYSGALAKPLMASESAVNRLDVSSLEEFVAEHYTAPRMVLAASGVDH

SEQ ID NO: 148310 - protein, 68 aa, Triticum aestivum
  Clone ID: PAT_TA_42728.pep
PSLLFYHELLALLSRFFFFFIFAQFFDFILFVCLSFRYLLISLCINTFSLSLIIFLVYVHFPCSLLFS

SEQ ID NO: 148311 - protein, 57 aa, Triticum aestivum
  Clone ID: PAT_TA_42729.pep
GSFTVMDLKRSGKWQKRPGGYVLCTSLCPSVVGSGRSGDLLFDQAATTATLPMIYLP

SEQ ID NO: 148312 - protein, 99 aa, Triticum aestivum
  Clone ID: PAT_TA_42730.pep
YFGILARSGFTVSKALFFNFLSALDALAGTALALSLGKDPGHSSLIEGFTAGGFIYIAVAGVLPQMNDQITTMKSSLAQLISLAMGMLVALGISLVIII

SEQ ID NO: 148313 - protein, 77 aa, Triticum aestivum
  Clone ID: PAT_TA_42731.pep
MGTSPDIPATMLCVALFVAGCFGATVCRYSHARHTDADFAILFPSSFGSCGRPRNCCDSGIKDASLSVWHFNNRGGQ

SEQ ID NO: 148314 - protein, 133 aa, Triticum aestivum
  unsure (1)..(133): unsure at all Xaa locations
  Clone ID: PAT_TA_42732.pep
DPHLLPTRCPRVRYRRSAPNPMSVDPDMLNESGHHHAIAFVEGDKYYGAKATINVWLPKIEQANEFILSQLWILGGSFCQDLFSIVTXCEVSPDLVVYNNIMVFTYLPSDSYHATCCFNLLCSGVILINIHDC

SEQ ID NO: 148315 - protein, 79 aa, Triticum aestivum
  Clone ID: PAT_TA_42733.pep
PVLVRRLLRRPCRGHRLVRLPPQRGERAVHHSPSAELRRRSRDELPRHIPRLRRGLLRRDVPFVPFLVAVSYRCSGQWY

SEQ ID NO: 148316 - protein, 88 aa, Triticum aestivum
  Clone ID: PAT_TA_42734.pep
SPACSSIALAIYRPPHFNQPDELAERLAPSSSRNMARMQNVGSGYGGRGGLVAAGWRRRPLMLTSAAGWWRLPLCPASPTCADSARGP

SEQ ID NO: 148317 - protein, 92 aa, Triticum aestivum
  unsure (1)..(92): unsure at all Xaa locations
  Clone ID: PAT_TA_42735.pep
RAELLHELLKTGAGFDPLPVLTQETLIIWGDKDQVFPVDLGHRLHRLLGERSRLEICRDAGHAXLQLEGADHVIRSIKSFLLDYAVGPGAGA

SEQ ID NO: 148318 - protein, 65 aa, Triticum aestivum
  Clone ID: PAT_TA_42736.pep
KPPTCELRQVRLSRGHDWPASPPPSPRRFPGLRRSLRRQRAPTWLNPPGGNLHQACRANYAIFMG

SEQ ID NO: 148319 - protein, 99 aa, Triticum aestivum
  unsure (1)..(99): unsure at all Xaa locations
  Clone ID: PAT_TA_42737.pep
MAAPKLATLALAVLLAATVVAPPAAVRAAMSCSTVYSTLXMPCLPFVQMGGAMPPQPCCGGFRSLLQLANNTPDRRTICGWLKNVANGANGCGTYISRA

SEQ ID NO: 148320 - protein, 53 aa, Triticum aestivum
  Clone ID: PAT_TA_42738.pep
APFSGCPNTPCISSANCNNQLLVIGARIDAQGNICPQAAAIFLLIVGHKEDYS

SEQ ID NO: 148321 - protein, 90 aa, Triticum aestivum
  unsure (1)..(90): unsure at all Xaa locations
  Clone ID: PAT_TA_42739.pep
NPVATPCSGAVLLTGAMQLLAPGLRRLVLGTGAACQVGPAAAAAGMRAYHERVVDHFNNPWNCCSFDKDDPNVCSGLDXAPALCDFMKLQ

SEQ ID NO: 148322 - protein, 97 aa, Triticum aestivum
  unsure (1)..(97): unsure at all Xaa locations
  Clone ID: PAT_TA_42740.pep
MDGGAGAGRWSVPSSSGFRRRVPPAVNGHGHDAPPPSRRSFGSLSRGHSTPLTGERTVKRLRLYNALAIPYHTTVHXACQRLAFRMVYAVLLTVFHA

SEQ ID NO: 148323 - protein, 72 aa, Triticum aestivum
  Clone ID: PAT_TA_42741.pep
AEGVEEATLQDLAGVLVDHQSCYGVRAKQDFTYLSFLIYVLLYSFQIKASVLVVHQDYCTHFRSRNVTHLKL

SEQ ID NO: 148324 - protein, 110 aa, Triticum aestivum
  Clone ID: PAT_TA_42742.pep
NFLRPASSRGTSAKRKPRRSYLGVEDEQLLHGPGIGAGGGGTAGGHGSAGDNGEGGARREDTGFGSDSSAANLRYARSRRRPAAGEGWDESDNGRTRGRTSGRTRGWTRG

SEQ ID NO: 148325 - protein, 92 aa, Triticum aestivum
  Clone ID: PAT_TA_42743.pep
LPASNHQPLESVPSPCSSCNRAATNQACDTDRELHRSGDRHARKAPAAHDGNGNGGGGGCNTQGVRDGARGPGGSGAAPFLCAVWASLSTRF

SEQ ID NO: 148326 - protein, 93 aa, Triticum aestivum
  unsure (1)..(93): unsure at all Xaa locations
  Clone ID: PAT_TA_42744.pep
AGNPNLASDRLQVRHYSVPASSSWIRXITTVVFLTTAAVAALLTVSTSSLVAAGAGSRPSSYMISEPSRNVLRMACHIQXFALSRWLSANLPI

SEQ ID NO: 148327 - protein, 46 aa, Triticum aestivum
  Clone ID: PAT_TA_42745.pep
NKSMEQIEHGLLYHGHGPWHATDCLIDSNNTQQTTLLEYYILARAY

SEQ ID NO: 148328 - protein, 120 aa, Triticum aestivum
  unsure (1)..(120): unsure at all Xaa locations
  Clone ID: PAT_TA_42746.pep
YFSNLRRTLGPGIDGWEVSLKGMMSIVVLLGLVITSIYWGVNKYVLNDPSLSKADRKMKKELPKLGMKESLKVLLSSRYVRDXLSTLVVAYGIXXNLVEFTWKSILRHSSLCPKEFLFFH

SEQ ID NO: 148329 - protein, 97 aa, Triticum aestivum
  Clone ID: PAT_TA_42747.pep
APPTPPLTTRVRRMMLAVILRNDVGWFDQEENNSNLVVSRLSTDAVDVKSAFAERICLILQNMTSLLVSFVVGFIIEWWVALLILVTFPFLVLSNFA

SEQ ID NO: 148330 - protein, 88 aa, Triticum aestivum
  Clone ID: PAT_TA_42748.pep
LNLASSSSPTSRHSGQQHRSDRSSTGRVTGSSSVFFPAWLAAAYLSGPHSRALAYVRAFNTPGEIGLGDGDGLRGRHSVPGGDHRREP

SEQ ID NO: 148331 - protein, 151 aa, Triticum aestivum
  Clone ID: PAT_TA_42749.pep
ASATATPPLPPPMSAYAHPPPTAAYPPPSGKADAYAPPAAYPPPSGKADAYAPPATAYPPAAKADAYPPPYGAYPPAGGKADAAYPPSSGYPPAAGKPAKGGEPVTAYPSGGPSTAAPYAAPPPQYGGYGYPPQHAAGYGYPPPQQAGYGY

SEQ ID NO: 148332 - protein, 141 aa, Triticum aestivum
  unsure (1)..(141): unsure at all Xaa locations
  Clone ID: PAT_TA_42750.pep
FKFFDRAAPPALSQLSPMARTKQTARKSTGGKAPRKQLATKAARKSAPATGGVKKPHRFRPGTVALREIRMYQKSTELLIRKLPFQRLVREIAQDFKTDLRFQSSAVAALHEAAEAYLAGLFEDTHXCAIHAKRVTIMPKD

SEQ ID NO: 148333 - protein, 95 aa, Triticum aestivum
  unsure (1)..(95): unsure at all Xaa locations
  Clone ID: PAT_TA_42751.pep
RPSTRPRRSWGMCERCASCASEHSNVCDAVPFVIGPGMRRDCTTRFRDARWSPLHDLLAVFSFXEYTVVDVNQVVKVDPAVPTKLACLLSCGAGT

SEQ ID NO: 148334 - protein, 96 aa, Triticum aestivum
  unsure (1)..(96): unsure at all Xaa locations
  Clone ID: PAT_TA_42752.pep
MGLFTVTKKATTPFDGQKPGTSGLRKKVTVFQQPHYLQNFVQSTFNALPVDQVRGATICCLXXYRYFSKDAVQIITKMAAGNGXRRVWGGQKQLMS

SEQ ID NO: 148335 - protein, 99 aa, Triticum aestivum
  Clone ID: PAT_TA_42753.pep
STTIRCLSHPSAHVRALSMCVLRDILSNGSVNPNKTIQGEQLRYGIQSPSYRCLAAGIINWQADVERCIEWEAHSRRATGLTLAFLSAVAKELGCPLPS

SEQ ID NO: 148336 - protein, 71 aa, Triticum aestivum
  Clone ID: PAT_TA_42754.pep
TYQLTEDQWNPWMCFSQNPGGSPKKRCSYIRSSPFFIRTVSSATKTDNNPSLDVCICHKPYLVHPCMDMKR

SEQ ID NO: 148337 - protein, 94 aa, Triticum aestivum
  Clone ID: PAT_TA_42755.pep
LVVSHRAFHGGHQKGHSQCADQQDSRPQPHHGQPPRSKKVGKKKDRSAHWVRECARLCSLHTLVRSSPSAPPHHEDMIHIQQTSSSLGCSLSWN

SEQ ID NO: 148338 - protein, 153 aa, Triticum aestivum
  unsure (1)..(153): unsure at all Xaa locations
  Clone ID: PAT_TA_42756.pep
PRVRDMIDDTADSIVSDMLLWPHRHVVKLGVNVDTSDLELKPQGRLSVTVVKATSLRNKEMIGKSDPYVKLFVRPMFKVKTKFIDDDLNPEXWYETFDLIVXEDKETQSVFFEVYDVDILQLDKRLGVAXLALNTLESEITQDATFKLFIHWI

SEQ ID NO: 148339 - protein, 103 aa, Triticum aestivum
  Clone ID: PAT_TA_42757.pep
MDSAQHPTGELINSYDTLMVSGGDQSRQPQDAGNETSFTNWKDLPMELLLRIISLVGDDRIVIVASGVCTGWRDTLGWGVANLSLLWSQDRMNDLVISLAHKF

SEQ ID NO: 148340 - protein, 117 aa, Triticum aestivum
  Clone ID: PAT_TA_42758.pep
SSFHDLLLQSYLDFSRRRHGDLGARGPVLHLRTRRRAGRRRAAAGPALSLRLLQRPGRRAVRVRGALRLGRRRPRPRWLQAAGGEERADPVERHRRWPPHLRRGPARRLFDSCLATP

SEQ ID NO: 148341 - protein, 72 aa, Triticum aestivum
  Clone ID: PAT_TA_42759.pep
PKIAADRAPSAMRARSEESNHRPRLSEEKRRRRTSRGKVLRVRVIKSLTMVIQLALIKQLGNGAPAPWTRRE

SEQ ID NO: 148342 - protein, 153 aa, Triticum aestivum
  Clone ID: PAT_TA_42760.pep
VPRLLPLVRPRVLSTLVAVSFGYLAPEYAMRGHMTVKVDVFAFGMVILETLAGRPNFDNMLDEIKVYILEWVWQLYEDKHPLDMVDPKLEEFNSGEVIRAIHVALLCTQGSPHQRSSMSRAVSMLAGDVEVGVVVNKPSYITEWQIKGGNTSS

SEQ ID NO: 148343 - protein, 86 aa, Triticum aestivum
  Clone ID: PAT_TA_42761.pep
PRDRARARCHYRPKFSPYPLCHPRDHKPHQTRVHRRTSSPAREQLRWKAAAAAAGVELGSSKPQIATQAEMAEARMPLAYRDQSAH

SEQ ID NO: 148344 - protein, 76 aa, Triticum aestivum
  Clone ID: PAT_TA_42762.pep
ENPAELEDWLGDLNPHSKEVIKDAYAVPSLATAVLGDMFQFERLGYFAVDTDSTPDKLVFNRTVTLRDLFCKAGPK

SEQ ID NO: 148345 - protein, 76 aa, Triticum aestivum
  Clone ID: PAT_TA_42763.pep
RSTAPPPRTGSKPPAALQGTWTTTHAFLYSPSTSRRSRRFPGPPPLQPQMLCMKHSRRSMSPQDRTSFLGCRTTRP

SEQ ID NO: 148346 - protein, 138 aa, Triticum aestivum
  unsure (1)..(138): unsure at all Xaa locations
  Clone ID: PAT_TA_42764.pep
MGRRHRRGEDVSHPLKVSLDDLYNGTLKKLSLSRNVICSKCKGKGSKSGASMRCPGCQGSCMKVTIRQLGPSMIQQMQQPCNECKGTGESINEKDRCPGCKGEKVIQEKKVLEVHVEKGVPHNQKITFPGEXDETPDT

SEQ ID NO: 148347 - protein, 50 aa, Triticum aestivum
  Clone ID: PAT_TA_42765.pep
GLDYPGVGPEHSFLKDIGRAEFDSVTDQEALDGMSRSLSIVCYGLNYFSF

SEQ ID NO: 148348 - protein, 148 aa, Triticum aestivum
  unsure (1)..(148): unsure at all Xaa locations
  Clone ID: PAT_TA_42766.pep
GRVGAPLTFRGFQQYRALTVPELTQHMWDAKNMLCAADPRHGRYLTVXAMFRGKMISKEGDEQMIIVQIKNLFYCVEWNPNNVKFSGCDIPPRGLFMAFTFIGNWTFIQEMFLRVRDLFTVMFRRXGILHWDTGEGMXDEMEFTEAVY

SEQ ID NO: 148349 - protein, 45 aa, Triticum aestivum
  Clone ID: PAT_TA_42767.pep
IEEKALCSRRHFGLNKPLRSSLCMVSYWIDSGRQSSRMHCNDIGQ

SEQ ID NO: 148350 - protein, 91 aa, Triticum aestivum
  Clone ID: PAT_TA_42768.pep
MTRLLERSGLGEETCLPYAQHYIPPSRDLVSSRAEAELVIFLAIDDLLAKTGVSPRDIDILVVNCSLFAPTPSFAYMVALLVMLRGDLRNV

SEQ ID NO: 148351 - protein, 65 aa, Triticum aestivum
  unsure (1)..(65): unsure at all Xaa locations
  Clone ID: PAT_TA_42769.pep
SANKRKRKRDKNDIRQESKTKNEDATEKEKQPRKKETVNXQKRHRERMKRQRNEKTVSRIMNNAQ

SEQ ID NO: 148352 - protein, 76 aa, Triticum aestivum
  Clone ID: PAT_TA_42770.pep
AHAFCDAWVLKRLFHSLGARRPPRFTPGRSPRPHSGDAKPRARALPCVRGDEDRAPGPCLRRARLRQVGAGGGGPL

SEQ ID NO: 148353 - protein, 145 aa, Triticum aestivum
  unsure (1)..(145): unsure at all Xaa locations
  Clone ID: PAT_TA_42771.pep
PTRPLSIALLQQYFVREVTILFNLCNEPWLKYSISIAADNGLKMLLYTSARLKKGEVIFLETHFYWYXLCFSGEKPRGIXLSSNAFDAEPEKHQSISHHSQYGSVEHELRDVFRWSRCKKAMPLXAMLFTAFPLPADQLEGVHDY

SEQ ID NO: 148354 - protein, 128 aa, Triticum aestivum
  unsure (1)..(128): unsure at all Xaa locations
  Clone ID: PAT_TA_42772.pep
SVQCTDPAGHLPCPLVSPTDPVDFKPESKVTRIRQPVHLLSREYHEKYKEAVAKMKALPEENPLSFAAHAAIHQAYCDAYYKYDPTAKDAPVDVHFSWIFAPWHRMYIYXYERALGQLIGDDTFSLAF

SEQ ID NO: 148355 - protein, 84 aa, Triticum aestivum
  Clone ID: PAT_TA_42773.pep
SFLRSKGSAACWWNSKRPAKATRRIYTDIQEHKLVKKVIDKVLPIWLTSDGLSNMAFGGSQSIPLKNLELKDVNGSVLLKGYVL

SEQ ID NO: 148356 - protein, 152 aa, Triticum aestivum
  unsure (1)..(152): unsure at all Xaa locations
  Clone ID: PAT_TA_42774.pep
SEFSLFGSLSNVGAMVGAISSGQLAEYIGRKGSLMIAAIPNIIGWLAISFAKDSSFLFMGRLLERFGVGVISYTVPVYIAEIAPQDQRGALGSVNQLSVTIGILLAYLFGMFVPWRILAVLGILPCSILNSRLFFVPEXPRWLAKMGKMEDF

SEQ ID NO: 148357 - protein, 89 aa, Triticum aestivum
  Clone ID: PAT_TA_42775.pep
MGLQEEFEEHAEKAKTLPESTSNENKLILYGLYKQATVGDVNTDRPGIFYQKDRAKWDAWKAVEGKSKDEAMNDYITKVKQLQEEAAAS

SEQ ID NO: 148358 - protein, 120 aa, Triticum aestivum
  Clone ID: PAT_TA_42776.pep
TINMLRRVEPYVAYGYPNLKSVRELIYKRGYGKLNKQRIPLSNNSVIEEGLGKHNIICIEDLVHEIMTVGPHFKEANNFLWPFKLKAPLGGLKKKRNHYVEGGDAGNRENYINELIKRMN

SEQ ID NO: 148359 - protein, 57 aa, Triticum aestivum
  Clone ID: PAT_TA_42777.pep
SQHHHVKCSSRHPETVSVINYICWEILVGRTYLFLNTHSLPSFKDCAWTFRAACTQD

SEQ ID NO: 148360 - protein, 147 aa, Triticum aestivum
  Clone ID: PAT_TA_42778.pep
LRIPPDDPASLARAALVSRHWHRVITGPVFRRRFREFHRSPPLQGYISNIHNSIQFVPISSFRPRHADLDDVIAIHSSPGRVLLCRRPGKGLDVFPGKGLDVFLSVWDPITDELRDLPALPLPVVPGPCTCNWDAAVICAVGEGCNH

SEQ ID NO: 148361 - protein, 125 aa, Triticum aestivum
  Clone ID: PAT_TA_42779.pep
PTQPSRPDAPPTVLPPPRPRRRTLPRVPQGRGSPEMDWSAVTAEDLVDALREVDWSMPPRPVPEFFSRFTVPRSYSKWTSRLKCNLYYYRTNYFILIMFILGMGFLWKPVAIVAAFMTGLSIAFL

SEQ ID NO: 148362 - protein, 154 aa, Triticum aestivum
  Clone ID: PAT_TA_42780.pep
PRVRASGASHGTPSFFFCHGTATADSASLETSSGVLDTSPRGTSSDDNKACRKHKEDSGASFSSARSKDSNSKESSERSGGKRDRSTKKVDEEEPKGYIHVRARRGQATDNHSLAERVRRERISERMRVLQALVPGCDKVTGKALILDEIINYV

SEQ ID NO: 148363 - protein, 96 aa, Triticum aestivum
  Clone ID: PAT_TA_42781.pep
GFLIVRPAIPIWWRWYYWANPVSWTIYGVVASQFGENQGELSVPGGKPVVVKQFLKDNLGIQHDLLGYVVLVHFAYIIAFFFVFGYSIKFFNFQKR

SEQ ID NO: 148364 - protein, 82 aa, Triticum aestivum
  Clone ID: PAT_TA_42782.pep
EQDHSDLDIQFEEPQGICCILLCMHTLHPYLDMQQVLNLLLNRVKSKELHLHLLCHDQVICYLLSYADTTYTTDAMKKPPTR

SEQ ID NO: 148365 - protein, 129 aa, Triticum aestivum
  Clone ID: PAT_TA_42783.pep
MKRKTRNKIIVWTLALAAVAILVGGTIALVLTAGTWKAKIKKSQEKICNKGWECSGSKYCCNDTITDFFKVYQFENLFVKRNTPVAHAVGFWDYQAFITAAALFEPQGFCTTGGKQMQMMELCAFLGHV

SEQ ID NO: 148366 - protein, 153 aa, Triticum aestivum
  unsure (1)..(153): unsure at all Xaa locations
  Clone ID: PAT_TA_42784.pep
PRVRSGAVGHIPLGRGKYQLNRGRHYYSAFKKSLRPTSTLKKSSSSGIDKNLKFQISGLTSQIVESETSSLGKLQDFQCLDVAQTLFSKIQKTRPHPSNFDVLSVARSVCCKTSLLAALEVKYGPLPENIFVKAAXLCSDNGIQIDWHQEGFI

SEQ ID NO: 148367 - protein, 142 aa, Triticum aestivum
  Clone ID: PAT_TA_42785.pep
MLCIRTYVRMCGQKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAQWRT

SEQ ID NO: 148368 - protein, 133 aa, Triticum aestivum
  Clone ID: PAT_TA_42786.pep
NQQNDEATARALQAAMNLQQNLARIQAHAVPEHYEAELEINDFPQNARWRITHKETLAPIQDWTGAAITTRGTYIPQGKIVGANERKLYLFIEGPTESSVKKAKAELKRVLEDCANQALNLPGSAQTGKYSVI

SEQ ID NO: 148369 - protein, 61 aa, Triticum aestivum
  unsure (1)..(61): unsure at all Xaa locations
  Clone ID: PAT_TA_42787.pep
MRRHGWQLPYHPLQVVAVSVFLALAFAFYVFFAPFGGRNVFQYVVIGLYTPLXLCVFFLYI

SEQ ID NO: 148370 - protein, 93 aa, Triticum aestivum
  unsure (1)..(93): unsure at all Xaa locations
  Clone ID: PAT_TA_42788.pep
HSLINGCGGLWVCFAWPWMLSVKKNAGTGHLSELSCVSLTVLCSSLVGCARGGKISAAAGGWSMNGCKRHCQKCWGYKKSGAFNFKKKNXLKS

SEQ ID NO: 148371 - protein, 72 aa, Triticum aestivum
  Clone ID: PAT_TA_42789.pep
MHDRSHKPQPPEAGEGAGGGNVDRVLFKNLVEMVPLVESLMDRRVNSAYSRRTSLVYTPAPAKKASELGSVK

SEQ ID NO: 148372 - protein, 63 aa, Triticum aestivum
  Clone ID: PAT_TA_42790.pep
PRVRRAAASVPSVGGDFEKRTESIAAKSRLKTEVRFKADIVSPEQWERCISFDVYALCPILYI

SEQ ID NO: 148373 - protein, 151 aa, Triticum aestivum
  Clone ID: PAT_TA_42791.pep
FIHAVERSIAGIEKKHAKLKGNEKAVVARHEVGHALVGTAVANLLPGQPRVEKLSILPRSGGALGFTYTPPTTEDRYLLFVDELRGRLVTLLGGRAAEEVVLAGRVSTGALDDIRRATDMAYKAVAKYGLNQRIGPISLATLSNGGLDDSG

SEQ ID NO: 148374 - protein, 146 aa, Triticum aestivum
  Clone ID: PAT_TA_42792.pep
HASAHASEIFGPLLPIITVKNIEDSIAFVKAMPKPLAIYAFTRDAALRRRIVDETSSGSVTFNDAVVQYAIDGLPFGGVGQSGFGQYHGKYSFEMFSHKKAVMKRGYLVELTLRYPPWDESKVTLMRYLYRFNYFAFVLSFLGLRR

SEQ ID NO: 148375 - protein, 144 aa, Triticum aestivum
  Clone ID: PAT_TA_42793.pep
DFLGISPEISDSIWSAGLADHDVVVGVLDTGIWPESPSFSDKGLGPVPARWKGLCQTGRGFTVASCNRKIIGARIFYNGYEASSGPINETAELKSPRDQDGHGTHTAATAAGAPVPDASLFGYASGVARGMAPRARVAAYKVCW

SEQ ID NO: 148376 - protein, 124 aa, Triticum aestivum
  Clone ID: PAT_TA_42794.pep
MPRKPKRKAPASPARHDPSPEPYPSHASPCSAQCLVVRDALLAFHGFPEEFAAFRVLRLGGLSPNRDPRPSSPTVLDGLVTTLLSQNTTDAISRRAFASLKAAFPSWDQVVDEEGKRLEDAIRC

SEQ ID NO: 148377 - protein, 36 aa, Triticum aestivum
  Clone ID: PAT_TA_42795.pep
VRHAFVDSLFYASSQAQTEGGGLIGEVRPFVVVLPF

SEQ ID NO: 148378 - protein, 151 aa, Triticum aestivum
  Clone ID: PAT_TA_42796.pep
DAWVHSMHVSSGNLVCHGDIKPANILLDDNLTAKLTDFGISRLLVGGVTRYTTTVKGSIGYMDPIYIQEGRLTPRSDVYSFGLVLCELMAGKGVRKGAINLILYANKGCASGKGFREICDAAIANENNMKILKEMQKLAAECLSLTISRRP

SEQ ID NO: 148379 - protein, 149 aa, Triticum aestivum
  Clone ID: PAT_TA_42797.pep
GRVGSAEHVIATLRGVHPESTKYFLGAAEKLTEELGPHALASALAHLSGFSQPPSSRSLISHEQGWVTLQLTREQGFGRGFFSPRSVTGFLSDVCSAAADEVGKIYLTADENVQGAVFDLPEEIAKDLLTMELPPRNTLTKISKLSALQ

SEQ ID NO: 148380 - protein, 113 aa, Triticum aestivum
  Clone ID: PAT_TA_42798.pep
MAKLPRLRCPFAVLALVCILPLFAPRPALSSRAAPKDGVSFAGAGNTIHQLLKDHGLPGGLLPRGVESYTLDESSGLLQARLSAPCYAKYDNGDLAYFDNVVRGNLSKGALRG

SEQ ID NO: 148381 - protein, 146 aa, Triticum aestivum
  Clone ID: PAT_TA_42799.pep
LLDQLLELEKIRQRESDITKERIDKILKSGANVVLTTKGIDDMSLKYFVEAGAIAVRRVRKEDLRHVAKATGATMVSTFADMEGEETFDSSFLGHADEVVEERIADDDVILVKGTKNTSAVSIILRGANDFMLDENDRSLHDGLCI

SEQ ID NO: 148382 - protein, 111 aa, Triticum aestivum
  Clone ID: PAT_TA_42800.pep
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIG

SEQ ID NO: 148383 - protein, 97 aa, Triticum aestivum
  unsure (1)..(97): unsure at all Xaa locations
  Clone ID: PAT_TA_42801.pep
QAAREEAWAKVSALELEIAATIRDLSIEKQRYXGARERIILRETQLRAFYSTTEEISFLFAKQQEQLKAMQRTLEDEENYESTLMGVDLNKGPLTTD

SEQ ID NO: 148384 - protein, 152 aa, Triticum aestivum
  Clone ID: PAT_TA_42802.pep
PTRPGEGALEPGHGDVAVGGLVELGAVPVPVEATTRRRTPTLSFAGNYSQHALTIWRPSFMQQIRFDAHTPLREAWEIDAHMQSAVRGPGAFNVYGRAGEHPAPWTDPPGPLDRAPAVGTFQIELQQQAQVRSDQSASRTSGRGEALESRAD

SEQ ID NO: 148385 - protein, 39 aa, Triticum aestivum
  Clone ID: PAT_TA_42803.pep
NQVSVINGLVYKCYLFSQKKYFWVTTLQLDPALISRFTC

SEQ ID NO: 148386 - protein, 72 aa, Triticum aestivum
  Clone ID: PAT_TA_42804.pep
MAFLNMEQQTWAFTFGILGNIISLMVFLSPLPTFYRVYRKKSTEGFQSTPYVVTLFSCMLWIFYALLKFGAE

SEQ ID NO: 148387 - protein, 137 aa, Triticum aestivum
  Clone ID: PAT_TA_42805.pep
MAAATSSSTYLAIGRKTLNPAPSVATAATSVSFPATQHPCLVAASADRRRAVAAKVSSPSVIGTAMPSLDFETSVFKKEKVSLAGHEEYIVRGGRDLFPLLPEAFKGIKQIGVIGWGSQGPAQAQNLRDSLVEAKSD

SEQ ID NO: 148388 - protein, 86 aa, Triticum aestivum
  Clone ID: PAT_TA_42806.pep
PSHARSTSSILISFKPPWPWGSPASAATASSLAGHSLHSVPPSIAGPWSEPRLSATPPSKLKLGTVLGRRPCACSLRTGNCTAISS

SEQ ID NO: 148389 - protein, 127 aa, Triticum aestivum
  Clone ID: PAT_TA_42807.pep
APSQKIPHFLRGEESVKDRAPAATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFRS

SEQ ID NO: 148390 - protein, 103 aa, Triticum aestivum
  unsure (1)..(103): unsure at all Xaa locations
  Clone ID: PAT_TA_42808.pep
SGRPLFFYGARQLALSGTGGISRKILDPAPSVTTADTSVFLLATKHPCLGVVFVDRRRAEARKVSSPPVIGTAMPELNLXTSHYKKEKVFLGRREEYIEWGGR

SEQ ID NO: 148391 - protein, 153 aa, Triticum aestivum
  Clone ID: PAT_TA_42809.pep
DPEYDATCNAIEEIKSSLKEYLKEQRKLLRPASVNYVNVGKDMYLIEVPESLGGSVPRNYELQSTKKGFYRYWTPELKELILELSKAESEKESKLKAILQNLIQLFVEHHTEWRQLVSVVAELDVLTSLAIASGYFEGPSCCPTIKESNGTDD

SEQ ID NO: 148392 - protein, 67 aa, Triticum aestivum
  Clone ID: PAT_TA_42810.pep
VHVHLKAALYKILDLVEYFLASHGGRARRLPLRPSLAALAAGCHCHLLSSFPGKGSSTRPSSCPAST

SEQ ID NO: 148393 - protein, 99 aa, Triticum aestivum
  Clone ID: PAT_TA_42811.pep
PSTAATMSSSPSSVNRRPPGPLALGLESLGKKISIGWSPSRAASSPSRVAPTRPHWAMASFPVVQVFSVLRLHPCASAGIIASNLPRLHNLIQRQSKGA

SEQ ID NO: 148394 - protein, 129 aa, Triticum aestivum
  unsure (1)..(129): unsure at all Xaa locations
  Clone ID: PAT_TA_42812.pep
LLLAAAFFGYMLALLQRRVLGMYSNGDEQEDESPVKAKLSSIPPPGRRTLHVICQTTGCSMIISRRDRLRHILXRKKRVNVHHHQLGRPTSWPVQESYAIPRDETAPPLDTRAPTPRKSYAFMLKEPEK

SEQ ID NO: 148395 - protein, 152 aa, Triticum aestivum
  Clone ID: PAT_TA_42813.pep
GRAQELCMLLDDYWERMGLKVPIYFSAGLTIQANVYYKMLIGWTSQKIKDSHTVHNPFDFKHVCHFERSFINNPGPCVLFATPGMITGGFSLEAFKKWAPSEKNLVTLPGYCVSGTIGHKLMCGKPTRVDYEDTHIDVRCQVDFHVISYLAN

SEQ ID NO: 148396 - protein, 81 aa, Triticum aestivum
  Clone ID: PAT_TA_42814.pep
MARIPSLKSLNAFPHAEEHLLKKTYSGAVVTIFGLLIMITLFVHELQFYLTTYTVHQMSVDLKRGETLPIHINMSFSSLPC

SEQ ID NO: 148397 - protein, 84 aa, Triticum aestivum
  Clone ID: PAT_TA_42815.pep
RLLYQSYDVRCDHAYAGTLYSGTHKGERKRGEATHKQEKKKKKGRSRSITHRGSRSFALPSGIKIHAKCHLNLECLLELLLVLL

SEQ ID NO: 148398 - protein, 135 aa, Triticum aestivum
  unsure (1)..(135): unsure at all Xaa locations
  Clone ID: PAT_TA_42816.pep
FLVVDYMTLKLVSSXLAKGIAATDAVHEYXHAKLCDLYENDSVVDKCECCLSGDGLHAATGSYSNLLRVLGCSPESVGASTLEASRNPMRRQVADPTRPARTLTGAVRRGGENTSVDSSGNFCDLLTKLVHLAWH

SEQ ID NO: 148399 - protein, 90 aa, Triticum aestivum
  Clone ID: PAT_TA_42817.pep
MSTSVAAGQAQVVADPSSISKLQADLPIARRHSLQRFLEKRRDRVVSKAPYSPAKSFDGMESAGMEMTADGKQGARPSILKGWGAAKSEV

SEQ ID NO: 148400 - protein, 121 aa, Triticum aestivum
  unsure (1)..(121): unsure at all Xaa locations
  Clone ID: PAT_TA_42818.pep
ISESLRQSLRSKGIKSLFPIQATTFDLVLDGXSDLVGPTAPGQGKNLAFGLANMESLGNGANKGFKRTEHGRTPSVLVLLPTRELANQVHADFEFYGATFGLSACCVYGGSPYRPQEMALR

SEQ ID NO: 148401 - protein, 57 aa, Triticum aestivum
  Clone ID: PAT_TA_42819.pep
VIHKGGPCYYPDNLVSRAAVAMNLYYAANGRHPWNCYFNNSALVVQSDPSYGSCTYY

SEQ ID NO: 148402 - protein, 153 aa, Triticum aestivum
  Clone ID: PAT_TA_42820.pep
HASAHASADAWVQDRVMEETKEKKNAVEAYVYDMRNKLYDKYSDFVTSEDKEGLIAKLQEVEDWLYEDGEDETKGVYIAKLEELKKVGDPIELRFKEWEIRSSAVSQLVYCINSFREAAQSTDQKFEHIDMSEKRKVINECSEAETWLIEKKQ

SEQ ID NO: 148403 - protein, 76 aa, Triticum aestivum
  Clone ID: PAT_TA_42821.pep
GSFVKLIYLRSCYKSLPSTSVYLCEITTKVFNFYIFYCYTDLSVCLGKDIGRFYCWKKGLKNLQPDFNFYFLIASR

SEQ ID NO: 148404 - protein, 152 aa, Triticum aestivum
  unsure (1)..(152): unsure at all Xaa locations
  Clone ID: PAT_TA_42822.pep
RIPAWCDRVLYRDSRTSSQIECSLEXPVVCSISLYYSCMEATDSDHKPVKCVFNLYIAXVDKQTMRQKYGEIMGSNKEVLDSLQGLEALPEVDISTNDIILQDQNPFVVKLHNRSTKELACFEIIGQTPKSSGTPLSGFPSWLKSSPAIGII

SEQ ID NO: 148405 - protein, 90 aa, Triticum aestivum
  Clone ID: PAT_TA_42823.pep
GMVQSSCWRCFPCTFHVQLYTILSCTIHSHISMGIPHYLLAQTAFSIADSEAREVSYFENIIISAFSMSITLAIALSFRWISYGKRRAAK

SEQ ID NO: 148406 - protein, 109 aa, Triticum aestivum
  Clone ID: PAT_TA_42824.pep
PSRDLSLSVLLPRSADPTHASLSAPAVVFVFLTPPASFPDTASAQIRGGFPVPGSKAAGEQASFRRRGPPGGNLSWSRLPPRLLSRRGAEAGITWRSSCVWIDFFVCGG

SEQ ID NO: 148407 - protein, 151 aa, Triticum aestivum
  Clone ID: PAT_TA_42825.pep
PRVRPDPEIDAPWFTRGTLDRFVRFVSTPEVLERVTTIESEILQIEDGIAVQGSDSLGLRSVEYYNGKLVDCMEGSKASYNPDADRALVPYKAGTQPIPPLQNHDATQEENSKDQLLRVLETRKTVLRKEQAMAFARAVAAGFDIDNLVYL

SEQ ID NO: 148408 - protein, 103 aa, Triticum aestivum
  Clone ID: PAT_TA_42826.pep
MSSSVGGGSAGGGGVDMVSLLEKAKDLDQLKKEQDEIVADINKIHKKLLASPEMVDKPVDTILLKLRGLYARAKELSENEISASNALIGLLDGLLQSGASTAQ

SEQ ID NO: 148409 - protein, 141 aa, Triticum aestivum
  Clone ID: PAT_TA_42827.pep
RRALNLGVNVKMITGDQLAIGKETARRLGMGTNMYPSSALLGQNKDESIASLPIDDLIEKADGFAGVFPEHKYEIVKRLQARKHICGMTGDGVNDAPTLKKADIGIAVTNSTDATRNASDIVLTGPGLNGIINAGLTNRAI

SEQ ID NO: 148410 - protein, 145 aa, Triticum aestivum
  Clone ID: PAT_TA_42828.pep
MAADALRGLLPGVYAVLMVIAVTSAASSDASSVVVGLAKCADCTRKNLKAEAAFKGLEVAIKCKNSKGEYESKAMGKLDGFGAFSIPLSTDLHGADCVAQLHSAVENPCPGQEPFRIVPQSSKGNFVVVPGKTDYPSKEWAVATL

SEQ ID NO: 148411 - protein, 128 aa, Triticum aestivum
  Clone ID: PAT_TA_42829.pep
MHMEIGRRIYRERLDTSDRDAVMEQRRAFQKLIYVSNLVFGDASVFLLPWKRLVGVTDSQIDIAMRENAKILYSVQLKSIGRGLDISTLIEVRRAQLAYKLSDEIAAEMFREHAKHLVQENISLSLDI

SEQ ID NO: 148412 - protein, 152 aa, Triticum aestivum
  Clone ID: PAT_TA_42830.pep
SPNLQAAIDGPGKRTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSQTFTFEKGWAFPRRVYFNGDNCVMPS

SEQ ID NO: 148413 - protein, 127 aa, Triticum aestivum
  Clone ID: PAT_TA_42831.pep
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYV

SEQ ID NO: 148414 - protein, 117 aa, Triticum aestivum
  Clone ID: PAT_TA_42832.pep
LPSRFVLHSARNCHRPPRKLHCAQIKTATPTTSASAGDVTTDETKPLPTAPPPPHGLGSPCLPLPSAPRGLRRRPIPTRLNTGSASASVPTYHTHGTCGHLRATAPASPPASAAPVC

SEQ ID NO: 148415 - protein, 82 aa, Triticum aestivum
  unsure (1)..(82): unsure at all Xaa locations
  Clone ID: PAT_TA_42833.pep
KKRGGREWVEENLSKRGRERGGERQXGGGWGGDERMQARWEREVWLNSGLFISPSPLPHSPLASGSSQGSLFLPPLNAPHWN

SEQ ID NO: 148416 - protein, 147 aa, Triticum aestivum
  Clone ID: PAT_TA_42834.pep
HAFAEVDAKTGLEKPRVTAFAHKTLREGHYEAEFKVPASFGPVGAVLLENEHHKEIFIREIKLVTGSDSSTAVTFGCNSWVHSKFDNPEKRIFFTLKSYLPFDTPKGLEDLRKKDLQALRGDGHGERKASERVYDYDVYNDLGDPDK

SEQ ID NO: 148417 - protein, 134 aa, Triticum aestivum
  Clone ID: PAT_TA_42835.pep
VDLVARRLGFKMSPPAYLSLTPVSKFDLFTCRIGANYACGGSGILNTTGNGTLTLQKQITLFFKTQARMSWARCKLKSMGSRSLVLVSAGGNDFSAFSEMGMGEQDAPGYISSMVSTYVQHIDALYKVGARRVG

SEQ ID NO: 148418 - protein, 95 aa, Triticum aestivum
  Clone ID: PAT_TA_42836.pep
AAVVLLLLLLPRFCSPAGDKLTPGESLLPGETIVSDGGAFALGFFAPSNATPGRQYVGIWYNNIPVQTVVWVANRDAPVTVGDARSGNSSSSSSS

SEQ ID NO: 148419 - protein, 77 aa, Triticum aestivum
  unsure (1)..(77): unsure at all Xaa locations
  Clone ID: PAT_TA_42837.pep
MSSGGSMSRAARLGRSTMMHDVHTLLKCEITDLPFFAXRVKSGNNGVNCVIFRHLHEMTFYEADALEALYAELTASI

SEQ ID NO: 148420 - protein, 142 aa, Triticum aestivum
  Clone ID: PAT_TA_42838.pep
PKGTLMSLTSVLLRTGNSSYSSEARHNYTETPKEIQTQHHTINGSPSYNSVQDRYERGTAHCESSTKLDCRKRRLIFQQPQAIPVINLEPQPAPEPSAHVASRVADHLYFDDGFFENLNLDAIEAQATEQWRQKTTQSTHKP

SEQ ID NO: 148421 - protein, 141 aa, Triticum aestivum
  Clone ID: PAT_TA_42839.pep
PFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEM

SEQ ID NO: 148422 - protein, 71 aa, Triticum aestivum
  Clone ID: PAT_TA_42840.pep
FGCPQANSQQFTEPSNPWGPGPLITTFIQGGGRSTPSRRVIGRGGTQILKLVHPWGGPPTQGGLVGFFSQT

SEQ ID NO: 148423 - protein, 141 aa, Triticum aestivum
  Clone ID: PAT_TA_42841.pep
PTRPPTRPPTRPLPPPPRAVKASGTGHRRRKTPAATEPSSVALRRRVGVIQLVDAWRGDPQCEGNLHDASTSLLPVTKKDLQSSIFMEAFAPDKICGSGRSAVTTQERVMEAQSSTCFSKVVGPNLWYGDRTRLTPKQEEA

SEQ ID NO: 148424 - protein, 142 aa, Triticum aestivum
  unsure (1)..(142): unsure at all Xaa locations
  Clone ID: PAT_TA_42842.pep
PTRPFLPVPPTVTVFQIPKTVREGAVXLINKWQLVAPALPDDLMIRIIAFGDTAKFEGMYLGTCKTLTPLMSSKFPELGXNASHCNEMPWIKSVPFIHLGKQATLFDLLNRNNTFRPFGEYKSDYVYHPVPKTVWAQIFVWL

SEQ ID NO: 148425 - protein, 56 aa, Triticum aestivum
  unsure (1)..(56): unsure at all Xaa locations
  Clone ID: PAT_TA_42843.pep
MIYYNQHPNRRAPPAHGYGDKGGYPPPGYPPXGYPPAGQGYPPGGYPQQGYPAESR

SEQ ID NO: 148426 - protein, 116 aa, Triticum aestivum
  unsure (1)..(116): unsure at all Xaa locations
  Clone ID: PAT_TA_42844.pep
MATINININGLPRIGTLVVRVXALHSPHVELVGDNDPFITTDYMTYMFKYDTAHGQXTHHEVKVKDSKTLLFGEKEVAVFGCRNPQEIPWAAAGAXEYVDESTGVYTDKDKAAAYI

SEQ ID NO: 148427 - protein, 45 aa, Triticum aestivum
  Clone ID: PAT_TA_42845.pep
AFYYKTYPYTSLFCRLRPGQVYSHSGSQQFFDRTSDNGARWNQVR

SEQ ID NO: 148428 - protein, 69 aa, Triticum aestivum
  Clone ID: PAT_TA_42846.pep
RLTIPASLQKFIQRTHRYFRKNIVGYTHQWLGGHISSVELLRLIVAPTGRVGDATSTGLAGANSASRCF

SEQ ID NO: 148429 - protein, 66 aa, Triticum aestivum
  Clone ID: PAT_TA_42847.pep
KPLYKTHNLGNTFGSTFRLGTGLIIHHCLIHSSKESSSGAPFQSHANRDVMFVGPMSRRITRCSCG

SEQ ID NO: 148430 - protein, 71 aa, Triticum aestivum
  Clone ID: PAT_TA_42848.pep
HDPVSEGSGFGEWGGYGWRRKDRTPRRIQTRRRRDHTRSSCCEEGVKPAPRGDVTERPHVKVGKPPGIGNR

SEQ ID NO: 148431 - protein, 63 aa, Triticum aestivum
  Clone ID: PAT_TA_42849.pep
HAVMLQTKQSQVFCRKGGTAQRTRSRSSTPIFAIVSCVGAGPGTSARGEGGASRSADPRDGSW

SEQ ID NO: 148432 - protein, 57 aa, Triticum aestivum
  Clone ID: PAT_TA_42850.pep
HDALGPEEDLQLLHRLPHLAHPLPPHAFHMSSAMSAPLTRVFALEVPGHVSADVGLG

SEQ ID NO: 148433 - protein, 137 aa, Triticum aestivum
  unsure (1)..(137): unsure at all Xaa locations
  Clone ID: PAT_TA_42851.pep
LSFIARKVVSRGIKPYIPDFRTAFEHFCIHAGGRAVIDELQRSLTLSDEQVEASRMTLHRFGNTSSSSLWYELAYVEAXGRMRRGDRVWMIGFGSGFKCNSAAWECIRPPAAPGGADGPWAACVHRYPVDIPDVLKH

SEQ ID NO: 148434 - protein, 120 aa, Triticum aestivum
  unsure (1)..(120): unsure at all Xaa locations
  Clone ID: PAT_TA_42852.pep
MASYNPANPSTPAPSAPPLYPSLTMADLAPPEIPRSPAFPDAPPPSDDVLLRVPGAQXHLIDRQRSHPLAAGELSLHRIRAGDTSLADIAALGAVQWPLARDVAVVKLDPRHYSFFFAVP

SEQ ID NO: 148435 - protein, 68 aa, Triticum aestivum
  Clone ID: PAT_TA_42853.pep
SVSRFNRTQWRVICQLCKPNATLIVYTTEIHVCKIMLLNILHKQFAQFILCCVLKRNHVIHGSTLIYR

SEQ ID NO: 148436 - protein, 39 aa, Triticum aestivum
  Clone ID: PAT_TA_42854.pep
TALSYNGRDRSLSNITSFLKVIPWSNQFNATVWTIFIDL

SEQ ID NO: 148437 - protein, 65 aa, Triticum aestivum
  Clone ID: PAT_TA_42855.pep
VIMTTSFWSILYSLSSGLVGGKKNGDPACIIFFFFRFHFQDDIGKVMVAYARGIRLFVLFLLDDV

SEQ ID NO: 148438 - protein, 51 aa, Triticum aestivum
  Clone ID: PAT_TA_42856.pep
AVFQVRTEHGHELKQLESLTKLQGNPKIHHLENVKNKEAGDAKLADKKRLI

SEQ ID NO: 148439 - protein, 81 aa, Triticum aestivum
  Clone ID: PAT_TA_42857.pep
ISLMGVPCMLPAAQAQVLKGPSSPKRLISRTVALSVYADFFSKTEPVKIVNKSGGLVICASLEVYAQYSISVTVSLACRLC

SEQ ID NO: 148440 - protein, 52 aa, Triticum aestivum
  Clone ID: PAT_TA_42858.pep
LQQSYISYEDNMTTLRQTMSGFKFSTICFLPMLQFNGHILQFLDLLLVDNKI

SEQ ID NO: 148441 - protein, 39 aa, Triticum aestivum
  Clone ID: PAT_TA_42859.pep
RLEASFGADAAELSVKNCDQEHVLPDGHGLMGAGFLPAS

SEQ ID NO: 148442 - protein, 139 aa, Triticum aestivum
  unsure (1)..(139): unsure at all Xaa locations
  Clone ID: PAT_TA_42860.pep
ASPPPPSWIRRRNPTPSSPTCSPASPPSPSPGPPPGPTSTSSSRRSTRRPRARPPSASSSSSSGCRASATPPCSTPXPRRRRRLRRPLRAPGAGPAPRPRAHRLLPRRRRRRRRRRRCPADHRGGPRGVPYRGAVRGGP

SEQ ID NO: 148443 - protein, 54 aa, Triticum aestivum
  Clone ID: PAT_TA_42861.pep
VESKDNITLNWYLSNNRAMLVANCLFRMVFTMILVSDKRLNRMGSLYKHDHTGR

SEQ ID NO: 148444 - protein, 63 aa, Triticum aestivum
  unsure (1)..(63): unsure at all Xaa locations
  Clone ID: PAT_TA_42862.pep
ELPADSKIHPVFHVSHLKSLTXTTVSVFSELPATTDLITKETIPVEILDRRMMNMGNAPVVQL

SEQ ID NO: 148445 - protein, 64 aa, Triticum aestivum
  Clone ID: PAT_TA_42863.pep
PTRTPTRSRTRGGSNSIRALGGGASGGFCLLLLHCWFQWTATVISSKSYPMGSISLDSFLCAYL

SEQ ID NO: 148446 - protein, 141 aa, Triticum aestivum
  unsure (1)..(141): unsure at all Xaa locations
  Clone ID: PAT_TA_42864.pep
VESYQLHWPGIWGNEGYLDGLADAYEQGLVKSVGVSNYSEKRLRDAHERLKKRGVPLASNQVNYSLIYRNPEENGVKAXCDELGITLIAYSPIAQGALTGKYTPANPPTGPRGRIYTFDFLSKLQPLINKIRENGGSYDKT

SEQ ID NO: 148447 - protein, 59 aa, Triticum aestivum
  Clone ID: PAT_TA_42865.pep
ANGLLDGEVEPVNDVNTNPWSSICSTVCCPMIVEQTVTRMVQSTANTIFLFLRFLFLFF

SEQ ID NO: 148448 - protein, 48 aa, Triticum aestivum
  Clone ID: PAT_TA_42866.pep
NKNIELVAQKNEIQDIGEYKWIKLSTDSIHFKPKINEITALSCFLQTQ

SEQ ID NO: 148449 - protein, 87 aa, Triticum aestivum
  unsure (1)..(87): unsure at all Xaa locations
  Clone ID: PAT_TA_42867.pep
IPGSPTRSPHQVRVEIESLFCGTDFSEPLTRAXRFEELNIHLVRMTLGPVKKAKDEACLEKTQNHEMALVGGSTRISKVLILLEDLL

SEQ ID NO: 148450 - protein, 137 aa, Triticum aestivum
  unsure (1)..(137): unsure at all Xaa locations
  Clone ID: PAT_TA_42868.pep
GAWADAWANMSFDELLKAFASKHEGNDMPGNLSGGILIDQVYAVAPNDLNTLLFSPSSDFLQSLAKMQGTTGLDIQQWRLXNDGEILKRVITYTKAATKLVKAVKATEDVTYLKADGDIDAVLTDVXLPEVPFGNNF

SEQ ID NO: 148451 - protein, 119 aa, Triticum aestivum
  Clone ID: PAT_TA_42869.pep
NRPGSPNCSNGYEGDGGWAQHSYIQQFPQQDNYLKHPLCVMTTSVFRAPCGVQVRVVWWSSRLGLSSFTQCSGTWPSLHVVTNGLAPGVARTTPAPAACRRSPARSRASAVGSSICFSL

SEQ ID NO: 148452 - protein, 88 aa, Triticum aestivum
  unsure (1)..(88): unsure at all Xaa locations
  Clone ID: PAT_TA_42870.pep
MHIFVKTLTGKTITLEVKSSDTIHNVKAKIHDKEGIPSDQQCLIFAGKHLXDGLTLSDYNIHKESTLHFVLKLRCGTMINVKTLYWER

SEQ ID NO: 148453 - protein, 58 aa, Triticum aestivum
  Clone ID: PAT_TA_42871.pep
DARTSALPFPSFVKQTGGAGKQYTSSSNFSIGTLIVLMADYPPLLMRRPTKIRVTSSI

SEQ ID NO: 148454 - protein, 69 aa, Triticum aestivum
  Clone ID: PAT_TA_42872.pep
RYYCCVAYIDRLHWAIRMVIYLSGAIDKSMIYTIVVYLRKITRFSLKSQLFVYFCRLASAFFIAGEFLS

SEQ ID NO: 148455 - protein, 74 aa, Triticum aestivum
  Clone ID: PAT_TA_42873.pep
KTLSRTRMPTPILLYRAWNSWTGLSPSTQAYQATVSASVHLVPDSVANKRTRVVMKIASYQKLCQLLVEDTKVL

SEQ ID NO: 148456 - protein, 92 aa, Triticum aestivum
  Clone ID: PAT_TA_42874.pep
KALVCHFSFIKRWKMYIGAYVIWSLRRLALSLATTGIYGSTGCMLFKSCFMILSWYKKNPEIWLVNKNKSNVAWTCYLLRSVLCKSYLVMVK

SEQ ID NO: 148457 - protein, 136 aa, Triticum aestivum
  Clone ID: PAT_TA_42875.pep
ALLILLLRWPSGATEGRRGASFPAAPCFVRCRGPCVPGRRCLPGPAADTPSVLWQQVRSPTGVESGQRQNVGEEAGEFSGEKVIAEFERLTRDAAIVQRETLRRILAENGNTEYLRGLGLGGRTDAASFKQCVPLA

SEQ ID NO: 148458 - protein, 112 aa, Triticum aestivum
  Clone ID: PAT_TA_42876.pep
NPDRDLLPRNSLKLVHTNRIPVPLDQLGPDRRQPGGSRRSPAARELGLQLQQPCPRETIPGCDYEYEHWMVIMEGPPGDASNPDIHRNEIIDGYIKTLAQVVGMYAVPLPYP

SEQ ID NO: 148459 - protein, 36 aa, Triticum aestivum
  Clone ID: PAT_TA_42877.pep
QIKLYFFLPLYALFYFIINYFLYPDGIFLGIHLDGV

SEQ ID NO: 148460 - protein, 37 aa, Triticum aestivum
  Clone ID: PAT_TA_42878.pep
VTSALPYTMSEASPCQGSEGVTETSTPPASCSSRGTP

SEQ ID NO: 148461 - protein, 146 aa, Triticum aestivum
  Clone ID: PAT_TA_42879.pep
HSHQPEKELASEDATLLPNQDLVGWAAVENMPSKDADVNSSNSKDEDDTTEETPAFSTPTVIIRSAADCDAQDVANGPTKKRSKAASSKVAKPSPRASKPTKEQQEARKATPKKASTTSTAKKSKKEKADDSASNGLDKGKADDSA

SEQ ID NO: 148462 - protein, 49 aa, Triticum aestivum
  Clone ID: PAT_TA_42880.pep
SAQVIGLLRCRLGKSWHPPRTLTTSFPLLRERVMSTGDVYHSRNLRLSR

SEQ ID NO: 148463 - protein, 79 aa, Triticum aestivum
  Clone ID: PAT_TA_42881.pep
PRVRRRLASNHLRTVLMMQYVLPKVYRARTRGAAARRMQYATHGGTNPAATATYYVMKYLMTCGTTHSTGNRDIARDGT

SEQ ID NO: 148464 - protein, 58 aa, Triticum aestivum
  Clone ID: PAT_TA_42882.pep
CPSVVGAKVVTAYQAHLGTLYISPGTNYVCGHHSILVVEHRPFLVQSNITIKQSVSQI

SEQ ID NO: 148465 - protein, 85 aa, Triticum aestivum
  Clone ID: PAT_TA_42883.pep
HREGCIGSTGQETLQDQEEYLYLWMGPALYNGGSRCVKYLSVTTPKCWAVDSEANTRETDGSYNAYVVEVGSSVIYHRGLHWIKD

SEQ ID NO: 148466 - protein, 64 aa, Triticum aestivum
  Clone ID: PAT_TA_42884.pep
SSTNPLSSFILGQYVVPLARTPAWRHLIILLLLQVIHLLIVVVRVLTVAQSMQIPTFRWALVTS

SEQ ID NO: 148467 - protein, 72 aa, Triticum aestivum
  Clone ID: PAT_TA_42885.pep
NFYDICYTCNLNNQSKIMFQHGFYSVFCFRNFTLKQRQVIWTGGSSNFCLFKDCNPIGMFFLYICLEQGMSF

SEQ ID NO: 148468 - protein, 114 aa, Triticum aestivum
  Clone ID: PAT_TA_42886.pep
FPDGRYDPQLLRHLPVISSVPESSHQKKPYYGAPPPVTARFLLLLLLDADAPQEPTGARPRPQSVCPLRHGQLLPLIPIPPLPHPLCSISDLLFSGPDLLLPPFSFLIGLDWIG

SEQ ID NO: 148469 - protein, 54 aa, Triticum aestivum
  unsure (1)..(54): unsure at all Xaa locations
  Clone ID: PAT_TA_42887.pep
MLLCMQSAEAVKTVKICCIXVGYVRGPTMVVIAIKCPTIEVVVVDISKPRIHAW

SEQ ID NO: 148470 - protein, 61 aa, Triticum aestivum
  Clone ID: PAT_TA_42888.pep
DGGTTRAATDDISHLSTSAWGRSIFGEDYSDIVLTGKDLVNSGDDNYLTHYDAHGRVALHP

SEQ ID NO: 148471 - protein, 151 aa, Triticum aestivum
  Clone ID: PAT_TA_42889.pep
PRVRVNGSRNLLKLCDFGSALPAGINDITPILVSRFYRAPEIILGLPYDHSLDMWSVGCCLYELYTGKILFPGGKNNGMLWLHMELKGPFPKKMLRKGAFTTQHFDQDLNFHATDENLMMKKAVNKLCMNVKPKGVGGKISSFAGEDPKML

SEQ ID NO: 148472 - protein, 108 aa, Triticum aestivum
  Clone ID: PAT_TA_42890.pep
LPAYVSMLKFQDRLHAHEYFHKAAARAIRCYMKLHDSPLKSSAEENDELSKLPAAQRKKLRQKQKKAQARAKREAEEKQEDETTSTNSSKSGEKQQARPVDLDPHGEK

SEQ ID NO: 148473 - protein, 73 aa, Triticum aestivum
  Clone ID: PAT_TA_42891.pep
MTAKEKALCPRPRPLQMTNKKGNSGSPANCKSTMMHKSLPPSSSEHCGWLAVSLLVAVNPPPTELQVGVRQKR

SEQ ID NO: 148474 - protein, 75 aa, Triticum aestivum
  Clone ID: PAT_TA_42892.pep
NRASRAMLNHDIHLAVRVVLLVTIASAIVSAADSVVVTERATHTSRVTCDSLLDSCYNNYLAATARADSFAYSLD

SEQ ID NO: 148475 - protein, 83 aa, Triticum aestivum
  Clone ID: PAT_TA_42893.pep
WRFRRTLTPSTWPLLADPDLRIQIAETPPYGVAGVLTAGPNLWGLFIQSDDSLPTGPPLGGATSSLVTLGIRWMFTCSLIEDN

SEQ ID NO: 148476 - protein, 107 aa, Triticum aestivum
  Clone ID: PAT_TA_42894.pep
FACTAVRWYPRLSVPQFLLRHYIPGSQHAAIPYYAPIMSCAKLSSSCSQVSQHSWYGFRKPRAPATFCPVCSEEHCGHTAWCSAQSALVHSSLALNMVPALCECMCL

SEQ ID NO: 148477 - protein, 97 aa, Triticum aestivum
  unsure (1)..(97): unsure at all Xaa locations
  Clone ID: PAT_TA_42895.pep
IMCDVADYVVRAVLXQRVDKKLNVIXYASQTLDIVQINYATIEKXFLAAVFVCDQFRPYIVDSKVTVYTDHAGIKYVMEKKDANTRLIRWIFLLQEF

SEQ ID NO: 148478 - protein, 47 aa, Triticum aestivum
  Clone ID: PAT_TA_42896.pep
VEVEVGAHAVERVLSGRSGGFVNSSSRGGAFGDSRFPRSCGGFGRSR

SEQ ID NO: 148479 - protein, 118 aa, Triticum aestivum
  Clone ID: PAT_TA_42897.pep
MALRRAIGSLVVRSQAYYLRRAAASPPPSFSRPIIPYRSFAAPPQHAKKVTKGDDADAGPRINNDITAPFLRLVTDEGHSVVPRHEALQLAARMGLDLVEVHRKTDPSVCKIMDFHKE

SEQ ID NO: 148480 - protein, 78 aa, Triticum aestivum
  Clone ID: PAT_TA_42898.pep
RKTILGTSSRHDRLALRTASVTADKTGSFESHSYQLATMSAPVTSFVVNSSVPLYLSQPAIGPMHDSSSAMGLACPHT

SEQ ID NO: 148481 - protein, 101 aa, Triticum aestivum
  unsure (1)..(101): unsure at all Xaa locations
  Clone ID: PAT_TA_42899.pep
MSRGGSAGGGQSSLGYLFGDGEPAKPXAAAPAAKPAPAEKPAPAAADVAKQIPAGIPGSRANNYYRADGQNTGNFLTDRSSTKVHAAPGGGSSLGYLFGGK

SEQ ID NO: 148482 - protein, 69 aa, Triticum aestivum
  unsure (1)..(69): unsure at all Xaa locations
  Clone ID: PAT_TA_42900.pep
RAAAARSLMRGGGGGQGRTPGSGGQXGSGGGGSVSGQXPAAGGEGGAEGAPAPTNSHGGDGGHCRGEEK

SEQ ID NO: 148483 - protein, 110 aa, Triticum aestivum
  Clone ID: PAT_TA_42901.pep
MDPTISADVVTEATPTPASMAVLNQMVCSSAPAPIITVVSKQLVLPEGTAPVEDLNLSSSDMPMLSCHYIHKGLLFPATGMPNARLMSSLALSLSRALGVFPALAGRLVT

SEQ ID NO: 148484 - protein, 83 aa, Triticum aestivum
  Clone ID: PAT_TA_42902.pep
TVYRQGSCGLHASRYSADAIKARMYNIGIAAGVQSMTGNKANLVEKSNPKGVLFAQTRDCLLPIGLTCENGAQRFGITRIEQD

SEQ ID NO: 148485 - protein, 75 aa, Triticum aestivum
  Clone ID: PAT_TA_42903.pep
LGDGALTSCVPGVDYPCHSGAHTDTGARAYALTRLLRWRLWQCIYRAAQVSAANTFTELAAEKHLQNQDGWCRRR

SEQ ID NO: 148486 - protein, 148 aa, Triticum aestivum
  Clone ID: PAT_TA_42904.pep
PKRATEQNRWPAMTSGRGPANLMPNTELSDKSSKPVTLSNTSRGLSPKKISASEDTGKRLNQSLDDVARRLAIHAKRRDEQLDSGSDVYSQTTERSKYVSRPSRTTTLPVPVLHRSSSPNKVLSAASSASRAFQSPSRTRPSTPCRSQ

SEQ ID NO: 148487 - protein, 105 aa, Triticum aestivum
  Clone ID: PAT_TA_42905.pep
SQRKGGDFLGEKRVSVAGVRTSLTDLSGSIDNRSSGSKNRVGTHMPCAADIYGSPIVGSSRLAIASRRQFSSRPNSASTMSSEPVSSNAEPRYWWGINRFIYLNC

SEQ ID NO: 148488 - protein, 61 aa, Triticum aestivum
  Clone ID: PAT_TA_42906.pep
QLAAIANNQHQQQSSSIYFYRNQGEAKSAASAVANNQCHMAVLSISTHAPHRHLHTSQART

SEQ ID NO: 148489 - protein, 123 aa, Triticum aestivum
  Clone ID: PAT_TA_42907.pep
MDEEYDVIVLGTGLKECILSGLLSVDRLKVLHMDRNDYYGGDSTSLNLNQLWKRFKGDETPPASIGASRDYNVDMVPKFMMANGALVRVLIHTGVTKYLSFKAVDGSFVFHKGKIHKVSSTDM

SEQ ID NO: 148490 - protein, 128 aa, Triticum aestivum
  Clone ID: PAT_TA_42908.pep
MGGRVGAPSPSACSPIFSSSPAIGLRNIRRRGERKRQPIIARRSSSVRPASSAAMGFFTRSTSKQTAKLKSLVKLAVARLAVVRRPRLGRRSIARGDVAQLLSIGHLDRAFSRADHVMDEDSVLDALD

SEQ ID NO: 148491 - protein, 95 aa, Triticum aestivum
  Clone ID: PAT_TA_42909.pep
LWSNLRTNLNTLQISTLIYMLIFFEEIVYSYVIIEGYHLMPSYAAHGHQAIAALATVLQPHKPMVRAYSHANLASDSPPEKSSPWSEQVQIYLWH

SEQ ID NO: 148492 - protein, 110 aa, Triticum aestivum
  Clone ID: PAT_TA_42910.pep
PMVGDSGTEDHAMHDQRREGPEQHPLYTEFFRSSQWVGPRDHVQVCPVHRRLTSVVAPTERGGIRGWRRLFHALTKAASIEARNRTGYGGCRVRSDGGSAGSGGSRKRVA

SEQ ID NO: 148493 - protein, 115 aa, Triticum aestivum
  Clone ID: PAT_TA_42911.pep
DLLYEPWQVYDENGLAFTTFNMYWEKCMKLHIEISSSLAPWRLVPVSGIENICSSSIDDLGLESSKDEESSNALLSRAWSPGWRNAEKTLEDFVSHGLLDYSKDGMKVAGTTTSL

SEQ ID NO: 148494 - protein, 144 aa, Triticum aestivum
  Clone ID: PAT_TA_42912.pep
RRYRQGSTAAPPRRGAALTGSRHRPGASRAGRRRRTPSPCHDCVVTTRPDPDRVGRRIRTALGAKQSESPMVRRWREKGKPEGGRGPVGTVPARCVADLLSRLIMGCVSGGAEQAKTKTERVCVGYAEGAGACARAPALFVRAP

SEQ ID NO: 148495 - protein, 142 aa, Triticum aestivum
  Clone ID: PAT_TA_42913.pep
GKSVCPTSFVRREVGKSTFGNADDSLRTASQILSIMKPPAGLSHFATQLRTSVQSCLKLDTAHAKNSAITHNRNELSGNAYPTYNHQVIMKPPAFDALDLELIDLPGSEMCNANEQKLESSGNLNTVNCNGTGSAPISNVTS

SEQ ID NO: 148496 - protein, 115 aa, Triticum aestivum
  Clone ID: PAT_TA_42914.pep
AAAVLFRQSSLSSQHDHALANINRRASPSGSGGSEISYHADTTLMTNSHSIASGAQLSSSSSGDSVYKSFRRDSSPDIPDLQAAVSEIATNLKHSHDQDDLKLQIESMKVKLRHL

SEQ ID NO: 148497 - protein, 150 aa, Triticum aestivum
  Clone ID: PAT_TA_42915.pep
DSPPPDPPSSLPGRAVPSPLGFFPHRRRPTPNPLLAPPTPSHPHPAPPTPVPPLPGNDVPAPNSSSFPWSWRHHVPSGALDALSSPPQTGVASTTVTSCHHQPRLPGSLVPFHGELCLTWNSDHPTTRSIQGRQGAPGCHRRPHAATTFM

SEQ ID NO: 148498 - protein, 96 aa, Triticum aestivum
  Clone ID: PAT_TA_42916.pep
SARGISRPPARPPGSSRGPSLPWGSLADRGAYAGGHRRRRKREEGGQRVPPLWSQLRGHTMRRYQLCSVRRCFPGTPMRPPIINLLLSQQNGFFFL

SEQ ID NO: 148499 - protein, 49 aa, Triticum aestivum
  Clone ID: PAT_TA_42917.pep
ALPESGSPPSLLSLIQRSWDSDPERRPSFGDIIEELNASVLHLTHHLEI

SEQ ID NO: 148500 - protein, 151 aa, Triticum aestivum
  unsure (1)..(151): unsure at all Xaa locations
  Clone ID: PAT_TA_42918.pep
EYYPNGCDYQWDGWVSVSIGLEDDEYDDADDDEQRQPVKVRLAICLIDQFQWDQSVYIHECETEDFVLNPVVCDKDFIRRSTLERSSHLKDDSFIIRCDVIVLDVKXTSTRRLALPPSFISSSKSLLXDMAIHYKYLLMSKEGADVTFEVG

SEQ ID NO: 148501 - protein, 55 aa, Triticum aestivum
  Clone ID: PAT_TA_42919.pep
DMILNPFFFHLILMPPHQIYLVDMHDTIYDTPITTSLRDSHGMGRPEWCHWPINF

SEQ ID NO: 148502 - protein, 106 aa, Triticum aestivum
  unsure (1)..(106): unsure at all Xaa locations
  Clone ID: PAT_TA_42920.pep
PTRPAGEPNTMVLFEEAGGDPXRVNFHTVAVGAACAEAAEVGDXVALACSHGRTISSVYVASLGVARGKCGAYEGGCESKVVLAAFTAVCVVMESCSVRHTEDFLA

SEQ ID NO: 148503 - protein, 87 aa, Triticum aestivum
  unsure (1)..(87): unsure at all Xaa locations
  Clone ID: PAT_TA_42921.pep
VHCQIVHLLDWFIYLLKYVRHVARGYARQTEWFTACSHCHCGSTRVDAKAVHSLYIYTYIYTPSVRKYLTXKVMDTVIDASMFSTTV

SEQ ID NO: 148504 - protein, 129 aa, Triticum aestivum
  Clone ID: PAT_TA_42922.pep
AEFKAKAHLPHLSVVFSLLLICRSLLKLVAKRWLWIANKLLLPPPDPLLQLSDAPQIGLLRLSNALHPRLCTGLAHGDLHQRQPAVDELHLRRAAQSTRVSSLGFPLCRYCVRSIDLLCLFPTRPPTRP

SEQ ID NO: 148505 - protein, 105 aa, Triticum aestivum
  Clone ID: PAT_TA_42923.pep
LSSKASRQAGSTLRSISVPVHVRLCLSVKPIVGSGLGRERLAVDSRAGETRRRRGLGLPHEQRSGPRRDQQMPGVGGGMAVGWRRDWEGGREGSRKKRWKLRGGR

SEQ ID NO: 148506 - protein, 128 aa, Triticum aestivum
  Clone ID: PAT_TA_42924.pep
PTRPRTRGCKLALLDSVLASRRLTCHILLSTQVWYLENRYSTKRTFLTLVSRHMKVMSKHNPLKQKHGEVAGCIFCLEMILFTDHILFVWWLYFVTLAWMSVIKYTISRFLLGKEICSSEYFIFPGCS

SEQ ID NO: 148507 - protein, 151 aa, Triticum aestivum
  Clone ID: PAT_TA_42925.pep
LFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVADHPESNSGVDLAVTVLTTD

SEQ ID NO: 148508 - protein, 153 aa, Triticum aestivum
  Clone ID: PAT_TA_42926.pep
PTRPPTRPRTKPQRSLRTAAAPAPPGSAVVDAAEPWPAARPSSSPRSSSSPWPSRRWPTPRRPPRTRRRRPPTPPRPTRRPPTRPRRGPPMDRRLPPGLRASPASRPTTTTTTTSEPECMPFWKDPFDADQIVRMDFSFETIIILLRIGLLPC

SEQ ID NO: 148509 - protein, 61 aa, Triticum aestivum
  Clone ID: PAT_TA_42927.pep
RFLGLDKVLKGLFRNMTSPNLTFRERVELLPVRRRRRRGFRNQNGKQESHGPRGSSPKRFG

SEQ ID NO: 148510 - protein, 150 aa, Triticum aestivum
  unsure (1)..(150): unsure at all Xaa locations
  Clone ID: PAT_TA_42928.pep
ASPGFEKQMFQEWLRSMLREHGGPFFDAFRSKHPERTGAYTCFNQKVGAEEYNYGSRIDHILISGACFHDCNSVEDHSIFHCHVEDCEIMNHFRRGDSGNISKWKGWRSSKLDGSDHIPSYMILNGIPXLPAHNTPPSGGRYFPEIRGRN

SEQ ID NO: 148511 - protein, 123 aa, Triticum aestivum
  Clone ID: PAT_TA_42929.pep
AAVGMDGAHGVAQQRSIYARRLLYVFPVCSKIRLDFLFHQVSGVDTNVYCSFFAAELAHQVMPTRTCMTTPATCVGHDTPVVAAEAAASGIGGHDLSSLAALSLQQAHTRRRLGWSWRWVSQL

SEQ ID NO: 148512 - protein, 125 aa, Triticum aestivum
  unsure (1)..(125): unsure at all Xaa locations
  Clone ID: PAT_TA_42930.pep
PRVRGHVGQDVKVMVFFSSCSSAKFHAEFLNFLGIERYDIHGQLKQQKRTSTFFQFSKMNKGILLCTNVAARGLDISNVDYIVQDDPSDDLNDFIHRVGRTARGDXGIGRPVLFLLPKEMKLLIY

SEQ ID NO: 148513 - protein, 72 aa, Triticum aestivum
  Clone ID: PAT_TA_42931.pep
QIIGEGLGSLGIKELELLEKQLDSSSRYIRSTRLIDCFPYNHDLEDRSTSSFIMYRKQYKLFLCTACFYSVK

SEQ ID NO: 148514 - protein, 98 aa, Triticum aestivum
  Clone ID: PAT_TA_42932.pep
MSSPEPGSIASRWRELHGAGSWEGLLDPLDQDLRAFIIAYGELAEATYDGFNSQRRSPHAGACFYGHADLLAAAGVSRAGYYSVTKFIYATSGFFLAP

SEQ ID NO: 148515 - protein, 89 aa, Triticum aestivum
  Clone ID: PAT_TA_42933.pep
SPLSTWDSHQHKVVEYREKLAACLCTPCVAHGSTSPPKLASPTARRLPEKKGSRWVTQQLVGVDVQGAAGTAMEVAGGGRRPSSPFALL

SEQ ID NO: 148516 - protein, 74 aa, Triticum aestivum
  Clone ID: PAT_TA_42934.pep
PRVRECNEMIGDNCCLPLVTRRKRTLVTSTTNHHLHIGCRHSFDLCMSNMFLAYIERYVIAYCLRSRRRCMRWG

SEQ ID NO: 148517 - protein, 113 aa, Triticum aestivum
  Clone ID: PAT_TA_42935.pep
MGMWRDSMHKRRATGGKQKAWRKKRKYELGRQPANTKLSSNKTVRRVRVRGGNVKWRALRLDTGNFSWGGEAVTRKTRLLNVAYNSSNTELVRTQTLVKNAIVQDDAAPTKRG

SEQ ID NO: 148518 - protein, 59 aa, Triticum aestivum
  Clone ID: PAT_TA_42936.pep
CPQRWRKGLGTEMSREVLLHIVALNRILVASFVVPLLDNMPDQISLHAGGLALGHWSAP

SEQ ID NO: 148519 - protein, 104 aa, Triticum aestivum
  Clone ID: PAT_TA_42937.pep
MARTKQTARKSTGGKAPRKQLVTKAARKSAPTTGGVKKPHRYRPGTVALREIRKYQKSTELLIRKLPFQRLVREIAQDFKTDLRFQFHAVLALQEAVEAYLGGA

SEQ ID NO: 148520 - protein, 113 aa, Triticum aestivum
  Clone ID: PAT_TA_42938.pep
SSRPDPPPLQGLGSSCRWYRGATAAVGPLSTPVNLGVSIVPERKVFVVERLGMYHKSFSSGIHFLVPGIDRIAYDHSLEEEAIQIPVQPCHHKGWHLDLDWRSAHMLSMPFLS

SEQ ID NO: 148521 - protein, 113 aa, Triticum aestivum
  Clone ID: PAT_TA_42939.pep
AGLVSVSVFDHQVRSRAIWPVGGCDCCLSEERGSSLLNFGFSLWMGGPLVDCSAEGVSSSSCLSRSTCGKAGFEHSSCALPEDEKFEAGIACVKDDLVVKEISLALVEVIACL

SEQ ID NO: 148522 - protein, 110 aa, Triticum aestivum
  Clone ID: PAT_TA_42940.pep
RTRGVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 148523 - protein, 97 aa, Triticum aestivum
  Clone ID: PAT_TA_42941.pep
MKEVAIFQEKKMMQANTEKAVKFQIASCLPMLAIIYMDHIHIPVGLPNEHVIDYFMSRICFVCQKDFDWLDNVDKNNLTLVQPFYGKHTQVILLHLV

SEQ ID NO: 148524 - protein, 52 aa, Triticum aestivum
  Clone ID: PAT_TA_42942.pep
ASLLTLVLWMMISQVMVSVTGCELLRCVGWLHYFFLGPSVWMISQVMMCNRL

SEQ ID NO: 148525 - protein, 127 aa, Triticum aestivum
  Clone ID: PAT_TA_42943.pep
MARFLVALLAATLVAVQAGGQLGHAAPATAEVFWRAVLPHSPLPDAVLRLLKQPAAEATSFVRDPEDRPPFDYRDYSRSSSDDEPSKRTGAASGAGGFDYDNYSGADERRGATDEYKAPSSSPAGSG

SEQ ID NO: 148526 - protein, 52 aa, Triticum aestivum
  Clone ID: PAT_TA_42944.pep
PRVRASDTEATEEAVSFALDYAKKLGLCKSGDSVVAVHRLSASSLVRILTVN

SEQ ID NO: 148527 - protein, 133 aa, Triticum aestivum
  Clone ID: PAT_TA_42945.pep
KNAATLCLAVLRPAPPPRATPRASCAAGTPPPSSSPAHSPPHPSTPTNHCPVHHRWAPPPTTHPPAPTPTTQSYPRPGAPIHLPSHRVAPPGPQKHRPTWDPSGQPPKGASRRCFRANNYSHPSPRLVASITL

SEQ ID NO: 148528 - protein, 75 aa, Triticum aestivum
  Clone ID: PAT_TA_42946.pep
FCAVQRYCGVFVAPRQRPRLDRAQGVRTGSPGLPGWRHVHAHIYQRSTYQQSQPSREKAHPCRQWIHKGTQLRHG

SEQ ID NO: 148529 - protein, 45 aa, Triticum aestivum
  Clone ID: PAT_TA_42947.pep
DLKQAHEQVCASISSDSTNMNELVQWNELYGEGGSRKKTPLSYFM

SEQ ID NO: 148530 - protein, 107 aa, Triticum aestivum
  Clone ID: PAT_TA_42948.pep
LQKEVDRLTELAERALLDASKAEEDVSNIMVLAEQAVALEMEAAKRVNDAELALQKAEKAVESVVELVPAADGHMSDEEDDLSDVYDYSGDGMADISEGMRCQMSSV

SEQ ID NO: 148531 - protein, 93 aa, Triticum aestivum
  Clone ID: PAT_TA_42949.pep
PCSHCKEEKDWDVRAPAGKPCVHCSSSSTSIQVRGEVARGLRFQQRWGLSVQFPQYPRNPKYDSIGHVSYGMSRRTGEGVGMAGGHLYEGRWE

SEQ ID NO: 148532 - protein, 50 aa, Triticum aestivum
  Clone ID: PAT_TA_42950.pep
QKWRLFLLVPHEDHSIRFDMRHASSTTRRIDSEFSNQDYQVASKRPCNVA

SEQ ID NO: 148533 - protein, 72 aa, Triticum aestivum
  Clone ID: PAT_TA_42951.pep
SLLLGQTGYSGDIKLLQTVNVDRRSFIKMHVLAIPLLALGLLGTYRQIIWLLLGDDGCYEDHLAFHPDYRAM

SEQ ID NO: 148534 - protein, 135 aa, Triticum aestivum
  Clone ID: PAT_TA_42952.pep
LRTDRGGEFTSIEFGEYCADRGVQRQLTAPYSPQQDGVVERRNQTVVSMARSMMKATAMPAKFWGEAVTTAVFLLNRAPTKSVRGMTPYEAWHGTRPAVHFLRTFGCVAHVKNVRPHLKKLDDRSTPMVFIGYEE

SEQ ID NO: 148535 - protein, 129 aa, Triticum aestivum
  unsure (1)..(129): unsure at all Xaa locations
  Clone ID: PAT_TA_42953.pep
PSLQPRPFSTSRTAPPAATTSSPFPAPSPAAGPSSFARARPDAAYVVCSAAAAVDASEAEPVEKFRMDNLSRDKGARRKPKRKGRGILAAQGASCGIXMREQNGRLQPGVRRGVAGEQMPVYRLLAEQD

SEQ ID NO: 148536 - protein, 75 aa, Triticum aestivum
  Clone ID: PAT_TA_42954.pep
IRQIYFAVDQNMLRRRSTSAPTEPAQVKQFRSCSATRMRAQIPAQPMYHNTVTLCIALHRSLASSGPPPMPMSAV

SEQ ID NO: 148537 - protein, 72 aa, Triticum aestivum
  Clone ID: PAT_TA_42955.pep
ALEIEHDRWEKKKVTSGRARTSLSTSTQPHFGFIYTVIAQTNVFQLHSEFSLDLDHHVCLCSGINPNVLQYI

SEQ ID NO: 148538 - protein, 135 aa, Triticum aestivum
  Clone ID: PAT_TA_42956.pep
KGLGRSCARGGVRAPAGKSCVHSSSSTSIRLRGEVARGPRFQQLVSELGVLGVLAVPEAWQRWRRLPGAARWSSGSCVGLWRWAALWLPWRVAEAAGGDVVRAATAEAAEALRGGAVARHDMAAWKPRRCRAIRR

SEQ ID NO: 148539 - protein, 99 aa, Triticum aestivum
  Clone ID: PAT_TA_42957.pep
RSLRPSFPFMAYRSLTEPVSATTRLTTGYSFMRCTSVTDRLMKNRLQTYRLCTTFLRGDGVAESELGDDTARDSPPPSWRTNFCSNQCLQRHTTRPIPS

SEQ ID NO: 148540 - protein, 71 aa, Triticum aestivum
  Clone ID: PAT_TA_42958.pep
GLPKKANVGACAGGKAWTPQNGRPFISFVRYFWFFYFFFLFFFYFVYFFFYFLFFFFFFFFTVNNNPTNHN

SEQ ID NO: 148541 - protein, 59 aa, Triticum aestivum
  Clone ID: PAT_TA_42959.pep
PRREAADFTCAQYKTVFILTIDLIIMLIVREKLMIYHLQIGLIHVWVRERIGMDYLEYF

SEQ ID NO: 148542 - protein, 88 aa, Triticum aestivum
  Clone ID: PAT_TA_42960.pep
PRAAIHCGAAILRRCWHLVISTSTAVRRIGLGCPRFERLRLPFVGKGFAIELGHGHGIADCECHHGSACSCLSCIQRSSCPCCRLRGS

SEQ ID NO: 148543 - protein, 139 aa, Triticum aestivum
  Clone ID: PAT_TA_42961.pep
DPRVRTRVRPRVRPRVRTYFSIYADQEDGTPLFGGSLPPPFPSPCTVRVALARYADLLNSPKKSVLLALAAHASDPKEAERLRHLASSAGKKEYSQWIIASQRSLLEVISEFPSAKPPLGVFFAAIAPRLQPRYYSISF

SEQ ID NO: 148544 - protein, 114 aa, Triticum aestivum
  Clone ID: PAT_TA_42962.pep
MPIGVPKVPYRIPGDEEATWVDLYNVMYRERTLFLGQEIRCEITNHITGLMVYLSIEDGISDIFLFINSPGGWLISGMAIFDTMQTVTPDIYTICLGIAAFMASFILLGGEPTK

SEQ ID NO: 148545 - protein, 134 aa, Triticum aestivum
  unsure (1)..(134): unsure at all Xaa locations
  Clone ID: PAT_TA_42963.pep
MMAALSSLVLVLLLAVASQEAAATITRGDFPPGFIFGTGSSSYQVEGAVAEDGRKPSIWDTFTHSGHFVDGATADVTXXQYHKYXXXVKLLSDMGVDAYRFSIAWPRLIPDGRGAVNPKGLEYYNNLIDELLAH

SEQ ID NO: 148546 - protein, 144 aa, Triticum aestivum
  unsure (1)..(144): unsure at all Xaa locations
  Clone ID: PAT_TA_42964.pep
WHRWWLRCWHLSEKRFHVNTADSECIYLQLDIQRILYSSSSPAXLRMQPTXXKLLGWRTRALPLARRRRGGRCCRNRSPAGLPAPLLRRAAAGTSSSRGGRKVREARCCWCCCCGGGGWWLAAAATGMEVVMRGLRLAGCCLWS

SEQ ID NO: 148547 - protein, 87 aa, Triticum aestivum
  Clone ID: PAT_TA_42965.pep
RGRVGQGHMFSQNLFPSKSTQSGGSLLSSSVAHLAPAPSPNGHSTTINIDQAEKTVELLLPVDITTVRIRFSPKNDDTGSRATVVWH

SEQ ID NO: 148548 - protein, 121 aa, Triticum aestivum
  unsure (1)..(121): unsure at all Xaa locations
  Clone ID: PAT_TA_42966.pep
PACRFGRVASSPINGGTSRSFLLQCGPSPWSKPKVPPHRPQKRSPSAACSQGVESTAAEEPRRPPPVWSXPPPSNTAVLPQDPGRCRVMLSATEEPPCPLHPEVLPRHPSSTTGDGSPLPC

SEQ ID NO: 148549 - protein, 107 aa, Triticum aestivum
  Clone ID: PAT_TA_42967.pep
MAEGLFSMAHPWASAFGILGNIISFLVFLAPTPTFLRVYRKKSTEGFSAVPYVVALFSCMLWIFYALVKTNSSPLLTINAFGCVVESFYILLYVVYAPRNARHRALV

SEQ ID NO: 148550 - protein, 133 aa, Triticum aestivum
  unsure (1)..(133): unsure at all Xaa locations
  Clone ID: PAT_TA_42968.pep
APTVEPKSNKAKETDDPIPLVDKSAFNDTKVPSSSTKDSVAPENNANGCGLSASQEVVAGSTTCATNPVLLKDKPSSEVEPDDDLPSHGKMEFHMTEDAVXXPTAVQEDLKTLTLRICWLVCTLFTFSLYIMN

SEQ ID NO: 148551 - protein, 100 aa, Triticum aestivum
  unsure (1)..(100): unsure at all Xaa locations
  Clone ID: PAT_TA_42969.pep
MAIGSLLASRLARSGHALATRAIAQAPRTHNHHHATSPLLSRLGAVARAFXSRPAAADVIGIDLGTTNSCVSVMEGKTPRVIENAEGARTTPSIVATNSK

SEQ ID NO: 148552 - protein, 53 aa, Triticum aestivum
  unsure (1)..(53): unsure at all Xaa locations
  Clone ID: PAT_TA_42970.pep
TFHNQSRTHWKPIWAFPIWRQRYQLTCIFVNFFLRQCIFXNXRLWRPXMVRPI

SEQ ID NO: 148553 - protein, 115 aa, Triticum aestivum
  unsure (1)..(115): unsure at all Xaa locations
  Clone ID: PAT_TA_42971.pep
MAPTAAEQSQQHTRKAVGLAARDVSGHLAPLAITRRSTGDDDVVIKILYCGICHSDLHXXXNDWXTPTYPVIPGHEIAGEVTEAGLNVTRFKAGDRVGVGCMVNSCQCCESCYKG

SEQ ID NO: 148554 - protein, 118 aa, Triticum aestivum
  unsure (1)..(118): unsure at all Xaa locations
  Clone ID: PAT_TA_42972.pep
NIVRATKPVFSVLTNPIMGPLLEVLEYTLPLWNLCAETVEYLNSAAMVAMETSFSAVVSPDQMIMWPSWFIFSTTFNISNSILYPAIRFVGVXLAVPFRLIVALASFAANFCHDILDV

SEQ ID NO: 148555 - protein, 69 aa, Triticum aestivum
  Clone ID: PAT_TA_42973.pep
PTFDYAPTQKLSPSRHRSCAHLVGRGSPRPRGPNQDLILRVLHPILFAYCSVHLINLHVKPIIGKHTQA

SEQ ID NO: 148556 - protein, 87 aa, Triticum aestivum
  Clone ID: PAT_TA_42974.pep
DPSPSVRLLTAAGQRRRVLPVQHHLHRRSWTSSPCFLTYPSLTHPSLRRCSVESRAYGAQSAQCSFQAGTAVFVRHSYGFYFRNEYL

SEQ ID NO: 148557 - protein, 97 aa, Triticum aestivum
  unsure (1)..(97): unsure at all Xaa locations
  Clone ID: PAT_TA_42975.pep
PHSRKRTRLIIEPSTSREATNWMXDRNADLRKQEGPAHAVGDASRRLPDPPGSLLHVDGSSSSGSARRAPPVSHRRGHHDAACSPPSWYRGTQYMQL

SEQ ID NO: 148558 - protein, 97 aa, Triticum aestivum
  Clone ID: PAT_TA_42976.pep
VISTLPSPKKAPLSLIPYGRICAQFYRGCSLPLSEAPVEKKPEFWPRLQLLQKLLLVLGLSLSSCRPALHRGGVAFSRHNSASSNPGKVWPEQEWTC

SEQ ID NO: 148559 - protein, 119 aa, Triticum aestivum
  unsure (1)..(119): unsure at all Xaa locations
  Clone ID: PAT_TA_42977.pep
HASAHACADAWARPLYLSQPKHLTLESKQPRRRRWVQGSPGGMGKQGGLPGDRKPGDCAAGDTKDRKFEPPAAHXRVGRKQRKQRGPEAAARLFPVAPFSKXPLRLLKPDRVKDYLLME

SEQ ID NO: 148560 - protein, 54 aa, Triticum aestivum
  unsure (1)..(54): unsure at all Xaa locations
  Clone ID: PAT_TA_42978.pep
XHIWRLGGGGRGSLWAPGPWGPADGADGRYLLDPDYLSWAGSSSWHGYDVKCLL

SEQ ID NO: 148561 - protein, 116 aa, Triticum aestivum
  unsure (1)..(116): unsure at all Xaa locations
  Clone ID: PAT_TA_42979.pep
PKCRRHGQGALSITSLSVFLIWSWCSVPVREAPSLLCCKVRQASLLVETEQAGGTNISSRLVFFTPLCDGCHLFLCMLHGEEKLLRSHLLKEDAXHPRCSTSPPSVACQEGFECWK

SEQ ID NO: 148562 - protein, 151 aa, Triticum aestivum
  Clone ID: PAT_TA_42980.pep
LSCTRAHLITSRRAGEGQPVLQLDPATAADMRRQGLDPHELDRSTEQLMSLIHENLPDPPVSTTARFVALRALSSDGVDRFSGLSDALLRNIVSRLPVKDAPRTAVLAVRWSGVWRSTPLVLIDTQLIFNGRTPARASTPDVTGGVFRILV

SEQ ID NO: 148563 - protein, 53 aa, Triticum aestivum
  unsure (1)..(53): unsure at all Xaa locations
  Clone ID: PAT_TA_42981.pep
LLRLTCLLQGLYFWHEQTXWHETLMNDLDKVXXVHKEASVVPSALVIGDVLTG

SEQ ID NO: 148564 - protein, 76 aa, Triticum aestivum
  unsure (1)..(76): unsure at all Xaa locations
  Clone ID: PAT_TA_42982.pep
DYGVLMEVYSKNDNTRWESNTLYLSNKRTHSIEXQRQPRGQSDLTSKARDLNQCTNLPIPLLGQSHTIKPSCNRFK

SEQ ID NO: 148565 - protein, 123 aa, Triticum aestivum
  Clone ID: PAT_TA_42983.pep
ACPTTQRHVSTKYLGLVADISRIRMVNFALLSLNHLMASIVKFKDGSSNLEGNLPLLQLWFWEKVRVHKFDTSIDYSQRSKPLMQHWTEEKALSSGHRPWLRSWRGCCRPERAFQVPKRAILL

SEQ ID NO: 148566 - protein, 96 aa, Triticum aestivum
  unsure (1)..(96): unsure at all Xaa locations
  Clone ID: PAT_TA_42984.pep
MALNEACYHSLQNDSPTVPAIKKNVHALTRLYDAQLVIIPXHSTGEGHHFYSNGAVLKAILHRYHQSNLTRLXIEQHEHMQRTLSHLNDINPNLPT

SEQ ID NO: 148567 - protein, 36 aa, Triticum aestivum
  Clone ID: PAT_TA_42985.pep
HACADAWVDNYLYYGSCNARIRDNRICHTSCGWLIR

SEQ ID NO: 148568 - protein, 82 aa, Triticum aestivum
  Clone ID: PAT_TA_42986.pep
AVLAPLISSPPRSQPTVQKGSDAQATMANPSTSSRPSFAAPSGTKLSCLCSPTNHPGSFRCTRHRNPRGRPQTSLPSFFGRA

SEQ ID NO: 148569 - protein, 51 aa, Triticum aestivum
  Clone ID: PAT_TA_42987.pep
MYRCFVGGLSWATDDQSLQNALCKHGDVIDSMIITGRQTDLSRRFGFHTLL

SEQ ID NO: 148570 - protein, 141 aa, Triticum aestivum
  Clone ID: PAT_TA_42988.pep
PRVRLVLPSCHFSQATPSTNALSAEEIKALTKRTQEGGTEVVEAKAGKGSATLSMAYAGAVFGDACLKGLNGVPDIVECSYVQSTVTELPFFASKVRLGKNGVEEVLGLGQLTQFEKDGLEALKGELKSSIEKGVAFTNAS

SEQ ID NO: 148571 - protein, 149 aa, Triticum aestivum
  unsure (1)..(149): unsure at all Xaa locations
  Clone ID: PAT_TA_42989.pep
QISSYDVSAKILIEAGILPPLIADLFTVGSNQLPMRLKKVSATILANVVASGANFQSIPLDHNRHTLVSEEIVHNLLHLISNTGPATECKLLXXHVGLTXXSTTVQGIVDAIKSSGATVSLIQFIEAPQREVRMASIKLLNYISPCMGQ

SEQ ID NO: 148572 - protein, 110 aa, Triticum aestivum
  unsure (1)..(110): unsure at all Xaa locations
  Clone ID: PAT_TA_42990.pep
AAGPTAAPVIGSAAPCLPVSSQDGAGGRCPDGRACAIHGTQLLHPGPPAQRRRGHYFVRTDYHNHAQVLDMMAGRDEEDILDPHGCQGFEGLGRCRGGXYDRDDCGTQFK

SEQ ID NO: 148573 - protein, 118 aa, Triticum aestivum
  unsure (1)..(118): unsure at all Xaa locations
  Clone ID: PAT_TA_42991.pep
MRAKEEKRRSPSPVRAQDSRRRDLVHERRWGSRSRMLLTRLFAKKEMRILMVAIDAGGKTTIFSPLKLARLPTTIPTIGFNVETVXYKNISSTVWYVCCHDKIRPLCRHYLHNTQGLI

SEQ ID NO: 148574 - protein, 82 aa, Triticum aestivum
  unsure (1)..(82): unsure at all Xaa locations
  Clone ID: PAT_TA_42992.pep
GSXXVSGVCAAAGIATMCLPIACMIGMPFSSVVMVSSFHVRALFRSGLYRVLVCDAHVSYVPHLVCTSPDQRRIRYTRGGKS

SEQ ID NO: 148575 - protein, 118 aa, Triticum aestivum
  Clone ID: PAT_TA_42993.pep
DILATASRHAAPAPPSTWSLAADGAGGSGADQRRPWPAPVRAGAGAAWARAGGVRAAAEPAAERRGAAAGGQRRRVVRQGARRSGREFGFGCSGGSGFRVVSHSRSESCITPHPVILV

SEQ ID NO: 148576 - protein, 104 aa, Triticum aestivum
  unsure (1)..(104): unsure at all Xaa locations
  Clone ID: PAT_TA_42994.pep
STHASAHASGAKEYGRELGRHELFMKTHXKKDGNALAKAQPKIDELKKPAILHPELLERPIEKCDLFSHVFGREPRGYVRGVGLGPTPATLGIDGYRSCASTSV

SEQ ID NO: 148577 - protein, 71 aa, Triticum aestivum
  Clone ID: PAT_TA_42995.pep
VLSRVRLILLSLAAETVPAHHPELQKWREHLRGLALSYVEERSYLWFSFMVTTRTHALLIVRSIELCLFVY

SEQ ID NO: 148578 - protein, 49 aa, Triticum aestivum
  Clone ID: PAT_TA_42996.pep
NMPYDDFRFFNYQPSLRVELPEQGESFEPYKQPILLNFLLKASQNSIFK

SEQ ID NO: 148579 - protein, 115 aa, Triticum aestivum
  Clone ID: PAT_TA_42997.pep
MGGTKPNPKARTNTLAPRGSRGTGRGRGRGRGRGGAGRPGEKRSHGPHLPNKLRRELESLGPARDRGSDDDDDDEDDVVGEDVYEYEEGVPEEEARKNDRYDAVAKYEYDFDSDD

SEQ ID NO: 148580 - protein, 156 aa, Triticum aestivum
  Clone ID: PAT_TA_42998.pep
TTVTDSGDLLHSVALPPAVEPCTAAVWFRLRAPPHLAGGTSLGRGYRPCLASSGIPKSKVLSVSCAMKSYKLSDLSDAEVSGLKARPRIDFTSIFSTVNPIVEDVRVRGDAAVKDYTEKFDKVTLDNAVVRVSDLPDAELDPAVKEAFDVAYDNIY

SEQ ID NO: 148581 - protein, 71 aa, Triticum aestivum
  Clone ID: PAT_TA_42999.pep
SAEFYIGSLLTSHPADVVLYCTGDCTCGRISPPVLRRNVHSKPDSGALLQPSTSQSCLVLWSANYADDVCV

SEQ ID NO: 148582 - protein, 49 aa, Triticum aestivum; identical to SEQ ID NO: 147490
  Clone ID: PAT_TA_43000.pep

SEQ ID NO: 148583 - protein, 104 aa, Triticum aestivum
  Clone ID: PAT_TA_43001.pep
GGEPSPSYRQTRSSKLYKLLAARSNDATMLSSRSSDQIRSPPMRRCEWPSAFRASSSLRSAIFSTTHSSHPGMTTSASPRRTMRRRWPRSGGIASKWTRRRSQI

SEQ ID NO: 148584 - protein, 81 aa, Triticum aestivum
  Clone ID: PAT_TA_43002.pep
MADQLTDEQIAEFKEAFSLFDKDGDGCITTKELGTVMRSLGQNPTEAELQDMINEVDADGNGTIDFPEFLNLMARKMKDTK

SEQ ID NO: 148585 - protein, 51 aa, Triticum aestivum
  Clone ID: PAT_TA_43003.pep
FTTPLNLVGHEPLLSLAQSRSTRREHTQLGLQDVASHQGHSGHSFNLPMLL

SEQ ID NO: 148586 - protein, 113 aa, Triticum aestivum
  unsure (1)..(113): unsure at all Xaa locations
  Clone ID: PAT_TA_43004.pep
SLGNRLVSGSNTQLWTEKHRXIRSTLGAVVSWIKSHGNPQLERHGVRVELGWFHATVSGYYQLGIVVAVNENFYKNYHHHEHAPNFGDRSEMNLAVSTSGFQSKQFRIQPCTS

SEQ ID NO: 148587 - protein, 65 aa, Triticum aestivum
  Clone ID: PAT_TA_43005.pep
VLCFSLQIIVRRDASLIVGLSVCLHSLSTGQLSQALGSTDQAFHNKFSCNRDYQSLLYQGRVVIL

SEQ ID NO: 148588 - protein, 107 aa, Triticum aestivum
  unsure (1)..(107): unsure at all Xaa locations
  Clone ID: PAT_TA_43006.pep
MGNCKSSSRARLGKAHVVPDSEWRMQDFGKTHVPDLEWRINDFSSLLETGAKSAKSDAFHCSGYNWYLQVSPMHKETGSETPYVALXLKTSQPSMVPGHTVHVVFEV

SEQ ID NO: 148589 - protein, 118 aa, Triticum aestivum
  unsure (1)..(118): unsure at all Xaa locations
  Clone ID: PAT_TA_43007.pep
GWPGGLRPWPSSYSSLPWCSHWSCEWLARSDDAHRSVFVELFAASPDDLETTGRRPRTQHTPLARTDRGLRWXACKLAAXRLSLFSSPAKDLFHAVQIAGVFGCSVYAGVXDDVALRV

SEQ ID NO: 148590 - protein, 59 aa, Triticum aestivum
  Clone ID: PAT_TA_43008.pep
RPRTRGFFYFHFFFFFFFFLVFFFFFFLKKRQIFIEIGWPPLKWGGPTESPKLRVLWEF

SEQ ID NO: 148591 - protein, 161 aa, Triticum aestivum
  unsure (1)..(161): unsure at all Xaa locations
  Clone ID: PAT_TA_43009.pep
VRVAAVEDGKLMADADAGEFWGLFGGFAPLPRKTFSEPNGKDTAFPPKLLWVNKGQTVSVDYEVLTKALLDSTKCYLLDCGSEIYVWMGRETALEDRKQAGLAAEELLREGDRPKSHIIRLMEGFETVIFRTKFNKMAQESSMHLXDYSRGKVASLLKRPG

SEQ ID NO: 148592 - protein, 124 aa, Triticum aestivum
  unsure (1)..(124): unsure at all Xaa locations
  Clone ID: PAT_TA_43010.pep
PPPPPPPPVGLLWRHGGRNPXPPPPPPSPPLSRLAAARGAAGKAGLAPVTAAAGHFPCSLLLRAPALALGLAVKGCSGQGCFGPWCATVAPVLLCIIAARWAGGGGRGRFGPYLGFSAPVMGAA

SEQ ID NO: 148593 - protein, 58 aa, Triticum aestivum
  Clone ID: PAT_TA_43011.pep
IFTRLIQHLLIALKRALSVQILKSGIVHMELQPDMFLITVQNCSTQTPSGWMRRPMTP

SEQ ID NO: 148594 - protein, 120 aa, Triticum aestivum
  Clone ID: PAT_TA_43012.pep
YHLPPIAPELTTVTPFLRFFLSMGQIGHACPQVAKRDLRFRRKPLPCPRATTRSFSPLLLQPPTHLIPGALLGAFHRRVVALVTPSAPHLHPYPPLASLPTPPPCARAGQSMPVHPRARG

SEQ ID NO: 148595 - protein, 149 aa, Triticum aestivum
  unsure (1)..(149): unsure at all Xaa locations
  Clone ID: PAT_TA_43013.pep
RPVFFNPLEQTRDEIVMIVVSNPDVSVLNSTGSCLKCQISPEWQYVSGEKISTGRHRLYWRASVPALGLETYYVAVGQDCEKATPAVVKAFTASQEFSCPEPYHCSNLEGKTVEMKNSYHTLSFDVSHGXLQTVTRHKHGEKTEIGEEN

SEQ ID NO: 148596 - protein, 163 aa, Triticum aestivum
  Clone ID: PAT_TA_43014.pep
RPPTRPRFLPSTSRGVTDLKDVLWSSSLTFKHALSTSAANVDESTSARKFASYTVFKGKAALSISPILPLFTKLESGGSRVNRNGSVMLTFFPAVGQRKYDYTKKQLFALSPTEVGSLISLGPAESCEFFHDPSMKSSHEGQVKKSLSITPLGSDNGYFVNIT

SEQ ID NO: 148597 - protein, 138 aa, Triticum aestivum
  unsure (1)..(138): unsure at all Xaa locations
  Clone ID: PAT_TA_43015.pep
VRVIHVPYRLRKPFRKIHVRLVRELEKKFSGKDVVFVATRRIVRPPKKGFAVQRPHTRTLTACHDGILEDVVXPIVIGGKRVIYRLDGAKVIKIYLDPKERYNTEYKLGTFFAVYRRFFGXDIFFESPVDCNPLKIHS

SEQ ID NO: 148598 - protein, 158 aa, Triticum aestivum
  Clone ID: PAT_TA_43016.pep
VREIVMKRYEKESMHPIQNLFSGELARAMLIQVQKLKLDLQEAMLELDQILKANEINFAILAALPAFGLLLLLLFLVRAWAMHDQGAEGRGRIARHQRWQLLIEVERRLKEFKKCMINEMDEEASCKFGLTLYTLDRLYKAVEVHAKETGEWSSLRDD

SEQ ID NO: 148599 - protein, 73 aa, Triticum aestivum
  Clone ID: PAT_TA_43017.pep
KDLGNVLEDKEQKASRRCLRQELRHGSPSPPLPTAATTDEVDGHGQVKVLWFVSFRRQCNRTGKNGRLPGSGR

SEQ ID NO: 148600 - protein, 55 aa, Triticum aestivum
  Clone ID: PAT_TA_43018.pep
MSPCTPPKFSLRDHAAPTSPVCRSFFAGHVHDTSCKFRWRHLCKVIFVVISHGNF

SEQ ID NO: 148601 - protein, 44 aa, Triticum aestivum
  Clone ID: PAT_TA_43019.pep
RKLILYLKRRVHELVYLLDQHRSQSLALNWRRLQDSDASAIPVV

SEQ ID NO: 148602 - protein, 75 aa, Triticum aestivum
  Clone ID: PAT_TA_43020.pep
VGNPSFNLWEVMMSTVFIELIEFLNFFSGDHTVSHYSKRWILAPDPSCMIPQAKYCSVCNIITMWVCILSQSTGR

SEQ ID NO: 148603 - protein, 87 aa, Triticum aestivum
  Clone ID: PAT_TA_43021.pep
IYIAKHLCVSFVRFNKKFGLCTRLSTGILTLVISTCVYETFEVVGLHILDLRYLSFLRSTLKWLNGYLYQIYNEFSTQDTFVMICVG

SEQ ID NO: 148604 - protein, 137 aa, Triticum aestivum
  Clone ID: PAT_TA_43022.pep
VRLTVIEFETKLLEIEDTSQEAVCWIRRLPPRLWATAYFEGIRYGHLTANIMESMNSWILDASVLPINQMMEVLRRQLMTWFNERREASMQWATILVPTAERRVQEAIERARVLQVARANEAEFEVISPHEGTNGVD

SEQ ID NO: 148605 - protein, 121 aa, Triticum aestivum
  Clone ID: PAT_TA_43023.pep
SKPLLLVRSIRGKASTLLGPGFRALTRSTHATRTITRSRHGGVLVWLPDGAGVQVRSDGRGPHDPLPPAARARHSRPDLRPRRDRRRPGRAPAGRTVLEARPRQQAERFVPVHRRHRRAGE

SEQ ID NO: 148606 - protein, 68 aa, Triticum aestivum
  Clone ID: PAT_TA_43024.pep
ISKKKKLGCFISIAAGTYSQIHPWPAHPVPVGHRRAEPIIRAWLQRCIERGGRGALKPVMVTLVKNAL

SEQ ID NO: 148607 - protein, 113 aa, Triticum aestivum
  Clone ID: PAT_TA_43025.pep
RTLYPQLQICEFSMVGTSYSEAQTTTAVNSEEHLLIAQQRMKKYADRKRVGRTFAVVDMVYLKLQPYAFGLRSHIKLQRKFYGPFRVLYHVGNVPYHLQLQTWVSAQCSTLAS

SEQ ID NO: 148608 - protein, 61 aa, Triticum aestivum
  Clone ID: PAT_TA_43026.pep
RPVTGRKPNTKILFLEEVGIRMDNKGAVGGVWYSRTLVDSIWAAGDVTDRDQLRTPGSHLM

SEQ ID NO: 148609 - protein, 125 aa, Triticum aestivum
  Clone ID: PAT_TA_43027.pep
MAPPSQLVLAASSTDAGVAAWDLRTGAEAIRHRPCASRPRAIAAVAGRFLAAAQVAAGNSAPIHYYHWDKPQVAVKSFPAEPIRALIADPEGNYLIGGGVSGDIFFWEVASGELLVRWHAHYCDV

SEQ ID NO: 148610 - protein, 118 aa, Triticum aestivum
  Clone ID: PAT_TA_43028.pep
VRPRVRPRVRPELQWSYVGRRRCCTGAVAEFQWSFAGASLLRWSSVGLQWSSPEAVSAGIEASPERRCCAGAPSGCNGAHRRPSVLALKLCRGCIKAPPRLQWSAAGAPSVMRGAAVG

SEQ ID NO: 148611 - protein, 67 aa, Triticum aestivum
  Clone ID: PAT_TA_43029.pep
ENAQNAESSEACSSARQLHKRKHSVDPVLEELAIPIEALTDGTNTQFGSNSILLESALRDVHAFQTE

SEQ ID NO: 148612 - protein, 150 aa, Triticum aestivum
  Clone ID: PAT_TA_43030.pep
SDLIQSSPPPISPGNLRSKQSQGSLGLLLKMQIFVKTLTGKTITLEVESSDTIDNVKAKIQDKEGIPPDQQRLIFAGKQLEDGRTLADYNIQKESTLHLVLRLRGGMHIFVKTLTGKTITLEVESSDTIDNVKAKIQDMEGIPSDQQRLI

SEQ ID NO: 148613 - protein, 114 aa, Triticum aestivum
  Clone ID: PAT_TA_43031.pep
MSTAEATREENVYMAKLAEQAERYEEMVEFMEKVAKTADVGELTVEERNLLSVAYKNVIGARRASWRIISSIEQKEESRGNEAYVASIKEYRTRIETELNKNWDGILKLLDSHL

SEQ ID NO: 148614 - protein, 118 aa, Triticum aestivum
  Clone ID: PAT_TA_43032.pep
FARLLRLYQIAATNASSPSFDPPRLPCVEGGPSPNPTLQLRRLPDPSHSHPTVPVASHPGLFTQLLAALPAAAASSDVRRIPPTPSTARGPFAPWSLSIQLDRVLAATKAHPRPIPHG

SEQ ID NO: 148615 - protein, 102 aa, Triticum aestivum
  Clone ID: PAT_TA_43033.pep
VRPSLILSYIYLPFRLKRCFSLCAMYPRDHVFHMEVAVHIWGAQGFVEPQGQIPLSDIARSYFQELIDRSLFQEAAGAPDTYVIHDLIHDMLQLVSANESSS

SEQ ID NO: 148616 - protein, 70 aa, Triticum aestivum
  Clone ID: PAT_TA_43034.pep
RPYPSQKPLPSPPAVSAETRPAPLPPPRMAPPPPLPLPPPPPPPPPPRCQSSRGGGFGGRSGSGSAPCSP

SEQ ID NO: 148617 - protein, 93 aa, Triticum aestivum
  Clone ID: PAT_TA_43035.pep
MASRVKEDEKNERVIRGLLKLPANKRCINCNNLGPQYVCTNFWTFVCTNCSGAHREFTHRVKSVSMAKFTAQEVTALQGGGNERAREIFFKEW

SEQ ID NO: 148618 - protein, 99 aa, Triticum aestivum
  Clone ID: PAT_TA_43036.pep
SAIAYGSNLGGLHVQDVCSDVGSKPCCLHVQIVLRWWIQAVLFACPNRAQMDAIGYCVCRRLAQGRSQPPRRAPGRASLSLGSSLTVPASVDVTIVGSS

SEQ ID NO: 148619 - protein, 110 aa, Triticum aestivum
  Clone ID: PAT_TA_43037.pep
VRPRVRRSPTPLSLATLPHAIPRRRRPIPAISGGYCRRAAHPHLPLAPLLPPLRLDSTLPATNARLQYLPMARVSVTVRLRRILSVAYHLLDGAPGIGRRKGLLPQDVLT

SEQ ID NO: 148620 - protein, 57 aa, Triticum aestivum
  Clone ID: PAT_TA_43038.pep
SSNTGLHVTQHFQSLMSFPLQQFLDVHVGIGCESHVMPKHHVLEIRKLGGRARVGGR

SEQ ID NO: 148621 - protein, 55 aa, Triticum aestivum
  Clone ID: PAT_TA_43039.pep
QFGTGGEQSGTQVCSNCSVCMGEYFCRPCKFFDYDLYKEQFHCKDCGFCIVGGKV

SEQ ID NO: 148622 - protein, 65 aa, Triticum aestivum
  Clone ID: PAT_TA_43040.pep
KYCKKKNVKPTSLKFEHHQTFIFVEPAIYRSMDNHTTPLENVPEFAYIFLKNHANVWVHLVYHER

SEQ ID NO: 148623 - protein, 83 aa, Triticum aestivum
  Clone ID: PAT_TA_43041.pep
STVLLFCALPNLIFLHQCLSLHALSMVYLPAMIIIIIEDPYIVLQSSSRSFLLYSSSDLHTSCGTSSRSGGGLPPPPAAAAGR

SEQ ID NO: 148624 - protein, 107 aa, Triticum aestivum
  unsure (1)..(107): unsure at all Xaa locations
  Clone ID: PAT_TA_43042.pep
AYPSSLTDKFNQYALIIRQVTFDMGRLXDERGAQLLALETIRSEYANAXQLRMQLLQNDEGSNYSAGEGILLEDAALKIGDXELTLEQEVEGLNPETFSYKRKGSSF

SEQ ID NO: 148625 - protein, 116 aa, Triticum aestivum
  unsure (1)..(116): unsure at all Xaa locations
  Clone ID: PAT_TA_43043.pep
LPFLTLHIFFLFLVLGWVPKRGRRIMSTNRPDVLDPALLXPGRLDRMFEIPLPNVLSRTDLLKIYASGVAKLGEIXYGAVVKLSEGFNGAXDLFNVCTXAGMYVIRAERYYLVSRG

SEQ ID NO: 148626 - protein, 52 aa, Triticum aestivum
  Clone ID: PAT_TA_43044.pep
KFLSHAYKFKLCWYRLLSENTINLAFFLVGSSVQTVTMLLVFESPYALESTR

SEQ ID NO: 148627 - protein, 110 aa, Triticum aestivum
  Clone ID: PAT_TA_43045.pep
EPRPSCHMQQPFLDVDGDAVRHSVNILWHRTATGPHRHHATNSFHHVPRPSTSHEVGRTAVVASDRKGSDANCWGAFTSQRHFFFLMRCLSQINLHLSLSLSTTHTTRSW

SEQ ID NO: 148628 - protein, 82 aa, Triticum aestivum
  Clone ID: PAT_TA_43046.pep
YIICNGICLDCYSTESSSFLTMPSMPSMISSRVHVCIIISPKLGHFSPVLVGFSRSNELGSSVWRSRMRREVGRKWGSVLQW

SEQ ID NO: 148629 - protein, 98 aa, Triticum aestivum
  unsure (1)..(98): unsure at all Xaa locations
  Clone ID: PAT_TA_43047.pep
MAIKKTKAENKIAYDQKLCQLLEEYTKVLIDVLDNVRSKQLQEILKGLRGHSIVLMGKNTXLIRRCIKVHXEKTGNXTFLELINLLVRNVGLIFTNGD

SEQ ID NO: 148630 - protein, 85 aa, Triticum aestivum
  Clone ID: PAT_TA_43048.pep
VKDLLAAKVDHLKVRSITQILAFTILISAAVVSIPIYHTPEFRPHSFHVTYIVIFLYMMCFLLILKSSPLVFFFPKRRIDPRPLP

SEQ ID NO: 148631 - protein, 49 aa, Triticum aestivum
  Clone ID: PAT_TA_43049.pep
FPQKNEWSECCYSHISESNRCICPIHINQSIDYKKLNGDTHPTRTAYAW

SEQ ID NO: 148632 - protein, 103 aa, Triticum aestivum
  Clone ID: PAT_TA_43050.pep
HHTTSAHLSLVSGLVSDMWRKIRVMVCTMVYRAKCRSSYYSEDWADADYDQEIDLNSPSIKPDNHYVNRDVHGTARRKCRCSRPGRKAGGRRAQSRRNAWGEK

SEQ ID NO: 148633 - protein, 64 aa, Triticum aestivum
  Clone ID: PAT_TA_43051.pep
SKKRREMQSLRWGNHGVGPACAWLAYSSPVVGAPAGSSEGVVSEAEAAPSPALVYASGFLQRFC

SEQ ID NO: 148634 - protein, 73 aa, Triticum aestivum
  Clone ID: PAT_TA_43052.pep
SGYPYIPLLWFPQIVWGHTMSKDLIHWRHLPPGFVPHQWYHIKGVLIGFINVLSYGNGNLLLTRHNVSFVQVN

SEQ ID NO: 148635 - protein, 98 aa, Triticum aestivum
  Clone ID: PAT_TA_43053.pep
AWRRRRPRPRSGPPPPPPSSPLAPDTTPPVAPAPSAPAFLAAPLPSPTPQTAPPPSPSPCARPGDGPLLLGRLIMQGPNVKLTEKLKEHIVDKGGARC

SEQ ID NO: 148636 - protein, 110 aa, Triticum aestivum
  unsure (1)..(110): unsure at all Xaa locations
  Clone ID: PAT_TA_43054.pep
MAPIKIGINGFGRIGRLVARVALQSPDVELVAVNDPFITTDYMTYMFKYDTVHGQWKHHEVKVKDSKTLLFGEKEVAVFGCRNPEEXPWAAAGAEYVVESTGVFTDKDKA

SEQ ID NO: 148637 - protein, 66 aa, Triticum aestivum
  unsure (1)..(66): unsure at all Xaa locations
  Clone ID: PAT_TA_43055.pep
MLVWELNESEMVTADASTRANQVMKSGLVCFKPKCMNGAXLTRRPSLVVIAVKYDKPTYQRVQPNN

SEQ ID NO: 148638 - protein, 94 aa, Triticum aestivum
  Clone ID: PAT_TA_43056.pep
ASGDPFREIFRRDLGPSPPAAPGEEAAQAIHQPPAAVSGGGGGIGVVEMLFRCNILALVGGGDAPYYPANKVMIWDYHQSRCIGELSFKSPARG

SEQ ID NO: 148639 - protein, 89 aa, Triticum aestivum
  Clone ID: PAT_TA_43057.pep
TSEPCKPLRLPPKEHYNDLTRSSFSLQSERLTALHREATAVNKMELAQKRKSSPRKRNISFPEYATLGRCTTKVQLHRSARVHLEYMQS

SEQ ID NO: 148640 - protein, 90 aa, Triticum aestivum
  Clone ID: PAT_TA_43058.pep
VRGGHVEHAGERDLRRQQGGLAWSPQLRPEHGGHRREHRGEEAGHEEQAVGTLHGWGGLSLSLSLHASIRPAVGRGSASAHGRWRAAAGR

SEQ ID NO: 148641 - protein, 110 aa, Triticum aestivum
  Clone ID: PAT_TA_43059.pep
RPPTRPPPSPPHPNRRHFANPGYSRGARAPLPSSFLPPGVDAAAAPGGGQAGAATRRWACARQGRAQARVRGSGIGGVDEELGGARTAGNGGSGGLHAGRPAAIYFCQAR

SEQ ID NO: 148642 - protein, 95 aa, Triticum aestivum
  unsure (1)..(95): unsure at all Xaa locations
  Clone ID: PAT_TA_43060.pep
MLRVAGRRLSSSLSWRPVATVVSRGPLAGAGGPGRDNDDVFGLPAAVSHLXSPFLTAERGFFSAETLVPRYQYAGLAXDLPALMLALKNPNLKIL

SEQ ID NO: 148643 - protein, 56 aa, Triticum aestivum
  Clone ID: PAT_TA_43061.pep
VRHAYEDSWSDTEHREFGGMARQGRGLSFFILFSKGNIGKAEVAEESHRSQMFDTR

SEQ ID NO: 148644 - protein, 117 aa, Triticum aestivum
  Clone ID: PAT_TA_43062.pep
SADAWAKPHQHERPVQLQIRRRPPAARCDRNPPAPPASPPPLSDLISPIAGESLDGSFGAGNVNCRKQQLFTFWYCMMDGSTGSLGDHVNGKQVQSVDPPGLQVSTMDKTPSRECIE

SEQ ID NO: 148645 - protein, 50 aa, Triticum aestivum
  Clone ID: PAT_TA_43063.pep
MGNEKTHINIVVIGHVNFGKSTTTGHLIYKLGGFDKALIERFEMDPLNEQ

SEQ ID NO: 148646 - protein, 51 aa, Triticum aestivum
  Clone ID: PAT_TA_43064.pep
VRTLTQNAQASSARTEPATTTTMAVTTAQLPQPRALAALLVLVLLITLGGA

SEQ ID NO: 148647 - protein, 37 aa, Triticum aestivum
  Clone ID: PAT_TA_43065.pep
PPNPHLQANPHNHHHPVLDPPPHHHHHPRPQANHHRT

SEQ ID NO: 148648 - protein, 59 aa, Triticum aestivum
  Clone ID: PAT_TA_43066.pep
IFCFCDGFFTGTGKMLTRFFFQPNRKNKVIIINLLVLHRVLTFRGVALSNCLKLGGTIH

SEQ ID NO: 148649 - protein, 61 aa, Triticum aestivum
  Clone ID: PAT_TA_43067.pep
MAGKGGKGLLAANTTAAMTAEKDKVKKAPIFRSFRAGLQFPVGRNHRQLKQRAQAIGRVGA

SEQ ID NO: 148650 - protein, 77 aa, Triticum aestivum
  Clone ID: PAT_TA_43068.pep
INSYLNLTKHTINGTYKIMTWFQKKILYNYLLVHEKVLNMLRFSCMLFQKYAFLNILMRKFRGKAPRTASSLLFSFC

SEQ ID NO: 148651 - protein, 75 aa, Triticum aestivum
  Clone ID: PAT_TA_43069.pep
MKAMILRRRGAGGGLRIKRKGRGFMCGCGGSKAVSVFDGFDMHSPMGTPPTNTSSATTGTTMSTVTTTATRRAGN

SEQ ID NO: 148652 - protein, 97 aa, Triticum aestivum
  unsure (1)..(97): unsure at all Xaa locations
  Clone ID: PAT_TA_43070.pep
MAQTMASMTGLSQGVRLPGPAGRRASRFIVRASSAEAEAAGRRAVLGLMASGVVGCAFAQVVHAGTVAAIKVGPSATFFGGLTGTXNFYEGRDFDLP

SEQ ID NO: 148653 - protein, 67 aa, Triticum aestivum
  Clone ID: PAT_TA_43071.pep
IGYHKDILEHLIIRLCEHNEPPFATPSLSNAPNYRSDLNHASRDLFFANFIIGRFYTHEAVYPGPPI

SEQ ID NO: 148654 - protein, 52 aa, Triticum aestivum
  Clone ID: PAT_TA_43072.pep
NNHFDLDRKQIDMFKLKWISLIHTCELNYKIIELIEPTFDTLCMSKALLSMY

SEQ ID NO: 148655 - protein, 55 aa, Triticum aestivum
  Clone ID: PAT_TA_43073.pep
APSVSCDCQELASYCLNMRVYRLGPAPTVPSPLHLFIVPCALAHALPCTVDGCAG

SEQ ID NO: 148656 - protein, 57 aa, Triticum aestivum
  Clone ID: PAT_TA_43074.pep
YLHVDCPRSPLTSVATARSTGEDPIVANNRRQLVCSRSHNLPLFPRSRGFHAHNRLG

SEQ ID NO: 148657 - protein, 36 aa, Triticum aestivum
  Clone ID: PAT_TA_43075.pep
FSITKSLRPRLILFIVRKEYLSTKIGYFVISGLCKI

SEQ ID NO: 148658 - protein, 61 aa, Triticum aestivum
  Clone ID: PAT_TA_43076.pep
LRKRGSPPVLLKSHGPFDYTTGAAQTHYLFFPSFSDSRKHLHAYSGLELVFLTSTTLPVQL

SEQ ID NO: 148659 - protein, 62 aa, Triticum aestivum
  Clone ID: PAT_TA_43077.pep
VRVSGVSLTIGLSQLSSSSQSLRIARPYTCNIELGTFSITGLHKSIELMFIIIFGSSIFQLD

SEQ ID NO: 148660 - protein, 67 aa, Triticum aestivum
  Clone ID: PAT_TA_43078.pep
WTSWLLFFLFFVYLGPKPHSFKLKKRVSPPPNPKIKSLFFFSRGESYPYFVFIPNGSGFAHYLNFLG

SEQ ID NO: 148661 - protein, 52 aa, Triticum aestivum
  Clone ID: PAT_TA_43079.pep
TRRDILRTQSASLQITHEPCHTHNLFYAGDLVTSGSSQEAVLYTLIDDLRHG

SEQ ID NO: 148662 - protein, 114 aa, Triticum aestivum
  Clone ID: PAT_TA_43080.pep
PFSHHQASQHPTRPLKSLPIIITLLSPAWTMARPPANVLEATTVFHSRSAACVQFPTRSGQIRQVLAESAIARPPSSIGVVGDASALPALPPLLHASSLSPRDRPRVRPRVRGR

SEQ ID NO: 148663 - protein, 50 aa, Triticum aestivum
  Clone ID: PAT_TA_43081.pep
RWLPLSPMVVQTLSKNPPNGTFAVHVIRQPVPVRVIYSGMNKDPTGAKVI

SEQ ID NO: 148664 - protein, 69 aa, Triticum aestivum
  Clone ID: PAT_TA_43082.pep
PGLPHCICLPFRFLPQTNKQKRNIMKTYKITSCKKGWPAIRRSDQRAELASAFYVINAPLPEVEVCCTY

SEQ ID NO: 148665 - protein, 104 aa, Triticum aestivum
  Clone ID: PAT_TA_43083.pep
SEVISIPFCLEKLSKVTNRPFSAIVMQSDIYYAEGSAGHKDRQEGLQIHLAGAVGGDRPVLGERASERSTGREGGEVGRVWAARLATVAAEPGDVCWGEEGSLV

SEQ ID NO: 148666 - protein, 86 aa, Triticum aestivum
  Clone ID: PAT_TA_43084.pep
RTGASWLWGIHALGQERRAHGRSRRCSRRQERSCLCHHRWSMSSGPRPISRNRPNLTLTASPDHERPCSLFLVGSPRTRRKRITSR

SEQ ID NO: 148667 - protein, 55 aa, Triticum aestivum
  Clone ID: PAT_TA_43085.pep
FPITTLHWVARATSRHCSFDTKTSGDMCTGTWTQTAHRWATPFRFQQVRRRPMNT

SEQ ID NO: 148668 - protein, 101 aa, Triticum aestivum
  Clone ID: PAT_TA_43086.pep
RPLYRSVIPDATHSVSKHATRAGGLFFFFFFFFNFFGRCLFFFGLYFLFFFCTFLYFFASFIYCFFASFPLVNQKILSQGGHKIKITKHIVSGKTPKKEWS

SEQ ID NO: 148669 - protein, 67 aa, Triticum aestivum
  unsure (1)..(67): unsure at all Xaa locations
  Clone ID: PAT_TA_43087.pep
FYTFFNVRGKIQFLEGILPYQHLLFFVCLAFEDSHTLSNYNIHKESTLHLVLXLRDDMQIFVKTLTC

SEQ ID NO: 148670 - protein, 57 aa, Triticum aestivum
  unsure (1)..(57): unsure at all Xaa locations
  Clone ID: PAT_TA_43088.pep
MVGGLSKWARGLFCVMGVCLCLLFLYFSGSKGQAGIAGLXSGTFVSPSLGWGSYGDG

SEQ ID NO: 148671 - protein, 89 aa, Triticum aestivum
  unsure (1)..(89): unsure at all Xaa locations
  Clone ID: PAT_TA_43089.pep
LSYDFQLSCSFEACARCIGYYWKKDETVHTIVAKGXLLTGVIGFIYNYGDVFIVDRIKELIKYKGFQGSSYXLYAILLFHPFVEDASVF

SEQ ID NO: 148672 - protein, 72 aa, Triticum aestivum
  Clone ID: PAT_TA_43090.pep
PGVAELHHHQGAMDPGRELRTVYRSVHMQGSHLDAHRCGRASPLSEVTDPTSTAARRERCSPLSLAERVGER

SEQ ID NO: 148673 - protein, 60 aa, Triticum aestivum
  Clone ID: PAT_TA_43091.pep
TTQVICTKQNFSWATKVCHSYLRNNSYLWACWIDKLLKPGTILLLPILLKGLGAFSGGRV

SEQ ID NO: 148674 - protein, 44 aa, Triticum aestivum
  Clone ID: PAT_TA_43092.pep
VRPRVRPGVQLSHRVTKKSIDKLQPHINGRRGYQATGHTWRSCF

SEQ ID NO: 148675 - protein, 109 aa, Triticum aestivum
  unsure (1)..(109): unsure at all Xaa locations
  Clone ID: PAT_TA_43093.pep
SCSCSPSTSPSPSPPSSRGSTPTSSPPPPPSTPRPPTMTTRGSTSTCRPLRPSPSPSPPLPLPXPPPPRSRPRIALPRSTSGTRTSSRASPFRKRRPPATPPRRQSPPR

SEQ ID NO: 148676 - protein, 108 aa, Triticum aestivum
  Clone ID: PAT_TA_43094.pep
RHAADSDHSKQEEVRLSTREQREWRPRFMGGALWVSPMLLQPSWAQRGFQPLGQDLPFPWKSPRGAFFSGPIAINLVGNGNFPRPKAPLAPKFYSWLASGSGSPGPKP

SEQ ID NO: 148677 - protein, 111 aa, Triticum aestivum
  unsure (1)..(111): unsure at all Xaa locations
  Clone ID: PAT_TA_43095.pep
MATTVMALSPSFFDGKAVKDLPSSALFGEARVTMRKTVVKANPVLSGIPWYGFYRVLYLGPLSGDPPSYLTGEFLGDYGWDTAVLSADPXTFSMNRELDVIHCRWAIAWRS

SEQ ID NO: 148678 - protein, 104 aa, Triticum aestivum
  Clone ID: PAT_TA_43096.pep
QRVWPLWPAAAACSPLLLPAVCCYCCWLPPVPAVASPQLRGYAPVSNSSPLRASADAAGRCSSPLHDAAAAASRRQRKPRSVQAKVRRPAKKKCSPAVQHCRGR

SEQ ID NO: 148679 - protein, 116 aa, Triticum aestivum
  Clone ID: PAT_TA_43097.pep
VRRHPGQGSLATGSLLLYMPRDPRARPPPCCPWCRATRPSCRPRHRPVRPCLPPSSFGSGSQAGARRPPRRRSPSPRAARERHRAFCHGLLLIFLARARPVPLVIKFGCVLSPGSS

SEQ ID NO: 148680 - protein, 127 aa, Triticum aestivum
  Clone ID: PAT_TA_43098.pep
MAASSSSSSSSSSSSSPSSPSDPDYKVTTSDIEDDAAGVEPPSSDEEFPSVFRTQGHVDAVCMKYGIPKDQYTALPAGDLRASSSPPHGAVCVYAHALEAGMRVPLHPFFVDALNHFGLAPTQLAPN

SEQ ID NO: 148681 - protein, 76 aa, Triticum aestivum
  Clone ID: PAT_TA_43099.pep
RPEPFLSTPSLPAFVVRSVHPICFCSFMDGAAPNLQQLDDAISQAVSAVSCFPFVGRLRHGCTWPLWRPSLRAGEG

SEQ ID NO: 148682 - protein, 60 aa, Triticum aestivum
  Clone ID: PAT_TA_43100.pep
CWTPLPESTARDPSSRGSFAYGKLKCKGHYWDNFCFLSFYSFFYISVMISNCPASVMCYI

SEQ ID NO: 148683 - protein, 104 aa, Triticum aestivum
  Clone ID: PAT_TA_43101.pep
MASATASSSVGALNVGGELFQTTTATLSRAGASYPLASLGPWTDDAPHLLDRDPVVCAAILSFLRNGRLACPSTCPVLLAEARHFLLDGLLLCFLFPASDLSPM

SEQ ID NO: 148684 - protein, 103 aa, Triticum aestivum
  Clone ID: PAT_TA_43102.pep
MWAYCGKYKDELIKNAGYIGTPGKGILAADESTGTIGKRCASINVENVEDNRRALRELLFCTPGALQYLSGVILFEETLVQSTKGGKPFVDIPKGGQGPPGIK

SEQ ID NO: 148685 - protein, 71 aa, Triticum aestivum
  unsure (1)..(71): unsure at all Xaa locations
  Clone ID: PAT_TA_43103.pep
RTWTLGSAPVPHRFLADEKAIDGVIVGVGEARAGRDGGGVCXGGGDAVFGCSGEERRCRLRQSSVPGVPGR

SEQ ID NO: 148686 - protein, 87 aa, Triticum aestivum
  Clone ID: PAT_TA_43104.pep
MEHCDISALEQVLMLTASHVGDNQCWCPAVDPRGSFSLQLLSIPFFWHRLPHLKKVFSANGLSKYYIHQIACYLSRRADVLPNDYIS

SEQ ID NO: 148687 - protein, 102 aa, Triticum aestivum
  Clone ID: PAT_TA_43105.pep
EGFLCGSKRWSEMRERGGAGGDTACIGSAHGLRQPFNAPPNAHPLLPCLLRLRFPRPSTLRLKRHRRRPRRRDPPSLLSHAVLRAPPQLSGKEGGRLPGRKR

SEQ ID NO: 148688 - protein, 72 aa, Triticum aestivum
  unsure (1)..(72): unsure at all Xaa locations
  Clone ID: PAT_TA_43106.pep
NRTGRERRSPILAAFLAIGLAWHCALHHAAGAVVTLLTALRWVXDXAEDRVKLACVNWSSYQEPXLAEGLGK

SEQ ID NO: 148689 - protein, 71 aa, Triticum aestivum
  Clone ID: PAT_TA_43107.pep
LPAVGVGVDCQTASESEGLVDLDLIATVAATLPVGAPSGEGPHARRHHTRRGDHVGYKIERALSSSVCLPI

SEQ ID NO: 148690 - protein, 44 aa, Triticum aestivum
  Clone ID: PAT_TA_43108.pep
PTASPPTPLPEVLTTAYSSLTASRTRRSSSGDGFCPLPNRETRT

SEQ ID NO: 148691 - protein, 74 aa, Triticum aestivum
  unsure (1)..(74): unsure at all Xaa locations
  Clone ID: PAT_TA_43109.pep
GARTSNASXXPPRPRPSLSLNHTGNHTQPQAQPQGTLEEPAKRQAARWPAGLPQGPPKRYSKRQPPCPCYAQCL

SEQ ID NO: 148692 - protein, 118 aa, Triticum aestivum
  unsure (1)..(118): unsure at all Xaa locations
  Clone ID: PAT_TA_43110.pep
MITSPIVAPTSRACLSRRGSYFAVVCSGGKKIKVDKPLXLGGGLTVHIDANGRKVGKKGVYQLDDKYGANVDGYRPIYTPEEWSESGDRYAGGTTGLFIWAGTLAGLLGGGGLLDYNT

SEQ ID NO: 148693 - protein, 70 aa, Triticum aestivum
  unsure (1)..(70): unsure at all Xaa locations
  Clone ID: PAT_TA_43111.pep
CLSSYVKPFDGAATFRYMTGGNDVIQGDLETHVLPVIRNIKTVLKAAGVIGVPDTRTXATSVLGVKYPSV

SEQ ID NO: 148694 - protein, 85 aa, Triticum aestivum
  Clone ID: PAT_TA_43112.pep
KKCKLRKNSPTFSSPKWVRNAIQRSLLPTVGLVGVLLKWAPPMGRPIILEEWPLSEKSKLFSHGARRRPIFFGCRECLGVGPPVS

SEQ ID NO: 148695 - protein, 70 aa, Triticum aestivum
  Clone ID: PAT_TA_43113.pep
SVHAFATSQCSSFFRSCPFIGTWRSRRRLMASLLVWSRSAAGRDGGGGCYGGGNADVGGRGKGARGQRRQ

SEQ ID NO: 148696 - protein, 131 aa, Triticum aestivum
  unsure (1)..(131): unsure at all Xaa locations
  Clone ID: PAT_TA_43114.pep
YADAWAQNPQRNRCCSARSGKESATDGDRGRWHLGRGWGRRGAGXSVLVTGGAGFIGTHTVLQLLEKGYAGTEGDNYHNFVPEALDRVRHMVCRALFARLQFILGDLTIKDDLQKVFRXKRYDAVIHFCGL

SEQ ID NO: 148697 - protein, 52 aa, Triticum aestivum
  Clone ID: PAT_TA_43115.pep
HASRHAFAHFSLSLILSSPTLYLCSFFCGARSRKSTPSTPRCFFLCLIFCGL

SEQ ID NO: 148698 - protein, 98 aa, Triticum aestivum
  unsure (1)..(98): unsure at all Xaa locations
  Clone ID: PAT_TA_43116.pep
RPEIARRCSVDVQICSPGDGLAIARESDVPMKIRKMDKGSVGSSVAVDVISLTRCATCXYQFSRDSSMTDFPAGSEVENEDEYYEGNTTXGWLGVKLA

SEQ ID NO: 148699 - protein, 57 aa, Triticum aestivum
  Clone ID: PAT_TA_43117.pep
DRSRSESPMFSTRAGAAAQDLRFLLYRMSISERSMSVSQKAHYLPRQRRRSRRGGNR

SEQ ID NO: 148700 - protein, 60 aa, Triticum aestivum
  Clone ID: PAT_TA_43118.pep
YHFLMLLDEQPHRTPLFTEHRIHMLPCIKLYICVGSCKPSCYLNAVHSALLVLRTIQAST

SEQ ID NO: 148701 - protein, 81 aa, Triticum aestivum
  unsure (1)..(81): unsure at all Xaa locations
  Clone ID: PAT_TA_43119.pep
MATETDTFAFQAEINQILSLIINTFYSNKEIFLRELISNSSDALDKIRFESLTDKSKLXAHPELFIHIIPDKATSTLTIVD

SEQ ID NO: 148702 - protein, 67 aa, Triticum aestivum
  Clone ID: PAT_TA_43120.pep
VNATQALIYKYYALCKASSEGSIIMHDNLDRIDFVVTPLVTLITPFIIGSPLKKKKKTHASAHASAD

SEQ ID NO: 148703 - protein, 58 aa, Triticum aestivum
  unsure (1)..(58): unsure at all Xaa locations
  Clone ID: PAT_TA_43121.pep
MACPNVSWGCLLLLLCFAWTGDAXYIKYKDSNLPVNTSIKGLIGRMTLAEKIGLMTHI

SEQ ID NO: 148704 - protein, 103 aa, Triticum aestivum
  Clone ID: PAT_TA_43122.pep
VRPELRSGVRRARLMSSRLEDIQAADQVAAPVLPAPRGRGGRRGGGASGIGFKKAVATGRGMPAPKAIGKRDWAIDLTDQPFEDIPDAISLDGCSFTAHLDLA

SEQ ID NO: 148705 - protein, 86 aa, Triticum aestivum
  unsure (1)..(86): unsure at all Xaa locations
  Clone ID: PAT_TA_43123.pep
RTNDGVWLAHLLFDYSLPMGAGAHVNGGSAGEVCVMWIAFHHSLVXATMAGFPGGKVIAHLDHNTFKVCLKIAFTSYSHEQKIRIG

SEQ ID NO: 148706 - protein, 112 aa, Triticum aestivum
  Clone ID: PAT_TA_43124.pep
TSIAKMWWLEMRRPPPWGGGAALARRSDGMWLMAGTQYQSGFSLSCKAGAQLNSGRTVLTFQSPSRHIQIKLLSHTLRPQLRRRGAEGGEESPATLTMDINLLAKLSFSVPD

SEQ ID NO: 148707 - protein, 83 aa, Triticum aestivum
  Clone ID: PAT_TA_43125.pep
VCIIVDKLWNLSREAIEKKMISIGLSSKPVQGIIKVLSIKSLSKLEEVLGYGVEPAPHLKQLSPLAEQYGYADWICVVCKVRT

SEQ ID NO: 148708 - protein, 123 aa, Triticum aestivum
  Clone ID: PAT_TA_43126.pep
RPENFITIINDVHGTKKGHLEARRLSLQVRNSEYSQVLADMDLAKARSCNFWGPCELVPPLSRFQLLRVLYLYIDHRDHYCSRGNQQQCDLSPLRGLFQLRYLSLMSSHHFMLDAGDLPSTLW

SEQ ID NO: 148709 - protein, 84 aa, Triticum aestivum
  Clone ID: PAT_TA_43127.pep
HTFLWLNFKQPHVYSCFIVDTMLFSFVGTIRFKNSGHVIHFYICWNFLISTIYSYVQISNILVNMLGKIGYCATWCWPSQLATA

SEQ ID NO: 148710 - protein, 84 aa, Triticum aestivum
  Clone ID: PAT_TA_43128.pep
CSSVPQYPGGPYRSIVPTLHRRRRMYVTRVAHVGLWLRGCGGGSDGLRGVPGWSTLRGWRESWWRSSDDTITCRGVTPAPVAVS

SEQ ID NO: 148711 - protein, 101 aa, Triticum aestivum
  unsure (1)..(101): unsure at all Xaa locations
  Clone ID: PAT_TA_43129.pep
DEPSSSADPKAKKDYSTAILERKKSPNRLWVVEATNDYNFFVVLHPDTMERLQLFRGDTVLLKGKKRKDTIXMVLAEDTWXEPKVQMNKTCMKNLEWSLGM

SEQ ID NO: 148712 - protein, 103 aa, Triticum aestivum
  unsure (1)..(103): unsure at all Xaa locations
  Clone ID: PAT_TA_43130.pep
RPPTRPVRTQKTAETISKSVGGVMTEAEAAFKKVTANVKEKMSVATEXVKESFGLGKEETSSFRDGSHGTSNHGKTEASSHSNDKSQDATSAYMLFDKLRSTF

SEQ ID NO: 148713 - protein, 81 aa, Triticum aestivum
  Clone ID: PAT_TA_43131.pep
IRFYVQGEQATKPPCENCESSKGSEMCNSKVEHRSYTGYKIQFVLAVATECHRSVLGYGENSTRVEDLQTEKAKSRTRGRT

SEQ ID NO: 148714 - protein, 62 aa, Triticum aestivum
  unsure (1)..(62): unsure at all Xaa locations
  Clone ID: PAT_TA_43132.pep
IVVLMALSRQRQRMRASRFRNTKDKRCVNXMPMAASLHVGGARVRVSLGAWRHPIVSSTMAN

SEQ ID NO: 148715 - protein, 75 aa, Triticum aestivum
  Clone ID: PAT_TA_43133.pep
DGEIVEGIRQEEEEEEELEEGEIVEGIRQEGEEEEELEDGKIVEGTRSGYTILSTPAGVDTPYVIDLRKPWWKDP

SEQ ID NO: 148716 - protein, 43 aa, Triticum aestivum
  Clone ID: PAT_TA_43134.pep
LDGMVRFIISDPDLHGKSRPAVRRSLRSSRIGFKPADGRMDGR

SEQ ID NO: 148717 - protein, 46 aa, Triticum aestivum
  Clone ID: PAT_TA_43135.pep
HSFTLVRTQGFETLRDFDHLRARTNTIGAVARIRHQLAYATHSIFR

SEQ ID NO: 148718 - protein, 43 aa, Triticum aestivum
  Clone ID: PAT_TA_43136.pep
SAVTGASCMESAAQPDVYGFLVGGASLKAEFIDIINAVTVKSG

SEQ ID NO: 148719 - protein, 63 aa, Triticum aestivum
  unsure (1)..(63): unsure at all Xaa locations
  Clone ID: PAT_TA_43137.pep
MATAGKVIMCKSAVAWXAVNPLFIEEVEVVPPHAMEVRVXSISTSLCHTXRYFWVAMGQTAMF

SEQ ID NO: 148720 - protein, 62 aa, Triticum aestivum
  unsure (1)..(62): unsure at all Xaa locations
  Clone ID: PAT_TA_43138.pep
GGSFGVGDTCEHHFESKADSCAFKTYPXQAGAIRKGGHIAIKALPCKGGEVSTCKTGKHGHA

SEQ ID NO: 148721 - protein, 113 aa, Triticum aestivum
  unsure (1)..(113): unsure at all Xaa locations
  Clone ID: PAT_TA_43139.pep
LPDRTSLLEASHTSTPLERLFPVADATTFFTDMHDILXVWAAXGDIRTVCHHRLNLLEQKFNLHLMDNADRELLAQKAAPHRDFYNVRKVDTHVHHSACMNHKLLLWFIKSNM

SEQ ID NO: 148722 - protein, 41 aa, Triticum aestivum
  Clone ID: PAT_TA_43140.pep
RSWTLGLTLGPTYRPLPQAMDATVTVAKGKMGSVWRMAGCP

SEQ ID NO: 148723 - protein, 29 aa, Triticum aestivum
  Clone ID: PAT_TA_43141.pep
FTQHNLYLLLSALTMYIMIIGVRLILNEL

SEQ ID NO: 148724 - protein, 81 aa, Triticum aestivum
  unsure (1)..(81): unsure at all Xaa locations
  Clone ID: PAT_TA_43142.pep
PAVPSGFPVDHHPSTPRXTSSSYTGALQAGERYQRWGVATATPRTFAPSSTGTPATPIPPLAARAAEAAASTTGTIRTRRS

SEQ ID NO: 148725 - protein, 95 aa, Triticum aestivum
  Clone ID: PAT_TA_43143.pep
MKLRLRSMDARGGGAETHRVQLPDTAVLADVKSFLAAKLSAAQPVPAESVRLSLNRSQELCSPDPSATLAALGLASGDLLYFTLSAELLSQPPAP

SEQ ID NO: 148726 - protein, 132 aa, Triticum aestivum
  Clone ID: PAT_TA_43144.pep
SALRLPALKHAILIGDECQLPATVVSKVGKDALFGRSLFARLSSLGHEKYLLNMQYIMHPSISIFPNSSFYGGQLLDASSVMQKEHQMMYLSGTMFGTYSFLILKIVVRMSMNLIISGRTWFEVYHYSGNLA

SEQ ID NO: 148727 - protein, 103 aa, Triticum aestivum
  Clone ID: PAT_TA_43145.pep
SSAYPPLPYKNPSAKPLIGGPFPPPGRLLRAIPLKPKSTPFNQKATVPSSDPTLGPGEVVVGGCGRSGCNGGGWCGGRGPVVALEVPDRDPRHRPRGPLLRRG

SEQ ID NO: 148728 - protein, 73 aa, Triticum aestivum
  unsure (1)..(73): unsure at all Xaa locations
  Clone ID: PAT_TA_43146.pep
EREPSIITPIEPYFSYQHIGSMNVLFCPGNRIRFGRYALQALEPAWITXTHILSRLIAITLFALSGGKIWVHI

SEQ ID NO: 148729 - protein, 92 aa, Triticum aestivum
  Clone ID: PAT_TA_43147.pep
RRRRITPSRAGLRGAHNIRAGAFVLLVLPNSLAFPVAFLVVLAAGGVSTTMNPFSSRAENVDRLRDTVPSLVLASPDIAGKLPPFVRPVVLV

SEQ ID NO: 148730 - protein, 74 aa, Triticum aestivum
  Clone ID: PAT_TA_43148.pep
PVPVPNSRVTYAFCILSPSVTTNSLLLAPRLRFGPGKAAPAAVTAEIWCRVITVGWVGNTVLVALALRTDETPF

SEQ ID NO: 148731 - protein, 79 aa, Triticum aestivum
  Clone ID: PAT_TA_43149.pep
SYASLFPPHERAPIPSPPPPPSATNRSNPGPRSRFRSADQRAPAPNLPDRTLFSPPRALVMAGMAPEGSHFVASSMTAR

SEQ ID NO: 148732 - protein, 62 aa, Triticum aestivum
  unsure (1)..(62): unsure at all Xaa locations
  Clone ID: PAT_TA_43150.pep
DNNSPAGIQEASDGEFGVPVTDHHLNKLHLGLVHGGGVNRLDPPTGEXPISKRFVLNMVPAH

SEQ ID NO: 148733 - protein, 60 aa, Triticum aestivum
  Clone ID: PAT_TA_43151.pep
RWARGAARAPAPERPGAAGRGGRARGGDALWCRLQWSAARQAGVAEGNGNECRQRWASGR

SEQ ID NO: 148734 - protein, 86 aa, Triticum aestivum
  Clone ID: PAT_TA_43152.pep
GRTRPPTRPAPVSPTPTRRTRVRSETPLPVAAPVPGPEVFDVVIFGASGFTGKYVIREALKFLPPNAYPVRSFALAAHSRDRLYSL

SEQ ID NO: 148735 - protein, 67 aa, Triticum aestivum
  unsure (1)..(67): unsure at all Xaa locations
  Clone ID: PAT_TA_43153.pep
ARWGKGRARRRTKGQGRAXRRTGGEWESVPARGGEGKARRRLRATPEVAAAVLRVGKKVSVGMSFSD

SEQ ID NO: 148736 - protein, 54 aa, Triticum aestivum
  unsure (1)..(54): unsure at all Xaa locations
  Clone ID: PAT_TA_43154.pep
VRHKQKNNGVSHGRRLHLAPGPAPRRAPVRRXIPGLRPRPALLHQGSVRPAGQL

SEQ ID NO: 148737 - protein, 78 aa, Triticum aestivum
  Clone ID: PAT_TA_43155.pep
TLKHLPRQTTNHAWIQIIHILTLHNYLTQPLFFPPWVIRIHSQISTTTILSLVQKNYFLLNFFFPNTNHSTIFFSFHE

SEQ ID NO: 148738 - protein, 76 aa, Triticum aestivum
  Clone ID: PAT_TA_43156.pep
RVGTYSSTNTKHTGCLNWALATYCTQTFYFSEPTDSIYIFQRPYGFGNGSCRPHETTHPIGEAVPFHVNGPLIFIN

SEQ ID NO: 148739 - protein, 101 aa, Triticum aestivum
  Clone ID: PAT_TA_43157.pep
RPASLLPRSRLRPAPSSSRLGAAFTPLPRASSPLTSPPARLLSSHPHRRCRLERRLRGQIPEQTPPNTQHKEETGHTPRAEHIQQGYTPPPLASKEGGSKE

SEQ ID NO: 148740 - protein, 62 aa, Triticum aestivum
  Clone ID: PAT_TA_43158.pep
DASADAWGLPKVFPGETATTKDIVKLHGKEKLPVNYLPQRKRKVEKEKKAKPTEASDAEYYF

SEQ ID NO: 148741 - protein, 95 aa, Triticum aestivum
  unsure (1)..(95): unsure at all Xaa locations
  Clone ID: PAT_TA_43159.pep
VRGRVGGRVGGRVGEEQQMXEVVMXXCGGGXXGWQETEAXGFAWDAAAAAADQGGLRAASLTYSRQGKRPQHSGESETPAARCIPAKHSGSRARH

SEQ ID NO: 148742 - protein, 112 aa, Triticum aestivum
  unsure (1)..(112): unsure at all Xaa locations
  Clone ID: PAT_TA_43160.pep
GRTRPERAQAVLLLLVGRELXPNVGASPSSGASYSMRLNSHRMASLMTIREKRKERNYXIQKIRYSARKEVPHTMHRPKGEPTSSKANAEYTSAAANTHRCAVEGPPLSPPV

SEQ ID NO: 148743 - protein, 87 aa, Triticum aestivum
  Clone ID: PAT_TA_43161.pep
GAGVRGRVGTRLLSLSLPHRTDGYRRACQLCGDSARMEMLFSSLFCDSASSENFSGHPGGEKWPFLEDHNGATTLSISFGLAGTCQG

SEQ ID NO: 148744 - protein, 94 aa, Triticum aestivum
  Clone ID: PAT_TA_43162.pep
FHSLPNQEAALHVVVVAPCYCLHGWLVHHQLRCRSRRAPCPCLGAANGTNWMGWRRGDVEEGPQPSERAPRTPEKLRWRGCVLCAAAAPGRVRP

SEQ ID NO: 148745 - protein, 93 aa, Triticum aestivum
  Clone ID: PAT_TA_43163.pep
LHLPSRNDRRVRGRVGFGLGSSLRAAAASPTPWGSSTINQPKKRITPSGPSATQAAAAAIHGHGRDLQPKLRRAGRRRLRLRGPRRVGAATAT

SEQ ID NO: 148746 - protein, 80 aa, Triticum aestivum
  unsure (1)..(80): unsure at all Xaa locations
  Clone ID: PAT_TA_43164.pep
HGHPIRWSHGAARTGGLAPRRGGIRRCRRSGARXCAKGRASSSPPFLPGARGLRSCGHRQRRAGRAEWPPPPAAHAAAGR

SEQ ID NO: 148747 - protein, 51 aa, Triticum aestivum
  Clone ID: PAT_TA_43165.pep
RWFDLQNILFSTYWTPQMSWDSFTTRGTPIDYELAPVNLDDMGSLTCTTSH

SEQ ID NO: 148748 - protein, 101 aa, Triticum aestivum
  unsure (1)..(101): unsure at all Xaa locations
  Clone ID: PAT_TA_43166.pep
PPWTLGSGHVAFRWPGDHVKTVVPRLGKAEDXHASDLAVDVSAGSVHCHAYAATDACKVKKVDSIRQALRMRGFRCNLVYTRACTRLNVIPLSASRPRALR

SEQ ID NO: 148749 - protein, 83 aa, Triticum aestivum
  Clone ID: PAT_TA_43167.pep
MPALTLSLRFHRERLSLGSRGGRYKTTNLPITSLGSSTGSHLLAGSYNGNHDMISNNTLQNIAGVQTGSTWLDTDATGSVLEL

SEQ ID NO: 148750 - protein, 149 aa, Triticum aestivum
  unsure (1)..(149): unsure at all Xaa locations
  Clone ID: PAT_TA_43168.pep
LRNTTRSLEAVCKHDCTWYLKAGKDTRSSSIQIKKYTDKHTCTKAWDLKVLTAPFLTTQFRKEFRGNEKMPLLKFSEKVDQEFNLVAHRSKLGRARRAAIKEIRGEDDDQSTTLWXYGQELRRSNPPSLFFLCTKEVFDDKAKPTRPRT

SEQ ID NO: 148751 - protein, 109 aa, Triticum aestivum
  unsure (1)..(109): unsure at all Xaa locations
  Clone ID: PAT_TA_43169.pep
MPPSPEYEYEALDEQEYPNGDDLVDIEDIMSGVHYDVEINLCSNKPTVSNCSWTPNRGKDLALSNSQHTSRKMKHIGRLKTEHLAYVLPDGHPLLEEFEERVPEDPSXY

SEQ ID NO: 148752 - protein, 73 aa, Triticum aestivum
  Clone ID: PAT_TA_43170.pep
RPATSTLPNQTLPPALLPSTLSAVSTIFCFRSSIIPPPIHSPPLCRNRPITRPALTKLHTYTLSNAITTLINH

SEQ ID NO: 148753 - protein, 118 aa, Triticum aestivum
  unsure (1)..(118): unsure at all Xaa locations
  Clone ID: PAT_TA_43171.pep
TRRAGASSCAKAPQTLTLVLAXLPSSRASWSHGADQGRGAGHRHRPRHHLLVRRRVAARPRRDHRQRPGQPHHALVRRLHRLGASHRRCXAKNQVAMNPINTVFDAXVLSAKGLLMPL

SEQ ID NO: 148754 - protein, 160 aa, Triticum aestivum
  unsure (1)..(160): unsure at all Xaa locations
  Clone ID: PAT_TA_43172.pep
CTLRPSKWRVADASAHASAHASGIYFAGAVTTWDAGFYGKGDDXXHVNLGMLTNRLARYRTTPRVYVGCMKSGPVLSQKGVKYHEPESWKFGDEGNKYFRHATGQIYAISRDLASYISINQPILHRFANEDVSLGAWLIGLEVEHVDDRSLCCATPPDCE

SEQ ID NO: 148755 - protein, 63 aa, Triticum aestivum
  Clone ID: PAT_TA_43173.pep
MARRVLLLALVAAAVAVPPASAAVASIDLGSEWLKVAAVHLAPGRAPIAGAINEMSKRKCPAL

SEQ ID NO: 148756 - protein, 150 aa, Triticum aestivum
  Clone ID: PAT_TA_43174.pep
ARVREATAEITDANPCVSLTVRLLALQSKTSVHIEEIYIFADLVESSSDDSVAGPGNMGGSSLLAMLVPGLMQISKSRDCKIDDKYFAEGLKAQLPEGCALKDSIPCGNIAKEAGLYGTNDSKFRPAGVQSRLPPAQSGTICDDDGNQHE

SEQ ID NO: 148757 - protein, 149 aa, Triticum aestivum
  Clone ID: PAT_TA_43175.pep
GGASAHASADAWGATVTFGATKDGLACHFNKVGAVLKTLIGSDGATGQPTGSAYIEFLEKESAEKALTLNGTSFMSRILKVVRKSSVEVPQQPGWSRGVRASPFASRLIRTAYPRATFPGAMRGRLAIRGDARSFQWKRGAADSVDAGK

SEQ ID NO: 148758 - protein, 132 aa, Triticum aestivum
  Clone ID: PAT_TA_43176.pep
SADAWAFVSSSANLRAHAGGDLLVTVADFLTSCSADQIRMAPDKFLNVCRVLKNEVMQLNAPIRGIAPLRAAVRKIQTSSEQLTPLHAEYLMLCLLAKQYKAGLSVLEDDIFEGDQPKDLVLYWYYGAMIYI

SEQ ID NO: 148759 - protein, 115 aa, Triticum aestivum
  unsure (1)..(115): unsure at all Xaa locations
  Clone ID: PAT_TA_43177.pep
GGTDEGDIMHTDIGVLDKEGTHMHGRIPTDLSARVNDILKEGNGYLMKRFACKQSKPTYRAGDRPYMMQFTRFSTIDPVVGDEEDFPYWTYRLTXFLDIPMPGPHTPRFIDVIGR

SEQ ID NO: 148760 - protein, 118 aa, Triticum aestivum
  unsure (1)..(118): unsure at all Xaa locations
  Clone ID: PAT_TA_43178.pep
MADDDYNEVDMGYEDEPPKADIEVQIXHYYIYCWYSLEEELVATYKYYWRITEKXEGVEEDPENNEDAPXICDRVXGVKKEQREDDCLLPTIQQYYITNYERPLILTTRALIIIINAP

SEQ ID NO: 148761 - protein, 121 aa, Triticum aestivum
  unsure (1)..(121): unsure at all Xaa locations
  Clone ID: PAT_TA_43179.pep
FDGGSKPVFDKGLVYTNVFDAQXDTLVWSLRKAGVPDMKIIVGEIGWPTDGDKRANVKYAQKFYDGFLKKMAKNVGTPLRXPGHMDAYLFALIDENQKSVLPGRFERHWGLFTYDGKPKFP

SEQ ID NO: 148762 - protein, 138 aa, Triticum aestivum
  unsure (1)..(138): unsure at all Xaa locations
  Clone ID: PAT_TA_43180.pep
GGEMHHESLLEALPGDNVGFNVKNVGWKDLKRGFVASNSKDDPAKEAANFTSQVIIMNHPGQIGNGYAPVLDCHTSHIAVKFAELVTKIDRRSGKEIEAAPKFLKNGDAGIVKMIPTKPMVVETFATXHLLGRFAVRD

SEQ ID NO: 148763 - protein, 42 aa, Triticum aestivum
  Clone ID: PAT_TA_43181.pep
MSKLQSDALREAITNIINDCREKNRKFVETIELQIGLKNYDP

SEQ ID NO: 148764 - protein, 136 aa, Triticum aestivum
  unsure (1)..(136): unsure at all Xaa locations
  Clone ID: PAT_TA_43182.pep
VREDLQLLAAVQTFGCNWQLVSGNLVGRIGNXCSNRYRKTLIPERKRVGRWSEDEDKRLMVSVKLFRSGSWNKIAQFVPGRTQSQCSERWRNVLDPDIXMXEWRPEEDSKLLASVHEVGPCWSKIAGAMIPHRTDN

SEQ ID NO: 148765 - protein, 98 aa, Triticum aestivum
  unsure (1)..(98): unsure at all Xaa locations
  Clone ID: PAT_TA_43183.pep
FPRPARPCYPFPYXHGRASRPRPKARHAEFFSPSHPPLPDWPGVEIHPRGFSLLGNEDLTCFVYSIFFLTFSFDASSRILTRGYEIDVVNYRTIGELL

SEQ ID NO: 148766 - protein, 54 aa, Triticum aestivum
  Clone ID: PAT_TA_43184.pep
NHHHIFISSIITKHLTYFEYSIFFLTSSFHPLNQILTLDYQIYVVNYITIVILL

SEQ ID NO: 148767 - protein, 144 aa, Triticum aestivum
  unsure (1)..(144): unsure at all Xaa locations
  Clone ID: PAT_TA_43185.pep
ARVRALQHLQFLTQQQQQQQQLLLGAQXNITSSSGEMDARRLRVLLSSRKDGQSNAFTDIIPSVGPSLQNMYSHVQPMETDMLMKKIAALQQQRQSSNQQQLLQQSLLSQLPQSSNHFSGHHEKMVPGSVSMDGSLCYSFRGNE

SEQ ID NO: 148768 - protein, 49 aa, Triticum aestivum
  Clone ID: PAT_TA_43186.pep
VNLDPLKRPPFFFFFFFFFFFFFFFFFFFFFFFFFFFFFFFLTPNLNFV

SEQ ID NO: 148769 - protein, 73 aa, Triticum aestivum
  Clone ID: PAT_TA_43187.pep
SKHAGIVNSAREEEGLSGIPAFQSVGRTTKDGALGTAGAPIHMVASETGQFKEQLWRTFRSIALTFLVISGIG

SEQ ID NO: 148770 - protein, 71 aa, Triticum aestivum
  Clone ID: PAT_TA_43188.pep
MGGPLPVAVRKGVQKKKKKKKKKKKKKKKKKRKKKKKKKKIKKKKKKKKKKKGGRLKKSNFTPPFIKMKNF

SEQ ID NO: 148771 - protein, 60 aa, Triticum aestivum
  Clone ID: PAT_TA_43189.pep
AITSAYDLISRASFPSLQKMNAARSVPNNSVRSSNVASFYLTSCVWPEVLLVFLILVASS

SEQ ID NO: 148772 - protein, 122 aa, Triticum aestivum
  Clone ID: PAT_TA_43190.pep
GGWCTQNKYHSLCIPKVHYTDNNNNNNNNNNNNNSITPFEGKLSRRRELTQSSYPPKTDRSIFTKELGPHRPSSKPYIYNPNIPFSAFLMIISQSPFAFGDASNGTFHALIQMKKRENPRFT

SEQ ID NO: 148773 - protein, 140 aa, Triticum aestivum
  Clone ID: PAT_TA_43191.pep
RPARAATPPVESGTLPPSTFWTLCKGCSHIHQYDRLYEARKLKCSSCHQPFVAEAMAEPPPIVPGTDMYYCTWGFFPIGFPGCPGYADLVNSQPQGSGQLNVPWLGANGRVAAENGTPITIGAAREGPVASEPSPEPLMR

SEQ ID NO: 148774 - protein, 95 aa, Triticum aestivum
  Clone ID: PAT_TA_43192.pep
AMDLISSTRLSRITHGVTVEHVVSSDAARRERRIKMLIWRDHWQLLPTRLQVRYRIRPHWKNFANSLAPRFNVYLSERAMCIARFEGHSHTMENR

SEQ ID NO: 148775 - protein, 95 aa, Triticum aestivum
  Clone ID: PAT_TA_43193.pep
PVRAPAASEALLLLTGQRVTRGSLARECDSDLGCGGADLVHDNPDLNYAGVAVGRRPIDGGGRAGAAPPDLGRRDLDPRRRPRGWPSCPVARQGG

SEQ ID NO: 148776 - protein, 139 aa, Triticum aestivum
  Clone ID: PAT_TA_43194.pep
GSPAAPCRGRHHRSADHHAPSCRRRRRRSASHHHHLLAASHRNRPLAATDAVAALVTMDHLVVDDVLATPILMTASRRRTSQRRHTVVFLWQLHTAISILRHRTATGRPRHRTVSGLHLAPPSPTSHGVRHGATTASAD

SEQ ID NO: 148777 - protein, 129 aa, Triticum aestivum
  Clone ID: PAT_TA_43195.pep
KQRCCRCVDPAMSLPHLTSSQKDRPPYKIIGRTLAPPTLLSPFRLRRHPPKPHLARHQIPPPPPPTMATPTPFKFFASDDRQVGHLLAAVDAAASRCTAAAQRLEAAATNEAKLKGKGEAVDADAARAT

SEQ ID NO: 148778 - protein, 92 aa, Triticum aestivum
  Clone ID: PAT_TA_43196.pep
IAVHRWAHHFINYAGLRVYHEYFGWYSSQTPSRVDLGPVTLKLLNVKAFENHPIHEVVPSVFTEIGVHVISCVLICSRSGNGVIFLYVLTEY

SEQ ID NO: 148779 - protein, 68 aa, Triticum aestivum
  unsure (1)..(68): unsure at all Xaa locations
  Clone ID: PAT_TA_43197.pep
VRVPCSSIPRRSKPRRVDLYYSSWCSRAVESRRGNGGSTACEILLFHHEDMGIPYELARLAXSQGMWG

SEQ ID NO: 148780 - protein, 53 aa, Triticum aestivum
  Clone ID: PAT_TA_43198.pep
CGGSGFFPGAIDWCRSGFLHVSHFKYGPGYFIFFSHKVSMKGLSPGGVVFFLF

SEQ ID NO: 148781 - protein, 88 aa, Triticum aestivum
  Clone ID: PAT_TA_43199.pep
RSNQPPPLLFSGRPLRSPPPSVAFPPEDSVSIGLVMASAAYLDDIDAEVIDPPKIEMLDVTELVGDLIEHSPKPNVIVSSNGRELLEC

SEQ ID NO: 148782 - protein, 139 aa, Triticum aestivum
  Clone ID: PAT_TA_43200.pep
RPRTRGKDLKYLSHRLELYNLIKVESVVDAKEAKLYQKKNLSELSLCWGRRKYHGPQDDVGNMEEVLEALAPHSEIKVLEIHGYGGTKFSSWMMHSQMCQCLRKLIIFNCPKCKHLPSAPLLVSLEYLSLGYMDSLTII

SEQ ID NO: 148783 - protein, 121 aa, Triticum aestivum
  unsure (1)..(121): unsure at all Xaa locations
  Clone ID: PAT_TA_43201.pep
RPGKWSKLGDWILPFSGPAQYIAEHGLWFGFSRKDEHLCVANLVQEPPAPLLHEFPFQQVWEEPHLSEAWTPMAASLLPLGSGKLCTARVFRTSKGNKDRKAESIVVLAGMEXSTMPAREG

SEQ ID NO: 148784 - protein, 75 aa, Triticum aestivum
  Clone ID: PAT_TA_43202.pep
VRPRVRGRVGEKLRPSIRDLTTRRRTYRFADSSVPTAVDLHLDGQHRRDLLFKSYRAVFYLSNMSLSTFTLNFAL

SEQ ID NO: 148785 - protein, 139 aa, Triticum aestivum
  Clone ID: PAT_TA_43203.pep
VRSFSFATPAPPFPPPRGAAPGARQPPSPAKSAPLTTDPAAPVYFPPDPIFAAVRRACCKELRPHVSEELAPTPLTPERRSQGRSGTRKTTPPKPKLQDTKRGATAMAQRQEGSAEEGEEHRLRAALRHLQAEAGVLER

SEQ ID NO: 148786 - protein, 54 aa, Triticum aestivum
  Clone ID: PAT_TA_43204.pep
VRQEPYTYKAEEDSTPSGIFARGSYSARLKFVDDDGKVYLDMRYSFEIRKDWPA

SEQ ID NO: 148787 - protein, 139 aa, Triticum aestivum
  Clone ID: PAT_TA_43205.pep
VRGRVGGRVGRSTLFPNFGSMLSVADQHPKTEHWDEENVHRDDEEYASDAGGDYEDNVHSPLLSRQTTNTDGKDHGHHGSTLGMRRRSLLEEGGEAVSSTGIGGGWQLAWKWSERQGEDGKKEGGFKRIYLHQEGVADS

SEQ ID NO: 148788 - protein, 134 aa, Triticum aestivum
  Clone ID: PAT_TA_43206.pep
MFFTLLAIRRFLLPAAPDADAAPTAPSSASPRSPPCPGGGSAGKEELPSGASVLATAAPQWALLPSKSMPPPCPWPFPPQNPPPPPTPSAAMAQRPKNPFENTTASNAIRARLDQGIDESADVHAEERCLTTSD

SEQ ID NO: 148789 - protein, 102 aa, Triticum aestivum
  unsure (1)..(102): unsure at all Xaa locations
  Clone ID: PAT_TA_43207.pep
MGKEMTHINIVDIGHVDYGKYTTTGHVIYKLGGIDKRVIERNEKEANDMNKMALKYAWLLDKLNADREMGITIDIDLWXIETTKYYCTDIDAHGHRDFIKNM

SEQ ID NO: 148790 - protein, 88 aa, Triticum aestivum
  Clone ID: PAT_TA_43208.pep
KNTTKVEFEGTSLIFMVVLQLKLYTEDHYTMLILVFSYNNFSFIINRRTYRRLNEGSEFIYTRFNSSPSLQVVGTGGSEKSKQLDNVE

SEQ ID NO: 148791 - protein, 59 aa, Triticum aestivum
  Clone ID: PAT_TA_43209.pep
NIGNTPISYNTNMEGINQLHHHTYIQQSTCMRKWDEKIHGVLQSSKNTPIVENPHAHID

SEQ ID NO: 148792 - protein, 86 aa, Triticum aestivum
  Clone ID: PAT_TA_43210.pep
MASGEKVDYVFKVVLIGDSAVVKSQILARFARNEFSLDYKATIGVEFQTRTLVIDHNSVKAPYLGLPSVMKGTKSVTKRILQRRFW

SEQ ID NO: 148793 - protein, 138 aa, Triticum aestivum
  Clone ID: PAT_TA_43211.pep
VRGRVGQCRTSQNYKSLLSCSCFMVQFRDDSPLEALSDYHSTSTCLMDKHMVLPPGNDTGYGDYKIITHCCPRFQPEQHEANCYSTTSPDLTLHTTGPCTDLQSQILHEMSFWYLGLPRVRMYWRHVKLISAIERWVP

SEQ ID NO: 148794 - protein, 52 aa, Triticum aestivum
  Clone ID: PAT_TA_43212.pep
ADGKLHRRHLAHTPSSPWSALDRARQHQQKVGLPGVSSLSDPEDLKMVSEPC

SEQ ID NO: 148795 - protein, 67 aa, Triticum aestivum
  Clone ID: PAT_TA_43213.pep
MAETEYRCFVGGLAWATDDNNLQQAFSQYGEILDAKVTLTPLPLPDPFEFRVVGARSGPIWWFLWRI

SEQ ID NO: 148796 - protein, 61 aa, Triticum aestivum
  Clone ID: PAT_TA_43214.pep
GHAWNGCILIWRCITYTCNLLATVQIPAGNETTRSGVYFFTRVFKREKMIQTGPKMHCYWE

SEQ ID NO: 148797 - protein, 46 aa, Triticum aestivum
  Clone ID: PAT_TA_43215.pep
CLSMVRSRRYPWYGLGAFHVHSFARCICVRRPRVSSRVCCYFTDNS

SEQ ID NO: 148798 - protein, 71 aa, Triticum aestivum
  Clone ID: PAT_TA_43216.pep
NPWLKNTRLSASFHFRLEFAQWLVSYTCKLYTSISRSIHPPLCNSPNREMLLFICLTKCPSDESIRTRGRT

SEQ ID NO: 148799 - protein, 88 aa, Triticum aestivum
  Clone ID: PAT_TA_43217.pep
RPGSRSCGFLLLSSQSVKCSSLFSLGLLCAADSKKEEEEKACTNLKCPQFCIKMEDEQAWPSVSFAPLLCFLGLLFSVFFLHFFCALD

SEQ ID NO: 148800 - protein, 106 aa, Triticum aestivum
  Clone ID: PAT_TA_43218.pep
MKKKQVHEQQASLPHDHDCTEQDHSPTTGNQGRDGKAPPFPSTEEESEQQQPGVDLPEGAIVEILSRVPYRSLCRFKCVSKPWLALCSDPNVRKKSTQTLSGFFFK

SEQ ID NO: 148801 - protein, 106 aa, Triticum aestivum
  Clone ID: PAT_TA_43219.pep
NDHWPYQHHATLSGLSSSMIRTWSRPSSRWTTRRWCQIHWRTSLPTTAPCPRSSITLHCHRSRSSIKAPCSLLPRSSIKPPSSKTTTTPSGTSRSSSKKMMIPRLL

SEQ ID NO: 148802 - protein, 92 aa, Triticum aestivum
  Clone ID: PAT_TA_43220.pep
VVWSIVHTNCFYSVACSYMCVYNILIRVSHDTVMVNIPWFLWFASVNLDLQFMPLVFSMEAFIISILVSDQVLCWVGLPLYSFMSLWRIEIM

SEQ ID NO: 148803 - protein, 55 aa, Triticum aestivum
  unsure (1)..(55): unsure at all Xaa locations
  Clone ID: PAT_TA_43221.pep
KDEQKNTINFHACLDINGRLLRHVNAERRLXEWRADAADRQLKKLAXDFLKKKAK

SEQ ID NO: 148804 - protein, 56 aa, Triticum aestivum
  Clone ID: PAT_TA_43222.pep
MCENDRFCEPFLYLEKYRKDAESCVNAEEESVRASLGKKKAVPKPRDANKLKICMG

SEQ ID NO: 148805 - protein, 69 aa, Triticum aestivum
  Clone ID: PAT_TA_43223.pep
AALQEKERKNNAFMTNGMSDHFSGLPRVSFINPGYYCSTVRAGSCTHPNILTVAMRFLSMTFFRYKLYP

SEQ ID NO: 148806 - protein, 109 aa, Triticum aestivum
  unsure (1)..(109): unsure at all Xaa locations
  Clone ID: PAT_TA_43224.pep
DPRILPSLKHLIATFHYLPVGGFCKRYDAHGYSLWFCDYKYQEENTSSDVTLNKVAGFLQRMDLCRKYAFXKILLIGSEAPFKVKGLWLFRGQDILEFIMKEVYYIELY

SEQ ID NO: 148807 - protein, 110 aa, Triticum aestivum
  Clone ID: PAT_TA_43225.pep
SLMPGEQEVLRSVTKKCQTTAARPHHRPPLPAAVVYAVHRCCSSTENIAVLSTSRRGHLTWPPRTSPDPDYHLAMDAGRKKPARAAAAANRLGQPPPPVFALPLTTRLEE

SEQ ID NO: 148808 - protein, 74 aa, Triticum aestivum
  unsure (1)..(74): unsure at all Xaa locations
  Clone ID: PAT_TA_43226.pep
MADVKYLCFLGCLDXEATDDQWLQNTFSKDSYDIHSNFMTDRVTGQCRSFSYGTLSXDDAILHAIDAINRHDLD

SEQ ID NO: 148809 - protein, 116 aa, Triticum aestivum
  Clone ID: PAT_TA_43227.pep
VRPAAPGPASPPGNRTAPPPACAPPGTNSTPPSPPAPPPSSPLRPPSTPAATPPSPGATPATPSLPPPTGPGVPAEPSAPSTTPYTATDLPTPSDQASTPTSTSSALNTATVAGIA

SEQ ID NO: 148810 - protein, 80 aa, Triticum aestivum
  Clone ID: PAT_TA_43228.pep
YGTRGRTHGPGPSLRLTESTDVLIPWGRHHAPSLNRTVCVLGIFTLKKLEGSNHVIDVHTLWPNNLMDCAILLSQTKASE

SEQ ID NO: 148811 - protein, 44 aa, Triticum aestivum
  unsure (1)..(44): unsure at all Xaa locations
  Clone ID: PAT_TA_43229.pep
AYYTDTHLLQSALKKVIGSXTLQAXSLVDVDRLLFDFIFHRPLT

SEQ ID NO: 148812 - protein, 68 aa, Triticum aestivum
  Clone ID: PAT_TA_43230.pep
LLPLHITIPTNNFFPNSSHFPLNTNQCNFLKPLSFINISTSLLVLSHLLSLFFSLYQSSYHLNTIKSL

SEQ ID NO: 148813 - protein, 141 aa, Triticum aestivum
  Clone ID: PAT_TA_43231.pep
VRESALMDMYAKCGKLGVSHYRFSEMSAKDEVTWNSMISSFAQNGEPEEALELFRQMSMEGVKYSNVTISSILSACAGLPAIYYGKEIHGIIIKGPIRANVFAESALIDMYGKCGNLELAFRVFEFMPEKNEVSWNSIISA

SEQ ID NO: 148814 - protein, 127 aa, Triticum aestivum
  unsure (1)..(127): unsure at all Xaa locations
  Clone ID: PAT_TA_43232.pep
VRRSVVVYTTMVSGYTRDGRYRDAVGAFDDMLNXGFEPGAVVLASVLSACARSESGGLVMGRRVHDIMERRGMAAPAGVILGTLLVDMYGKNGAIEEAVTVFNGMPYLNTSTWNALISVFVHHVHCK

SEQ ID NO: 148815 - protein, 100 aa, Triticum aestivum
  Clone ID: PAT_TA_43233.pep
QARSKGCCEHNWDYVTCTRGCSRSPANKQITDTNGALQGAGLWISDPCSNYGDRTHTRRLNYTDYILTSAPCQKQAEWVPPTRLIVPTTSLRKVERPGHA

SEQ ID NO: 148816 - protein, 58 aa, Triticum aestivum
  Clone ID: PAT_TA_43234.pep
VRGRVGPNKKVHKRGSPSNGTTPLKMRSILAAFSSRYREPTPEPLERHSHAHHVQPSN

SEQ ID NO: 148817 - protein, 78 aa, Triticum aestivum
  Clone ID: PAT_TA_43235.pep
RNQQSVPVQKEHLPVQLPDPVISSSGQVSISSSSADRAPPVKIGEPEGNNPIFKYADGHVRVRERQLRARGEGAGNAS

SEQ ID NO: 148818 - protein, 34 aa, Triticum aestivum
  Clone ID: PAT_TA_43236.pep
RPVRVSCHLLSRLFYLKVSYEIKRGASLNLFPKI

SEQ ID NO: 148819 - protein, 50 aa, Triticum aestivum
  Clone ID: PAT_TA_43237.pep
LCHYSRKRSLLHGLRQQASKHKEGIEERSLLEQITITISLFKHGCKSCAQ

SEQ ID NO: 148820 - protein, 106 aa, Triticum aestivum
  Clone ID: PAT_TA_43238.pep
VRTRPPALFDRFFLHPPGDDKGAICDILQSNKIEIYNKPSFISKQASVYYISNTLPRKYSRATKNMHKFVLHYIHQDPIKNVILIFRCKTLMLKTKIMPSTRTRFP

SEQ ID NO: 148821 - protein, 139 aa, Triticum aestivum
  unsure (1)..(139): unsure at all Xaa locations
  Clone ID: PAT_TA_43239.pep
VRAHLGDGIIRSEDYVLMKAPGTSXPAYVATIEEIEALRPGRSNGTDKGHWFYLPDESIDGRTPLHGEMEVHICDHHNEQSADTIEDTGTECNYHXYTNLSAENADDSIXQFEYNSTTKRCKTDRIARYGTCEKAYKPG

SEQ ID NO: 148822 - protein, 126 aa, Triticum aestivum
  Clone ID: PAT_TA_43240.pep
MGRGNTHVNIGVIGHVHSGKSTTTGHLIYKLGCIDKRVIDRFEKEAVEINNRSFKYTWVLDKLKAEREKGITIDIALWKFETTNYYWTVIDAPGHHHFIKNMITGTSHADCAVLIIDSTTGGFEAG

SEQ ID NO: 148823 - protein, 77 aa, Triticum aestivum
  Clone ID: PAT_TA_43241.pep
MQHFTIFGYARSKMSDEELRNMISMTLTCRIDQRANCSEKMDQFLKRCFYQSGQYNSEEGFCELDRKLTEKEVIPNS

SEQ ID NO: 148824 - protein, 85 aa, Triticum aestivum
  Clone ID: PAT_TA_43242.pep
TRPFFFFLFCFFFFGFFFFFFFFTTTLFYFFGNSKFFFKRFTSLKNFLHVKNNFSRPKFNPRPIQKYFQNILFNPAVFPTPFFVP

SEQ ID NO: 148825 - protein, 96 aa, Triticum aestivum
  unsure (1)..(96): unsure at all Xaa locations
  Clone ID: PAT_TA_43243.pep
VRDKDTMKLERHTDAGKIDEKGIASTAAELETKSXTLLAPPYPAGVTTAPTAGSKSVPXDQMILLHLQNYTEEPRDNEFEKRITPKVVPANEIGVL

SEQ ID NO: 148826 - protein, 142 aa, Triticum aestivum
  Clone ID: PAT_TA_43244.pep
DAFGEAITNIINDWRETNRQFPERIQLGVGLKNYDPEKDRRRSHCPKLPDIHPHKIRVSIHGDPQHVEEARQMRLHLIDMECLEKMNRDNTLVNMLGKNFYAFLACEAIINQIPRLIGPGLNKAGKFTTLVSHQESLESKVY

SEQ ID NO: 148827 - protein, 92 aa, Triticum aestivum
  Clone ID: PAT_TA_43245.pep
EKLQMGTLQRGLDAEFLLAHMCSLKFKEWIAVLATLLRRAEVLVDLFPHDLRLWKAYSITLQAHDVFSEDLDLLSALEEELSSVSDRTLQNN

SEQ ID NO: 148828 - protein, 117 aa, Triticum aestivum
  Clone ID: PAT_TA_43246.pep
GTVLSAGYVLGVCVVVALAFLPATGACICREGRQPRLPSAGRRFSYPLLLALALGLHRSGKVNRGAHASGNRGKNLRRHMHTRRRPSSLEDSFTSGECPGPMKAPPTGGRGHRVRTV

SEQ ID NO: 148829 - protein, 84 aa, Triticum aestivum
  Clone ID: PAT_TA_43247.pep
MAVERDIFGISGPTYLNPVSWNCENNRRSVAACLVQAVYVLERDRQLNRQSVDAAAPPWWEFFHFEMIRKLGDDVDLSIFGAIF

SEQ ID NO: 148830 - protein, 145 aa, Triticum aestivum
  Clone ID: PAT_TA_43248.pep
SAHASAHASADAWGNFGMPMGPFQLQDLAGYGVALAVKDIYAAAFGTRNFNSVLVDLMVETGRQGKSNGKGYYLYEKGAKPKPDPNVQHVIDEYRKQAKTMPGGKPVTLSDQDILEMVFFPVVNEACKVMDENVVIRAADLDIAS

SEQ ID NO: 148831 - protein, 124 aa, Triticum aestivum
  Clone ID: PAT_TA_43249.pep
MDGSGTETGAKGKKGAAGRKAGGPRKKSVTRSVKAGLQFPVGRIGRYLKKGRYAQRVGTGAPVYLARVLEYLAAELLELAGNAGKDNKKSRIIPRHLLLAVRNDEELGKLLAGVTIAHGGVIPK

SEQ ID NO: 148832 - protein, 129 aa, Triticum aestivum
  Clone ID: PAT_TA_43250.pep
NQYDGSSWHFDEKRWTDQPVQESVAKHRLYFAHHSMTNCRMFKLGPREGYSSICRLPAISPWCVHFTLEDVLVGKPIDQPQCLVLPCRGIKFQSSGTITCTIPVRWPGRVDGRVGGRVGVRVGGRVGGR

SEQ ID NO: 148833 - protein, 48 aa, Triticum aestivum
  unsure (1)..(48): unsure at all Xaa locations
  Clone ID: PAT_TA_43251.pep
SCGSDCSSPKHPCPYSTDYIQKNTTNXGLLIADGLHLNSKERHAPVKA

SEQ ID NO: 148834 - protein, 56 aa, Triticum aestivum
  Clone ID: PAT_TA_43252.pep
RPIGSFTDILYYPLHAEELKYPPPPFLNCYTPSSSIQHQGSQSTYPTVPYLYRPTL

SEQ ID NO: 148835 - protein, 136 aa, Triticum aestivum
  unsure (1)..(136): unsure at all Xaa locations
  Clone ID: PAT_TA_43253.pep
VRGASPEVMLIGVRALGGLVDGLTAACYCVVHYGAIPGFXARLLTIEYMDLDEQALQALKKISLEHPTGCLRAGALMAVLSYLDFFSTGVQRVALSTAANICRKLPSDASEFVMEAVPXLTNLLHQHDSKVLEHAS

SEQ ID NO: 148836 - protein, 135 aa, Triticum aestivum
  Clone ID: PAT_TA_43254.pep
MPSHCPFPASAPPTHTGTGGPPPPSSLPASRLSVGHAATRARMATLRNLKIKTSTCKRIVKELRSYEKEVEKEAAKTADMKEKGADPYDLKQQENVLAESRMMVPDCHKPLEAALTDLKATLAELKESNETGTEI

SEQ ID NO: 148837 - protein, 80 aa, Triticum aestivum
  Clone ID: PAT_TA_43255.pep
SEQMLLIHFKTKFLERRGSTKPEHRGTTIRNKKYQLNPPARCFPSVANSASTVYEDVNIARAELQPRLTPKFTPYNATWS

SEQ ID NO: 148838 - protein, 87 aa, Triticum aestivum
  Clone ID: PAT_TA_43256.pep
KLVSIGNCNTANESPSTCESRYIIARSWSASLPGFNWKMTSMIVEEVGTLLVKINVLLVILDIDHNVLEPPVDQQPPVFEYADLDEK

SEQ ID NO: 148839 - protein, 97 aa, Triticum aestivum
  unsure (1)..(97): unsure at all Xaa locations
  Clone ID: PAT_TA_43257.pep
MATGGKVIXCKAAVAWEAGKPLSMEEVEVAPPHAMEVRVKILFTSLCHTDVYFWEAKGQTPMFPRIFGHEAXGIVESVGEGVTELAPGDHVLPCVHW

SEQ ID NO: 148840 - protein, 90 aa, Triticum aestivum
  Clone ID: PAT_TA_43258.pep
VEGVQDKSGVGRSEGLGGDWGEMPKEITAIRARGDRGRWARVRPRERRERRRFCNESVRLIGIESHCSIYLPLSLNESVGEKESKDEWPP

SEQ ID NO: 148841 - protein, 94 aa, Triticum aestivum
  Clone ID: PAT_TA_43259.pep
MTEVCVKAAVGHPDTLGDCPFSQRVLLTLEEKKVPYQMKLIDVCNKPDWFLKINPKGKVPVYNGGDGKWIADSYVITQVIDEEIPNFHSLFIFF

SEQ ID NO: 148842 - protein, 45 aa, Triticum aestivum
  Clone ID: PAT_TA_43260.pep
YRVMAPSASPAANASHSSQSVFISTNAPDVWCKKSEVLSKNEEKR

SEQ ID NO: 148843 - protein, 124 aa, Triticum aestivum
  Clone ID: PAT_TA_43261.pep
SGGKASSYSPLSEQPILPPTGFPFVQGRTHLPPPPGAIRECISIHIGQTGIQVRNPCWELYCLKHGIHPDGQMPGDKTARGGDDASNTFFSQTRSLKARPLASLVNVDHTAIDEERTGTYPHVF

SEQ ID NO: 148844 - protein, 34 aa, Triticum aestivum
  Clone ID: PAT_TA_43262.pep
DGSTCLYRYRSGYLLFALSSFCAHPGVVFKYEFS

SEQ ID NO: 148845 - protein, 119 aa, Triticum aestivum
  Clone ID: PAT_TA_43263.pep
VRVALALLLSTPRYAPPDSASRFHPGSNLHHSSPPVTSGHSSARIPSCARSIASLHRQIRASSSGHRPSSIYHLLRTLSARSHRRRCASSVALGSAHAGSISIWRSAPATYRPSPLVVA

SEQ ID NO: 148846 - protein, 62 aa, Triticum aestivum
  unsure (1)..(62): unsure at all Xaa locations
  Clone ID: PAT_TA_43264.pep
SALLLGVLLAGSLCALRAAKEEAKKLGTVIGIDLGTTYXCVGVYMNGHVVIIVDDHCHRITR

SEQ ID NO: 148847 - protein, 144 aa, Triticum aestivum
  unsure (1)..(144): unsure at all Xaa locations
  Clone ID: PAT_TA_43265.pep
AFFQSSEEGGSGTFRQASIDGITARSPLVGLPEFSYLGWGHWFTLRDLELATNRFSKDNIIGEGGYGVIYRGEIVNGTPVAVKKLLNXNLGQAEKEFRVXYEAIGHVLHKNLFRLLCYWVEGTHRILVLXYVNNVNPKAMALFD

SEQ ID NO: 148848 - protein, 61 aa, Triticum aestivum
  Clone ID: PAT_TA_43266.pep
KKEKGSLELSWLYNKEGLLHILISSEANIISNQVKKQGRILRFLLEDFYFSHSRCASMCKQ

SEQ ID NO: 148849 - protein, 82 aa, Triticum aestivum
  Clone ID: PAT_TA_43267.pep
MKRTRAHNPKAQDPEPHDPVVAGCNPNPKPDGRAKQPRQPKAAATAGKKTDAARDAAAVAVTADAAGSNFDGALGPAAEMAP

SEQ ID NO: 148850 - protein, 59 aa, Triticum aestivum
  Clone ID: PAT_TA_43268.pep
RNTVGPERHPGDHDRGGDERQSGRGKPPAPRSGCLRPQEWCTRRYADAGEWKGLCLDRT

SEQ ID NO: 148851 - protein, 57 aa, Triticum aestivum
  Clone ID: PAT_TA_43269.pep
VVVVHHSLVGTLCGQRTQSLTSALSGVSIHPARIVPYPDGDFLSRGQSASGGRVGGR

SEQ ID NO: 148852 - protein, 117 aa, Triticum aestivum
  unsure (1)..(117): unsure at all Xaa locations
  Clone ID: PAT_TA_43270.pep
QAIIKGRNPSPGGDKLAFNKIKSRLPGRVRTMSSGACPLSADVMVFLRICFGGDILEGFGTTATCCVITLTHVGDISTAHVGSPNPACEVXLADAPDMNYTSEDQPYRQGEIFAQIP

SEQ ID NO: 148853 - protein, 145 aa, Triticum aestivum
  unsure (1)..(145): unsure at all Xaa locations
  Clone ID: PAT_TA_43271.pep
RVRLTPVAMMPSSSSSRRRRRRRGNRNRPPPPPAPITGAGDVTSDEAELPPSAVAHRLECIPFSRAAPPKPNPPEPQPQPHGATHHSCFTSXSRRRRGRRGRKGTVPAPSACCGGGEGLGGAPAGRALRHPSQARPRRDPDRRGA

SEQ ID NO: 148854 - protein, 116 aa, Triticum aestivum
  Clone ID: PAT_TA_43272.pep
VNRCPCFGGHWPVPRRMLPKLGLFRPGRPPGHLLRTHGVQVLAGVEGRPPHRWAQRQVVGVLLRPKLRVQRRDRPRRRYPELEGKRRGRLPHPHPHGLNLVPLLLLMLRWPDAWRR

SEQ ID NO: 148855 - protein, 89 aa, Triticum aestivum
  Clone ID: PAT_TA_43273.pep
KGFSSHSIDSPFSEGVYRCDIDARSNKVTVAVTGNVSADALLKRLRRSGKNAQLWPEQQQQQQQQLAVGTQRHGETKNDAIHPDKPGGT

SEQ ID NO: 148856 - protein, 93 aa, Triticum aestivum
  Clone ID: PAT_TA_43274.pep
YPSPPIFFPSFCSPPLLSNPAWLSVGSGRSKPVRARRGLDGRWLGRRRSGPGAGPAAASGASERRGVGRPLIFVLVQGMGLALPLGLLTRGPT

SEQ ID NO: 148857 - protein, 78 aa, Triticum aestivum
  Clone ID: PAT_TA_43275.pep
ITALRIVEPNAHLGGGHPRRDDTLSIERSAKKADRDRLRPRAEAQAVDEKANTNEQSSSRSLRGMPAGMPGGLPFPRG

SEQ ID NO: 148858 - protein, 124 aa, Triticum aestivum
  Clone ID: PAT_TA_43276.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIIS

SEQ ID NO: 148859 - protein, 82 aa, Triticum aestivum
  Clone ID: PAT_TA_43277.pep
HRRAIEADENDPKLLQNPELGRKGGAETASGFFYRIPARVNHWDAIIVLLGVVALTTYPPGRGGPTRKTRGHIHRQLEVNSD

SEQ ID NO: 148860 - protein, 60 aa, Triticum aestivum
  Clone ID: PAT_TA_43278.pep
YLFQKFMKHFLVLVWNYVVIAIFLKIGKWREDKFGKVLKCTQSFLMLKIMVQRGALRRPP

SEQ ID NO: 148861 - protein, 155 aa, Triticum aestivum
  unsure (1)..(155): unsure at all Xaa locations
  Clone ID: PAT_TA_43279.pep
SDVTNLFRMLRASAKKAAGERIVPATDNRKMYYNKSQKEILENSKSDITNALMKRYPQLLRKYLPDKAKISPLIDMMMLLKLEMYSLKRQEQNFKAAIDLIVDAFFKHGDKDTLKSCIKAIAFLCMKXQADLLDYAENKLKILEDEVVLKVKTAI

SEQ ID NO: 148862 - protein, 52 aa, Triticum aestivum
  Clone ID: PAT_TA_43280.pep
HSCQVMTNLGEKLFEEEVEEMVREADVDGDCQINYDEVLKGHDGQVRDNPPF

SEQ ID NO: 148863 - protein, 81 aa, Triticum aestivum
  unsure (1)..(81): unsure at all Xaa locations
  Clone ID: PAT_TA_43281.pep
VRSTYAISCLTLEFREITMCWVDRIEXMIFNITNETSKSNDIYSQVDEIHVXEPLAFLNYFQDVAGYMASFGAELAYSRSN

SEQ ID NO: 148864 - protein, 87 aa, Triticum aestivum
  Clone ID: PAT_TA_43282.pep
LRTEYPPSGAAFDSSMALLRRNPSTKRMLHVPRTSFCSFSSYCSSNNRPTFRTHTPSFLRRPQPPGPEPRAWSTIGRFRSYIFLDIH

SEQ ID NO: 148865 - protein, 63 aa, Triticum aestivum
  Clone ID: PAT_TA_43283.pep
AATHPSVFFFFFLTSQSSKIYYSRWQSISHPESYHIIQFNTQPSTTVLITHSTDSCAQDRDKA

SEQ ID NO: 148866 - protein, 89 aa, Triticum aestivum
  Clone ID: PAT_TA_43284.pep
LVGGSPVYLAAVLEYLTGEVLELAGNASRDNKNTRIVPGHIQLVVRNDEELTKLLGGATIASGGVMPNIHQLLLPKKASSSKGGTRNDD

SEQ ID NO: 148867 - protein, 93 aa, Triticum aestivum
  Clone ID: PAT_TA_43285.pep
ISPQPSLSSPRRLPRIWRKRREAGSGGGRGDPGIPAVARPMRGDDELMSASSTPSSVLAAAATPTPLSVLAVAAASIYVLRDDAASPSDRPSW

SEQ ID NO: 148868 - protein, 76 aa, Triticum aestivum
  unsure (1)..(76): unsure at all Xaa locations
  Clone ID: PAT_TA_43286.pep
SFXAWADTWADAWSNACVSPVRVLFLLAVRFPHLTLNFAPVRMFSSMTFCPGSGRRGGRQDLEEEEEIRSSRGWLD

SEQ ID NO: 148869 - protein, 100 aa, Triticum aestivum
  unsure (1)..(100): unsure at all Xaa locations
  Clone ID: PAT_TA_43287.pep
GAHASAHASVLSYSIKRSRKSLSXETNLNSVDQTASPQSFERNTPNVEFNISASMKXSDDKISELADAKSLRDEAIKHVDRPDSILAQMKCSLSLSSPKT

SEQ ID NO: 148870 - protein, 80 aa, Triticum aestivum
  Clone ID: PAT_TA_43288.pep
MASAMELSLLNPAIDQHGIAGKTASHLPLLPARRGAVRFRVRAAVAAPPAPAAKPGSPKKRGKTEVNESLVTPGFYTTDF

SEQ ID NO: 148871 - protein, 72 aa, Triticum aestivum
  Clone ID: PAT_TA_43289.pep
FQKGGGAFLEKVLKLSSNDQITLSGLVWGGLISIQVVKQEMALQRGRAVLILILRQGMAHQKRSCPNHLPLA

SEQ ID NO: 148872 - protein, 51 aa, Triticum aestivum
  Clone ID: PAT_TA_43290.pep
NQQMDTMQRRLACTISLVVVLLSQSFVVLARRRLTLNYRISWIHHPSSIRT

SEQ ID NO: 148873 - protein, 99 aa, Triticum aestivum
  Clone ID: PAT_TA_43291.pep
MYRAAASLAFKARQAGSSARQVGSRLAWSRNYAAKDIRFGVEARAMMLKGVEDLADAVKLTMGPKGRTVIIEQSFGAPKVTKDGVTVAKSIEFSDRVKN

SEQ ID NO: 148874 - protein, 75 aa, Triticum aestivum
  Clone ID: PAT_TA_43292.pep
SADAWAVLNLLTPSLFLSIGGDYPGSASFLLLPPGMLVVVTLELIQFRLFDLFTLPVALGVLGGSLVKKLWSGIK

SEQ ID NO: 148875 - protein, 97 aa, Triticum aestivum
  unsure (1)..(97): unsure at all Xaa locations
  Clone ID: PAT_TA_43293.pep
VRPRVRAGVVSFDPSGMKVLWDGFDADLGGRYFDEVLFEHFAEEFRDRYKIDVVGNVKASMRLRAVCEKAKKVLSANALAVRNKXCLMAEKDVKVIF

SEQ ID NO: 148876 - protein, 116 aa, Triticum aestivum
  Clone ID: PAT_TA_43294.pep
LHLASGHFPLPLGVLRPIDDLRSYNTQRGVSRSGSRHAYPCLMQRLLGCGGEGSMGWCRCGVIGGRIMSRRRYTEHGTSASSSRVGAPGAHETVTPGSGARPGVGRRELRKSRSGR

SEQ ID NO: 148877 - protein, 118 aa, Triticum aestivum
  unsure (1)..(118): unsure at all Xaa locations
  Clone ID: PAT_TA_43295.pep
RPPTRPPTRPPTRPAKRAKDSSVVDTTLCELHSSDVEHNIMSPGKNCVGKSSTGCSSQTANDFEAPIDPEVEGENGKADSDPENLSDIDDVEGDGYLHNEEETQNXXGIWEEMNKEYL

SEQ ID NO: 148878 - protein, 86 aa, Triticum aestivum
  Clone ID: PAT_TA_43296.pep
MQVVTRTEGIGGLIEMVARACPYTVRWANVMKMARPDSFFNCARKIQQGETAALDERTFEPRTTQERFRNIQLQEELATYDPKENR

SEQ ID NO: 148879 - protein, 141 aa, Triticum aestivum
  unsure (1)..(141): unsure at all Xaa locations
  Clone ID: PAT_TA_43297.pep
VRPRVRDEEVLVSESISVGSPGQNAIIGKLVLFTKSLPSRYEDWEEGTKALVDKDCLVGGGSVGTVYKATFENGLSIAVKKLETLGSLTTQDEFEHEMGQLGNLNHPNLVTFQGYYWSSSMQLILAEFVTKGSLXEHLHGN

SEQ ID NO: 148880 - protein, 66 aa, Triticum aestivum
  Clone ID: PAT_TA_43298.pep
MSFSVAGMEKERGAAAAVEEIRRLPAEVNWEMLDKSRFFVLGAALFSGVSAALYPAVGVKTHLEVG

SEQ ID NO: 148881 - protein, 136 aa, Triticum aestivum
  unsure (1)..(136): unsure at all Xaa locations
  Clone ID: PAT_TA_43299.pep
VRISSNESKDPDACRDLQLVPADGAVPSDGLKQQQILKAVEKVLAGSIRREMARDEQCAKQAVEIQQLNRLVQQYKHERECNAVIAQTMEGKIARLESLMDGTLPTDEFIHEEYXSLMNEHKILQKKYDNHPEVLL

SEQ ID NO: 148882 - protein, 117 aa, Triticum aestivum
  Clone ID: PAT_TA_43300.pep
RPHFPPPLPLPFLPATPATSGLFAPVGPHPPPTSSTSSATWGFVKMKLVQDNLAGTSMFYFVKMKQVQDNRAGTSMFYPVLPDSMHDLPAPLVPRFTTAKKYNRYYRARLAARRSVF

SEQ ID NO: 148883 - protein, 117 aa, Triticum aestivum
  Clone ID: PAT_TA_43301.pep
SARSKPPKPYRTPPRQPWRRPPRSGPQQRRLLQAAADGDLRLFKSIASALDGGKGRVKEAVEAVRNCGAGALHTAAGRGRTPMCAYLDEELGVDVNAADDQGATPLTYALRWRAVGT

SEQ ID NO: 148884 - protein, 110 aa, Triticum aestivum
  unsure (1)..(110): unsure at all Xaa locations
  Clone ID: PAT_TA_43302.pep
MDSKPQAPSSEGAAYPLMCSEDLAPPASTVVAPACSNPYVLYSTCSVPPAKSTKENLWETLSSQAKRFREAARKTEGIDGDVXHDXKTVPSITDAAMGRIDQGCNGILGG

SEQ ID NO: 148885 - protein, 132 aa, Triticum aestivum
  Clone ID: PAT_TA_43303.pep
PQCFSSCGIKIDSQLTRVEGRVLSAPMLVVGNSQDCVPFKGRWNYNNKKLFEPVRIERWAIVNFSARCDMSRISRELINCGRTKGIIIEGPYSLVDEDNQARRCAPIVRVERMFEKVKANLPGPPEFLLCVL

SEQ ID NO: 148886 - protein, 64 aa, Triticum aestivum
  Clone ID: PAT_TA_43304.pep
LCSLRCPYVYIGCTLEDYAPTNLHEVSIGSSEKSRDCIPGKHNTIQAHGTKQSDLKSKVIVYSR

SEQ ID NO: 148887 - protein, 88 aa, Triticum aestivum
  Clone ID: PAT_TA_43305.pep
GDPNRFLRADPIGGLCAPGSKICYFSVSRVHVLDNIVTMDAETISLYRSAERIFRCGPLHAFSTTAVATLCWSDLNCDPRVRPRVRGR

SEQ ID NO: 148888 - protein, 59 aa, Triticum aestivum
  Clone ID: PAT_TA_43306.pep
YLLRGRTLPVKIRWASERDGLIDGTRIGDEMFLSDRSVAFIFRLVLSPSWFIGFFYNLC

SEQ ID NO: 148889 - protein, 43 aa, Triticum aestivum
  Clone ID: PAT_TA_43307.pep
RLHYVGGSYTGAALPDQQWFAYFTYYLVLIKGPYASRQNSFSL

SEQ ID NO: 148890 - protein, 77 aa, Triticum aestivum
  Clone ID: PAT_TA_43308.pep
RPHSRFSPTLPSSPLPASKRQNATGESSRSPRRVGPSRWWMWSTGWRAWPRRRTRPACAALSLAPWSALSFHWRPLT

SEQ ID NO: 148891 - protein, 66 aa, Triticum aestivum
  unsure (1)..(66): unsure at all Xaa locations
  Clone ID: PAT_TA_43309.pep
KMVQESQNYTSXDDEPKTKGGGKNSLENYAYNMRNTIQDVKIDFKLAVDHKKKIEDAVDTAIQWVD

SEQ ID NO: 148892 - protein, 134 aa, Triticum aestivum
  Clone ID: PAT_TA_43310.pep
LLKQKCQPLSSLLEQQCHPLSSLHEQQCQPLSSLLEQQCHPLSSLHEQQCQPHYSLHEQQCRSLYSHQQNFQPLPLSSLHEHCKLLSYPGPGQSLWPPQHLSSPLQCLWTNAWSYVCGRTGRSGREFGGVTSAG

SEQ ID NO: 148893 - protein, 103 aa, Triticum aestivum
  Clone ID: PAT_TA_43311.pep
NQSPRCSEAMAMRALRIRTAHPACGPSITGSDSSSSSFSSLIPLRPAWLASIWWLVGPWCIGLDWICAASEGGFEWIVPLARCTDSGEEQEDHARVGADAWAD

SEQ ID NO: 148894 - protein, 118 aa, Triticum aestivum
  Clone ID: PAT_TA_43312.pep
MEQEEEGAAAQAEGDLLRDFERILHDDPLIDEVGFLHPTQFHSLLVDSTNKSTSQYFWCADHKLAIFFNILPDLYRAARRAHSNATLNPSLSPSASAAALIMTHSKALLILCPDLLTG

SEQ ID NO: 148895 - protein, 140 aa, Triticum aestivum
  unsure (1)..(140): unsure at all Xaa locations
  Clone ID: PAT_TA_43313.pep
VRTENTASTLHIKETCLAATIGETPPIVFGELDAYVXTPRDLRTINYAWAQHIIKDVRRRLYTNCCMIKKKALTKYALNYDTDAITKETHMQIETIKKYATVVTLIVHTPIRKMIGSKHKNAFLMVIHINGGSIADKVNY

SEQ ID NO: 148896 - protein, 90 aa, Triticum aestivum
  Clone ID: PAT_TA_43314.pep
GRRIASRGRGSACPPAPAGSDSPPSAPAAPWPCTAPRAATSATTTTATAAAARRRAPRRRGPAAAAGTPAAGTGTSSRWWGILRRGGRVG

SEQ ID NO: 148897 - protein, 143 aa, Triticum aestivum
  Clone ID: PAT_TA_43315.pep
HMGGWSIPDPPDPSIISRLKSGGADASAASNDMNVPGPAKLSSTGVNTYAKIRINVAECDIKGHDNPSGEKEANESYITKGKVEIPAKTQSKSCVQTVNMNTGVFDRKNSGVEDVSTVLNAAGSPVLRRSARKTQDADGSSSL

SEQ ID NO: 148898 - protein, 47 aa, Triticum aestivum
  Clone ID: PAT_TA_43316.pep
AWTNLNVNLFSLICRSGTFPVTLNYLGPNNVLCKNVYFNGGVFFDWT

SEQ ID NO: 148899 - protein, 139 aa, Triticum aestivum
  unsure (1)..(139): unsure at all Xaa locations
  Clone ID: PAT_TA_43317.pep
RPPSRTRASPTPSSSRLASLSLKTLTRARLPAPPPPPPLLFLPPAPPCPAPXPGPAPHRRHLASASSSFLSLCSARARSLQGRRRQGRRAAPAPSARLTDPASPILAQSPTRSSGGGGTPRGGCHARVVPLRARRVQPR

SEQ ID NO: 148900 - protein, 39 aa, Triticum aestivum
  Clone ID: PAT_TA_43318.pep
RPDYCYSMGVPCYLTKRTLPFRRRLSVYIGPPILNSLRS

SEQ ID NO: 148901 - protein, 99 aa, Triticum aestivum
  unsure (1)..(99): unsure at all Xaa locations
  Clone ID: PAT_TA_43319.pep
MSTDVVVDVPAPEEEGTDDPGVVTTGVAGDGDAKPAKETKVKGGKANKPSVQRKPRANRAHPTYAXMGYKAITALEERTGLSQDAISKVRGDKRKGHLP

SEQ ID NO: 148902 - protein, 49 aa, Triticum aestivum
  Clone ID: PAT_TA_43320.pep
ASFMSGDYWTIEGINCNGMRRDIEREWSRTHTCLEHTGHVNRCYTHTHA

SEQ ID NO: 148903 - protein, 57 aa, Triticum aestivum
  Clone ID: PAT_TA_43321.pep
SAPAPHRGASESNPAPVLSPPCTDLCRRRIWIWLFIWLEIFPPTLYACYPSRMGRSP

SEQ ID NO: 148904 - protein, 46 aa, Triticum aestivum
  Clone ID: PAT_TA_43322.pep
ITSISPNLRRFVPSPPLPHFGSGKSARELAFPVKVQERVSRIVRPN

SEQ ID NO: 148905 - protein, 138 aa, Triticum aestivum
  unsure (1)..(138): unsure at all Xaa locations
  Clone ID: PAT_TA_43323.pep
RPGSRGAPLPQPQDSPILLPLLRLLVLRAVTGDAVVDSADPCAGRTIHIRDLPPRINTHLFRHCDTAFPIDDPSSXGTSTPTCELIGNHGLGPSTHSRSCSWYRTDTRLLEPFFHRRLLERRCLVADPGLVDAVFLQY

SEQ ID NO: 148906 - protein, 85 aa, Triticum aestivum
  Clone ID: PAT_TA_43324.pep
RPLGVKHMICCCNKMDATTPKYSKARYEEIVKEVSSYLKKVGYNPEKVPFVPISDYHGNTSPFRHLVHDRRRLLLSHFQTVLQAA

SEQ ID NO: 148907 - protein, 46 aa, Triticum aestivum
  Clone ID: PAT_TA_43325.pep
NLLPLVILTANIMFHSRAPRDGPALMGHGLGGSGVVLEYDTRVRGR

SEQ ID NO: 148908 - protein, 76 aa, Triticum aestivum
  Clone ID: PAT_TA_43326.pep
RPVDVAVGAANPKKWRLLPYTTLTHLLAEVASRLARPPGGAGPSSAAGDSLSANVSSLAAALNPGAGVLVSSGIQG

SEQ ID NO: 148909 - protein, 71 aa, Triticum aestivum
  Clone ID: PAT_TA_43327.pep
NRVSPPSVRGTEYLGAETAAAAGKGRPVVVLAGVNSGAAAATTGHIDGLLGGTATPAAGAAKVEVGVGGRT

SEQ ID NO: 148910 - protein, 58 aa, Triticum aestivum
  Clone ID: PAT_TA_43328.pep
LTLSKKTTRASPRRPTMTRSRTPTWNFSVILSISDTSMCPPKDVGLDRSQGRSYIKPD

SEQ ID NO: 148911 - protein, 62 aa, Triticum aestivum
  Clone ID: PAT_TA_43329.pep
GIRRLVLAKKMEAPWEAIAINSLSRCITELGRAPNREIWWIIRLLEGTIQGLRYPNVMTIAL

SEQ ID NO: 148912 - protein, 57 aa, Triticum aestivum
  unsure (1)..(57): unsure at all Xaa locations
  Clone ID: PAT_TA_43330.pep
RVTRSKFPSSLQTSQMLFEGVLLKHDLLNKLFTTITSCXVVTIISLLPGCNLYDDIW

SEQ ID NO: 148913 - protein, 78 aa, Triticum aestivum
  Clone ID: PAT_TA_43331.pep
TLPTERSVQIDSECFFTKYHVFSYKRYCNRTQKITKSQPGCYCHLIYSVYFFQVPPQITEELHSPFGSSNQDEHFFAR

SEQ ID NO: 148914 - protein, 55 aa, Triticum aestivum
  Clone ID: PAT_TA_43332.pep
YTSKVRYTYPRLLVLQDTCKRGVVLALVCSNMSYTTLIEVFFKRFIYFSPRVRGR

SEQ ID NO: 148915 - protein, 118 aa, Triticum aestivum
  Clone ID: PAT_TA_43333.pep
SADAWADAWAPSSLPHRRHQPGPRRASCHCSPLAPPLLSSHLAAPVATRSAASLTPQPTPAGSGDSTTAQHIDELGSDPSSSKPVGSAAPVPLRSPVTPNLWLGFRLQIASILGTFPA

SEQ ID NO: 148916 - protein, 103 aa, Triticum aestivum
  Clone ID: PAT_TA_43334.pep
SGGTVSSSYQTANSVHTFGRQVLKRKNIALNNETVCVGPIRKMHQRYNRVSSLSETWPGYREYPASDASKLDEGFEHSTQTQKRLRLAEVDDGTLRICGNSFC

SEQ ID NO: 148917 - protein, 80 aa, Triticum aestivum
  unsure (1)..(80): unsure at all Xaa locations
  Clone ID: PAT_TA_43335.pep
MFGFGHHHKGQGPTALGPNQIFKIYWRALEDYCLSVRDGEGVLVPGDPKGETHXLVKDMRFNTTVKDKEGMPAFSLVNKG

SEQ ID NO: 148918 - protein, 100 aa, Triticum aestivum
  Clone ID: PAT_TA_43336.pep
NITSSHRDGVLPSRSIDTAASMKASCLLVVLLLAVATGSRLSLAAREGSTLGGELGELIVKAGSFLTSARRAVADGWHFHTAEEVDASANKGHGHLGGAE

SEQ ID NO: 148919 - protein, 102 aa, Triticum aestivum
  Clone ID: PAT_TA_43337.pep
WWWCPTPRRTPVVLLIADARESTKRAIWGACEPSRPGERTEATGVQIGHKEGRRTGIRGWPAGPVVIAPLGKPRLEEILDRNWLGLKPNKKPAAVGTNAWTD

SEQ ID NO: 148920 - protein, 78 aa, Triticum aestivum
  Clone ID: PAT_TA_43338.pep
RLCGKCFKPVPAREAVNCKYCEALFHRKHFNVPRGAVDTVYVCNKCLAEKVEPVVSPQKKAASKKSSPKKSSSKKKQM

SEQ ID NO: 148921 - protein, 93 aa, Triticum aestivum
  Clone ID: PAT_TA_43339.pep
GAYVRNGWIEKAKKLHVHMLEKGARPIYKTWEILIEALVQSRHMDKAVNAIKRALSLMNSCHWRPLLKLVEAIASFFEEKGNTDDASRYIKLL

SEQ ID NO: 148922 - protein, 81 aa, Triticum aestivum
  Clone ID: PAT_TA_43340.pep
MSMAASSMAATLAPVRAAARFVQTRLRSSGKVLIEEERAAENVYIKKMEQEKREKLARMGPSAGEQASFTPSAGSIDVSST

SEQ ID NO: 148923 - protein, 57 aa, Triticum aestivum
  Clone ID: PAT_TA_43341.pep
MRLWSLLLLVCLPTLIVSEDYSDVTVIVRGSKTIAATSDEFICATLDWWAPEKCNYD

SEQ ID NO: 148924 - protein, 105 aa, Triticum aestivum
  Clone ID: PAT_TA_43342.pep
MEAYKVWVRKNRDLVRSLESLANGVTWILPERFANSEIAPEAGDASLSIGVTFSPTPRFFGLNLLSSVVYALLGIVSSVNQHIIETPNDGHSLALKEQSIPWALG

SEQ ID NO: 148925 - protein, 59 aa, Triticum aestivum
  Clone ID: PAT_TA_43343.pep
TNWAIGANQPVVGWLEDYGIPVHQGQILILAFILRFISGFPAMHIQWEETFPSTTRCLQ

SEQ ID NO: 148926 - protein, 71 aa, Triticum aestivum
  Clone ID: PAT_TA_43344.pep
VFLCLPVKQFQVMGLDLHFPRFLADKYIMRENLYVLMLCTSKYKQSRKISSLTFLTTPGWGHGCKIWVWDL

SEQ ID NO: 148927 - protein, 78 aa, Triticum aestivum
  Clone ID: PAT_TA_43345.pep
MAASPEMLRRCWWAAAAVLSAVLTVSRVSANTEGDALYSLRQSLKDANNVLQSWDPTLVNPCPWFHVTCNTDNSVIRV

SEQ ID NO: 148928 - protein, 95 aa, Triticum aestivum
  Clone ID: PAT_TA_43346.pep
RPAPAASSHGDHHLPPAPYPPWPRLRAPSPPQALPAPLQSAPARPASDPSPPRRPPPPSRRRRRRPRRAPLGRRPVRSRLLLGREGGRWGRGGGR

SEQ ID NO: 148929 - protein, 87 aa, Triticum aestivum
  Clone ID: PAT_TA_43347.pep
MASGGRTDLDGGAVAPLTICVIGAGGFIGSHLCEKLMAETPHTVLAVDVYCDKIRHLVDPSPPHLAGRIAFHRLNIKNDSRLEGLIK

SEQ ID NO: 148930 - protein, 103 aa, Triticum aestivum
  Clone ID: PAT_TA_43348.pep
GHASVLEAAHVRKEYDDASSKLSKIQSRITSLTDKLKQDFGKEKEFYYFYDQCFEGKEGKYVYKVCPYKKASQVEGHSSTNLGRWDKFEESYRMMRFSNGDKC

SEQ ID NO: 148931 - protein, 107 aa, Triticum aestivum
  unsure (1)..(107): unsure at all Xaa locations
  Clone ID: PAT_TA_43349.pep
VRPRVRDVMAAPGTLIPADVFNSXGTPFNFSQTLGQNQVVESASNIEDDPVALQSEHKRNQGHMFANNNRISVNLSSYENTMTGGSSASEPGTLDPMMALGKTSTLP

SEQ ID NO: 148932 - protein, 59 aa, Triticum aestivum
  unsure (1)..(59): unsure at all Xaa locations
  Clone ID: PAT_TA_43350.pep
MSDCCPMFLLESLHPLNGPLAGSITAGGSAGXTLTLPGGVMISEIPRIPQRVSGRVGAR

SEQ ID NO: 148933 - protein, 56 aa, Triticum aestivum
  Clone ID: PAT_TA_43351.pep
MSFSVAGMEKERGAAAAVEEIRRLPAEVNWEMLDKYRFFVLGAALFSGVFVALYPD

SEQ ID NO: 148934 - protein, 95 aa, Triticum aestivum
  Clone ID: PAT_TA_43352.pep
PQTDAVADQPSDQVLEPQSAGLVEEPVVHQSDTSTSKPHMSQGEAAAGESYRPAYESKNNAYLGEPSQPMVDALTEERPEGQIDAGAHDLTGATL

SEQ ID NO: 148935 - protein, 71 aa, Triticum aestivum
  Clone ID: PAT_TA_43353.pep
VVTASAEERAGETVAAANANAGRDGGSRGRVGEVAGNGDGDAADGEVLGDGGGGAAREDDGHGGDPSLTRT

SEQ ID NO: 148936 - protein, 101 aa, Triticum aestivum
  Clone ID: PAT_TA_43354.pep
CAHASAHASGNGKVAYIGTEGTFRPERIVPIAERFGMDANAIIYARAYTYEHQYNLLLGLVAKMAEEPFRLLIVDSVIALFRVDFSGRGELAERQQKLAQM

SEQ ID NO: 148937 - protein, 103 aa, Triticum aestivum
  Clone ID: PAT_TA_43355.pep
MSGRGKGGKGVGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 148938 - protein, 133 aa, Triticum aestivum
  Clone ID: PAT_TA_43356.pep
SADAWAAQLLQLRSQRTFRRAPGNGGFLPVRHLSDAPKPSPSLLKTTAAAAFLLSNSRKSLPTPRAFARLRPNCPHLSRTQTPVPVLASAVSWLVDAPALPLPRIQVIRITFASSGSSSCAMSAVAPPLRTWI

SEQ ID NO: 148939 - protein, 79 aa, Triticum aestivum
  Clone ID: PAT_TA_43357.pep
MSPPISLCVFVLLSSLLAAARAEDPYRFYTWNVTFGDIYPLGVKQQGILINGQFPVPHIDAVTNDNIVINVFNNLPAPF

SEQ ID NO: 148940 - protein, 67 aa, Triticum aestivum
  Clone ID: PAT_TA_43358.pep
PLFYSHNYILAHCDIALAQHIPHKSHFLSHIILPCFHLSRGKTHHNLTIHSSIPANQCQWHPHHSMF

SEQ ID NO: 148941 - protein, 81 aa, Triticum aestivum
  Clone ID: PAT_TA_43359.pep
VRPPPNSQLLAAIPTSTSNGISAPGEASPARSRSGSHGSTSPRSLDLCPPAVATPQVCWLMSRPFQGRFFPGEPPGVCPMR

SEQ ID NO: 148942 - protein, 86 aa, Triticum aestivum
  Clone ID: PAT_TA_43360.pep
TIDLRSEITLLVDGMRYICTPRGRLLRERATGGPLDCEAVLLDRVSAEVGVESRHDSGEDLLGILNPLRRLQKLVFESRKPYRGFC

SEQ ID NO: 148943 - protein, 81 aa, Triticum aestivum
  unsure (1)..(81): unsure at all Xaa locations
  Clone ID: PAT_TA_43361.pep
PLVRSYAYFYYIIASSIAXKSDLGQGIWIFLFHKIYCVPHKNGSRPPYFFKSSVAVSRNILHEFHNMVIIVFYPKGVKLIT

SEQ ID NO: 148944 - protein, 90 aa, Triticum aestivum
  Clone ID: PAT_TA_43362.pep
NYGEVVNLGLWMDKAGNLSLGFGYVEFKMRADADNALFYMDGAQIDGNVVKVKFVPAPVQTAAAAFLSKAFSNPSKRNLYETDTLVSFLC

SEQ ID NO: 148945 - protein, 139 aa, Triticum aestivum
  Clone ID: PAT_TA_43363.pep
CVSLYSRCTQFRIAEAAHAYADAWGVGPADHLRSFNMALVLNQSAVGQGMADNPMNAIFVPSPSPVEVSLIQVVGITQFGSYIEGASGSNWANPRHQGSGGNRRPPRNFGMFSPQTEQLATVPPKQRTAEAIARAADAM

SEQ ID NO: 148946 - protein, 89 aa, Triticum aestivum
  Clone ID: PAT_TA_43364.pep
RPEKRKSPLSEESSSCAAVKDRASDKPTLSVKCTEKNMNEKDDFHTSLDKFDIPNIGAHLDERSEFRDEEEYHKRAIDRKNLEADYWPD

SEQ ID NO: 148947 - protein, 90 aa, Triticum aestivum
  Clone ID: PAT_TA_43365.pep
FADSWEHAYLQVDALGRVSFCAMRKPRALLEFDNPLSGEGPHDQNSSVRSLEKEPMLAARVTVEDAIGLLLEVDDIDRLLQSNQAQENSF

SEQ ID NO: 148948 - protein, 93 aa, Triticum aestivum
  unsure (1)..(93): unsure at all Xaa locations
  Clone ID: PAT_TA_43366.pep
MMAGMNACYRKKAVTRSVKAGLQFPVGRIGRYLKKGRYAQRVCSGAPVYLAGVLXYLAVEVLELAGNAANDNKKTRIIPRXHLLLGVRNDHDL

SEQ ID NO: 148949 - protein, 140 aa, Triticum aestivum
  unsure (1)..(140): unsure at all Xaa locations
  Clone ID: PAT_TA_43367.pep
VRPRVRLSAQRKKRQVPPSLAXIDELERYTQISSHPLHKTNKPGILSMDIHPSKDIVATGGIDTNAVLFDRTSGQILCTLAGHSKKITTLKFVPRDELVVTGSADKTVRIWQGGEEGNYSCIHTLKDHTAEVEAVTVHAT

SEQ ID NO: 148950 - protein, 68 aa, Triticum aestivum
  Clone ID: PAT_TA_43368.pep
QLNTSVFSDLYCLPSAILKRYPQLLQHEASSNLRKRKCQPNPRISPTHPLNQPPMQNEDCPCQRTGRV

SEQ ID NO: 148951 - protein, 58 aa, Triticum aestivum
  unsure (1)..(58): unsure at all Xaa locations
  Clone ID: PAT_TA_43369.pep
MGLDMDYYMDPYEEAEAEASSEAVCVTGPFSLSADEESDGDDDSEAXSNYQEDAYGLF

SEQ ID NO: 148952 - protein, 66 aa, Triticum aestivum
  Clone ID: PAT_TA_43370.pep
RPRTLGFCWCNCESAVSCIGGGYLFIGVFLLTKSFLCIKYIPTAFYFILDCARGNYKFCYCVSIYL

SEQ ID NO: 148953 - protein, 132 aa, Triticum aestivum
  unsure (1)..(132): unsure at all Xaa locations
  Clone ID: PAT_TA_43371.pep
DATRPLSFPSQISATSFSYWLVDRXSASSSTLEFGDSEQPAVTAPLLRSPRTNTFYYVGLSGISVGGEALSIPSSAFAMDDAGSGGVIVDSGTAVTRLQSGAYAALREAFVQGTQSLARAGGILLFDTCYDL

SEQ ID NO: 148954 - protein, 77 aa, Triticum aestivum
  Clone ID: PAT_TA_43372.pep
RRGAKGGAAEISDNNRAPGPRKDEVVTREYTVNLHNRLHGCTFKKNAPNAIKDIRKFSQKAMGTNDVRICVKLNKHI

SEQ ID NO: 148955 - protein, 63 aa, Triticum aestivum
  Clone ID: PAT_TA_43373.pep
LPCPNRALSTLSSSPTALLGSGTPCAGALHIYSSSHISPPITSLYYLSLKYHIFLLQQYVSSF

SEQ ID NO: 148956 - protein, 135 aa, Triticum aestivum
  Clone ID: PAT_TA_43374.pep
RPPKTRVRVREAAAALFPMPIGMDTGGAPEPEPEEETVVLPHWVMLDRKGNTLCHNSLEAARVAVDKDKTAAPVDMDGGPSCYVAFTLAAPQKGISCLNLHLPEGPPIALDTPPAYAFLRATDNNLVLFDISNPQ

SEQ ID NO: 148957 - protein, 108 aa, Triticum aestivum
  Clone ID: PAT_TA_43375.pep
MAPSKGGINGGGRIGRLVARVALQSPDVELVAVNDPFITTDYMTYMFKYDTVHGQWKHHEVKGKDSKTLLFSEKDVAWVGCRNPEEIPWAGAGAEYGVEFTGVFTDKD

SEQ ID NO: 148958 - protein, 88 aa, Triticum aestivum
  Clone ID: PAT_TA_43376.pep
MAPTKGEGPAIGIDLGTTYSCVGVWQHDRVEIIANDQGNRTTPSYVAFTDSERLIGDAGKNQVAMNPINTVFDAKRFIGRRFADAPGQ

SEQ ID NO: 148959 - protein, 89 aa, Triticum aestivum
  Clone ID: PAT_TA_43377.pep
QCWYVPVLIEFRCLILVDPASWQLHLRPAGGAAGHVVVCPSFFSLTMMAPRLLSSRLTMPRASHPAPGKVAPRRSRCKTGRRRHPGASP

SEQ ID NO: 148960 - protein, 64 aa, Triticum aestivum
  Clone ID: PAT_TA_43378.pep
HVVLQLCPFHLLFNDAIMIPPFLRLVYVYSMVQLVFQKYAQLLYVSNTVSPVVDINVSPYLDPA

SEQ ID NO: 148961 - protein, 105 aa, Triticum aestivum
  Clone ID: PAT_TA_43379.pep
RSGMAGGSHSSVHIHLQFLQSACLPTNLGGRGSRGRRRHTIRPPCRCPCWERPSLCSAPRSFFAGVLLTGRMTGLSPSGLGSHGGSKIALLFDDDCQHRRKLEEE

SEQ ID NO: 148962 - protein, 118 aa, Triticum aestivum
  unsure (1)..(118): unsure at all Xaa locations
  Clone ID: PAT_TA_43380.pep
RPPTRPQGFTRSSPPPSPVRPRRELGRRGPPPPSAPFPLPLPGGHIGSAXPPPPPRDGLLPLPTGPVLPDAGLNLRPLPVGSVRFIERYDISLPPFLPAGSLLPLGSKGQEMVFQEEV

SEQ ID NO: 148963 - protein, 136 aa, Triticum aestivum
  Clone ID: PAT_TA_43381.pep
GSHSSGILEMFSGVQPWRGKSPGEGDQWVGLKKEKPIFPYNLPAEGENVLSSCFEYDFRDRPLMSDILQAFESAKDGDYDNNGWDRSENPMAVVPSHTNWSHFKDKLQVGDKVRSRKVKNSCTPETMEIPDGTIVG

SEQ ID NO: 148964 - protein, 131 aa, Triticum aestivum
  Clone ID: PAT_TA_43382.pep
RPHAYVLKTSLGSLDVSVGDSVVHLYSRFARMDDAWAVATTMACARDNLTYTSLAKGLNQIGLPSKALEMVVHMFREEVRIDGFSLACLLSAAATLPSIEPGKHLHWWSLKLGLSSHVPVFNSLINMYSKH

SEQ ID NO: 148965 - protein, 64 aa, Triticum aestivum
  unsure (1)..(64): unsure at all Xaa locations
  Clone ID: PAT_TA_43383.pep
RPRTRGSAFTLYLIIPFHTGWSVVWSRFXLEVFWKGVRPGRLCGVLNLISRRASTEVKKGMTLK

SEQ ID NO: 148966 - protein, 134 aa, Triticum aestivum
  unsure (1)..(134): unsure at all Xaa locations
  Clone ID: PAT_TA_43384.pep
VREALDGLMRCHELKLETDXRSWRRCVSTAVTVLQSKLGRGTIAEKESEGTEGLPFPRNRHFIGREKELAEIEGMFFGCAGEVEDVECPGGSTMPNCVSSGVSDGGFADEDRDRVRTSSGRFGRLELHKCNRAM

SEQ ID NO: 148967 - protein, 59 aa, Triticum aestivum
  Clone ID: PAT_TA_43385.pep
KKKSRFEVIECYGIAHGSKGTGSEPSHQLLIDNQISAFFILFSYKLRRHNLIIEQNSSI

SEQ ID NO: 148968 - protein, 76 aa, Triticum aestivum
  Clone ID: PAT_TA_43386.pep
MDASATVATGKGKKGAAGRKAGGPRKKSVSRSVKAGLQFPVGRIGRVLKKGRYAQRVGFGAPVYLAGGLEYLARRA

SEQ ID NO: 148969 - protein, 56 aa, Triticum aestivum
  Clone ID: PAT_TA_43387.pep
IWRLIINLYHFVRLLPSPAPPLIGPAERTTNEHLADGGIGGDHGEGGLDAPTSPRT

SEQ ID NO: 148970 - protein, 85 aa, Triticum aestivum
  Clone ID: PAT_TA_43388.pep
FHNRVVYNIYVYLFIYLFILVISLNCLNYLHIFQILQHVFFPQPQAYENSLEERRMLILPRGEDLHKYSMKIHCDVVPWRRGLHI

SEQ ID NO: 148971 - protein, 69 aa, Triticum aestivum
  Clone ID: PAT_TA_43389.pep
PPSRSTQRKIKCSKPASRSSARRESTERKTGNDPARGARGHHHLVPAHLHGSPTAARFLCFTFSSRLSD

SEQ ID NO: 148972 - protein, 42 aa, Triticum aestivum
  Clone ID: PAT_TA_43390.pep
YIHLIRHNLYNPHSKRGSLTKPRVTRTQRRSGLAFKIRLKDP

SEQ ID NO: 148973 - protein, 100 aa, Triticum aestivum
  Clone ID: PAT_TA_43391.pep
MDTGSSLMGGPSSADAPTDGEHRMGTTIVGGCYAGGVVLAGDSRTSTGMDGANRASDKIRQLTDNVYGWRSGSGGDTQGMSDYGRYFLHQHTIQVGQPAT

SEQ ID NO: 148974 - protein, 97 aa, Triticum aestivum
  Clone ID: PAT_TA_43392.pep
MSKVTGGNLSSGKSGAGRRCIAQALDTVRYMPMETLFRVLEVWSIHLEGMNEINAKVKELQSTTTSEDCVTITKDKWPRRSSNSMVALSFNGTVRKP

SEQ ID NO: 148975 - protein, 83 aa, Triticum aestivum
  Clone ID: PAT_TA_43393.pep
VRVSSRRRRSRRLPLAGLGVGRIPGRCYLHIKNKPYPKARCWRGGPDPKIRIYDGGMKKKGGGEVSHWGYLGVWEKGERVQGG

SEQ ID NO: 148976 - protein, 82 aa, Triticum aestivum
  unsure (1)..(82): unsure at all Xaa locations
  Clone ID: PAT_TA_43394.pep
GARTKETAMNSTGGKAPRKQLATKGGRKSGPXTCCVKNPHRFRPGIVSLREILKFHNSTDLVIRKVPFQRLVREICQDFKTD

SEQ ID NO: 148977 - protein, 56 aa, Triticum aestivum
  Clone ID: PAT_TA_43395.pep
MAGAVAEKGYIGPEDGLASGEPAQDIHDDHGHAAEGFGRTGGMGNGVGSSPRVRGR

SEQ ID NO: 148978 - protein, 81 aa, Triticum aestivum
  Clone ID: PAT_TA_43396.pep
MGRGKIEIKRIENATNRQVTYSKRRSGIMKKARELTVLCDAQVAIIMFSSTGKYHEFLSTGTDIKGIFDRYQQAIGTSLGI

SEQ ID NO: 148979 - protein, 87 aa, Triticum aestivum
  Clone ID: PAT_TA_43397.pep
VRGRVGGRVGVVRVETGVIKPGMVVTFGATGLTTEVKNVSIHNDCHLKAIPRHNAKFRLNTLADMDMNLDSHYSNTIMTLPNYHSFL

SEQ ID NO: 148980 - protein, 70 aa, Triticum aestivum
  Clone ID: PAT_TA_43398.pep
SAHASAHSSAHASGFRSHSLSGRTAPEDPSSFRRNQKRDPLTWLASVAASAASALRLGWIRGWRWRFLPN

SEQ ID NO: 148981 - protein, 145 aa, Triticum aestivum
  Clone ID: PAT_TA_43399.pep
SGCSLNGFVESCSRSQSPHSHWSLLPTIPDHNPRSPSSTPAAMDPPPPPPASIPVPDDLLEEIFVRLPTPDGVARASAACTSFRSVIKGRSFRRRFRAMHGPPLLGFMDAAGFHPAQAPHPFAPLAGALAPCAADFSFGPAVVSS

SEQ ID NO: 148982 - protein, 72 aa, Triticum aestivum
  Clone ID: PAT_TA_43400.pep
ARVRSRRAWLGEEADPQYSDRLLMGCTRPVEVTTAADQQESRWFISKDAVVSGLGLLGIKQGGPEAQFVKPR

SEQ ID NO: 148983 - protein, 102 aa, Triticum aestivum
  Clone ID: PAT_TA_43401.pep
CLQSLLLYYSSNCHWGVLPTIVDHYSLTTFLHSSDHRPADVINGLHPRSRRPTGGDLVYDSPPRTVSPAPPTAELTSAKLLKAVFYDDSLRRCTGLPFFGSW

SEQ ID NO: 148984 - protein, 69 aa, Triticum aestivum
  unsure (1)..(69): unsure at all Xaa locations
  Clone ID: PAT_TA_43402.pep
FFXPSLXIDAWGAPAPCMXGCKXVGPPPNXLLPGLLPLLLLWLPLLSFAVAVVRFRPRRRRMMVTRGGC

SEQ ID NO: 148985 - protein, 93 aa, Triticum aestivum
  unsure (1)..(93): unsure at all Xaa locations
  Clone ID: PAT_TA_43403.pep
IRSFAPRGHLCIMPAAKHGLLEXRIQXGGPPPLTTXWPDKKLLRPLGQLQIKKAFALLAGILHGPRAHRLPKLGSSPKHAQGRQIREVSRVAD

SEQ ID NO: 148986 - protein, 87 aa, Triticum aestivum
  Clone ID: PAT_TA_43404.pep
HYDFPDRQLDSRLQLIDQTSNIKTWASSSGPRTGRGGRTRPPAHRPRSRRPPFGPATAARWYSYPTGEVERSKWPRPAKSSGRVGGR

SEQ ID NO: 148987 - protein, 113 aa, Triticum aestivum
  Clone ID: PAT_TA_43405.pep
MAASASAAGGEPQKQFLSIIRDFAAEKSHGERTVSGLKRRLDDVVSASDAATAELEAAKRAREAAETELRGSEVHAFIADASIQALEATISRLQEEIAKLGSELEALKITVDI

SEQ ID NO: 148988 - protein, 50 aa, Triticum aestivum
  Clone ID: PAT_TA_43406.pep
WHSRAHRPGVLLGPAIATPLHRQHNCRTRFRLAQYPLCAYCHTSHPYSLL

SEQ ID NO: 148989 - protein, 66 aa, Triticum aestivum
  Clone ID: PAT_TA_43407.pep
MATAGKVIKCKAAVAWEAGKPLSMEEVEVAPPHAMEVRFKILFTFVWRTDVFFWNAKDLDPVVAWD

SEQ ID NO: 148990 - protein, 46 aa, Triticum aestivum
  Clone ID: PAT_TA_43408.pep
LVTSFSVVNIIMYSNCEIWCAAILCKIYLYYLFKHHVPYYANWCST

SEQ ID NO: 148991 - protein, 128 aa, Triticum aestivum
  Clone ID: PAT_TA_43409.pep
MAAVAARSGLRRMFSIADFATPNTRMFSISAFAPPSPPTPPPKADPSPNLFVSGLSKRRTTDGLREAFAKFGEVEHARVVTDRVTGFSKGFGFVRYVSVEDATKGIEGMDGKFLDGWGIFAEYARPKP

SEQ ID NO: 148992 - protein, 57 aa, Triticum aestivum
  Clone ID: PAT_TA_43410.pep
PRVFSCASLRCFLVSTRGVIAAYVVAYLGGNSSSSAADVKNILDSRGAVGDEEKLEF

SEQ ID NO: 148993 - protein, 119 aa, Triticum aestivum
  Clone ID: PAT_TA_43411.pep
SGAEYFTFSSPGCSAPPVDPHGIPGLPPSVAKRRGGRLGRGAILASAMAPETRSGRAREPRASETASPPAQRPRLTRAGSRGDALTRRRSGQVNEDVESRFQHLASSAQNDVMQLKAAT

SEQ ID NO: 148994 - protein, 71 aa, Triticum aestivum
  Clone ID: PAT_TA_43412.pep
GRSVSPSRGAVHGHAMISPCLHTAQSTSSSDAEAAHRPPPYPPETALCFSSERKTTRVAKRAEGNRRTAGK

SEQ ID NO: 148995 - protein, 129 aa, Triticum aestivum
  Clone ID: PAT_TA_43413.pep
VREKWRFQAEILRAECNFLRMEREVALRKLDCHRGQMEAALKTAVETLASGRKKIDGSGEVGVAAALEEGIEDLEEMMQELRVENESGRRAMSGMRELLRSHGRNFDRQASSLRRRLEKMPPADAEPII

SEQ ID NO: 148996 - protein, 93 aa, Triticum aestivum
  Clone ID: PAT_TA_43414.pep
RGLKEEEAAATPSTGGEMVFFALLVGAELDGLTNLQPRGGCDDPSYPYYFKLRCESCGETSAKTTCVSLDEVGQLPTGKSTGNLLQKCKLCSR

SEQ ID NO: 148997 - protein, 82 aa, Triticum aestivum
  Clone ID: PAT_TA_43415.pep
NQLNVSRQLLVKLHDHLVHALTPNVKLVGGVLDGGRWVPPLLGANHLINLTDQKGGRRRRRLIAQASENARGRQGNTRKVQQ

SEQ ID NO: 148998 - protein, 67 aa, Triticum aestivum
  Clone ID: PAT_TA_43416.pep
SAGIEADGVTVVKVLSACIQYRAFDVAERLHHRVMHNELISTDARLATALVDMYAKHGFIQTAMDVF

SEQ ID NO: 148999 - protein, 95 aa, Triticum aestivum
  Clone ID: PAT_TA_43417.pep
GWGAHAHLGSHRGDHCRLQAERGGGEPPGTAYQRGGDVRRRRQGAGGAPAAGGAHRGLVPEGANRQWLVIILSSFRCRKSIRVNLKVEFLILILR

SEQ ID NO: 149000 - protein, 61 aa, Triticum aestivum
  Clone ID: PAT_TA_43418.pep
LHSYLADTDTRFRPWLCRTMASGCHCNSPTTNTSEWHYLMVVWIHIWRNSLKRRHRRSLGS

SEQ ID NO: 149001 - protein, 142 aa, Triticum aestivum
  Clone ID: PAT_TA_43419.pep
RPRTRGVEIKGELHIRNESSDVPETKIELPIGTPVTDIAGAELEVDDVGSALQFHEFCRTFAEVLKIRKGQPEKILQVITGGGRIGREVPSVVADLHISLLSVIQEDREENPSDYSRNGDAWIIDTGKYISESTVISKELPL

SEQ ID NO: 149002 - protein, 111 aa, Triticum aestivum
  Clone ID: PAT_TA_43420.pep
VRFISWNEIQTCSLLSTAVLPGGLFAKHRLMSYRAPIFHLQRALCLYQMNQQSPNTTKDFSCLILKIPGQTRSPIGTRCHPSSSDAIRTGLQWSKLVSVSEGHSFEPNELS

SEQ ID NO: 149003 - protein, 97 aa, Triticum aestivum
  Clone ID: PAT_TA_43421.pep
QESSFAAASSPCPWCPVDAGASQGSAARACPPRGSSTAASIPLSPATSAAVSRSSRRRHRTEQPGPRPPRARQKPLDRRVNRGLEGGDWWSRIPAGR

SEQ ID NO: 149004 - protein, 80 aa, Triticum aestivum
  Clone ID: PAT_TA_43422.pep
NEDVDKSVKQAHYTLRNIHKAIYEEQVLDMMIRETFVQTEGGNVTGMLEDFLQIFIGHEILLCLPLANSGQDSHSEMAGS

SEQ ID NO: 149005 - protein, 33 aa, Triticum aestivum
  Clone ID: PAT_TA_43423.pep
LLFKHKYRTALRRLEMGFTWTGDLRRNLLAWLQ

SEQ ID NO: 149006 - protein, 92 aa, Triticum aestivum
  unsure (1)..(92): unsure at all Xaa locations
  Clone ID: PAT_TA_43424.pep
RPRTRGFGGADQPHAQFEQLAADHQAMTVLRDYYGQYPTTTDAYLPGPQRTGSSSLVFGVAEEESAYMVGGFQCSPKPRAXGGRKRGRGAGI

SEQ ID NO: 149007 - protein, 100 aa, Triticum aestivum
  Clone ID: PAT_TA_43425.pep
CCTGPGCGGGGTRPRTRGPRVAAAACAPVTMANRGGGKMLQVVNYRMRVTIHDGRQLVGKFMAFDRHMNLVLGDCEEVRKLPPSKSFKTTCEREERRTLG

SEQ ID NO: 149008 - protein, 76 aa, Triticum aestivum
  Clone ID: PAT_TA_43426.pep
HLYDNHIEICTIKMNDKGIYMKQYNGVGSWRKEKYLGTSILQAHIALALFPADRRSVRNTWLQAFGSSPQTILLSK

SEQ ID NO: 149009 - protein, 123 aa, Triticum aestivum
  Clone ID: PAT_TA_43427.pep
VGDAGEHVAESPEQHVDGRFKAKVAEPGEELARTAALAVVGHARARSISKRATSGLAPAPDARAPASSGQNDGEERRGCQRARALVQRGKGTPARRCGGAGRSPKGDEIERSGDRSEGVRAGR

SEQ ID NO: 149010 - protein, 102 aa, Triticum aestivum
  Clone ID: PAT_TA_43428.pep
CDSWNNRTQKKHKGVDTTIQTKKADQTIQYSILIYIGQKATSNILAKRQLQIIYTTSAPHVDCECIPNSTNSTIICIEQERNPQPCTTAHNYLLYLKHFFGR

SEQ ID NO: 149011 - protein, 57 aa, Triticum aestivum
  Clone ID: PAT_TA_43429.pep
DPPGVSLGRPDLSAEKRFRPEMGAAGPDGGTRGPGDLQEKTRERGKMRASSVRRTRA

SEQ ID NO: 149012 - protein, 129 aa, Triticum aestivum
  Clone ID: PAT_TA_43430.pep
RRDEQHQRSHPVVGPPGKLWRGGGFHDDLELLVPPVVVYDDLDAAQERLEHRMPWPVPHDPVRALLESVEHHIAHLLVAHLELVEQDCRVLRVQGQHHLIKRPRGPDATPIGCAPASSLGESVVAAAGR

SEQ ID NO: 149013 - protein, 84 aa, Triticum aestivum
  Clone ID: PAT_TA_43431.pep
TLIFDCLKTVQSIARKCWRPEYWDTMDAIKHAFGGLPQIICKKGSVQELIKGKLQQWNWRGGIFCSWTGLLGFHCYLHEHNITG

SEQ ID NO: 149014 - protein, 75 aa, Triticum aestivum
  Clone ID: PAT_TA_43432.pep
PQNNTIPKAVVHCQVKEAKRNLLNRFYAHVGSKENKQLNAMLDEDPALMEKRDSLVKKLELYKFARNEIYLVAWK

SEQ ID NO: 149015 - protein, 53 aa, Triticum aestivum
  Clone ID: PAT_TA_43433.pep
TNKHTITQHNQTPRSVKSKKTPRLSHHPNRQYLTDDNFIDVRFIFMENTRSLK

SEQ ID NO: 149016 - protein, 122 aa, Triticum aestivum
  Clone ID: PAT_TA_43434.pep
MGDIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAATYCTGLLLARRVLKNRDLDEEYEGN

SEQ ID NO: 149017 - protein, 110 aa, Triticum aestivum
  Clone ID: PAT_TA_43435.pep
VRSLLADKTWKVPAKWLAFASQKENAAHLVCMASSVPRSGNPTLLGSLEKGKRRENVKNLIREEREVGNITYKSNSPSTYTLHKWAEMCEMRRAVDPSLNQNPCGSMLWW

SEQ ID NO: 149018 - protein, 108 aa, Triticum aestivum
  Clone ID: PAT_TA_43436.pep
RPRTRGTQSSPRSQLVAALTESGPFTTGQLPPTPLSHPSPPSPSPAAAASPSSPRRRFAPRPSPPRPRSQADWRYARRFSHRPARRRDAGSAGLLSLDGFLDSAGLST

SEQ ID NO: 149019 - protein, 117 aa, Triticum aestivum
  Clone ID: PAT_TA_43437.pep
ACTCLLCPGRPTRPLIVSVLLRLKVITFREYGARQDELAFLQYILQHAMVLKYALVQMVNPKFTSLSVDEMAYTIDNLQIKKKMGNLVHVAPACARVQGWVRPLWGYSTQPLPTFLL

SEQ ID NO: 149020 - protein, 61 aa, Triticum aestivum
  unsure (1)..(61): unsure at all Xaa locations
  Clone ID: PAT_TA_43438.pep
NGKLIGMSFQVHTVNVQVDDLTVRPXKGESYDEITKAIKPASQGKLKGIMGYVEETKSSRT

SEQ ID NO: 149021 - protein, 88 aa, Triticum aestivum
  Clone ID: PAT_TA_43439.pep
RAPTRPQQQGGEEMMVEPKADRTACDMGVTSHSHSQSQSHSHSWGEARTPESDIVNIDPSLFQQAAAFHAQSPSAGVALQEIMVTLMV

SEQ ID NO: 149022 - protein, 110 aa, Triticum aestivum
  unsure (1)..(110): unsure at all Xaa locations
  Clone ID: PAT_TA_43440.pep
VRSGDLPGFNYVYDLEVLRLAGNGFTGFVPSGLLKGDSLVLNQLDLSANNLTGHINMITSTTLQILNLSSNALFGDLPLLAGSCTVLDLSNNHVXGNLAFFTNWSKCLLN

SEQ ID NO: 149023 - protein, 139 aa, Triticum aestivum
  unsure (1)..(139): unsure at all Xaa locations
  Clone ID: PAT_TA_43441.pep
ARHASERRSRQRETGPVEIDGSYLRGRLXRREINGSPGISPERXGESRRRDDRYRERAYDGHRTHRDRHQGPRGSTLSSRLQGRIKLPGRSPDRVDARSERERDRRQLRDRLSPGVPMDIQGGRHREAGHHQERIRQRS

SEQ ID NO: 149024 - protein, 68 aa, Triticum aestivum
  Clone ID: PAT_TA_43442.pep
MLLRTPPQRKRRADPDPNLDLDLAGAGGVATGRTPGYDRRLGPYDRPTGLVCGSGTEEPSDDMVWTYH

SEQ ID NO: 149025 - protein, 31 aa, Triticum aestivum
  Clone ID: PAT_TA_43443.pep
LKTNAHPKLPRAPVLIDHRQYRMTRTDAWED

SEQ ID NO: 149026 - protein, 122 aa, Triticum aestivum
  Clone ID: PAT_TA_43444.pep
EARVRPLVRPRVRGRVGSQERHLSGHAARDAGAGYDSDDANANARVPWGSRSSDEGSDSDGAAAKDRPQAEAPKKPKKPKVKKPKVTVADAAGLIDAESLAAHLGNISGSYENQEGIHVMRF

SEQ ID NO: 149027 - protein, 59 aa, Triticum aestivum
  Clone ID: PAT_TA_43445.pep
AGRCGSRERRARPPGKIILAGEPAGVHGSAGVAAAIDLYTQSSLHLPPSSEGRSGESGG

SEQ ID NO: 149028 - protein, 58 aa, Triticum aestivum
  Clone ID: PAT_TA_43446.pep
PPTADGTVPEVRKGSVHGHDKRVVEEDVGRYRRPLCHFRATSRSGVRPDLGESQVGAR

SEQ ID NO: 149029 - protein, 90 aa, Triticum aestivum
  Clone ID: PAT_TA_43447.pep
HAPHRSPPPRRLGLLGGPRGRGAEADESESRGGRGGEEGRAGWPGAAAGRRGAGRSVGAEGAGYGETLGHAGGLVRVDRSPRVRGRVGGR

SEQ ID NO: 149030 - protein, 68 aa, Triticum aestivum
  Clone ID: PAT_TA_43448.pep
FAHAFTHPSFFIFVKNTLSPRAALMCGMGEENTDKDGLLYMTYSGENTFGLLYMALAATAIALNACCK

SEQ ID NO: 149031 - protein, 130 aa, Triticum aestivum
  unsure (1)..(130): unsure at all Xaa locations
  Clone ID: PAT_TA_43449.pep
SAQPHHHHTSMAGAGGEQGRPHGVEQGCSAGGEQEAARAASMAYSRAVSREVTRTASMADARGGEHGGRAGGEYGARRRLTPTLTTQRKGAGGXSFRHGAGGPLQRSFFLRGWAAHATMVAGGGPLFFFS

SEQ ID NO: 149032 - protein, 145 aa, Triticum aestivum
  unsure (1)..(145): unsure at all Xaa locations
  Clone ID: PAT_TA_43450.pep
RPPTRPPTRPPTRSTTRPSTRARTQRCTIYQQVLSISEDWHIFVLSHARSLNVFGKTAEIPSIKEFKHLRVVDFRECSQLENHHLVNVGRLSHLRYLTLXSMKVSKLPEQHWTPTLIXMLDITNTAVYELPASFCNFIRLAHFCV

SEQ ID NO: 149033 - protein, 68 aa, Triticum aestivum
  Clone ID: PAT_TA_43451.pep
RHVDFLAYAKCAIYGHEEQSRLGSAPAAGEVWQMGLQEGGHARLKGTCSWIQQIVQLDGWTLVLLSLC

SEQ ID NO: 149034 - protein, 94 aa, Triticum aestivum
  Clone ID: PAT_TA_43452.pep
APALSSQRWSEKAPRAILAARASAMLAAPRVCHARCQRDLPAPRPRERNARRPCCILLTARAASLLHTIRPALLTVRTGHGCVVVVWLCVRVPP

SEQ ID NO: 149035 - protein, 44 aa, Triticum aestivum
  Clone ID: PAT_TA_43453.pep
LEIPILINLGVMSQGLLSFLSNRMLAVIIWNLRLYKRLLTCCTS

SEQ ID NO: 149036 - protein, 82 aa, Triticum aestivum
  Clone ID: PAT_TA_43454.pep
AALQLSPRMDKALMPIVGAASRSSAACSSTLVLPLTAPSLFLWLFLYIFFSRSHVLTYGTVDTHAPKENTTWCFAKRLSSSV

SEQ ID NO: 149037 - protein, 58 aa, Triticum aestivum
  Clone ID: PAT_TA_43455.pep
PSHLSCSNIISTNGELVAITTGLAMQQLHHRLPAGSRGECDSSGQKHTYTLYLERYKD

SEQ ID NO: 149038 - protein, 84 aa, Triticum aestivum
  unsure (1)..(84): unsure at all Xaa locations
  Clone ID: PAT_TA_43456.pep
RPRTRGSCSAEWSTKDAAIRMPLGKRGITIYRMKCSVSPLGTGKAILIYTLAXMKRXNWHKPRMTSAEGISIGVWLMVILMLRI

SEQ ID NO: 149039 - protein, 86 aa, Triticum aestivum
  Clone ID: PAT_TA_43457.pep
VRFFFLLCLLLASAATPAMFGHERSPWVPVHSFERIFSFSRSPSNPTMAAPPSITHHHPWLSTKEKLGVAGSEAAASMSLPWPKRP

SEQ ID NO: 149040 - protein, 76 aa, Triticum aestivum
  Clone ID: PAT_TA_43458.pep
MPRRLLEGAMALAVTPDAANSSGSGAAPGSGPLWWVSGCHGAWYSLSVMLPSLAFVGLLAWQARRRFRCLSYRRSH

SEQ ID NO: 149041 - protein, 106 aa, Triticum aestivum
  Clone ID: PAT_TA_43459.pep
MAEPAGAGAAPLLPGLPDDISVWEILVRLPPKCVLRSRAVCPAWRRATSARDFLLDHHARQPGIPSCTGTTTRWTFSPWTTGQGSSPSTSFGPSLDLHNDSYRLDD

SEQ ID NO: 149042 - protein, 105 aa, Triticum aestivum
  Clone ID: PAT_TA_43460.pep
MAVVVCVTGAGGFIGSWIVKLLLARGYAVRGTSRRADDPKNAHLWALDGAAERLTMVQVDLLDRASLRAVFHGCDGVIHTASPMHDTPEEIIEPVITGTLNVVEM

SEQ ID NO: 149043 - protein, 130 aa, Triticum aestivum
  Clone ID: PAT_TA_43461.pep
MQMMGAVLDHFRSSAWYYLTPVLACAPVGVFRTYFNQYLRRPVRRLLPFLDPFVTIDIAAKPEDYSFSYQGKVKSSDVYAEVLAYLSAVCSRDARELRAEGAVEGHTFVLSLREGQVVADDFKGVTMSWS

SEQ ID NO: 149044 - protein, 44 aa, Triticum aestivum
  unsure (1)..(44): unsure at all Xaa locations
  Clone ID: PAT_TA_43462.pep
TYGGWGVRSISLFVNTQKIFMAGLNIMIWMKPPPQSSPLRXRKQ

SEQ ID NO: 149045 - protein, 61 aa, Triticum aestivum
  Clone ID: PAT_TA_43463.pep
HEEHHIYSFAEISGTTKYIFIFRSNITDYILMVSSFTIGPVGKWPVRPSTLLTWCTGPHYR

SEQ ID NO: 149046 - protein, 62 aa, Triticum aestivum
  Clone ID: PAT_TA_43464.pep
PPPPLVLFRRRTCRPDTMFRLHQTDPQGLELGTQCASPCGWLSGWSWVDWGFPYEQSGRVRS

SEQ ID NO: 149047 - protein, 132 aa, Triticum aestivum
  Clone ID: PAT_TA_43465.pep
PTRTGLGVRRKVKVGKGPSRDRPSPRCSARWCGASSARVGAPVASPVGVGLRRHRLQGRGCGCVPVAASPVRVWAAGWVLPRRRRRGSRRSVKGKGGHGGARLAVGSGVPGGGDGDVGCRRRTHGRTRGRTR

SEQ ID NO: 149048 - protein, 110 aa, Triticum aestivum
  unsure (1)..(110): unsure at all Xaa locations
  Clone ID: PAT_TA_43466.pep
LGTWGERATGQLTLRLKYLHARXTPRQRTLMGIMLLDTCKTKLWAAEERDTYYKLTMTKSHMKAYVYNASWESXPQTMMGAALLQSNNLTQAVEDELDYTICSYGSRRSL

SEQ ID NO: 149049 - protein, 117 aa, Triticum aestivum
  Clone ID: PAT_TA_43467.pep
SLSQPHLSLSNSQVSPHLPMMTRSMSLKLDQGIWAWIPLSITSLSFSQTLRSLLSSPQIAARTLLSSPQIASRTLLSSPQIAARTLGRGSPTLNEVIALKLFSSCGSGSPSHNDFFF

SEQ ID NO: 149050 - protein, 97 aa, Triticum aestivum
  unsure (1)..(97): unsure at all Xaa locations
  Clone ID: PAT_TA_43468.pep
RKVRSGKGSSPDRTSSRSLPNGVASNRLGWXMRMCQPVGVGLRRNRMQGRGSECVTVAASPVRVWAAEWVLPRCQRRGGRRSVKGKGGHGGVRLAPR

SEQ ID NO: 149051 - protein, 93 aa, Triticum aestivum
  unsure (1)..(93): unsure at all Xaa locations
  Clone ID: PAT_TA_43469.pep
KDGLPLLGAGLDLTVKHRERPLHLPQCLXVGGGQVEEGDHPEGLHHGLLPQLGVIDVVRRGHLPPAAAGAAAQARRRRREGGSGTWPWQLSTD

SEQ ID NO: 149052 - protein, 70 aa, Triticum aestivum
  Clone ID: PAT_TA_43470.pep
MPRSFYAPRILGRAMAILFLALTPLSKARAARTLLLFKKRRARHLRHYNYSYFGKYQFLALQVPHLVLAP

SEQ ID NO: 149053 - protein, 48 aa, Triticum aestivum
  Clone ID: PAT_TA_43471.pep
KKRDVDKSSPSTILYNNQPSHYNLPPLLKKPTFLTPSSQYKFFFISPL

SEQ ID NO: 149054 - protein, 76 aa, Triticum aestivum
  unsure (1)..(76): unsure at all Xaa locations
  Clone ID: PAT_TA_43472.pep
FPGGATRPRTRGRTRGQTHGLTRSMGSGVSFLAVERCXPXTELLPYGSFPDLSLVLPGVGATSSSIRAKQASLASP

SEQ ID NO: 149055 - protein, 98 aa, Triticum aestivum
  Clone ID: PAT_TA_43473.pep
YVLGFMRRLHHPHVHPRGSEVPSSSSTQVTSACKPLVICNARRSSLPNPTCENLRFFFLLIPVLILCSINLAPYPGARACTERGTRHMRAGPRNVFLT

SEQ ID NO: 149056 - protein, 35 aa, Triticum aestivum
  Clone ID: PAT_TA_43474.pep
SAHPLNDSLAMSYQLVNKTARGPGVGGVSTFICNI

SEQ ID NO: 149057 - protein, 150 aa, Triticum aestivum
  unsure (1)..(150): unsure at all Xaa locations
  Clone ID: PAT_TA_43475.pep
GSPRVRGRVGGRVGAPHPQASGAAPAPLQEGPAPPQYYQAPPQYYQQGPPPAMWGHPQQHMPPQYAPPPPQYAPQPPQQYAPPPQHYAPPPPQYGAQMAGGPPSGGEDIRSLWIGDLQYWMDETYLYNAFAPVGPQQVTSXKIIRNKHTG

SEQ ID NO: 149058 - protein, 54 aa, Triticum aestivum
  unsure (1)..(54): unsure at all Xaa locations
  Clone ID: PAT_TA_43476.pep
KEVDIIPWLVFTSEKCGEGXDVYADHLVXGAIGVRAVEWGRINDDEKVIEVVGR

SEQ ID NO: 149059 - protein, 134 aa, Triticum aestivum
  unsure (1)..(134): unsure at all Xaa locations
  Clone ID: PAT_TA_43477.pep
ERRVRPRVRSLAGFSSPPPWAPPKGPAPTPGDPTPAPTPAAGRRRLRSRRARAGSSSPLHGPAPPGAPCVGPGPPATGAAAAAGGAGAAAAAVAAXAVGGGVRASPKGRGGGKTTSPARGGGTTWATGAPAPTS

SEQ ID NO: 149060 - protein, 116 aa, Triticum aestivum
  unsure (1)..(116): unsure at all Xaa locations
  Clone ID: PAT_TA_43478.pep
MGDLVXAXKPVVDFLIRRAGLRQDTVDVDGACTGLTFWVRKDKLPKDKATGCEITPEAAGPGSKKKSKTKGKGPRASGGLVHGFPGXGDWTWQFQAGGLGKHYDGYIPDLLYFXGF

SEQ ID NO: 149061 - protein, 88 aa, Triticum aestivum
  Clone ID: PAT_TA_43479.pep
SILFNGANVVLLQICRFIPRKFRSESRRGHPIQAVFISYVESISSQSQSLALAIRYPIGRSPMHESHTRAPQLIIYYWTQIERTRRRT

SEQ ID NO: 149062 - protein, 101 aa, Triticum aestivum
  Clone ID: PAT_TA_43480.pep
LAETKYIYCDIPLEGVGKPKERGGASILTNTNFKHIYCYLTHQLAHNTVNGCNLRPTDMFATGTLSGPKPYSLGSSLEITWNWQKEISVGNSIRMFLQNGD

SEQ ID NO: 149063 - protein, 84 aa, Triticum aestivum
  Clone ID: PAT_TA_43481.pep
MNAGGRRRYTSEQLLFDVPANAATAGGAGRWTQRGGLRRGDGEIFLSVDPATPARVRGGDTAAGESPGQKHQLSPGLLDLHAFD

SEQ ID NO: 149064 - protein, 90 aa, Triticum aestivum
  Clone ID: PAT_TA_43482.pep
RRVRKWPAPFSSSSSSLSKKKKTPASPSTDARATPTPARRRSPEPASPPCQARPQSSAASLNCCGPTGGVNQPLRKLFRASQSSSGPLVD

SEQ ID NO: 149065 - protein, 35 aa, Triticum aestivum
  Clone ID: PAT_TA_43483.pep
RPRTRGAEMKNGVLWVTLLKVKEEERTDGFHFKVQ

SEQ ID NO: 149066 - protein, 68 aa, Triticum aestivum
  Clone ID: PAT_TA_43484.pep
GPRVRSHPATLPHSGSVAFPFPRSCGPSAGACWLAILLYLARHNPNLTLRVSNPFLMEPAINGYNPYD

SEQ ID NO: 149067 - protein, 147 aa, Triticum aestivum
  unsure (1)..(147): unsure at all Xaa locations
  Clone ID: PAT_TA_43485.pep
VRGRVGEEWLEWLLFKICVEEEKFKTGVAALGSTDGGESGNEFSAKHAFLMGTLSKCLTERPEEVSISNSFALHVFNILKHAAETLDFTCRGSSELPIGLPGIDVLGYSLVLLKDICAWEPSSSETEAPVDSPLXGEPSSSGTEAPV

SEQ ID NO: 149068 - protein, 40 aa, Triticum aestivum
  Clone ID: PAT_TA_43486.pep
IEFRLPNARGMAWPERERKHGPCKEAAPPLVRPGAKRWFI

SEQ ID NO: 149069 - protein, 61 aa, Triticum aestivum
  Clone ID: PAT_TA_43487.pep
VRKIQSMTECDIPINHTHHLIAGALLHMWEQLYTKLFHHNSLPNTSPLDNNNLGSVTHLIN

SEQ ID NO: 149070 - protein, 136 aa, Triticum aestivum
  unsure (1)..(136): unsure at all Xaa locations
  Clone ID: PAT_TA_43488.pep
VRKIGKQANQPIVLLIDELDLLLARNQSGLYNILDWPTKPNSNLVIIGIVNTMDLPEKLLPRISSRMGIQRLCFGPYNYRQLPEIITSLLKGNNAFEDQAIEFGFRKVICYSGDARGALEISRXAAEFAHYRVKQF

SEQ ID NO: 149071 - protein, 75 aa, Triticum aestivum
  unsure (1)..(75): unsure at all Xaa locations
  Clone ID: PAT_TA_43489.pep
MFAVGRSGYNLLLCMNLVLTLVNLHIIHFVFSSNKGKEYFFSIRGAGFNDPWLXTRASDKSLSYTGPNSSPLSDV

SEQ ID NO: 149072 - protein, 63 aa, Triticum aestivum
  Clone ID: PAT_TA_43490.pep
SVKLLCTAPTFFVHEHMQSANLHISRARALLKKKKKKIKYKIKIKKLKKYKDDKYKTKIPKGG

SEQ ID NO: 149073 - protein, 126 aa, Triticum aestivum
  Clone ID: PAT_TA_43491.pep
VQMVETVVNDDHGRNGVVSAHELQVCANQEIKEDESTIGDDENSVAAAIASVGEETMKACEADQPELLMDEQKIQDELRYEIDTAPQNGRATTYADGDSEYDETTDDDSILPKTGALVKHGAGGSF

SEQ ID NO: 149074 - protein, 151 aa, Triticum aestivum
  Clone ID: PAT_TA_43492.pep
SGGGARVRSSNRAAAADAPPSVLFAWAPGNSGGGWTINLNIANPTTGWQKKGEIDDYQKLGNLYDKRISQEGVGDLLGEGFKGYIFKIMGGCDKQGFPMKQGGVTSGRVRLLVHRGTPFLRGFGMRNGERRRKSVRGCIGSQDLAGVNFMI

SEQ ID NO: 149075 - protein, 51 aa, Triticum aestivum
  Clone ID: PAT_TA_43493.pep
WCSGGRSRVIAAPSFRASGRSPPTRSRARSPLPWGLTIMRRPSQARMLCRT

SEQ ID NO: 149076 - protein, 141 aa, Triticum aestivum
  unsure (1)..(141): unsure at all Xaa locations
  Clone ID: PAT_TA_43494.pep
VRVRVRKYKGYPTYDSSXPLGDALERGSGXVFFHSEYDDRNAHYYRILQDMGLGRVEIYEFTRLNMGYTGLSKRKLLWIVQNNIVEDWTDARFPTDRPRLQDRPPIPVLHPIYTWARAAQDYLILIDWDKLWTINKKIVDP

SEQ ID NO: 149077 - protein, 150 aa, Triticum aestivum
  unsure (1)..(150): unsure at all Xaa locations
  Clone ID: PAT_TA_43495.pep
RGWSWFRCKILMILWKAWQLKNNVVHGDGKETVSGAVHQLLRLSDDLEMATLATDKMGRKSTLFVHVQNICKPVTPASNRWCAPPEGTAKLNSDAAFLQETGMTXGGAVVRDHSDNPLLSVARPLQQCPPTEEAEASAVLRTRGRTRGRT

SEQ ID NO: 149078 - protein, 50 aa, Triticum aestivum
  Clone ID: PAT_TA_43496.pep
LLCLSLFLLISSLTCKASCFTDVPTISCYLPYLKCPSDNPLIGFNLRDQL

SEQ ID NO: 149079 - protein, 148 aa, Triticum aestivum
  Clone ID: PAT_TA_43497.pep
MSKFPDLPRVATSEKKEYPVDPSLADIKNSIYASDEFRMYSFKIRPCSRAYSHDWTECPFVHPGENARRRDPRKYHYSCVPCPDFRKGVCRRGDMCEYAHGVFECWLHPAQYRTRLCKDGTGCNRRVCFFAHTTDELRPLYVSTGSAV

SEQ ID NO: 149080 - protein, 76 aa, Triticum aestivum
  Clone ID: PAT_TA_43498.pep
LWGCRRDQRRGPRGEPPGLLLLHQPPQRTARSPPNERTLLEPSSTRPLGPLPYTLFFPRLDGFDGARRGLERTRGP

SEQ ID NO: 149081 - protein, 49 aa, Triticum aestivum
  unsure (1)..(49): unsure at all Xaa locations
  Clone ID: PAT_TA_43499.pep
RPPTRPPRPXLHRICPLKSTVPTPPRWGAALPHLLIYKIPNLIHHQTFY

SEQ ID NO: 149082 - protein, 74 aa, Triticum aestivum
  unsure (1)..(74): unsure at all Xaa locations
  Clone ID: PAT_TA_43500.pep
RPKKKKKKKKKKTGVPSKISSLAYSCMRRDNSSIVXPKFTPLTHFIHPSYSLNPGITHLNGLSVHTPFITLLNN

SEQ ID NO: 149083 - protein, 60 aa, Triticum aestivum
  Clone ID: PAT_TA_43501.pep
ALYEIINLNNFPGNSLTRCKHSIKDSPITEGVLERYLLSHTQRPTQLSKLLHDHQNMPSN

SEQ ID NO: 149084 - protein, 96 aa, Triticum aestivum
  unsure (1)..(96): unsure at all Xaa locations
  Clone ID: PAT_TA_43502.pep
RKVGGGRGNFFIINHRIFFATPSXLITIVAALGKKDVYLAYLPVGHILEVAGETIISGGGATIGDGPPFTLAGTLYKIKKATKGDTLPLMPTLMTG

SEQ ID NO: 149085 - protein, 103 aa, Triticum aestivum
  unsure (1)..(103): unsure at all Xaa locations
  Clone ID: PAT_TA_43503.pep
MSGXYKGGEGLGKGGHQXHKKVLLDNIQGITKPAILLLARRGGXKHISGLIYEETRGVLKILLENVIRNAITYTDHARRKTVTAMDGLYALKRQGLTLYGFGG

SEQ ID NO: 149086 - protein, 73 aa, Triticum aestivum
  unsure (1)..(73): unsure at all Xaa locations
  Clone ID: PAT_TA_43504.pep
ALALVEHPRSFMEEAXSSRESPDGVGXAASPVHALXCCPEKLLMAIELADRSLARTALPVILARFFSCASSTA

SEQ ID NO: 149087 - protein, 62 aa, Triticum aestivum
  Clone ID: PAT_TA_43505.pep
RRHASAHASVHPYSFLLKKKIIQGWGAPGVEEPSLSTPACYIIDLLSCYLNSHDYAELYNEG

SEQ ID NO: 149088 - protein, 96 aa, Triticum aestivum
  Clone ID: PAT_TA_43506.pep
VRVPSLLLRRRRRHHPANTSHGCMRASPPALATRLRLLVFSISALDPYPPPFGVPVDGAEEEADRFCRWVERRLERVGHRDGRPQCSSHAENRRGA

SEQ ID NO: 149089 - protein, 120 aa, Triticum aestivum
  Clone ID: PAT_TA_43507.pep
EKSTFHKTPVSKKITVLATKNTYAIDQLVHKSCTPSVLRFSTEGMAGSPCSVSSSFLRSGERPVVSGLGISSSSEASEAQGQRQASSGADLRAVETPWEQPRPSRKELCRRRLRWRRAGR

SEQ ID NO: 149090 - protein, 108 aa, Triticum aestivum
  Clone ID: PAT_TA_43508.pep
MANIDMAAVLADMERDAAADARTPRTKLVCTLGPASRSVPMLEKLLRAGMNVARVNFSHGTHEYHKETLDALRQGMHNTGFLCAGLLGTQGPGDLDLGFSKGWVKPNQ

SEQ ID NO: 149091 - protein, 102 aa, Triticum aestivum
  unsure (1)..(102): unsure at all Xaa locations
  Clone ID: PAT_TA_43509.pep
GTPRVRQVPEDAMDDESIEWVPLQEGPPSPDGEVSXATTDTDSVESDDDEDYVVSANQSMSESDHPDNDEDYWRSGHKVPQEISGESDDPDGTTTSFSSWYV

SEQ ID NO: 149092 - protein, 42 aa, Triticum aestivum
  Clone ID: PAT_TA_43510.pep
SRTRQQQDRGVTSTESRKIAMEPRESGRAVQPVAHRTHSLVG

SEQ ID NO: 149093 - protein, 76 aa, Triticum aestivum
  Clone ID: PAT_TA_43511.pep
RGAPLAPPAQGTAPVWADKGHAETVEAERGGRRRRGEGCCRGRPPIRWTPAPPPWPPIRPRDGMEGGREVGRLRLS

SEQ ID NO: 149094 - protein, 92 aa, Triticum aestivum
  Clone ID: PAT_TA_43512.pep
RPPTRPRGSSSSSIAPPLRQAPPHCCSSGVRPRRPQLPRRPPSSASIESPNSYATPSPSATASSRPRLLAFAPPVLLPAPTSSSAARAPPPA

SEQ ID NO: 149095 - protein, 57 aa, Triticum aestivum
  Clone ID: PAT_TA_43513.pep
TQSKFQCIVVRTRHKMREIVTHNHSSPPVGLVASPFLVHYLVAQIHCSSTPALLQPH

SEQ ID NO: 149096 - protein, 90 aa, Triticum aestivum
  Clone ID: PAT_TA_43514.pep
MASGPNGGGNGGGGGGGLMKNMSLLRLQYYCVLGAVAGAVLFATLRYMPAAGSGAALSTTSALATAAAPAGSGAGAGEHRKIKGTAPAPA

SEQ ID NO: 149097 - protein, 117 aa, Triticum aestivum
  unsure (1)..(117): unsure at all Xaa locations
  Clone ID: PAT_TA_43515.pep
VRLSRLAGLVGWLVRSVVGRRGEATAGRSRRRGPSRRRRRCASRSRRARTPASWRPPRTTSSSSRTPAPTXHWDCIKNRFRAAGDYIFNKTSSVFGRQKVEPEAKEETPGAKPERAP

SEQ ID NO: 149098 - protein, 96 aa, Triticum aestivum
  unsure (1)..(96): unsure at all Xaa locations
  Clone ID: PAT_TA_43516.pep
MANPRVFFDMTVGGAPAGRIVMELYKDAVPRTVENFRALCTGEKGVXKSGKPLHYKGSSSTADPDLCEGGTYQGTDRGSHYGRVAQSRHSTSRSSC

SEQ ID NO: 149099 - protein, 58 aa, Triticum aestivum
  Clone ID: PAT_TA_43517.pep
RPPTRPPTRPAGRNGLIDTAVKTSRSGYLQRCLIKSLESLFVSYDHSVRNVDGSIIQF

SEQ ID NO: 149100 - protein, 128 aa, Triticum aestivum
  Clone ID: PAT_TA_43518.pep
MERRDRLRALMARLEAEGQFDRLLRAQEDERGASGDDDDEGTEQIKYPFFTEGTNQLLQARIDIAMYSLPRAKARVERAKRRLADLDEDPEAEAALVVKQAADFALERSEIGDDRPLTGCSFSRDASM

SEQ ID NO: 149101 - protein, 51 aa, Triticum aestivum
  Clone ID: PAT_TA_43519.pep
SADAWVGDAPSVNVKKNCLWQPFTALLGDAPSVNVKKNVIVAITSDKGLWS

SEQ ID NO: 149102 - protein, 69 aa, Triticum aestivum
  unsure (1)..(69): unsure at all Xaa locations
  Clone ID: PAT_TA_43520.pep
MYVVKRDGRQEAVHFDKITARLKKLAYGLSQDHCDPVLVAQKVCAGVYRGVTTXQLDELAAETXXGMNR

SEQ ID NO: 149103 - protein, 68 aa, Triticum aestivum
  Clone ID: PAT_TA_43521.pep
VPFYKTYIIATLCEVTLDFLKGTIRVLKLLLYSFFSPFFFFPPPYYFIFFLFLILFFFSHASAYAWRP

SEQ ID NO: 149104 - protein, 125 aa, Triticum aestivum
  unsure (1)..(125): unsure at all Xaa locations
  Clone ID: PAT_TA_43522.pep
VRSPPSESPPLSPDGAASFRRGSCGSWPGVGSPVNDVLASLRQLRLAKAQASPSGGWSGYPTSPAAYGSPKAAGLYSLPTTPMGAQTGAXSFMPNLEPLNLRFLDDEEPVQRVESGRALREKVFE

SEQ ID NO: 149105 - protein, 48 aa, Triticum aestivum
  Clone ID: PAT_TA_43523.pep
LVRHNLRNEGRTLLTGYVYPCRHPQEPPRKEEAPSGDNDVYSERDHRT

SEQ ID NO: 149106 - protein, 72 aa, Triticum aestivum
  Clone ID: PAT_TA_43524.pep
RPRTRGRTRGQSLCNLRHFRGGLLMEALVWIPLGDNPCIGQQFYEIFSSWEINDHHLTDVVLTGMKAMLLTL

SEQ ID NO: 149107 - protein, 96 aa, Triticum aestivum
  Clone ID: PAT_TA_43525.pep
VREEVKIVMQMAEEAIYAQERDPYTAFANRSREINYGNSYFFKPIRISDLKKVNPIRACEYFNSCFKDPSAFTGVVVGNIDPAISIPLILEYLGGI

SEQ ID NO: 149108 - protein, 75 aa, Triticum aestivum
  Clone ID: PAT_TA_43526.pep
TRPPRCFGKWRENSSAPIKNGDGGGKILTDGSMDLNYKTLSYQEFLTQGTWIGDLVKPNMILISGRHSPRCHYAR

SEQ ID NO: 149109 - protein, 121 aa, Triticum aestivum
  unsure (1)..(121): unsure at all Xaa locations
  Clone ID: PAT_TA_43527.pep
SKEKPPWGGCRSDGTGSTCVCSPLAPPADPHESLLPGRLXRYRLSARGGLSAWMSLNSGSSSSSSIGSRWCCCCSPLPLPCSTPRLTMLLLLLLLLPLTAVCPLNMWPTRPPTRPPTRPRT

SEQ ID NO: 149110 - protein, 89 aa, Triticum aestivum
  Clone ID: PAT_TA_43528.pep
RHPAQDIGERGHSIGEHGGRGSSPPALDARVAGVPRPMEDEGDVGGENRGHRWRAQRGLAYCKPPSVQPHAVLGRAGGTRGSQIGGTGR

SEQ ID NO: 149111 - protein, 73 aa, Triticum aestivum
  unsure (1)..(73): unsure at all Xaa locations
  Clone ID: PAT_TA_43529.pep
VRLAVHRHLLRLLGFCAAASGERXLLVYPFMPNGSVAARLRGKPALGWQTPKRIAVGAAPGLLYLHEQCDPKI

SEQ ID NO: 149112 - protein, 81 aa, Triticum aestivum
  Clone ID: PAT_TA_43530.pep
SASARSHEKGSMDDAAGAEGVAVTWEAGEEDLVVAVITLYRPHLQFRTRTSFQPSLGKEIAAPSQVPPLPISSTLVNLDFP

SEQ ID NO: 149113 - protein, 71 aa, Triticum aestivum
  Clone ID: PAT_TA_43531.pep
PLLLTLYITLLLNHHSSPTPKQSFSFHSYPLPTLPSFLISHIPPLPFFFMIIPILFQLDHVETYPPYTTFI

SEQ ID NO: 149114 - protein, 48 aa, Triticum aestivum
  Clone ID: PAT_TA_43532.pep
RPPTRPPTRPPTRPPTRPPTRPPPCTACRLESLTGRYLKPSLVHCVIC

SEQ ID NO: 149115 - protein, 117 aa, Triticum aestivum
  Clone ID: PAT_TA_43533.pep
VRTRYAEACQELGLQGIDVQDELIECAKTLASTFNTILEVLNRDTVSHAMEYYTTFGRDCHTQDKENYKSVVHNVKQVQANPPCLHVSLCKEVQNSLGTAMDGGEPIHSNVPANDID

SEQ ID NO: 149116 - protein, 38 aa, Triticum aestivum
  Clone ID: PAT_TA_43534.pep
RPRTLGQTLGHTRRQLTYMTFGIDLGLGTPTSPPPLGR

SEQ ID NO: 149117 - protein, 115 aa, Triticum aestivum
  unsure (1)..(115): unsure at all Xaa locations
  Clone ID: PAT_TA_43535.pep
RRHACGEELNVAKRNEFANLTINXXERVLGAHEECAXKSQTAALVAEGRKEGGTLVNTLLPSIGSLANTRPGEAELRSMILRGVSQDITGHNEDLEGDKPPALVGGLTDALAQIL

SEQ ID NO: 149118 - protein, 54 aa, Triticum aestivum
  Clone ID: PAT_TA_43536.pep
RVDRRVGYPLYQKTGRFQWRDWGKCKPYILLIGHPLYPYIINHSETVVKSAYNL

SEQ ID NO: 149119 - protein, 56 aa, Triticum aestivum
  Clone ID: PAT_TA_43537.pep
PPPPPPPPPPARAGRTTPGRGGPPASPRAPPPRSGASPRSTRSAATASCAPSSTTT

SEQ ID NO: 149120 - protein, 54 aa, Triticum aestivum
  Clone ID: PAT_TA_43538.pep
VRGRRHASAELYLAVCGGKKDESMGRICELNSGLHHVNPKRNNVFHLSTNQGHD

SEQ ID NO: 149121 - protein, 52 aa, Triticum aestivum
  Clone ID: PAT_TA_43539.pep
AGGEPRVRPRVRGIEVNHILQQNICATWGVGGHALIGHTYILASSFEVQLEY

SEQ ID NO: 149122 - protein, 54 aa, Triticum aestivum
  Clone ID: PAT_TA_43540.pep
NLVYPPLRAEDGNVRLVDGARVVAFMERSQPPLRDHAGAKGRKGISIHGRVGGR

SEQ ID NO: 149123 - protein, 127 aa, Triticum aestivum
  Clone ID: PAT_TA_43541.pep
RVREEDDDQETSFGQFGFSNTYAEHPRVLARGLRIDRLGSGLLSADCGGGIDGGSGGGYLVTSGGGGGDRSGIEIHYKRLIEEDPCNGLFLKNYAQFLYQVRTTLAALLQCRHCRGRRLHFTTQIRR

SEQ ID NO: 149124 - protein, 33 aa, Triticum aestivum
  unsure (1)..(33): unsure at all Xaa locations
  Clone ID: PAT_TA_43542.pep
YTLNLHKCLHSCTFXNNVPNAIKEITKFSHNGI

SEQ ID NO: 149125 - protein, 57 aa, Triticum aestivum
  unsure (1)..(57): unsure at all Xaa locations
  Clone ID: PAT_TA_43543.pep
ARLKKFDGYLLSRNYIFXYQTSKDDFGVYSQFLIPPPSTCTNIARGDNHIDSLLKLN

SEQ ID NO: 149126 - protein, 119 aa, Triticum aestivum
  Clone ID: PAT_TA_43544.pep
MRATGTSRPPFPHSRFFRLGAATITRAFGGEEAMGSTRADPDDKEEGGMTTDFFWLHTDEPNAEGPREILVKNHDIKGLFGPDPMLCIKIAAHGLLHLWTDTLLRNQACARYWRAVTFS

SEQ ID NO: 149127 - protein, 151 aa, Triticum aestivum
  unsure (1)..(151): unsure at all Xaa locations
  Clone ID: PAT_TA_43545.pep
HAYVSSQCGATRAPTRSGRVNGTDYNRKALTLDTAGFSLRSEDTTHKXTGCWHGVHKWPNNELVRTYNLEKNAIVQGDADPFKQWNLTNYRGEIRRKNKAAVTVKKEAGDGQEAAGAAAAPQEATKSNNVQRKLEKRQQGRTLDSHIEEQF

SEQ ID NO: 149128 - protein, 110 aa, Triticum aestivum
  unsure (1)..(110): unsure at all Xaa locations
  Clone ID: PAT_TA_43546.pep
YLPYGPLGLLDEQIQNFIPNTTHRSCKGHVFYKAKGYLXPYYINRSMTNIQCDKIIHHMLTVDEFDTGWKQLIXQDGVRKHTYLTQIYEKKEKWAKPYYNGEFYAKITST

SEQ ID NO: 149129 - protein, 141 aa, Triticum aestivum
  unsure (1)..(141): unsure at all Xaa locations
  Clone ID: PAT_TA_43547.pep
RGQCFMFWNLKKTVGAPVIIAXLGGKAAIDGQTINSDAHVSHAMVGLRKLFTDAAVPDPGASVVTNWGLDPFSRGAYSYVARRASGQDYDIIGRPVANCLFFAGEATCKEHPHTGGGAILSGLREAGQIIDLGHRGKDYVA

SEQ ID NO: 149130 - protein, 115 aa, Triticum aestivum
  Clone ID: PAT_TA_43548.pep
MSGRGKDYKGLCKGGAKRHRKVLRDNIQGITKPAIRRLAKRGGVKRISGLIYEETHGGLKIFLENVIRDAVTYTEHARRKTVTGMDVVYALKRQGRTLYRFGGVSAIRALAVADT

SEQ ID NO: 149131 - protein, 82 aa, Triticum aestivum
  Clone ID: PAT_TA_43549.pep
ETHSKRRTTHFRVRDLAGRLHINPGSGPGYHRHITIFFPEGRLYQIQYAFKGGKSAGGTLIGVRGKDFRCVRTHKKVPRQGA

SEQ ID NO: 149132 - protein, 113 aa, Triticum aestivum
  Clone ID: PAT_TA_43550.pep
GAECAQPLVNQVRMMLASMSDGNIGVSAYDTAWVTLVPRLDDGDRPQFPATLQWILDNHLPNRSWGDAALFSSYDRITNTLGWGVALTKWALGPDKCIRGVSFLEENMWRVSK

SEQ ID NO: 149133 - protein, 102 aa, Triticum aestivum
  unsure (1)..(102): unsure at all Xaa locations
  Clone ID: PAT_TA_43551.pep
GGHASGCAATEIPRLHIPPAQTGPAARTPPLTTGIPRRRAGSGRPPGRWLPCGRWGSTLLYXGWRPQRCVIGRGGARCSYPAGGTHGMGGVQATPKRRQDPG

SEQ ID NO: 149134 - protein, 95 aa, Triticum aestivum
  Clone ID: PAT_TA_43552.pep
NPTLTWGTRASARGALGGENLLNYLTPTLLYRILVRLQLREGSRTYALSQTWNQQWVDLHSLYLGLMQKGGIPSEGESKQLLHYPGNMEKLSMRS

SEQ ID NO: 149135 - protein, 109 aa, Triticum aestivum
  unsure (1)..(109): unsure at all Xaa locations
  Clone ID: PAT_TA_43553.pep
YILSPKPPPITAFIHNAGEVGKRRKERSDRIGSAVLDAAADRLSTFLWALRVSTLGAFTGAGTXYLNLDEGVHYCLLRNMYMLDLLLFALNLRCYALGGASFNPTRGGG

SEQ ID NO: 149136 - protein, 132 aa, Triticum aestivum
  unsure (1)..(132): unsure at all Xaa locations
  Clone ID: PAT_TA_43554.pep
VLVDPTSKLTWLRGFSYSGTYATYGQLEDATTQLRCADRATTQGILIIMGSPGLTIYHVKRHLHKYRLAKDIDDSSVHGYNGDNKKPGDSLSGLGXPLXTHIYECLQLHMDGHKRMHEHLEVQRQLQLRIEA

SEQ ID NO: 149137 - protein, 58 aa, Triticum aestivum
  unsure (1)..(58): unsure at all Xaa locations
  Clone ID: PAT_TA_43555.pep
NSTTTRLWREHVFILRRMGNSKQALPDFINKXVDIEEAXEVVTMHQDEELWEELSKQC

SEQ ID NO: 149138 - protein, 120 aa, Triticum aestivum
  Clone ID: PAT_TA_43556.pep
ACASRRYGGRERGGATIAGGEGERGSVASLSPSRRHMRLAQGQLLLSCPAGYRLLAGAPSSQRVSRTASSPSSSMGGLSSAATVMPATCATECWSRTLCPGGIWDGRDTGATSFLLCRMV

SEQ ID NO: 149139 - protein, 105 aa, Triticum aestivum
  unsure (1)..(105): unsure at all Xaa locations
  Clone ID: PAT_TA_43557.pep
PIHTSTQPTTNHWHHLQPGDGGKGGRGGSIPIGTAFPKAKEYLNHTFLWVLXVSTLGAYTDGVTTYLNLHEGIHYALLVTECILAALLFGFNPLFYTLCGARFNP

SEQ ID NO: 149140 - protein, 74 aa, Triticum aestivum
  Clone ID: PAT_TA_43558.pep
ASARVRFRRVKRWLNRTNTPMVDTEVCVDTSTLTSASLKVCRALNICPSVPYYDMRLNTSRYITHNLGINVPIM

SEQ ID NO: 149141 - protein, 84 aa, Triticum aestivum
  unsure (1)..(84): unsure at all Xaa locations
  Clone ID: PAT_TA_43559.pep
ILWAVLHLLGRRGGEMGLTFTKLFNRLFANNEMRILMVGLDAAGKTTILYKLKLGEIVTTIPTIGFNVETVEYKNIXFTVWDVG

SEQ ID NO: 149142 - protein, 55 aa, Triticum aestivum
  Clone ID: PAT_TA_43560.pep
HIFLFLKLVVKLIKSFVVFCTCYQNWLLKFLCVVYMLAKLALKNFLCYVHTRRIG

SEQ ID NO: 149143 - protein, 124 aa, Triticum aestivum
  unsure (1)..(124): unsure at all Xaa locations
  Clone ID: PAT_TA_43561.pep
LHPSTSFCHAAGGTGPAAIXXKIHISIGGIGHGDSGKATTTGHLIYKLGGIDKRVIQRVGKEAREMNKRAFKDAWVLDKLKAXREKGITINIALWKCQTTQDSRAGIDGPGHRGFIKNMITWTF

SEQ ID NO: 149144 - protein, 129 aa, Triticum aestivum
  unsure (1)..(129): unsure at all Xaa locations
  Clone ID: PAT_TA_43562.pep
GRHASAHACAELWRRKQSDVMRFLRRVRCWEDRHHPAIVRITRPTRPDRARRLGFKGKQGDGVYRIPVRRGGRKRPVPKGIVYGKANHHGITQLKVQRNNMCIAEERAGRXLGGLFVVNSYWVNDDCTY

SEQ ID NO: 149145 - protein, 93 aa, Triticum aestivum
  Clone ID: PAT_TA_43563.pep
LLVGPLESHRCSSPPVKAAGCNFHVCFPSTLFLLHRDGHQHVSALLRVMPLWRSVGPCQATHLCSPRLNVGPPAHHHDFLYRSCHIGVLLVSR

SEQ ID NO: 149146 - protein, 79 aa, Triticum aestivum
  Clone ID: PAT_TA_43564.pep
VVEEALSLGYVRGETRNGGGQDVGVLLDLLALVGDRPRACEGAVYGFWSLGSCAHPQGPEGPFIEAVCKARKPGAFVRV

SEQ ID NO: 149147 - protein, 62 aa, Triticum aestivum
  Clone ID: PAT_TA_43565.pep
GILVVVIIAAYGQQIHAIQRADHTVSIAARGIYMSRRGSNRWPRWCYKPGFYVRERPRVRGR

SEQ ID NO: 149148 - protein, 52 aa, Triticum aestivum
  Clone ID: PAT_TA_43566.pep
RHTTHLMIGQHETLHIINMLSHPIKWENSYIWGGKNLSTERRYLGFGPKLLR

SEQ ID NO: 149149 - protein, 133 aa, Triticum aestivum
  Clone ID: PAT_TA_43567.pep
RAPTRTRTRGLSPPEPYCPLPGPTGPPRQRHTAYQGNPIPLPRPARPVSNPSTTCTTTRFKSLGLLPAMDDWENDDFQPNAPVGKGQPLKRNWGDEYEDEDDAKESWEGEGKKPNPQPWEKAGSKTKAKTGGK

SEQ ID NO: 149150 - protein, 90 aa, Triticum aestivum
  Clone ID: PAT_TA_43568.pep
SADACVHQLPSHPTPRPTVERAPPPGPMGPKGAENKPRAAVVENTGAGKNPQGVNRVVGTNDGCRYGITRGRKKGTNAKNGVVTDKIYMF

SEQ ID NO: 149151 - protein, 56 aa, Triticum aestivum
  Clone ID: PAT_TA_43569.pep
RFINNYNRHLCNTFSETIKSDDSFNLFEHYFCFDLGYMGFRTSLTHLTDLVILVRI

SEQ ID NO: 149152 - protein, 90 aa, Triticum aestivum
  Clone ID: PAT_TA_43570.pep
SDSLFHTHGTSFKRRTADGRFTEWMNPGCMNYTWSVRRSLNRTRLDALGPLCASDPEWMYSIPSLPVRLQSGLFLGSEPHAWAYACPPLE

SEQ ID NO: 149153 - protein, 83 aa, Triticum aestivum
  Clone ID: PAT_TA_43571.pep
VSSQFGATRWGTICPKGDPLLKDIRRNTILGKAGICQTDCGNLYQLSPPIHGQVWRLHYTDLDVSMSRDKGLYLKTTHSLFVN

SEQ ID NO: 149154 - protein, 39 aa, Triticum aestivum
  Clone ID: PAT_TA_43572.pep
SSPSNDSVSRDQNRYRYLYHLAFWVTCSKPSRPRRGGRT

SEQ ID NO: 149155 - protein, 61 aa, Triticum aestivum
  Clone ID: PAT_TA_43573.pep
PEPKLITTAMAILVPLITNLHGGHVGALSGFKLGTVAVIEMIMIAPVSTIHCATRERIASS

SEQ ID NO: 149156 - protein, 79 aa, Triticum aestivum
  Clone ID: PAT_TA_43574.pep
APTRPPTRAPTRPRLFKLTIWTFAHIIWGFCIAESCYPKGHTLDNFLVSFWAWSHLLGSTIQVDHGEIIIILIMTGYQG

SEQ ID NO: 149157 - protein, 90 aa, Triticum aestivum
  Clone ID: PAT_TA_43575.pep
MLKLPDLALVATSYHMEYPADPSLADINNSIYVSHELRMYYFKIRPRSRAYSHDSTECPFDQPVENPRHRDPRKYHYSYVPCPDHRIRVC

SEQ ID NO: 149158 - protein, 106 aa, Triticum aestivum
  Clone ID: PAT_TA_43576.pep
MLPRAKPPTNMASYIQAYAALIPGKIVNRTSYARAELHMDRAFSMHSCARITYYLKDGIREVPRKCADARKMGGFDLSTSALLVYRTSAEGAPNMLTFDEMQNKTY

SEQ ID NO: 149159 - protein, 51 aa, Triticum aestivum
  Clone ID: PAT_TA_43577.pep
SSRGNRVGHNVPLPQQGSIPPKRWGHWPCIPWQPNQDCAPHVPSWSVRHTR

SEQ ID NO: 149160 - protein, 72 aa, Triticum aestivum
  Clone ID: PAT_TA_43578.pep
HAYVSSQCGCTRAAGRKGGDREKAVTPYVKATRQFGIRRMGRYLNKGRYTQRGGYRGPVYLACQLNILDREA

SEQ ID NO: 149161 - protein, 126 aa, Triticum aestivum
  unsure (1)..(126): unsure at all Xaa locations
  Clone ID: PAT_TA_43579.pep
RAATYTNLNRLVGHVISXGTAGVRYDGALNVEQNKFQTKLVPYPMIHYMLCYYAPGISTEKAYHDQVTVAEITNNVFKPYYMMEKCDLQHRKNMDCCLMYHEDVVPNDGNAVVDTIETNRTIQVVD

SEQ ID NO: 149162 - protein, 63 aa, Triticum aestivum
  Clone ID: PAT_TA_43580.pep
RKKTLWLEFMLNKIGSNDHVDRRHHPVCQKKRFTWEILYVKCEENLGSHAFGIHVYSVSTNAT

SEQ ID NO: 149163 - protein, 63 aa, Triticum aestivum
  Clone ID: PAT_TA_43581.pep
KERLISNWVTGGGGLGVRAHFSLRANGPPAPRVVLSPVALKLAVSKHVLGARLPPQATYKVKL

SEQ ID NO: 149164 - protein, 85 aa, Triticum aestivum
  Clone ID: PAT_TA_43582.pep
RPGKHMICCCNMMDATTPKYSGARDEGIGNELSSYLKKGGYNPDKDPFVPICGVEGDNMIERGTNLDWYKGPTLLEGLDQNNEPK

SEQ ID NO: 149165 - protein, 97 aa, Triticum aestivum
  Clone ID: PAT_TA_43583.pep
VRKGRASRTPPPTNQAWKNQKVVDQQDGKRKTRTKLKFGDVHVCIYQDSGLCRNVPEIWFTQRDQTIRNTSRIVDALQIIFGMNMSIFENSLPSSNI

SEQ ID NO: 149166 - protein, 63 aa, Triticum aestivum
  Clone ID: PAT_TA_43584.pep
MVPRVPRCDDRYLQALRSHASNMTECISIHMGQARIHVGNACWELYCLQHRIQPEGQTNGDKT

SEQ ID NO: 149167 - protein, 64 aa, Triticum aestivum
  Clone ID: PAT_TA_43585.pep
RGRVGEDEYRVFMVLDNLPLVVPVQRPDRYTVAYQGGYHVGVKGQYAGSMDVKYYIHNHFVISV

SEQ ID NO: 149168 - protein, 77 aa, Triticum aestivum
  Clone ID: PAT_TA_43586.pep
LPCVFHLCHGILLLYSSSRSLVGSLMTRWENKPLAKSSPFQATRIWPWRRCPPPSWPSVVSHTFFVVASCPFVSRCS

SEQ ID NO: 149169 - protein, 57 aa, Triticum aestivum
  Clone ID: PAT_TA_43587.pep
VRLFNKCYYYVNFFIRMISMQLMMTLLCSTTVDIITSTCQCQTIYIIWRRRGRHSNL

SEQ ID NO: 149170 - protein, 45 aa, Triticum aestivum
  Clone ID: PAT_TA_43588.pep
ERPFMFGDDAIGEVKVPERHVIRPGEVAGHVKKRLVKRLHGRPRT

SEQ ID NO: 149171 - protein, 113 aa, Triticum aestivum
  unsure (1)..(113): unsure at all Xaa locations
  Clone ID: PAT_TA_43589.pep
MLSVGKAKASGVKRGGAKDPDXVPRSDMRXRDMDDFVPELELDSDFKQIVTMLCHIKDKAYKDGQNKTVHAIFSCSTEIHSIVQDTKTKFEKERQNVFKALTNASKECEGSLY

SEQ ID NO: 149172 - protein, 71 aa, Triticum aestivum
  Clone ID: PAT_TA_43590.pep
SIASPLKLLRADLAHEWPTKARQTIHKASALSGMVLHLVLLKLPFVVNTSTASPLELLEQPSHMHRHASAD

SEQ ID NO: 149173 - protein, 77 aa, Triticum aestivum
  Clone ID: PAT_TA_43591.pep
YMTGSYPRSAATVSLSITVRTRRTFSVASRHHVSWHPSSQLEGFMLLGMDPHPTTGEVRPLPIPATHGFGTRKLMMA

SEQ ID NO: 149174 - protein, 65 aa, Triticum aestivum
  Clone ID: PAT_TA_43592.pep
LFEEHLSIIVNKLNVYLQALYGSQAHSTIAAAGHGHANSSMMHAAGAPTSAFASAKKSKAVGSWK

SEQ ID NO: 149175 - protein, 51 aa, Triticum aestivum
  Clone ID: PAT_TA_43593.pep
SYSPVGDVSNHLLLLSMGRRIRRPPHGLRLENAGCERERGRAVEEGGGRLL

SEQ ID NO: 149176 - protein, 99 aa, Triticum aestivum
  unsure (1)..(99): unsure at all Xaa locations
  Clone ID: PAT_TA_43594.pep
TEPVIIAEAAAVLRSCSTISGAVFGLNVPIEDLEFFERILFLLEQAHCSYIDNSCEHNLYLKVLFFKDLTFLLFNXSCAGLRPYRAHLYYIYRVFTPLL

SEQ ID NO: 149177 - protein, 63 aa, Triticum aestivum
  Clone ID: PAT_TA_43595.pep
MPMDRAVGLRSSSCNRVNEALFTIHQYLETWLCAAYYLLTRLNSRIEVNAWVAESSDLWILER

SEQ ID NO: 149178 - protein, 104 aa, Triticum aestivum
  unsure (1)..(104): unsure at all Xaa locations
  Clone ID: PAT_TA_43596.pep
SAHAFCPTWWPPFFPSPWTCRAPSTRGAXAVSRCPAVRPSAATAPPASAAPRAAAPAAVASEPSPRRPFGECSTRMRRTSGQVTTITTTTITSRCMRPPARALN

SEQ ID NO: 149179 - protein, 127 aa, Triticum aestivum
  Clone ID: PAT_TA_43597.pep
SADAWVFKDHGISFLPKVPGHIHRSRNLLLELIVNCIKETAATPLWQTGRRSVGRQHFPSTGHTSCKIPTYFFGAQICFQLTKHFPPWASSASFRLSNERFSPFCPVSWWPKHPYSKGGENHPSLAS

SEQ ID NO: 149180 - protein, 88 aa, Triticum aestivum
  Clone ID: PAT_TA_43598.pep
DSVLFYSSFPGTNKISFCLDIVFPVSSDIFLDENLPIHKGKMTDGLNVRSLKPSSKPSLNPLSRKALRNVFNISKSQAPSIQKGHPLK

SEQ ID NO: 149181 - protein, 54 aa, Triticum aestivum
  Clone ID: PAT_TA_43599.pep
PHGSPLLIGGIARSAIGSPAREPEKVGGNRRSPERSVRVDKSVDGRVGGRVDER

SEQ ID NO: 149182 - protein, 82 aa, Triticum aestivum
  Clone ID: PAT_TA_43600.pep
WYIFTTVITPKIFKKMAKLHAMGTFVIQCDMKYLSKVCYDKNQKQARVLVPDNFFTLYFILHSKLHCWLLDIITLPTRLYSN

SEQ ID NO: 149183 - protein, 55 aa, Triticum aestivum
  Clone ID: PAT_TA_43601.pep
MADVEYRCFVGGLAWATDDQSLQNAFSKYGDVIYSKIITDRETGRSLGFGFDTFW

SEQ ID NO: 149184 - protein, 95 aa, Triticum aestivum
  unsure (1)..(95): unsure at all Xaa locations
  Clone ID: PAT_TA_43602.pep
MADAGAAKPEPEKKSWADVEEEEEAKAKAEAEAXLAAVALYFFSGAPIEPVVEAQAKQIEALLLSVPDDDGGARGPALLDDFDDFQIQVVTLGGT

SEQ ID NO: 149185 - protein, 57 aa, Triticum aestivum
  unsure (1)..(57): unsure at all Xaa locations
  Clone ID: PAT_TA_43603.pep
RPRQPYRGGGRGGYRGGGGRSRGYYGGRGDYXNMGRGGGQENYYGGGRGGHGNMGRG

SEQ ID NO: 149186 - protein, 146 aa, Triticum aestivum
  Clone ID: PAT_TA_43604.pep
SALGAPSPSSIPPSMAGAGSGGGSSSSTAREGRARARARKKQKQQEQQGEEEKGPNPLDPRFSDYNPRRADMVNTGFRNSRSNLNMKQLVVPSTILTGTSQRRGSCSVTRQILSRSGSVSSTMDTRSMLRHHHSQGQSGTQRVYLF

SEQ ID NO: 149187 - protein, 91 aa, Triticum aestivum
  unsure (1)..(91): unsure at all Xaa locations
  Clone ID: PAT_TA_43605.pep
MARKGGERKKAVTRSTKAGLQFPVGRIGRFLKKGRYAQRVGSGAPVYLAAVLEYLAVEVLXLAGNSVMDNMNTRIVLCHLLLAIRNDQDLV

SEQ ID NO: 149188 - protein, 101 aa, Triticum aestivum
  Clone ID: PAT_TA_43606.pep
RPRALPLPLPLPGCSTGRLLPLLRCSRSGMCARPRPPRSGMLFPSHRFTLAVLCLGAALLRVHMADCGVCSSPLPASLEAGVSCFMTPTSVFPVGCGCCGG

SEQ ID NO: 149189 - protein, 77 aa, Triticum aestivum
  Clone ID: PAT_TA_43607.pep
YILYLYLIPGCSTGLSASALSVALGRACALGPVLHVYNVQYPYHRIHSKMSSEMGACTALGSHGRKRSMYIFASCFT

SEQ ID NO: 149190 - protein, 55 aa, Triticum aestivum
  Clone ID: PAT_TA_43608.pep
VRSISYLQKHMDIVLTLLSESVDGEGDESMVLTLKTVEHLAILAAFLRKNSFKPS

SEQ ID NO: 149191 - protein, 126 aa, Triticum aestivum
  Clone ID: PAT_TA_43609.pep
PSPAAALKASMRRVPVNGADMRRRRLADASPDWPPLPPLPGVAPTQRWRGFIAVIVRAYLAEPTLSFGARSRRWGGSASAEEGRENEPRKGGTKVDEEQLLFRFAFCFTGRSSINTGGAFQLRADG

SEQ ID NO: 149192 - protein, 144 aa, Triticum aestivum
  Clone ID: PAT_TA_43610.pep
RPRTRGRRRRLCVLWAGGRRHHRGRRDHCRRPRTPSDPRRSPGSLLWRAMDSSEIPPSDRREEQPPASLPLPAAFLEFLGENGLDPALYSKADTIPRYIRLKPGTEPMVVTEIESELKCDLMKVSWLPDFYAIPPEIQNAGSMA

SEQ ID NO: 149193 - protein, 92 aa, Triticum aestivum
  Clone ID: PAT_TA_43611.pep
LLPLHGHEQPGDSLLLPPSLSSAPVRSGQLVLSERFPAVGGRRISRKQFLTEEPLQVKATTGVLHHQQSMYRAMHTPLCHFGDAMQFRNATT

SEQ ID NO: 149194 - protein, 38 aa, Triticum aestivum
  Clone ID: PAT_TA_43612.pep
KRRRIDTYFLFKNNKIENEGGTSMRQVKPIIKTQHRSH

SEQ ID NO: 149195 - protein, 69 aa, Triticum aestivum
  Clone ID: PAT_TA_43613.pep
KDQYLCTEVVLRNLKAGHTGGHFLVEGDDSGMVRWLRLYTANIKLARLPCAFFILSQRHARTHACMHRI

SEQ ID NO: 149196 - protein, 145 aa, Triticum aestivum
  unsure (1)..(145): unsure at all Xaa locations
  Clone ID: PAT_TA_43614.pep
RPRSSRRRFTPRTDAPTTSRRRPPTSTRTTPPAPTTSSRRRHAPTTAASTCRGPPSSTPPPSPRPPTSTDPFSRRRHTPTTTAPSTXTRSPATPTRPTARTTTTASSRRSPLTPTPQTSTTSSRCSRAATTSAPSRRTESISAPS

SEQ ID NO: 149197 - protein, 100 aa, Triticum aestivum
  Clone ID: PAT_TA_43615.pep
FSQCRQVGSRSSCGPGGGRERPAVSSTGCAHRRPSRVRLPQALRLPSVGGDGHSVEHYGSPGPWSPRIKLGEVDDDIDVPRLPISLVFVQQKREGSRWLA

SEQ ID NO: 149198 - protein, 48 aa, Triticum aestivum
  Clone ID: PAT_TA_43616.pep
FSKWDCLHHRLHSKRTGSALNPKGFNHMKKSYKYTNSNGRSDGSACVN

SEQ ID NO: 149199 - protein, 42 aa, Triticum aestivum
  Clone ID: PAT_TA_43617.pep
IYRIKNICSNFGRNGMTNIYLYMSKSSEVKIPLHLSHFIAAF

SEQ ID NO: 149200 - protein, 89 aa, Triticum aestivum
  Clone ID: PAT_TA_43618.pep
ADTLHSSCSSFVCKILTVVKAGHCLLVVCISFFVYFSLIFLDGYSLMLFLGASFVKTEYFSSWLVAFCWQPTHLALLNRYFKYKGLCGR

SEQ ID NO: 149201 - protein, 114 aa, Triticum aestivum
  Clone ID: PAT_TA_43619.pep
ARERSRADQRPRPRASGGTSHSAGEEEGGGGDPGGGAGTATALGPAASHGSTPGHERDVVSTVFSVSGGAMSASSGAEAARGTTSSGAAAEPADGLHPMTVTTEATNSMTATGR

SEQ ID NO: 149202 - protein, 114 aa, Triticum aestivum
  unsure (1)..(114): unsure at all Xaa locations
  Clone ID: PAT_TA_43620.pep
MKLIAAYLLAYLGGNSSPSAADVKNILDSIGAEADEEKLEFLLAELKGKDITEVIGFGREKFAAVPSGGGAIAVGAPAAAXGGAAAPAAESKKEEKVEEKEEXSDEDMGFSLVD

SEQ ID NO: 149203 - protein, 71 aa, Triticum aestivum
  Clone ID: PAT_TA_43621.pep
QLPDLERGRSKTQGATRAMQLLLTPRPPVVLTVSGASPKIDILPSLQSLSLVRCPVLGIHELQALENLLPT

SEQ ID NO: 149204 - protein, 115 aa, Triticum aestivum
  Clone ID: PAT_TA_43622.pep
CYLHLHEGRNKMVDILRTHQLVKRTRPLESRSRHPGPISSLVRRRCRSTMARERHPGDACIYWFSSSRLVVWRYAVGVSAAGACEQLPVVARLVFFFVSMVEEGRRPWIWRNPSQ

SEQ ID NO: 149205 - protein, 121 aa, Triticum aestivum
  Clone ID: PAT_TA_43623.pep
CTVVKTQEVGESIKAAVQARRPPSKAPERASPPRKRLDRAGQQKRRRDGAGPPRKRRGQSGPLRRRRVHTGPQGRRRDGADSSLGPGDGEAASRAALGFSGVSSGPGARQSVRVIVWGGGR

SEQ ID NO: 149206 - protein, 45 aa, Triticum aestivum
  Clone ID: PAT_TA_43624.pep
KKYKMYVLIPYIVALVCYSERVVHSLPKILSGHPCIIHMVVLREY

SEQ ID NO: 149207 - protein, 48 aa, Triticum aestivum
  Clone ID: PAT_TA_43625.pep
MVSNGELSQPQAGEYGLAVMRRRPKTKIVCTLCPASRSVDMIEKLLRA

SEQ ID NO: 149208 - protein, 73 aa, Triticum aestivum
  Clone ID: PAT_TA_43626.pep
RAPTRPSAWALLMATSAWALLKAYSGGTGPSQDLIHHIATSAWVLLAADSPETGPGLDLNHQSAASARFLLAV

SEQ ID NO: 149209 - protein, 118 aa, Triticum aestivum
  unsure (1)..(118): unsure at all Xaa locations
  Clone ID: PAT_TA_43627.pep
SGPLEVVVFHGDQPTITGKYKGEEKQFAAQYISSMIIIKMFEIAKGFTGVKNVLVTVPACFSESQWQATEDAGVFAGISVMRIINEQTAAVIAXGLYKKDSFVGIENCLIFDLGGGKL

SEQ ID NO: 149210 - protein, 121 aa, Triticum aestivum
  Clone ID: PAT_TA_43628.pep
VRPPRPTSFVRLRRRLSSTLQESPAPAAMADDDGTHHLPFVRDTVLKKRNDNEEWATMIRERKAVKRHMPPARRQGRHQAPRGLCRGVPQQGARLPADAHAPEGPEVAPRSRPSTPSCSLP

SEQ ID NO: 149211 - protein, 49 aa, Triticum aestivum
  Clone ID: PAT_TA_43629.pep
VCSKVTGRLRSEISIIGNVNYITELLVMDTPPRPLWLLTTTFHPFLAME

SEQ ID NO: 149212 - protein, 145 aa, Triticum aestivum
  unsure (1)..(145): unsure at all Xaa locations
  Clone ID: PAT_TA_43630.pep
LVFFHIMEATAVSKGKKYETRAPVGQVWAVYMNWNRGCSFENFKSWEYDLVEGLEISAASLTLSYLTKVDGFSTVFMLXRKGESTCGLKILRSDMMMFSHQIPSYRMTNEGDKLCGYWELDPASGPETFLARNTKGGKSYIAQQD

SEQ ID NO: 149213 - protein, 106 aa, Triticum aestivum
  Clone ID: PAT_TA_43631.pep
VPSCFHLKISDGMFSFITSVSPISNFVSTQAEINAANITSHVGKLQSPILSPDASSFGYQHHGRCSYQIHHSRRSPPIPSPEHEPAVPTLSQKSPPRRPSPLKQIH

SEQ ID NO: 149214 - protein, 113 aa, Triticum aestivum
  unsure (1)..(113): unsure at all Xaa locations
  Clone ID: PAT_TA_43632.pep
ASHLFDGMPPGEKVDNAPPASGSDIIGTLPDHILHHLLSFLPVQAAVQTCVLARRWRHLWRSTTGLRIVGLEXAESVEDLRVFVDHVLILRERTDLNTCEMIFDECSDDDEVY

SEQ ID NO: 149215 - protein, 90 aa, Triticum aestivum
  Clone ID: PAT_TA_43633.pep
SAHASAHASTPIRTPTRGLTPGLILASMLCSAPGADAGAYAAASANTKAKMIVKMVRTMRTAGHTSMHSKMHTMHKTTNTDDTTVHSTLQ

SEQ ID NO: 149216 - protein, 123 aa, Triticum aestivum
  unsure (1)..(123): unsure at all Xaa locations
  Clone ID: PAT_TA_43634.pep
SEMICCCNMMDAPTPIFSKARGEEIVKEVSSYLNKVGYNPEKVPFVPISGFEGDNMIDRSTNLDWYKGPTLLEALDQINEPKRPSDKPLRLPLQDVYKIGGIGTVPVGRVETGVIXKPGMVVT

SEQ ID NO: 149217 - protein, 64 aa, Triticum aestivum
  Clone ID: PAT_TA_43635.pep
EDWDTLGTESVAFHKHFLSNLKVVLAIFHKLVHSTNYITQLKSKTIGPYSVSLCRKYIDQLYRT

SEQ ID NO: 149218 - protein, 129 aa, Triticum aestivum
  Clone ID: PAT_TA_43636.pep
TLSSSWHMRHSPAWMSGSSWPPSSAISTTATDTASDGFSATPSSLVFAKPSTFTTTWSPIQNSPQQIELLAGGGGVVEDDRSPLLVRWAESRDVLLLSMSNSLASVWSSNQHAISLSWFCWFAGRVGGR

SEQ ID NO: 149219 - protein, 149 aa, Triticum aestivum
  Clone ID: PAT_TA_43637.pep
VRPRVRKEDSDEDIRPIKRGAEKGRYIKQQIFFAKRDNKSDKDQGQNSAEDNPLSSAVNDKKAAPAHGKRVERLKSVIKSCGMSVPPSVYRRAKQAPESKREACLIKELEDILEKEGLSSHPSEKEIKAVRKRKERAKDLEGIDMSNII

SEQ ID NO: 149220 - protein, 141 aa, Triticum aestivum
  Clone ID: PAT_TA_43638.pep
VRGRVGADSSDFLWYSTSIVVAGGEPYLNGSQSNLLVNSLGHVLQVFTNGKFAGSGKGNASSSLISLTTPVTLVPGKNKIDLLSATVGLTNYGAFFDLVGAGITGPVKLTGPKGALDLSSADWTYQIGLRGEDSHLYNPSE

SEQ ID NO: 149221 - protein, 150 aa, Triticum aestivum
  Clone ID: PAT_TA_43639.pep
MCFICFIVWKRRKGKVNINNQAATNRPEEYALVWRLEERSSEFTLFDFPEILQATHNFSKENLLGQGGFGPVYKGQLPDGMEIAVKRLASHSGQGFTEFKNEVELIAKLQHNNLVKLLGCCIQGEEKLLVYEYLPNKSLDFFIFDENRTT

SEQ ID NO: 149222 - protein, 121 aa, Triticum aestivum
  unsure (1)..(121): unsure at all Xaa locations
  Clone ID: PAT_TA_43640.pep
MGKEKTHINIVVIGHVDSGKSTTTGHLIYKLGGIDKRVIERLEKEAAVMNKRSFKHAWVLDKLKGERQRGITIHFVLXKLETTNYYCTVFDAPGDRDLIKNMITGPSQADCAVLIIDSTTG

SEQ ID NO: 149223 - protein, 66 aa, Triticum aestivum
  Clone ID: PAT_TA_43641.pep
NLTYDFLFTIIYMHFPINIGEVNFWCFRNNPAHIYQVTYWLAGMLRLGCFFSSLGYGCNRWLLCGS

SEQ ID NO: 149224 - protein, 103 aa, Triticum aestivum
  Clone ID: PAT_TA_43642.pep
IRLDPLNKPLPSTTDPSAASSGSNPSQQANLLIPSSSISVTSQPNAYPDRSTRPPAATPLGSLPVHHLPSFFSPKPASSSFSSPCSSERDLTFLSPSVQTTGA

SEQ ID NO: 149225 - protein, 104 aa, Triticum aestivum
  Clone ID: PAT_TA_43643.pep
GEVRRPTTDAAPATNGQFAKATGRSTASRRRRAPRPNPPLPPLPPTSPPLRGGSELHAAPPCSSAALPPAPPASQPPAPRPPDSGRGAPVPRCGSDPARLARAG

SEQ ID NO: 149226 - protein, 75 aa, Triticum aestivum
  Clone ID: PAT_TA_43644.pep
GGGGRQGPWMSSHGNHRIQMRGGGGGGLARTPDPQGNHRSLPSPRWLRCRCRIESSQSPPSRYTLNSEILKFSGR

SEQ ID NO: 149227 - protein, 101 aa, Triticum aestivum
  Clone ID: PAT_TA_43645.pep
SAQGQLKAVKGQGLICYKCGDGHRAAECTFSGDCHGCGRQGHKDRVCKVNPNSIVKWQPAHAQDLVTPSPGSVSRQAAPHVPSPPPASPVAGWRTTEQLLK

SEQ ID NO: 149228 - protein, 57 aa, Triticum aestivum
  Clone ID: PAT_TA_43646.pep
KKLKGRDAPLTDHGRHNIHLLRVEQMHAVRRRPEVERHSRSAFTGQKYRRRNRKKGW

SEQ ID NO: 149229 - protein, 87 aa, Triticum aestivum
  Clone ID: PAT_TA_43647.pep
PRKYPVASLPPVTVVVQRREVSGMAKGVRGANQTPFACSCLLLLACPPKPTPTCQEMLLPPAKLSAAQVCLLDSAPVTLDRLSLFFL

SEQ ID NO: 149230 - protein, 54 aa, Triticum aestivum
  Clone ID: PAT_TA_43648.pep
RPGVAEHGAVQRLVRRAGRATSCAATTPSARAGRCPSWYGHQLVPAQLRPSQRR

SEQ ID NO: 149231 - protein, 35 aa, Triticum aestivum
  Clone ID: PAT_TA_43649.pep
NRHCGTPAGFGDANERGVRGHGEDGEGARHGRGER

SEQ ID NO: 149232 - protein, 105 aa, Triticum aestivum
  Clone ID: PAT_TA_43650.pep
VRPRVRSHARRCLHGFLLRVRELQRGGIHLFLFFFLFPVRSVFFFSLCSRFRFVLRPGIMFFPFLRDHRFICSGFWIVPFWIHPWLRFVHRHRFLLVPFWFWGHW

SEQ ID NO: 149233 - protein, 113 aa, Triticum aestivum
  Clone ID: PAT_TA_43651.pep
HTHYTARRAAVHCTASASPQPCCPSGGGQGCSATPPTVELHMHAHAGCTQYAGELHTHAALGDGRGAPCRPLEGLIGTRIWARGPHRQHGPSPTAAGEEREGGAPRRGRVGGR

SEQ ID NO: 149234 - protein, 83 aa, Triticum aestivum
  Clone ID: PAT_TA_43652.pep
SLSMTPPRRVTSGPRNYPRILDIVLRVVCMDHGYHRLSLIYLPPLPRGARTSPVSKPLPSVTRMRPRGAALPFLVRSTMEGGG

SEQ ID NO: 149235 - protein, 116 aa, Triticum aestivum
  Clone ID: PAT_TA_43653.pep
GHHRRRGGGGEEEVEVIEATTGGAYQDTTGPRAGGERQGNEPLAAPVETADGVVRVRYVGQDDVRSDERTHGVRAQVVKGKLVTASWEVRHHCSEPASTKMINDLNVSMAQWLIER

SEQ ID NO: 149236 - protein, 80 aa, Triticum aestivum
  Clone ID: PAT_TA_43654.pep
HGRRSNNDRRATQKIRLIKRRNDGVTIGAYRPPPPPVTAGAKPTAWGWCPGGGATASARKPWGADLGVLSNNREGYAADE

SEQ ID NO: 149237 - protein, 88 aa, Triticum aestivum
  Clone ID: PAT_TA_43655.pep
VDKKIHHFMGITNGWADSVLPTLLETRSYQRTLLACLGLQLIQRPYAHPSYFCKVCQGQSCRSPSRRHGLLERLGHSTLIRHGEQDRR

SEQ ID NO: 149238 - protein, 90 aa, Triticum aestivum
  unsure (1)..(90): unsure at all Xaa locations
  Clone ID: PAT_TA_43656.pep
VRVLVGSPARMDSRWLCLGNFIAMLTCXATGQQAEAIWLLWRNAENXLIAEMPLRICYPAIGKPGIXIATGCDPKNTXWNYHNGGMRPVL

SEQ ID NO: 149239 - protein, 39 aa, Triticum aestivum
  Clone ID: PAT_TA_43657.pep
GRPAGAQSCSSLPGCVRPSSHPDEAIKSRSTCPPTRQRT

SEQ ID NO: 149240 - protein, 137 aa, Triticum aestivum
  unsure (1)..(137): unsure at all Xaa locations
  Clone ID: PAT_TA_43658.pep
VRSFKTLEVACDXLRHSRLFKKLLEAVLKTGNRMXDGSFRGGAQAFKLDTLLKLADVKGLDGKTTLLHFVVQEIIRSEGVRAARSAKEHNSSVFSVSGGTDDLSEDVGDDTEHYKQLGLEMVFGLSDNLQNVRKASI

SEQ ID NO: 149241 - protein, 128 aa, Triticum aestivum
  unsure (1)..(128): unsure at all Xaa locations
  Clone ID: PAT_TA_43659.pep
MAAEEATAYAAGTNFEVDLGHLLAYNPRTTSPSSSPSXRADLRDKCLRKATELAHAVTDALFSLPATEGRDGPVVRLPPPDYRLPREKHLPRPKPPTKWEHFAXSKGIIKHMKNKRAWDEQTNSWKRT

SEQ ID NO: 149242 - protein, 78 aa, Triticum aestivum
  Clone ID: PAT_TA_43660.pep
LTTFPRLLAAPTNLQHPPTSLLLYCRRRLLFGEMVIKAILYAGLDAFAFDPFKGILVEVCFLEEEGAFMTVDYRWMQS

SEQ ID NO: 149243 - protein, 57 aa, Triticum aestivum
  Clone ID: PAT_TA_43661.pep
MDSDDKKFGKGPRELTGAVDLISQYKLEPHHDFFCKRPFALAISDTHYLHNVVGGTE

SEQ ID NO: 149244 - protein, 84 aa, Triticum aestivum
  Clone ID: PAT_TA_43662.pep
RPRTRGKKKLHDAVADVVRKTRERGQTGAAATASPGRRRCRHRPDLHHLKCAFREELARAKVPRGVSFRSIGLGSLRMARSLNQ

SEQ ID NO: 149245 - protein, 106 aa, Triticum aestivum
  Clone ID: PAT_TA_43663.pep
LTLDITSGKKLTSKNSLQTKNVLQQQAWLLSPWPVCSCYQDHTLSHSPSYGDQSPLSQSVYAPCKLESPSVQQCLCAWQRPDCYHSHLEPPDSLVTKQLAWSLVHW

SEQ ID NO: 149246 - protein, 116 aa, Triticum aestivum
  Clone ID: PAT_TA_43664.pep
MWFAGRASATAPLPLLLLLLVAGAAATDQIFTTSGVPFGKNSREPRYRVEFHPVDSPYHPENGQESEPMKDHEGRQYTCYLPVEETKTMKSIVPQNATNVIIESERKVKPKEPDEL

SEQ ID NO: 149247 - protein, 109 aa, Triticum aestivum
  Clone ID: PAT_TA_43665.pep
WLKGRSREKTEAPDCCCCLGGWQPPARQRRGDKKAQPRAFPWARGLGRRRSSSWLLLVEEGRGDLWLVGIGRWVDRRDWVAGKIDQGGGCGGIGRWGNRGGFGGVAART

SEQ ID NO: 149248 - protein, 138 aa, Triticum aestivum
  Clone ID: PAT_TA_43666.pep
SALGYNEMASEAPLLAHAPPLARWPGAITVFAAPDAFLQAACPMCSRRHLLEQHIAMGYYPYSELAAAATMKIPSASVGFCIKVATERGPFGIHYARIYADGVEVSLRGHRCLRGAHHDPRRHGATPRRGLRLYGAGH

SEQ ID NO: 149249 - protein, 126 aa, Triticum aestivum
  Clone ID: PAT_TA_43667.pep
SDRPLPPLPPSSLVSISSLAPASRSRFLLRRPSLPPPSRPLSRSSEPPNLTGLLRLFRSDLTGTSSCSHERPPRPPLHRRHPFPYLSVDPFEQPPRGRRRHQPRRRGGSPTPLMASPSPGATSPRA

SEQ ID NO: 149250 - protein, 138 aa, Triticum aestivum
  Clone ID: PAT_TA_43668.pep
RPPTRPAGAAGDPSRRARRRKMCKAFYAQDFINRVDKIGTINSYALFGHADILEVAAEAAERCIQVVHLLQPVLVDEFASRPRAKTVVGVTTTLSVRLVEHCRIVLSECEEGYVPEHPLREAFYGLNALNRTGYPKPG

SEQ ID NO: 149251 - protein, 104 aa, Triticum aestivum
  Clone ID: PAT_TA_43669.pep
MVYIKNQNTRAYSKRFQVKFKRRRQGKTDYRARLRLTNQDKNKYNTPKYRFVVRFTNKDVTAQIVYATIGGDIVMARAYSHELPRYGLEIGLTNYSAAYCTGLL

SEQ ID NO: 149252 - protein, 63 aa, Triticum aestivum
  Clone ID: PAT_TA_43670.pep
MRTETCHKEGFRKVDPDRWEFANEGFLRGQRHLLRNIKRRKPTHGSQNQQSLGSYLEVGNFGH

SEQ ID NO: 149253 - protein, 70 aa, Triticum aestivum
  Clone ID: PAT_TA_43671.pep
QVCMHSPNHSPLLSSTPKQWGSLSRRLEILPSSWLSVSSYLPMPSLSFPRPPACLIILSRFSPVTVLLLE

SEQ ID NO: 149254 - protein, 59 aa, Triticum aestivum
  Clone ID: PAT_TA_43672.pep
YLYCLQSHSILPQCTMHSPGGMASFFLSPFVFCLDLDGVCACLTAPTPYQYVLTRLQAS

SEQ ID NO: 149255 - protein, 139 aa, Triticum aestivum
  Clone ID: PAT_TA_43673.pep
GAHASAHASAHASAHASGRFKRMRRGLMIILDFSLLLGPHLLNPWKGKMKMAFLCSESKKSSKGSSEKDKNLNNGTSTEDRKRKSDAINDPHKASGEVNAENDVVSKKKKKAKDKRNAVDSEKVNDEEKEVKLASSADT

SEQ ID NO: 149256 - protein, 76 aa, Triticum aestivum
  Clone ID: PAT_TA_43674.pep
MGKKKERSVNVSGKPRHSLDVNRPNDKKGAGGGGGAGGSRSAATVRRLKMYKLRPMRDRGGKIVKHDLQSKELPNT

SEQ ID NO: 149257 - protein, 138 aa, Triticum aestivum
  Clone ID: PAT_TA_43675.pep
SAELSFLHILVPPQSLPLPPPFMDLDSGRISSTDKNLVALYAGGYRPGSSLSGGYLIYDARKDSLSVIPRLPSDDLHGVMGHQSAVVMCDAQGEGYVLAELIKKGFSQAGVWLWKSSAPQPEWVSLPGSHPLPSSRFT

SEQ ID NO: 149258 - protein, 91 aa, Triticum aestivum
  unsure (1)..(91): unsure at all Xaa locations
  Clone ID: PAT_TA_43676.pep
ERTRPPTRPRTLGLLAISSSLPRDQAPGPNRRPAXPQKEPSDPPLSALLYSHLPRAGLPGVTATPAVGPAMPAPSLLVFHWRAPVPDSPLG

SEQ ID NO: 149259 - protein, 73 aa, Triticum aestivum
  unsure (1)..(73): unsure at all Xaa locations
  Clone ID: PAT_TA_43677.pep
SSEEPMPPLQQLLHRGCWYSRFMISPLASIPGLSIYLKLLLASIQALGRRRDLDPGSGERRKEEXKGMVGVGR

SEQ ID NO: 149260 - protein, 63 aa, Triticum aestivum
  Clone ID: PAT_TA_43678.pep
RLDSQQHRSRIPQISLVLSFHFNFLVLQSYPLSLLLVNTFLDNSQPPLHQNNPSLLASFLILS

SEQ ID NO: 149261 - protein, 80 aa, Triticum aestivum
  Clone ID: PAT_TA_43679.pep
RSLPPSGQPGFPCPSRPQCRRGRDGWWCGQGARRNVGRRGRREKLGVFAGEPTGARVGWGVSRGFVGEAAGVRESRIPRT

SEQ ID NO: 149262 - protein, 41 aa, Triticum aestivum
  Clone ID: PAT_TA_43680.pep
FLICDQWYVEIAHPLSVHSRLISERGPVTGPEGEKKTSPRT

SEQ ID NO: 149263 - protein, 36 aa, Triticum aestivum
  Clone ID: PAT_TA_43681.pep
RPTTLSHTHPTLASCITKTPSLAKGYSHAGYTPVAP

SEQ ID NO: 149264 - protein, 84 aa, Triticum aestivum
  unsure (1)..(84): unsure at all Xaa locations
  Clone ID: PAT_TA_43682.pep
ERLCSPASPASEGAVAGRSPRGGGDXLAPHVPGRRRRLAWRFPSAEPRVYELGLGGARLPWGWAQLSSCSPQIHLWSSYLRSTD

SEQ ID NO: 149265 - protein, 100 aa, Triticum aestivum
  unsure (1)..(100): unsure at all Xaa locations
  Clone ID: PAT_TA_43683.pep
MAGGVADAGVPTLAKANGSGAGCCPVKGPVYATPREVMEMGPREGLLYMTCVYNGTGXINKPDYLATGGVYPNVATYSXVIHRVPGTHNCDELDHYGWDR

SEQ ID NO: 149266 - protein, 99 aa, Triticum aestivum
  Clone ID: PAT_TA_43684.pep
MDKKRVAIGGACLSGLAAFKHLLERGCRPAVFEADTVLGGVWAHAPECTRLQTPRPMFQYSDFPGPESVTEVFPDHRQGADYLYAYARHFGVLDCIMFG

SEQ ID NO: 149267 - protein, 138 aa, Triticum aestivum
  Clone ID: PAT_TA_43685.pep
VRAKFEIDSLHDSIDFYGTITRARFEELNMDLFRKCTEHVEKCLADAKMDKSQIHDVVLVGGSSRIPKGQQLLQDFFDGKMLCKSINPDEAVAYGAAVQAAALNGECDQKVKDLLLLDVTPLSLGVEIGGGFMSVVIP

SEQ ID NO: 149268 - protein, 44 aa, Triticum aestivum
  Clone ID: PAT_TA_43686.pep
LLYMKQKLSCNHLVTFKCKLSRHVIGNLLTLAYKNELDLLYIPK

SEQ ID NO: 149269 - protein, 66 aa, Triticum aestivum
  Clone ID: PAT_TA_43687.pep
VPQTTFSYYHPESTGGGVSRMMDEIKKPPKSLYFLLHACPHNPTLGDSTEEHRLKTSYHITAKKQF

SEQ ID NO: 149270 - protein, 97 aa, Triticum aestivum
  unsure (1)..(97): unsure at all Xaa locations
  Clone ID: PAT_TA_43688.pep
STIYEPASSPGLKQLISYYPMRSMQQHLCGIGENSLQHKIFIXXLQRKASKRFQIKKLTMXKSIRVIISTPGGQXXNPFVVELIFHKKKKRKGTYIR

SEQ ID NO: 149271 - protein, 51 aa, Triticum aestivum
  unsure (1)..(51): unsure at all Xaa locations
  Clone ID: PAT_TA_43689.pep
GSDARRLRWDMIGFLKPHRCKLPPTYSEFRCYYIKAIRLIARVSKIGSSTX

SEQ ID NO: 149272 - protein, 75 aa, Triticum aestivum
  Clone ID: PAT_TA_43690.pep
NPANGFNFGGPNKKLIPCKDGDVNLGPLKRPPPFFFFFFFFFFFYFTLFFFFSLFFFFFFFFFLIPTRPPTRPRT

SEQ ID NO: 149273 - protein, 93 aa, Triticum aestivum
  Clone ID: PAT_TA_43691.pep
RVLQRGITARRPPPRLERWIRIYSLHHRVHEVLDVAGATNRSAASITATNDGPDLVAEQQRPRRGACVVADARHSDRDQDAVAGERRRLTRPG

SEQ ID NO: 149274 - protein, 79 aa, Triticum aestivum
  Clone ID: PAT_TA_43692.pep
MSNRLLHLACRHDVAECARLLLDGEYGITPASVDARDQLTRTPLHVAAEGHSKRCLQLLLSRNARTDVRLVDGTRLIPL

SEQ ID NO: 149275 - protein, 54 aa, Triticum aestivum
  Clone ID: PAT_TA_43693.pep
GRCIMTYKLHLGAYSSNRVYYLTFLNSRIHYTHIITELDLQSSHSYSCAEQWLG

SEQ ID NO: 149276 - protein, 87 aa, Triticum aestivum
  Clone ID: PAT_TA_43694.pep
CQLVLQNITSSHRDCVQPSRAIYTAASMNASCLLVVLLLAVATESKLSLAALEGSTLGGELGELISKAGSFLTSARRAGAYCCHSIT

SEQ ID NO: 149277 - protein, 75 aa, Triticum aestivum
  Clone ID: PAT_TA_43695.pep
ISLWTHSVRMITNIRLLVTNILRCLSLEGSLWGSIIRAFGPLHRGSWCTSPRLFLEDQFGCHPSGDWHVTDPRKL

SEQ ID NO: 149278 - protein, 78 aa, Triticum aestivum
  Clone ID: PAT_TA_43696.pep
KIWGILPVDHGGDRGKNLAGFGGSFIWDKGFSVRRGFDLGRAFPYVRAFFMCISLPYFPPVFSSSLPPSDLRIEETKG

SEQ ID NO: 149279 - protein, 50 aa, Triticum aestivum
  Clone ID: PAT_TA_43697.pep
RRRNQWSPCRRRSWWTEQWLAGRGGGGPGEQRGCFTKNPNEWMKAWTNEW

SEQ ID NO: 149280 - protein, 114 aa, Triticum aestivum
  Clone ID: PAT_TA_43698.pep
VRGRVGAAASLLLLSEHSSKISAYEDCYTEVMDSFAPNVSKDVKLNAFDHQLVRSAEFKKPKGCKCSAYDIFYGQCVKDNNLIPNVAKEKLRSLILPRIQLVRIALDNVRRTAA

SEQ ID NO: 149281 - protein, 58 aa, Triticum aestivum
  Clone ID: PAT_TA_43699.pep
VRALEDTSSFLLLLSQHSRKIGAHEDCYTQPMDSVAPNASMDIMLNALNHKLRPSAEF

SEQ ID NO: 149282 - protein, 87 aa, Triticum aestivum
  Clone ID: PAT_TA_43700.pep
VPCVLRWNLQYIFGWWHYPHLPDWVCAMQAFLGKCDFLMDKKCLAIVILGFKLKLIHLFSFHTWTSLFSFYLLQKSSWCYAPTRPRT

SEQ ID NO: 149283 - protein, 31 aa, Triticum aestivum
  Clone ID: PAT_TA_43701.pep
YLILIVLNMHCIVLCKKRGQNLKTTTPVYRT

SEQ ID NO: 149284 - protein, 106 aa, Triticum aestivum
  unsure (1)..(106): unsure at all Xaa locations
  Clone ID: PAT_TA_43702.pep
RVRPRVRPRVRPRVRPRVLPRLRPRVRRAGAIICTKAPQTLTLVLAYLPSSRSSXSHGADQGRGAGHRDLPLDHLLLRRGVAARPRLYHRQRPWHPRHSLVRRLHR

SEQ ID NO: 149285 - protein, 71 aa, Triticum aestivum
  unsure (1)..(71): unsure at all Xaa locations
  Clone ID: PAT_TA_43703.pep
MDQGRKMDSGKLNKVAAKKFGGPRKKSVTXSVKAGLQFPVRHIGRFLKKGRYAHRVGSCAPVYLAAVLEYL

SEQ ID NO: 149286 - protein, 127 aa, Triticum aestivum
  Clone ID: PAT_TA_43704.pep
RVIIPVVSPYNALIRKFYPTESTPPPPPVIPPGVAKATPIAPISPPHPHRTALLVDLLPLFRPHPRTRSWRAWLSPGYPAILPARSRRLCRNRGNLVVRFVAEATPRSPASGAGLEGEGGGERKNRT

SEQ ID NO: 149287 - protein, 105 aa, Triticum aestivum
  unsure (1)..(105): unsure at all Xaa locations
  Clone ID: PAT_TA_43705.pep
SDSVTPLGWAVGHGQEYSVNLLLEHNAKPDSETGDGITLFLSGVAAGSLPCLEVLIQAGANPNVSAGGATPLHVASNSGNLXMIKCLLQAGCDLNTFDDDVIKPL

SEQ ID NO: 149288 - protein, 51 aa, Triticum aestivum
  unsure (1)..(51): unsure at all Xaa locations
  Clone ID: PAT_TA_43706.pep
TVPAVPSXIPVDPLVRPLVSALLLFSGTRHVLKLIGTRGIMNDQCPTSTIH

SEQ ID NO: 149289 - protein, 86 aa, Triticum aestivum
  unsure (1)..(86): unsure at all Xaa locations
  Clone ID: PAT_TA_43707.pep
MRSMAAAVCLLRAASAVALSLMPSGLTIMPSPSPVPFPXAQSLVLPGLGAAILPSMVLMAVPNMKISYYXRGLRNGPIALKPVPVI

SEQ ID NO: 149290 - protein, 92 aa, Triticum aestivum
  Clone ID: PAT_TA_43708.pep
FADAWWQVATRIYAGLRANAGGALSKHADQNDVLRALCAEAGYVVNDLSNVTRCPERSPGVCASGSFYNLQCGLHSGGSCGIKGGSFTRRLF

SEQ ID NO: 149291 - protein, 127 aa, Triticum aestivum
  unsure (1)..(127): unsure at all Xaa locations
  Clone ID: PAT_TA_43709.pep
SGYFCQGKYPRRGEVSFSQGLPLNSMNSMISPPRSSARRKGGVGXRRAELAFAVGEAAGGAAGAGAAPPQRAQLRLEGRAAARRRIEHFPHLSSARRRSADGEAGPAGGRREAREEWRREEGHEGRT

SEQ ID NO: 149292 - protein, 95 aa, Triticum aestivum
  unsure (1)..(95): unsure at all Xaa locations
  Clone ID: PAT_TA_43710.pep
FVHLYSCKSTTTGHLFYKLVGIDKRVIDTFHYEAAQMNKMSFKDAWVLDKLKALREXGITIDIALWKFETTKFYCTYIESPGHSXSIKNIITGTS

SEQ ID NO: 149293 - protein, 71 aa, Triticum aestivum
  Clone ID: PAT_TA_43711.pep
GPGFLGGPTLSPTRFFKPAVGALGGPLRGAWDLALRDGLQLHKRARALSEPPPKASFTMLVCLSPTIAVVL

SEQ ID NO: 149294 - protein, 58 aa, Triticum aestivum
  Clone ID: PAT_TA_43712.pep
SPTEAVRAITHASFRKGELSIEANTIQCLQNIQHGLYICSPKILGPGPFLPPSKVFPY

SEQ ID NO: 149295 - protein, 42 aa, Triticum aestivum
  Clone ID: PAT_TA_43713.pep
WGMGRILMECTSGCLGCSARSYTKALQTEASLLYALAVKQGL

SEQ ID NO: 149296 - protein, 121 aa, Triticum aestivum
  Clone ID: PAT_TA_43714.pep
GEGLVRGLLYTPRERRARKAPAAPQGAANPRPGLPARRRWRSPTSPATRSSPASSTPRAPSAAPPRASPPPRRPTRRPPRPARARVVALSALAGSGPHGLLVPRAQREDRDWTRAGFYPRP

SEQ ID NO: 149297 - protein, 42 aa, Triticum aestivum
  unsure (1)..(42): unsure at all Xaa locations
  Clone ID: PAT_TA_43715.pep
EAAHHDNFEALSKLNMRDLGSPVNVNLGXHFTKPPSRYSDGA

SEQ ID NO: 149298 - protein, 117 aa, Triticum aestivum
  unsure (1)..(117): unsure at all Xaa locations
  Clone ID: PAT_TA_43716.pep
SDIRHAVYRIRSYKLSQKESKNELCHDKLKDCPVELLDRDEFPTDFLVKMQYFRFLEEEGVLDWFFHPELCKLACLNDYQRLVPRDHGACFDWEYADWEXDRNYFHSFEMQHEYIEY

SEQ ID NO: 149299 - protein, 74 aa, Triticum aestivum
  unsure (1)..(74): unsure at all Xaa locations
  Clone ID: PAT_TA_43717.pep
MGRIMVHVLKVKNKADLQGQLKDLNAELSLLRVVKGTCGAPNXLSKIKVVRTSIARVLTVISHNQMAVLMEAYN

SEQ ID NO: 149300 - protein, 45 aa, Triticum aestivum
  Clone ID: PAT_TA_43718.pep
SGDARVRGLFGSLSPFSFSEPGPYPLGCLGPHRFSNLCLAPASIL

SEQ ID NO: 149301 - protein, 86 aa, Triticum aestivum
  Clone ID: PAT_TA_43719.pep
SCSEDGAPKQEQVGAQVSRPAHQVNVQAGGMPRQSMESSLPRPNHRREPELGDVLGPHQGPLRLKEASRPLLQRRQHEARPNEWVP

SEQ ID NO: 149302 - protein, 142 aa, Triticum aestivum
  Clone ID: PAT_TA_43720.pep
SLGSRAHGRSRSASNAVAASCARGLHREGRSRSPGLGCLRASPYGHRPRRGASVKQVVPVSRSSTGPRPEEADAIAMRLDVRQRPRRGVRRQKRSAGPRQSRSTARTRWTPGCTLEGVASLALWHARMQAATSLNRAPSAGR

SEQ ID NO: 149303 - protein, 100 aa, Triticum aestivum
  unsure (1)..(100): unsure at all Xaa locations
  Clone ID: PAT_TA_43721.pep
FSLPSGSTPTRRPVAIPHFVLVDRATMQSFIGPDWCLNLEICYILNHDPLQAKDVRKSIKKRIGHKNSKIQVLALTLLETLIKNCGDFXYIHFAERDILH

SEQ ID NO: 149304 - protein, 46 aa, Triticum aestivum
  Clone ID: PAT_TA_43722.pep
GLRCVTSLYRGTPTRRHATMPQPLLVDRSYQSYIYSCRVWTESTHL

SEQ ID NO: 149305 - protein, 80 aa, Triticum aestivum
  Clone ID: PAT_TA_43723.pep
NDPPYAHRTFLLILEFLLWSVKRSSPYALCATYAKMLANLCYATYAEMLTTMLCHFTRLYVLLSQCDGTKMLFVYDKLGV

SEQ ID NO: 149306 - protein, 110 aa, Triticum aestivum
  Clone ID: PAT_TA_43724.pep
MQIFVKTLTGKTITLEVESSDTIDNVKAKIQDKEGIPPDQQRLIFAGKQLEDGRTLADYNIQKESTLHLVLKLRGGMQIFGKTLTGKTITLEVESSDTIDNVKAKIQDKE

SEQ ID NO: 149307 - protein, 97 aa, Triticum aestivum
  unsure (1)..(97): unsure at all Xaa locations
  Clone ID: PAT_TA_43725.pep
VPFSNSWGDPLIXLSPRPLVPLFSSSLLCSSWCASYPCTTRPARAPPPPSQGDDCTRRPAPSPSSLAQLKHVMLAASSSSLSLAATTTLTDPSPCSR

SEQ ID NO: 149308 - protein, 80 aa, Triticum aestivum
  Clone ID: PAT_TA_43726.pep
DGRVLLNIFLPVALPPSFPPLALRSQIPSLRWPGVGRSSGHSRARSRVRSLTFHRTERYNTRAGTGCPAGQTPLRQSFRI

SEQ ID NO: 149309 - protein, 79 aa, Triticum aestivum
  Clone ID: PAT_TA_43727.pep
MVCAPSSSVVNVYPLANYTFGTKEAKMDNDTSVADRLARMMVNYIKEGMRTSVEAILLVQDHNHPHILLLHIGNTFCKL

SEQ ID NO: 149310 - protein, 72 aa, Triticum aestivum
  Clone ID: PAT_TA_43728.pep
VPPSPSQWLIRLFLPPSRSLPSYVAAPIHTHHHPNKGSTCNNKGKEGRKITGWGGAGRQAAGWLACPRVRGR

SEQ ID NO: 149311 - protein, 85 aa, Triticum aestivum
  Clone ID: PAT_TA_43729.pep
LSPAGCSLPSVIDWLPTGSFPLGNISRGTRGTFIVNYIVCLPLFRGVLCISYSCLVQFRNHVSHPKLLGISTRDRRHPPPRRRGG

SEQ ID NO: 149312 - protein, 99 aa, Triticum aestivum
  unsure (1)..(99): unsure at all Xaa locations
  Clone ID: PAT_TA_43730.pep
VRDRKSSHFRKGYYARHRVALRWLATWLDVKWVKMEAIEVMVACSAMAAAKEQEQSGENATPKSKWAXWKRGGIIVAVALTGGALPAITGGVAAPAIAA

SEQ ID NO: 149313 - protein, 67 aa, Triticum aestivum
  Clone ID: PAT_TA_43731.pep
IPGGSHSSFDSLALRSPTLPPCLYSASGAWASQARSPRPLLSWRRRPSLPRGRPCRSSKPMTRSRRL

SEQ ID NO: 149314 - protein, 153 aa, Triticum aestivum
  Clone ID: PAT_TA_43732.pep
RPDSMGVEDDVHPMKPPKKGRKIKLTSNGNQKVHIKVKLKSQPENKNIVNDFELTNGNESKHLNSIADQRFKTPAINAPESRFRDVPAPLATKMYHSRGNYQLRLELAQLYRESCAEQSHSYASNTTPNSSQNNGLVPCDNSTLHGSDDSVLH

SEQ ID NO: 149315 - protein, 83 aa, Triticum aestivum
  Clone ID: PAT_TA_43733.pep
RPLSLTPLPCSVSLTHSPRHPWMWILVPGQSFRSPADSIKTPARSTPHSHSQGVTPSCRASHDAVPWQESCALRRGRGLGHRG

SEQ ID NO: 149316 - protein, 100 aa, Triticum aestivum
  Clone ID: PAT_TA_43734.pep
FSINRLVPRMPMPNQVPTSSSECIFCICSSTISVANMLQRSAFICTLSSSTAMARRGAPIRRSWSPPGRRAPVDADGIRAGAGDVGVDGGPHASAHASTD

SEQ ID NO: 149317 - protein, 76 aa, Triticum aestivum
  Clone ID: PAT_TA_43735.pep
MLWTTHTPTPTQYIQIPVLQSQLGKEEASAMSALFNFNSFLIVVLLVICTCTYIKMQFPAILNDRTGYVFYADFPD

SEQ ID NO: 149318 - protein, 95 aa, Triticum aestivum
  Clone ID: PAT_TA_43736.pep
KRCTRFSRKLLPVIQKATTDEHKKGQIFHRPWLLERGRGRRSCSRRPCPAVSSYFLWWLWRCSPQQAGSCSVPAIHKRWSKQGHGYCRGREQRED

SEQ ID NO: 149319 - protein, 108 aa, Triticum aestivum
  Clone ID: PAT_TA_43737.pep
RPPTRPGEGESSKVSEHEAHMQETGLLVAMDITDEEGIPALHENVQANGEVESSTVELSSCTSGQQESETTAAPCEESSPSQIKVSPSLPLGVAKMEVDPLEVIDHEA

SEQ ID NO: 149320 - protein, 131 aa, Triticum aestivum
  Clone ID: PAT_TA_43738.pep
MTSAVARRGAALPSLLKKLLAKPSASGAPVSFALRPAAVTAARRPYNTLGKEGRLYDDDGSSSSFSGESGSEYEDTDSDDRRRARDFFVPSFSQDVLDQFGAHTSLGRLLSGLEDAAAPTGLCFTGGASRL

SEQ ID NO: 149321 - protein, 118 aa, Triticum aestivum
  Clone ID: PAT_TA_43739.pep
EARVRPRVRRILHRGELRSFSRCFWRTRGFFPAMSRIGDLMPRERSVKSTSHSRKADGNSANVSGTPHDIAKHCHDEELGNIGGKLCKNDGHSFKESCSITNSEVLTRVKWKIRCSLK

SEQ ID NO: 149322 - protein, 79 aa, Triticum aestivum
  Clone ID: PAT_TA_43740.pep
MGSLHKTTFVLLMFCLAALGSADYLKYKDPKQPLGVRIKDLLGRMTLAEKIGQMTQIERENATAEAMSKYFIGSVLSGG

SEQ ID NO: 149323 - protein, 62 aa, Triticum aestivum
  Clone ID: PAT_TA_43741.pep
CPSESTTTPNPTNGVQNLGPDPRVHPDGVRHPPHVGAGDLAQRRPSVKRREDGRVRRQGNKR

SEQ ID NO: 149324 - protein, 149 aa, Triticum aestivum
  unsure (1)..(149): unsure at all Xaa locations
  Clone ID: PAT_TA_43742.pep
VRSFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWYAQVLGEAPHKFQNALDACKTLIAEPKGXDHFLPPXVIDDESG

SEQ ID NO: 149325 - protein, 93 aa, Triticum aestivum
  unsure (1)..(93): unsure at all Xaa locations
  Clone ID: PAT_TA_43743.pep
ARCWSPSSYNPKASSGGQADASLPHVEEKDDKDVHARVTRNNWGSPDNFRXEVLIFDIFPFRNGYHALLGRTAFAXFNAVPHYAYLKLMMLGP

SEQ ID NO: 149326 - protein, 76 aa, Triticum aestivum
  unsure (1)..(76): unsure at all Xaa locations
  Clone ID: PAT_TA_43744.pep
HYLFKLLLIGDYLVGISCLLLRLADDSYQESYIITIGVXYKIHTCDHDGKTINLQILDNAXQKLFMTISCSYYLRF

SEQ ID NO: 149327 - protein, 114 aa, Triticum aestivum
  unsure (1)..(114): unsure at all Xaa locations
  Clone ID: PAT_TA_43745.pep
FPWRPHASAGGIXVAQDSLLPPNVDIAGQAXALLIKHVFSNHTLQEYVSNKLIRSLTAALERELLYTSSINEYISRTIYLSFIIFRKVRFFQASTSVIPHLVCAPNGLNLMLVH

SEQ ID NO: 149328 - protein, 117 aa, Triticum aestivum
  Clone ID: PAT_TA_43746.pep
FVDAWDRPLFFQDVKARARRFRVETSSGCLLGLPVAATGNCADIILGHEPVHYFREGNQGAPYQCFHLPVVVTWLWPLVKKGKPVLKKNVMPSGIVKEAQAVCAKGRFLYVLQRTIA

SEQ ID NO: 149329 - protein, 111 aa, Triticum aestivum
  Clone ID: PAT_TA_43747.pep
MSSGDDDRVTVSRHHQRYKDKDRDHSSSRRHRDMDRPFSCHHRDYRDGERELDRDRDRHQRDKERYREERKARERSEKEREKEEKREKEREREREREREEREMDKERERAR

SEQ ID NO: 149330 - protein, 36 aa, Triticum aestivum
  Clone ID: PAT_TA_43748.pep
WSMYKNAVLGLSSFDHHHISSSSYSNNHIYSTQKRT

SEQ ID NO: 149331 - protein, 55 aa, Triticum aestivum
  Clone ID: PAT_TA_43749.pep
RSQGLDVEPVSKYEMLCLKERQMNPDIICQRCTKVRPNSPFSSPLTSQNIKNHAN

SEQ ID NO: 149332 - protein, 75 aa, Triticum aestivum
  Clone ID: PAT_TA_43750.pep
PLDFSWYVRSFALNKATCLTSLEQGSKWALLRVKLVDFTPMCTKSGAIFNGREPTLCGCNKKKKNPPQKEKKKEK

SEQ ID NO: 149333 - protein, 46 aa, Triticum aestivum
  Clone ID: PAT_TA_43751.pep
VNPLDKKFIKFLCDEAPPFISCAPTLKVFLAHDTCSPTRQTTSKRT

SEQ ID NO: 149334 - protein, 49 aa, Triticum aestivum
  Clone ID: PAT_TA_43752.pep
MGEHNEEPVAESMMDKISDKFHGGDSCSSCSNSDNQKKGSLVCTKGKIY

SEQ ID NO: 149335 - protein, 60 aa, Triticum aestivum
  Clone ID: PAT_TA_43753.pep
FYIISYLLNMRLDVLSERCVFQNSNSLWHHSSQEPLRIHPLFHLKRAVHVKSVMVGQDTV

SEQ ID NO: 149336 - protein, 52 aa, Triticum aestivum
  Clone ID: PAT_TA_43754.pep
STVRAVVYANGGTVICEAFGRVEVGIPVAIALSTQRDRLRIVCSKPKLPFRS

SEQ ID NO: 149337 - protein, 111 aa, Triticum aestivum
  Clone ID: PAT_TA_43755.pep
FFRGERPCGACNDSEMLLKRRPNGGFMVGCRGFPQCRNVVWLPGSLAETAVTQQICPTCVPGPVYKIQFKFNRGDIPPSFDGDHLGCIGGCDDVPKELTEMIRFYHHNQAT

SEQ ID NO: 149338 - protein, 65 aa, Triticum aestivum
  Clone ID: PAT_TA_43756.pep
FESEGDRGFETEAAAAASTGIFEEMNGGGGGGGGGEVVFVGRGLELKVYFNLHLAAYLHGDLLLV

SEQ ID NO: 149339 - protein, 115 aa, Triticum aestivum
  Clone ID: PAT_TA_43757.pep
TQKGRSHRVYNCPTVGWQRNRHNVDLLSGSGEQDLKVAKRRCGPRSQHTIDQKASRVKGPGEKNSGINHSPAGGCITGGQKGGVHGDGVAGGRRGRVGKVDDTRRSPPSPGKASE

SEQ ID NO: 149340 - protein, 68 aa, Triticum aestivum
  unsure (1)..(68): unsure at all Xaa locations
  Clone ID: PAT_TA_43758.pep
SYNTEQDVDLLNLVXWEHWTRQNVIELMDPSLSNHPSHDQVLKGISVRRPCAAGGTLRFVLRRYNVSF

SEQ ID NO: 149341 - protein, 65 aa, Triticum aestivum
  Clone ID: PAT_TA_43759.pep
TSCTCPMDLLTLYIHLGQYIRPQSFYQAGAKDNLMLVSYLHTSKPPARGSSSTPEFFKIFKRGIR

SEQ ID NO: 149342 - protein, 53 aa, Triticum aestivum
  Clone ID: PAT_TA_43760.pep
ILNLHGNYKTKNVFIQKIFLKSPITGCFLETDIAGIPFSGNRSKTIQVPTCPP

SEQ ID NO: 149343 - protein, 84 aa, Triticum aestivum
  unsure (1)..(84): unsure at all Xaa locations
  Clone ID: PAT_TA_43761.pep
RGRNPEPAQSDSGDTPNSCEGVTAALSITQGALDVVAFIEGVCVQTETVLRQDLGEEGYGRALTXNKMDRCFLELQVEGEEAYQ

SEQ ID NO: 149344 - protein, 89 aa, Triticum aestivum
  Clone ID: PAT_TA_43762.pep
EEGRGQRRERSGGRGAPHGRRAMRTSTRWMLSRSRDGRSAGPTTWPTRWPRRACHYVQARPPGGCSRSGGINTHRPGEKTGCTTWAWWP

SEQ ID NO: 149345 - protein, 66 aa, Triticum aestivum
  Clone ID: PAT_TA_43763.pep
KTWALDYRYRKKERKQHRAEEGQVKEAKSTPLQYHYHNDISINLESTLPITRNKPEAPACLGMELY

SEQ ID NO: 149346 - protein, 92 aa, Triticum aestivum
  unsure (1)..(92): unsure at all Xaa locations
  Clone ID: PAT_TA_43764.pep
MASMGKAIGSNAAKKAMFRSSKAGLQFPVSRIARFLKAGKIAXRVGAGAIVYHVVRLQYLLTDVLELAVNALRDNKKTRFVPSNIQLAVRND

SEQ ID NO: 149347 - protein, 52 aa, Triticum aestivum
  Clone ID: PAT_TA_43765.pep
LTHALNRHGWYYMVPNTCNYMAGVLLRHYCKNHGSSHNLGPYNDITFRLFVL

SEQ ID NO: 149348 - protein, 139 aa, Triticum aestivum
  unsure (1)..(139): unsure at all Xaa locations
  Clone ID: PAT_TA_43766.pep
INIIDAFVIRHNPVNGSLRIKLPSGAKKIVXQASCRAMIGQVAGGGRTDKPMTQGLVYVLLTMYSRCKSELXCPNVRGVAMNPAEHSHXDXNHQHIGHASTVRRVAPPGQKVGLNCFRRTGXRLRGQAVVFVVKAYKAT

SEQ ID NO: 149349 - protein, 96 aa, Triticum aestivum
  unsure (1)..(96): unsure at all Xaa locations
  Clone ID: PAT_TA_43767.pep
MAKTYPVVSAXYQEADEKARLKLRALIGEKNCSPLMLRLAWXSAGTFYLSSNTGRPFGTIKKPVEQAHAVNAGLDIIVRMLEPIKEEMPTISYADL

SEQ ID NO: 149350 - protein, 70 aa, Triticum aestivum
  Clone ID: PAT_TA_43768.pep
QNVKQRMTLTKSNSHPVDEGAYVPSAPTVPQPHVLTVVKMVHRLQALSRLQVSATLWRRATDSYRQREMR

SEQ ID NO: 149351 - protein, 60 aa, Triticum aestivum
  Clone ID: PAT_TA_43769.pep
MWDRRNLGPGGAGPSIYKCGGHKTAAPSVQRAPDKAYVFGSSAENGFLNVWDQEKGGKKK

SEQ ID NO: 149352 - protein, 55 aa, Triticum aestivum
  Clone ID: PAT_TA_43770.pep
KNALTTICKGVRIRKWLISSNWQQILSEIGKCLILLFRVLRHQLVVALPGAHRTP

SEQ ID NO: 149353 - protein, 97 aa, Triticum aestivum
  unsure (1)..(97): unsure at all Xaa locations
  Clone ID: PAT_TA_43771.pep
LFFLFYLYYSSSLVLEETCTLNDLPYGMXLEVPGAADFLSSAWQCKCSYKAYLDALFKQYGVRTEAALVTEHIWXFPKYNSRNHWDIKERLQNAYSA

SEQ ID NO: 149354 - protein, 111 aa, Triticum aestivum
  Clone ID: PAT_TA_43772.pep
GGAKSFPRELPGNRVVHRRRDISGSGRTGPTDKAGQDDVNKPDCVPYIDPYNIPGHGGTTGPMPWNGGYSGTPSYHGGFGTTPWHGGFGSTSSSRGSGSLPEPVHGWIGTP

SEQ ID NO: 149355 - protein, 131 aa, Triticum aestivum
  Clone ID: PAT_TA_43773.pep
HLRCASEHLQMTEEISDDNLIAQTEMFLNQVVLRNWKDSLKALETCDDLLPHAEDLQIVKRCIESLASKATTDPNLFGWPIREHGIMQSPGGSVLWNGISTGARPRNFSSDWWYDDVSSLSFPKYKRLLSG

SEQ ID NO: 149356 - protein, 134 aa, Triticum aestivum
  Clone ID: PAT_TA_43774.pep
FWVGRVGPKQYRLYRVVVRYGYRDVPKDDIEFEKDLVCSIAEFIRCGDSDDQNGSLDGATDHACERLSSISKGLPFQEDDDSEVNGSDSSILSTGKETYQNAVGPKAKRVRFVLPKDAQIDGEVRSELQELTDA

SEQ ID NO: 149357 - protein, 67 aa, Triticum aestivum
  Clone ID: PAT_TA_43775.pep
AGKKGALAAGEQWRFELGVLVLKGGAEELVAGGGDGGLGGVAIFASRPFPLRKNQPLKKWRLERKEG

SEQ ID NO: 149358 - protein, 106 aa, Triticum aestivum
  Clone ID: PAT_TA_43776.pep
MSRRLVPVDRRILEQNIKARYHAGDIGTQDALHLFDELLQCAGSSSIRAINYLVTTVGRDCPALGVSLFNRVASANVAPNSITYTILVDCCCRAGRLDLGFAAMGH

SEQ ID NO: 149359 - protein, 135 aa, Triticum aestivum
  Clone ID: PAT_TA_43777.pep
SEGIDVLLRARVARILFSYKGTKPVARGVVYRDSLGIVHVAYLNQGDANEIILSAGALGSPQLLMLSGVGPSDHLRSFGLDVVVDNPGVGQGMSDNPMNAIYVPSPSPVEVSLIQVVRITRFGSYIEGASGSDWT

SEQ ID NO: 149360 - protein, 122 aa, Triticum aestivum
  Clone ID: PAT_TA_43778.pep
ITSTTKKGQGDQPSAHTSTSNVLAESKRLGDPNTYHYIHHKRTRGIKIRAPSSTSNVRGSSQTTRSGRDRNTKIEQGKGEDKDKPLHTNRNHNHWSGNVEDGEEGELGLAMEEEEIARTPGR

SEQ ID NO: 149361 - protein, 51 aa, Triticum aestivum
  Clone ID: PAT_TA_43779.pep
TVRPPVRPSRRGVRQGRGLGAWRRSSRSGGPSSLLPSLRLVGEFGVGVCGR

SEQ ID NO: 149362 - protein, 61 aa, Triticum aestivum
  Clone ID: PAT_TA_43780.pep
TNAVASIRVAVTDKAEAEKILQIKRAGGEAELNYFTVVGIARQSQAILDGLRDSVLTFSET

SEQ ID NO: 149363 - protein, 54 aa, Triticum aestivum
  Clone ID: PAT_TA_43781.pep
VRPRVPTHVRASGANVIVSLKTLMDSYLETVEDSEFKVYVFIKLIETDLKKLIR

SEQ ID NO: 149364 - protein, 97 aa, Triticum aestivum
  Clone ID: PAT_TA_43782.pep
ANLLGMGGPLHPERHHIVGRAINQPTNRPSSPLARSRRWRAEAVAPPPPPTPPRRPSFSPPLSLSLLGTEGAAQQPFNGWWWWHGRRTRRHARGSGR

SEQ ID NO: 149365 - protein, 40 aa, Triticum aestivum
  Clone ID: PAT_TA_43783.pep
QPKPRHSFLPCADGRRLVNPSFSSDSVLPLQGKIDTRRTD

SEQ ID NO: 149366 - protein, 73 aa, Triticum aestivum
  Clone ID: PAT_TA_43784.pep
TPSEYEVDGCSQETLPVLSSSRLVFKDEPPGNDHGSGLYNQCADASVVGILSSYLSHSTTAIHTQGHINCSSV

SEQ ID NO: 149367 - protein, 85 aa, Triticum aestivum
  Clone ID: PAT_TA_43785.pep
VVYRYGMVLTNSPHIFTLIQVAKLVLYLLHWLLVCKGLCYTHYPTISIQFGLTCEAVLLNVHHQLSYFWKHLFVLLCIVLFYSLI

SEQ ID NO: 149368 - protein, 57 aa, Triticum aestivum
  Clone ID: PAT_TA_43786.pep
STGHAHITRSMNCKNSKCGSIPGKCHRPLTLPARIQKSSCPTRNQGRRQAPSGPSCA

SEQ ID NO: 149369 - protein, 109 aa, Triticum aestivum
  Clone ID: PAT_TA_43787.pep
STRPSRRAGPPPAAAATWPPSSPSSSSPRSRSSTTTSRWISAGPTTPRPRPRSSGAGRRGTGTGGPAPRACRAGSSTPAPTCSSARSGTPPSTAPFPTTRMIDTKLSWR

SEQ ID NO: 149370 - protein, 68 aa, Triticum aestivum
  Clone ID: PAT_TA_43788.pep
RPIKVSYEATKAGFPGGKVIAHLDQKSFKGWQKNAITSYLQEQNIRIGKPNDFLCTKTWPCPQGKPSK

SEQ ID NO: 149371 - protein, 90 aa, Triticum aestivum
  Clone ID: PAT_TA_43789.pep
ALRTWRHIHYNDGLAIRERISKKITPKLLYRNTASFRLKRASGPRKRSLYAVASPPYRLSLQHIAVWVVTNLAAAVAGCEETRMLPPPLG

SEQ ID NO: 149372 - protein, 103 aa, Triticum aestivum
  Clone ID: PAT_TA_43790.pep
LQDLIPLRIARCPARVLSNATISIRRLACPLLPVVRDLHEHQQPYGTHLVDSHLTGRGPFHSAARLLHQHLNICHAWSCTMGPRDLRPAWLLNVYAPPTTPRS

SEQ ID NO: 149373 - protein, 60 aa, Triticum aestivum
  unsure (1)..(60): unsure at all Xaa locations
  Clone ID: PAT_TA_43791.pep
MFSGDWTPPCGSCCTKKYATLVQIPWRVFCKKGCNADGDTWEECIGXCTEICYKDPAVED

SEQ ID NO: 149374 - protein, 66 aa, Triticum aestivum
  Clone ID: PAT_TA_43792.pep
SGDGGCSVTDGISNKQLLIFASATDGLWNCFNLDNSLGKNCHVHYQTGESESQYAYDNGMPKSKSW

SEQ ID NO: 149375 - protein, 104 aa, Triticum aestivum
  unsure (1)..(104): unsure at all Xaa locations
  Clone ID: PAT_TA_43793.pep
MMALSERQPQSEKKAPRARPMSGKAVFVLCATSFFVGLLLSGRMTVLTPPASGSHGGSRIALFSDDDCEHRRKLEEESNPNDVMNEVTRTHQAXIRSLDKVVSS

SEQ ID NO: 149376 - protein, 106 aa, Triticum aestivum
  Clone ID: PAT_TA_43794.pep
VRQLPPKKELILRVELTCIQTEYYKAMITEHYAELSKRGAGHVPIMTVKLDLRGPCCHGFMTAVPDTEPASPDDGLTRLLDYSGKMQLSHKMLEQLVEQRHIVLIY

SEQ ID NO: 149377 - protein, 134 aa, Triticum aestivum
  unsure (1)..(134): unsure at all Xaa locations
  Clone ID: PAT_TA_43795.pep
MLFPTKWSKPMARCLLLRRHLTAATATAAATAPLPARSAHRVLDRSAQTDRIQELARLGRLREAREVFDAMPHRSIFAWNTMISAYCHSGMLEDARSLVDAISGGNVRTSTILLSXYARLGRVLDARRVFDGML

SEQ ID NO: 149378 - protein, 57 aa, Triticum aestivum
  Clone ID: PAT_TA_43796.pep
LKEDPGSKWLFKTRYLLLTKGSWASVIHIMNAQNTKRHCIYIVIGCNLEVKIPPHLS

SEQ ID NO: 149379 - protein, 141 aa, Triticum aestivum
  Clone ID: PAT_TA_43797.pep
VRPRVRPRVRPRVRGSAMFTWHGNSSTYEQQQWAAKVAEFLKPGVTVKHCKEGTESSAFWFALDGKQSYTSKPIMQDTIVRDPHLYAFSIRKGRLEVTEIFNFCQDDLLTEDLMILDTHGEVFIWIGQCVEPKEKQKAFEV

SEQ ID NO: 149380 - protein, 108 aa, Triticum aestivum
  Clone ID: PAT_TA_43798.pep
QLTPVLPDVAGQEGDPAPAVTAPPRRRQLGPPLDEHQRCNVDGPAQTSCDLVQIATRSDEYQEAELQNPHWRDLEKGRRRDVKRVLPARGAPGSACHPPPPPLPRVGR

SEQ ID NO: 149381 - protein, 71 aa, Triticum aestivum
  Clone ID: PAT_TA_43799.pep
GEGLAVAPRNPLHRRQKRPTSLCRRISVAWTRRGARRRGSPWLSVGCSLGEVTAGAESGPRKSGAEPTNGR

SEQ ID NO: 149382 - protein, 54 aa, Triticum aestivum
  Clone ID: PAT_TA_43800.pep
MKKIFGAKKSQDPPPSIQDATDRIYKLGDTFDELIKELDAELSRYMEQYKNTRP

SEQ ID NO: 149383 - protein, 105 aa, Triticum aestivum
  unsure (1)..(105): unsure at all Xaa locations
  Clone ID: PAT_TA_43801.pep
VRAEPTLRRAHADHKEDHMPPMEAILAPLGSDLMLSRQDDYISFRRYNRVLHRLTKQKEAALLEAERTVLNAMSKAAMXVDCCEFXNQDSMNQIEICIEKNNILD

SEQ ID NO: 149384 - protein, 62 aa, Triticum aestivum
  Clone ID: PAT_TA_43802.pep
RLCRMFLRDFFFHKWVFNFIFKPLHAINSFGDIHAFGAKLSFGVAIMTNGNVLIGWKPPSFV

SEQ ID NO: 149385 - protein, 138 aa, Triticum aestivum
  unsure (1)..(138): unsure at all Xaa locations
  Clone ID: PAT_TA_43803.pep
SADAWVAQQIEHTHLLLRGLNLHLAQVGKXELGTVVFLHGFPEIWYTWRHQMLAVAAAGYRAIAPDSRGYGLSDQPAGDVEATWEDLVADVLAILDALFIHKVFLVGKDYGAMPAYDFALRHPDRTRGVMCMGIPFSP

SEQ ID NO: 149386 - protein, 72 aa, Triticum aestivum
  Clone ID: PAT_TA_43804.pep
GTFIDSNESCIHQIGVGFSENSYSDVKYALTSHNKQSQSSLHPINQLSQVGASHLHKTVSKGIPSNSISLTA

SEQ ID NO: 149387 - protein, 137 aa, Triticum aestivum
  Clone ID: PAT_TA_43805.pep
RPERLTYGHQSYHGHVHCQILCRNRRAIHHTTNLSCETCRPGVSIEVFFLAMHPPRPSKLFVRSVPDLGDSAFDEKPIVMAMVDDFFLIRVVMAFPRRLVTWEQKYDDYIYNPNRGILTRIPHPDGRIFYPGQVGLL

SEQ ID NO: 149388 - protein, 113 aa, Triticum aestivum
  Clone ID: PAT_TA_43806.pep
VRGRVGGRVGGRVGRNVTIVFFLKDPAKSGLIRFSRKQRKNNNMKIRRSKKKKNNIPISCRATHHSQHHYKAKRACPRLSVTVALLDQRRYPPETTAAPTKTFFVNAPSTLEA

SEQ ID NO: 149389 - protein, 92 aa, Triticum aestivum
  Clone ID: PAT_TA_43807.pep
SGKGKDPVPPLPPWVIPPPPPSPAGSSSPPPPPPTTPRHSEPGPSETGSRSRAPPPNSEPAAAGRGLRGATPWWRTRGRSPTRRRIRRSTTG

SEQ ID NO: 149390 - protein, 41 aa, Triticum aestivum
  Clone ID: PAT_TA_43808.pep
RPRNSWAYAWVLTMFPLYVTLIFLLGANGLTLRLPSALSTS

SEQ ID NO: 149391 - protein, 54 aa, Triticum aestivum
  Clone ID: PAT_TA_43809.pep
LYMTKNLPLKQHLVRDNNKYKIIFLFFKFQHSLNHRATHNQQEYKQHSTHASAD

SEQ ID NO: 149392 - protein, 52 aa, Triticum aestivum
  Clone ID: PAT_TA_43810.pep
NLLVYKCSASLRECALVTSSTQAVRALRFQAGITDQPVPPVHRNYPYTHCLI

SEQ ID NO: 149393 - protein, 75 aa, Triticum aestivum
  unsure (1)..(75): unsure at all Xaa locations
  Clone ID: PAT_TA_43811.pep
RPPTRPRTRGLRDTIKPVLISCYDLKSSXPLLFSRADALESGSYDFRLSDVGRAAWSEPGRFEPAEVASVDGVTF

SEQ ID NO: 149394 - protein, 56 aa, Triticum aestivum
  Clone ID: PAT_TA_43812.pep
MTHTFSRLSTHLSEMTCDLEIMSADNNTLQDQVQTKVSDPARVQETVAQLKRRIYY

SEQ ID NO: 149395 - protein, 105 aa, Triticum aestivum
  Clone ID: PAT_TA_43813.pep
VRLGEGFKLNMEVIRDVLGSCGYDMKKSMEELMSFSTKDLGKRPENEHIAVQDMAVESSFSMGSCLGSQYTSRFVLSSLCYWFIPFCSITNVTFCFIRHFSLRGW

SEQ ID NO: 149396 - protein, 146 aa, Triticum aestivum
  Clone ID: PAT_TA_43814.pep
SAHASGPVRVYMDGCFDMMHYGHCNALRQARALGDQLVVGVVSDDEITVNKGPPVTPLNERMVMVGAVKWVDDVIPDAPYAITEDFMNKLFTEYNIDYIIHGDDPCLLPDGTDAYALAKNAGRYKQIKRTEGVSTTDIVGRMLLCV

SEQ ID NO: 149397 - protein, 115 aa, Triticum aestivum
  Clone ID: PAT_TA_43815.pep
ILAAHRRMSAMHPIFKLLHPHMRYTLEINALARQSLINAEGVIESCFTPGPVSGEISSAYYRNHWRFDLEGLPADLLRRHDATQPHGIRLLIEDYPYANDGLLLWSAIGNWVERT

SEQ ID NO: 149398 - protein, 64 aa, Triticum aestivum
  Clone ID: PAT_TA_43816.pep
CCLWLKGYVDLSMRHCCIQKISSDLDIQEIKSERSAVRVTFFFCLSLKGFLKKKKTRETMVDSQ

SEQ ID NO: 149399 - protein, 119 aa, Triticum aestivum
  Clone ID: PAT_TA_43817.pep
RPPRRAAPPPDHRRRRRAPLIDDATCRRTSAPSGRRRRPASRARSTCRPRRGGRRRRRPRTGPMRSAPARRAAGVGMATASNSSPSLARSPWDRSTAASWMRTGGRAVSHGGTEFVRSG

SEQ ID NO: 149400 - protein, 147 aa, Triticum aestivum
  Clone ID: PAT_TA_43818.pep
VRFLPKMHTLVLTNNRLTSLAEIDPLASLPKLQFLSLLDNTVTKQPDYRLYVIHKLKHLRLLDFKKVKQQERADAAQKFHSKEAEEAAKKVAAKAYTPVVMDSQGTTKDQGPKVVAPTPAQITAIKAAIVNSQTLDEVTRLEKALST

SEQ ID NO: 149401 - protein, 70 aa, Triticum aestivum
  Clone ID: PAT_TA_43819.pep
FGHIRGIILHSQRRGELASSALAVAAVGPGCGKTCTPYRRTNGKPRTLNRRHAENPPEEKGWSPPAISPP

SEQ ID NO: 149402 - protein, 116 aa, Triticum aestivum
  Clone ID: PAT_TA_43820.pep
MARFLVALLATTLVAVQAGGQLGHAAPATAEVFWRAVLPHSPLPDAVLRLLKQPAAGVELLTEATSFVRDAEDRPPFDYRDYSRSPPDDEPSKSTGAASGARDFDYDDYSGGDKLR

SEQ ID NO: 149403 - protein, 140 aa, Triticum aestivum
  Clone ID: PAT_TA_43821.pep
VRKSGGRISHALSVYSCQLRQPNQVKKIFEFLKDGFHEVSSSLDLSFDDDSVADEKIPFLAYLASFLQENTSNPCEPPAGCLNFRNLVAGFMKSYHHIPLTPDNVVVFPSRAVAIENALRLFSPGLAIVDEHLTRHLPKQ

SEQ ID NO: 149404 - protein, 54 aa, Triticum aestivum
  unsure (1)..(54): unsure at all Xaa locations
  Clone ID: PAT_TA_43822.pep
KPAWLTHSTRGTYRTACVAXYMMQLQKTCLSTVLDELQSICIGKVRSFYLRLME

SEQ ID NO: 149405 - protein, 66 aa, Triticum aestivum
  Clone ID: PAT_TA_43823.pep
MKEATASGGGSTAGANDPRQPRTARPYAPPKLSAQDLPVDYADFLSGFFGVGDVMLQYKVCSWIVI

SEQ ID NO: 149406 - protein, 39 aa, Triticum aestivum
  Clone ID: PAT_TA_43824.pep
HSRWMFKVLYYLQWLLKIQSGWGLLVTFKKFRVFWIFPG

SEQ ID NO: 149407 - protein, 80 aa, Triticum aestivum
  Clone ID: PAT_TA_43825.pep
RDKTSTLTTNDITEREACICGKIKEVEKSSDTKSLFSELPASVMTMLSQSIFNNTGGDVVINQDGKREILGTPTEAAILE

SEQ ID NO: 149408 - protein, 116 aa, Triticum aestivum
  Clone ID: PAT_TA_43826.pep
MPAALSMVPACDAEEPLLAESSDRFSMFPIRFPQIWEFYKKAVASFWTAEEVDLSSDARHWDTTLSNDERHFISHVLAFFAASDGIVLENLASRFMSDVQVAEARAFYGFQIAIEN

SEQ ID NO: 149409 - protein, 136 aa, Triticum aestivum
  unsure (1)..(136): unsure at all Xaa locations
  Clone ID: PAT_TA_43827.pep
SDAFEPIPQYAAPDCTLQIFYIRVSEIGKDGLQWPLHVHGLVAARDSVNHKRNFLFNRTGDDWQTLTQXDPWLMLNGPSRALVLIDPIAFEVQLKVKSKTEPGKDELLAFKVFSYYKAFHSDEEVFTRCTCKRWTL

SEQ ID NO: 149410 - protein, 73 aa, Triticum aestivum
  Clone ID: PAT_TA_43828.pep
AVCGGVIRSLSISTRVIPSFTSHRDVVLPFFSCRRPAACYNGQRSLLAPPPAGVVPWRRRVMSSAAGCSPACT

SEQ ID NO: 149411 - protein, 81 aa, Triticum aestivum
  unsure (1)..(81): unsure at all Xaa locations
  Clone ID: PAT_TA_43829.pep
DLFRRNTKCRYTTXLLEQTHEERRRRLELLVQNSSNTNIHKCFRGRKAFELSRLGVRKNFGSTFAEHCQMVHRFCFSNNSD

SEQ ID NO: 149412 - protein, 34 aa, Triticum aestivum
  Clone ID: PAT_TA_43830.pep
LQTVKFAHACNQIKSIIWQHLETYSSDNLLFRKT

SEQ ID NO: 149413 - protein, 144 aa, Triticum aestivum
  Clone ID: PAT_TA_43831.pep
LSWYSSSGMSRCACNWSARLTEEHRDVCRIRPLHCSSEHLQRPLRVVHGVASCQLRRENLHHVMPTSSLSLSSFTGQVVGRPCSGCSCRRRCREDSPSSREMLGRGGSVVTGERIGAVGHEAAEAGEGRGGIGGDIGAVVGGGR

SEQ ID NO: 149414 - protein, 127 aa, Triticum aestivum
  unsure (1)..(127): unsure at all Xaa locations
  Clone ID: PAT_TA_43832.pep
RSRSSSVFFRRRRSPLQKPLACTCSDPRAPRPPRALXPCPCPVQSPPDLLPYEPPAWYEPCPPSPVLPPQEPPAXTEPCPPSLLXPPYEPPPWYEPRPVSPVDPSXSPRDLPSQPXPPPPPWARPPP

SEQ ID NO: 149415 - protein, 52 aa, Triticum aestivum
  Clone ID: PAT_TA_43833.pep
STHASVSTKVEMRLAKAEPVTWTSLDYTGKPKAPQKINVPGNSLRAECEQNC

SEQ ID NO: 149416 - protein, 136 aa, Triticum aestivum
  Clone ID: PAT_TA_43834.pep
VRPEHARAARSVAAWALPPPREQRRRPVAGSFSVLAAAAGGRPVVQRLVASSPLLSWSPVRRCDGRRLAMMDQEHLDFIMRHQHQGGMGFAPADRGDSEEALGSSESEPVGRPCGKRARCRRGAQPLREEAAVQDQ

SEQ ID NO: 149417 - protein, 103 aa, Triticum aestivum
  unsure (1)..(103): unsure at all Xaa locations
  Clone ID: PAT_TA_43835.pep
RPVIAAAEAKAGATIGGSAQSGTTAKGGAPVRNNGSGVNASSGEATASNVTAIPSVNQTRSAVSAXLHGNVAAPHRRGHPGKNHTAQGSLVHHDQQQSVNKSC

SEQ ID NO: 149418 - protein, 58 aa, Triticum aestivum
  Clone ID: PAT_TA_43836.pep
MGCIRERTTFFFLFKNCNDASSLLLMHGYADHQLQLKLYRHTSIFNCRTHVTMGGTNS

SEQ ID NO: 149419 - protein, 137 aa, Triticum aestivum
  Clone ID: PAT_TA_43837.pep
SAILSATISIVVLTVLLIGGSTSTMLEALHVVGDGNEGRRPSSLEDQENYEGNNNAGNIELGSEEGTSTTSKFKLKLQEIQKNTPSLAALDRNYLTPFFTSQNGDSDDDEHGPNREPRRSNELQDLESHGLPARETG

SEQ ID NO: 149420 - protein, 74 aa, Triticum aestivum
  unsure (1)..(74): unsure at all Xaa locations
  Clone ID: PAT_TA_43838.pep
QLTTPYAMLHQSHEGLYAGPSTGSTAARNTGSCIVQXPPSTSKFKLNGATVGTSRNTTTVCTTHSSXQLTPTFK

SEQ ID NO: 149421 - protein, 59 aa, Triticum aestivum
  Clone ID: PAT_TA_43839.pep
LAFVHASVGTRGYYYQILSRYIGVLTAGKQVCPWTYFSDWIRDLSFWVGKPFYPILFFA

SEQ ID NO: 149422 - protein, 148 aa, Triticum aestivum
  Clone ID: PAT_TA_43840.pep
VRGRVGVLRNPSPGATLLEPTNQSQTLKGSHRMQGFTGGSGALKELPNFSNISAEELLPQAEADRVDAMLKQLKHASEFHKRLFESAVSSIRTIAANHLWQLVVVRADLNGHLKALKDYFLLAKGDFFQCFLEESRQLMRLPPRQSTA

SEQ ID NO: 149423 - protein, 144 aa, Triticum aestivum
  Clone ID: PAT_TA_43841.pep
VRETLQLKELYLQQDNLIRDACAKLPPMLPNIETLAIESPWEVVDAPMLPTKFLYLKHLNINLRTGTTEYRPYDYFSLVSFLDASPSLETLELDVTQLRMLHKSIFADSQLRHMPEHRHSCLKSVKISGFSSWKCLIELTCYIL

SEQ ID NO: 149424 - protein, 67 aa, Triticum aestivum
  unsure (1)..(67): unsure at all Xaa locations
  Clone ID: PAT_TA_43842.pep
MWAFGVFFSLVACGVAVATYNGGASDFRDTPAFXESTQVQEFPGESELSGADVFEGIQLSCPALGGL

SEQ ID NO: 149425 - protein, 80 aa, Triticum aestivum
  unsure (1)..(80): unsure at all Xaa locations
  Clone ID: PAT_TA_43843.pep
GLRLYSCVRTCPAALNITFMVNDTLAPIENVHAVIERKAXTDSYLMMGTHLFDRSKAAFKASNFXACLLLLXQRMVQLKK

SEQ ID NO: 149426 - protein, 76 aa, Triticum aestivum
  Clone ID: PAT_TA_43844.pep
MAEAALEGSEPVDLTKHPSGIIPTLQNIVSTVNLDCKLDLKAIALQARNAEYNPKRFAAVIMRIREPKTTALIFAS

SEQ ID NO: 149427 - protein, 152 aa, Triticum aestivum
  unsure (1)..(152): unsure at all Xaa locations
  Clone ID: PAT_TA_43845.pep
VRGHSKGGAAKEATASADETEGYSKGATAKQATEEKVEEDGKGRSSKKASTADTPAKSRKRGNHNEELEGXAKTATTKETVDTTTQNGGTLVRSMSGKSDKEKADGDAESPTPTEEMADAQNGGTLALYKTEGEAHEEKMDTDANVKGTRKG

SEQ ID NO: 149428 - protein, 146 aa, Triticum aestivum
  Clone ID: PAT_TA_43846.pep
RSVDLFYVPFFSSLSLVVNPIRPPAAANASEAAATAGPSYSDEAMQDELVEWLERQSYWRRHRGRDHVFICQDPNALYRVVDRISNAALLVSDFGRLRGDQVSLVKDVILPYFHRINPFKGDVNVDSRPALLFFMGNRYRKEGGKV

SEQ ID NO: 149429 - protein, 92 aa, Triticum aestivum
  Clone ID: PAT_TA_43847.pep
RAPTGVADPQHTRKSPPPSSSAVPSSGQINAYALPSPTAVEATTTPDSATILHASINTRPSPRPAVVGLLDATPLHRCSRPLVPPADEPLQE

SEQ ID NO: 149430 - protein, 76 aa, Triticum aestivum
  unsure (1)..(76): unsure at all Xaa locations
  Clone ID: PAT_TA_43848.pep
MNMDIFCCRHGPVFILSQQMRALVLVDHTTRATLRDPSEPANTGLLSDLXDAYERLELLHADLLHEDCFNTPVKVV

SEQ ID NO: 149431 - protein, 133 aa, Triticum aestivum
  Clone ID: PAT_TA_43849.pep
RDRVVLLLEQEKVVPPLHSNGHLFPGHPCRKIKIKAPVHQRALPAQVGCCGRALAKQAASSNRAGPPARWASRKDDALLPLLSSRPRQGDLQHTGNGFVELWPRRRRMWLILAMLGVAAETLASHGDSGGRRT

SEQ ID NO: 149432 - protein, 114 aa, Triticum aestivum
  Clone ID: PAT_TA_43850.pep
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEM

SEQ ID NO: 149433 - protein, 47 aa, Triticum aestivum
  unsure (1)..(47): unsure at all Xaa locations
  Clone ID: PAT_TA_43851.pep
MTEVCDKAAVGHPDTLGDCPLSHRVLLTLEETKXPYHMKLISTHALC

SEQ ID NO: 149434 - protein, 122 aa, Triticum aestivum
  Clone ID: PAT_TA_43852.pep
MLGPPGTVDMEAEPEAAAALVALGLEPSASQLDVFKSRLHLLIDGNTSDFDTWVSLISSAEETSVNDIRVISLVYDTFLLEFPLCHGYWIKYAAHKARLCTYDGGGGVYEQAVQAVPYCTRL

SEQ ID NO: 149435 - protein, 70 aa, Triticum aestivum
  Clone ID: PAT_TA_43853.pep
RPPTCVQTLVNHMSRIIPRQLVLDVRNDHELGWLLVGVTIAHGGVFPNINAVLLYMKTDQMFPPALTQWL

SEQ ID NO: 149436 - protein, 50 aa, Triticum aestivum
  unsure (1)..(50): unsure at all Xaa locations
  Clone ID: PAT_TA_43854.pep
TIXGELFNXDDCCYYNLTAKFCSIFYLNNKEPGHTIVFTLLFGLYAGVLV

SEQ ID NO: 149437 - protein, 83 aa, Triticum aestivum
  unsure (1)..(83): unsure at all Xaa locations
  Clone ID: PAT_TA_43855.pep
PPVFPGDPRVRENYVTLSXHPLFMFTVYSSWMLGPFHHAPVLFPSPPFCLFLPVPSRLPFFLADAKAFASSQAPHSLHEVEED

SEQ ID NO: 149438 - protein, 47 aa, Triticum aestivum
  Clone ID: PAT_TA_43856.pep
WYLSSSITNQSMMRGGTPRSSLEYHIKRLGRVWLPVNCHTFNGYRTF

SEQ ID NO: 149439 - protein, 120 aa, Triticum aestivum
  unsure (1)..(120): unsure at all Xaa locations
  Clone ID: PAT_TA_43857.pep
RSEITFRSKDPRHSSEVVQQIRTLRRQVASRESERAXEWATLVTQEKLQQASNKTKQMRLNDVWIRPSFGGRGRKLTGTLEAHVNGFRYSTSRADERVDIMDGNIKHAFFQPAEKERLPF

SEQ ID NO: 149440 - protein, 114 aa, Triticum aestivum
  unsure (1)..(114): unsure at all Xaa locations
  Clone ID: PAT_TA_43858.pep
MANPRVFFDMTXCRPLVVRXIVMELYNDAVPWTVENFRALCTGXKGVGKSGKPLHYKGSAFHRVIPXFMCQGGDFTRGNGTGGESIYGEKFPDEKFVHKHTKPGILFMGNAGPN

SEQ ID NO: 149441 - protein, 87 aa, Triticum aestivum
  unsure (1)..(87): unsure at all Xaa locations
  Clone ID: PAT_TA_43859.pep
SAKVYIWSCGVVLFVLAAGYLPFNDASLINMYRKXYAGRMRCPYWFSPALLHLLRRILYPNPATRIDTDGILEHPWFRHGASGDCEL

SEQ ID NO: 149442 - protein, 146 aa, Triticum aestivum
  unsure (1)..(146): unsure at all Xaa locations
  Clone ID: PAT_TA_43860.pep
VRTADVXELTVDERNLLSVAYENVIGARRASLTIILCIELNEESRWIXAYVASIKEFRPRIETELIMICDGILKLLXDSHLDPSATATESKASYLEMKGDYHRYLAGVKSGAERKEAAVNTLXVAYKSAHDIXASLDLPTTHPIRV

SEQ ID NO: 149443 - protein, 64 aa, Triticum aestivum
  Clone ID: PAT_TA_43861.pep
GLTQVRSFAKEAAPVSAYHLLKGIFFEVKKKFETGLGVLKKEKITIDPNDPSAYANYAQGTRAV

SEQ ID NO: 149444 - protein, 31 aa, Triticum aestivum
  unsure (1)..(31): unsure at all Xaa locations
  Clone ID: PAT_TA_43862.pep
VDRDGLPTASGRSGHARTRERRXTCARXAMS

SEQ ID NO: 149445 - protein, 132 aa, Triticum aestivum
  Clone ID: PAT_TA_43863.pep
VCEGFFSLPMLPCSINTHKKFVRLLYTSRETRLIAMNQARRSDPCPRAAAAFSSHPLLSRGNDVGVAACSSASPLGSRSGEEIGWTHPARPLDCPLLQPQGPLPEDAEERNRLRVGMEKVGFMRTEAFFPRT

SEQ ID NO: 149446 - protein, 147 aa, Triticum aestivum
  Clone ID: PAT_TA_43864.pep
RPLLSVAPLAITNFEDSTLVACCTFLLELCGMCPNMLRLVIAALQRISSYYNLAQQNKQSELSSPRSTGLHVLSHGADIAPALARALAEDYVQSYHLQILEQMLTSRGPKREQPSQPFIAILEHLERASLPLLDECRTCGFWLLSGI

SEQ ID NO: 149447 - protein, 65 aa, Triticum aestivum
  Clone ID: PAT_TA_43865.pep
SADAWVLTVGASTINREFPADVVLGNGETFTGTSLYAGKPLGRTKVPLVYGENVGSNICEAAKLN

SEQ ID NO: 149448 - protein, 131 aa, Triticum aestivum
  unsure (1)..(131): unsure at all Xaa locations
  Clone ID: PAT_TA_43866.pep
MAPALRLLLAFLAIGSCTAADHXXLWAMPKTVSHGTQRLYVSNNATMSMAGSKYSDGKAILKDAFQRMLDLMKLNHNADGANPSSSLLTGVNIVVLSTQDELGFEVDESYNLTVPTIGEPLHAQIEASTVF

SEQ ID NO: 149449 - protein, 104 aa, Triticum aestivum
  Clone ID: PAT_TA_43867.pep
ATGTPVTTVSCRMKRPSLDAYIAFTTPIPAHHLLLITASCRKSRDRLPPCAAGLHLAWSVPSRHHFITKKGVKKNCWRRSCCSADLLRPRAAARDSLKVSLFSD

SEQ ID NO: 149450 - protein, 135 aa, Triticum aestivum
  unsure (1)..(135): unsure at all Xaa locations
  Clone ID: PAT_TA_43868.pep
RPRTRGHSGSLRSSAEFPTDRCLIELSAGSPASTYHYQSXTLRDLMLDCNYRCGGVEVVDSLRVGVYNCYITHFMTEGIAVRGCQXTFILNTFLGQHMTRGTDPGERLFGGTAIRLERNDNYVFDVVVFSAATGI

SEQ ID NO: 149451 - protein, 147 aa, Triticum aestivum
  Clone ID: PAT_TA_43869.pep
SAHASADAWGVIELDMWPNSAKDDISILHGRTLTTPVSLLKCLKSIKEYAFAASPYPVIITLEDHLTPELQDKVAKMVLEVFGTILYYPEEEHPKELPSPESLKGRVLLSTKPPKEYLEAKDGGAAKDGDAEQNPGKGTDDDAAWGT

SEQ ID NO: 149452 - protein, 78 aa, Triticum aestivum
  Clone ID: PAT_TA_43870.pep
LPIQQAQHTHLRPDLLPSRSPWGSSSLSASTTRQKHLWFYVSAVRQILHPFSGGRRGQPIFSVFSLPCYIFAPIPNRQ

SEQ ID NO: 149453 - protein, 97 aa, Triticum aestivum
  Clone ID: PAT_TA_43871.pep
YAHAHGQQKTNKSLLEEISLRADDIPTIRSRYNKKRRPMLTCLLAARIQSKLNFNKTIQKKSNVLLYMNRLSDYHTPTCFFYNMVQTVTMMRHELCG

SEQ ID NO: 149454 - protein, 57 aa, Triticum aestivum
  Clone ID: PAT_TA_43872.pep
LQDMLVFKKQSSFHIYKTFEALSCWVWNRFCFWFTVLLSIQRLLRTLKFLFLLHSHR

SEQ ID NO: 149455 - protein, 69 aa, Triticum aestivum
  unsure (1)..(69): unsure at all Xaa locations
  Clone ID: PAT_TA_43873.pep
RPPTRPPTRPPTRPGKLPVYQGLMEGYIGVAIPXLIQVLGPPESSCRDDLVVQTCPLAVHTIPLVVCAQ

SEQ ID NO: 149456 - protein, 121 aa, Triticum aestivum
  unsure (1)..(121): unsure at all Xaa locations
  Clone ID: PAT_TA_43874.pep
VRPSMTAXVTRFKCGGFRLGLAMNHCMFDGLGSLEFVNYWAEMARGATELTVPPFLDRSVLRPRDPPVISNPHYEFVEIADVSEMAVLYGREELLYRSFCFDPDRLERVRGLALADWDLEK

SEQ ID NO: 149457 - protein, 84 aa, Triticum aestivum
  Clone ID: PAT_TA_43875.pep
VVSTGSSQIASYLSIFNKKPTITYREIHDLSFCLVSTPAKTRQALLYSRAPRPSPCSLFSRRSSSVFSRFVEIDDRLGPRDRGS

SEQ ID NO: 149458 - protein, 123 aa, Triticum aestivum
  unsure (1)..(123): unsure at all Xaa locations
  Clone ID: PAT_TA_43876.pep
MVRKFFVGGNWKCNGTVQQGESIVNTLIAGQIASTDVVEVVVSPPYVFLPTVXAKLRPEIHVAAQNCWVKKVGAFTGEVSSDMLVNLCVSWVILGHSVRKSLMGESSVFVGKKMHCTPSRLVS

SEQ ID NO: 149459 - protein, 55 aa, Triticum aestivum
  Clone ID: PAT_TA_43877.pep
NTSSKEKGIVQHRKKRVKKLQHSFSFSSPPFFTFFPFTFPQADGTAPADSDHMRR

SEQ ID NO: 149460 - protein, 41 aa, Triticum aestivum
  unsure (1)..(41): unsure at all Xaa locations
  Clone ID: PAT_TA_43878.pep
GARIAVASRIMGGVFNSCRFHLAXXFSFSEFVNPIDHTKPV

SEQ ID NO: 149461 - protein, 133 aa, Triticum aestivum
  unsure (1)..(133): unsure at all Xaa locations
  Clone ID: PAT_TA_43879.pep
RPGKRFHSCCVVVKNMHRFIYAXIPSSSVFPRDTISWIEKNSTCSDASPSLRATLHELSFGLKIEVPEMLSDLNVSNFVMTPGKRNYAFERTDVPIGEQFVPKINFPYXFLGYQPTLRSEHFHVVLGTNNSAL

SEQ ID NO: 149462 - protein, 126 aa, Triticum aestivum
  unsure (1)..(126): unsure at all Xaa locations
  Clone ID: PAT_TA_43880.pep
VRPRVRSPFLERLMKRGYEGLGMVDAIDEYAVGQLKEFDGEKLVSATKEGLKLDXETEEEMKRREEKKALLDGLCKTIMDILGDKVDKVVVXSDRIWDLPFCLVSCDFCWTVNIERILYAHALLGQ

SEQ ID NO: 149463 - protein, 49 aa, Triticum aestivum
  Clone ID: PAT_TA_43881.pep
RSVNYLSNWEFRLKIYQLTNSLHWGMMLYMGAFYGYCGEHDLGYGLFIV

SEQ ID NO: 149464 - protein, 115 aa, Triticum aestivum
  Clone ID: PAT_TA_43882.pep
VRKDPGTNGFKVLQGGAGVWKKVEFERPNACSQVVAKHSLPANPWIQHFRSRDCSSSSSARGDGAQTSVGDLESGIRTVPGSTPLSHGRELGTCKGESLLDENSEVSDQNFVDDI

SEQ ID NO: 149465 - protein, 107 aa, Triticum aestivum
  Clone ID: PAT_TA_43883.pep
MAIDQQRRVKLMGSYGGRIERAQGRPSRYVDGEHLLLNVVSSVSTRGFRDLLAARAGFSDFSVKYCYSGEGLDSLCDVDTDEDLRDMLDMLLYRDLHVRLFNDMNTR

SEQ ID NO: 149466 - protein, 38 aa, Triticum aestivum
  Clone ID: PAT_TA_43884.pep
FRSSKLSNACMQRDSFLNSDHLQWKRACPFGLQLAQTI

SEQ ID NO: 149467 - protein, 139 aa, Triticum aestivum
  unsure (1)..(139): unsure at all Xaa locations
  Clone ID: PAT_TA_43885.pep
MCHMRRPRMWSGSYSDSVGMNVQKPGDDADAHSKSLYKILYVVSTAXHPEIQKAFHKAYLMFDPHMNPEDDEANEESQQLQKVIYIVGDHFKCDLYDETCKTVVLHWMKNRQTNXQEYFKTCFIKVSETVIEEFEDNFI

SEQ ID NO: 149468 - protein, 127 aa, Triticum aestivum
  Clone ID: PAT_TA_43886.pep
RQSCLDLAQLGCRPLSHSVYRLVLCRHLAFPSNTSSAWSWSAGDHIVSSASEDVWGASPVRILAYVLLSLCDCAVMAPLRSALPSKMLASLTRTGVMGFWLRSLCPIPAMMISVLSEPMDETHRKKE

SEQ ID NO: 149469 - protein, 95 aa, Triticum aestivum
  Clone ID: PAT_TA_43887.pep
MSGASGPLAVLLLVLVAAVSASSAGKGESWRAEQERDRVPWVPGQAFNASFAHYAGYVTVSEERGAALFYCFFEAAHDPASKPFVLWLNGWPDCS

SEQ ID NO: 149470 - protein, 55 aa, Triticum aestivum
  Clone ID: PAT_TA_43888.pep
VYIEFVGNSDKGFSIHHSGVYPTYLAHKFNILTSDQTECTQDVNKRTSYSIDSSG

SEQ ID NO: 149471 - protein, 73 aa, Triticum aestivum
  Clone ID: PAT_TA_43889.pep
RQALRGVHLMTQQELHLTFKPYQLPPRTIIPVNVTLFVIVFYSLHAVEANIRLDTILSRQAVEANFRREHYFI

SEQ ID NO: 149472 - protein, 112 aa, Triticum aestivum
  unsure (1)..(112): unsure at all Xaa locations
  Clone ID: PAT_TA_43890.pep
RSDIITAVMIAVLFAFGYDCRGCAKGLKLALTQVIATEIDPICALIALIEGMQILTLKDTLYDADIFATTTGNTNIIMDXHMGNQMKNIIICTIGYFIIQIDMNILKIYPGV

SEQ ID NO: 149473 - protein, 63 aa, Triticum aestivum
  Clone ID: PAT_TA_43891.pep
YNRRKLTMFWFKKPPPAYALKSDKTCVSSGMTLANGGSGVLDNTSQKVHPLAKQDKTFSMIYF

SEQ ID NO: 149474 - protein, 77 aa, Triticum aestivum
  unsure (1)..(77): unsure at all Xaa locations
  Clone ID: PAT_TA_43892.pep
SVYILRFLLELLHHTLAAGGVVSFIAEEFFXAIRTVXAFAQEPYEILRFVVNVNEILKLGLKQVLVVCLFFGGLNAA

SEQ ID NO: 149475 - protein, 45 aa, Triticum aestivum
  Clone ID: PAT_TA_43893.pep
RPLRHSPLVLSQDSSLSCQMREGQMLLSATCSTYYRNGRTYLCIM

SEQ ID NO: 149476 - protein, 125 aa, Triticum aestivum
  unsure (1)..(125): unsure at all Xaa locations
  Clone ID: PAT_TA_43894.pep
SAPFITLFPHSRALPVISFAEALEIHLAALADQTEKPFLMQPKVFLITKXADKAFRPGKAXSSFLMSVCLGIKTPXEAIDVTYIDKKCPFTGTFDIYXSIISVTRLSAKMYRSXIDRRNYLYFVK

SEQ ID NO: 149477 - protein, 70 aa, Triticum aestivum
  Clone ID: PAT_TA_43895.pep
RFQTLVPPPRAWPKLPRTGVLRQLPALSLAAPGITPRLGGRRLPSRRSLYQINKLEVSCNGCQREWCSER

SEQ ID NO: 149478 - protein, 77 aa, Triticum aestivum
  unsure (1)..(77): unsure at all Xaa locations
  Clone ID: PAT_TA_43896.pep
HLPSLNILFTFLPIFLCLTQNYIINSWSLRGFTLYELXSYFIPNNLSPTIVISFDHRRKNSSLEVMHSITLLTQYFT

SEQ ID NO: 149479 - protein, 59 aa, Triticum aestivum
  Clone ID: PAT_TA_43897.pep
QVPLHINYLLSPLLRTCLKAFITWGWAILLRFWCLMICLVHYFILLDYMLRVGNFYGHV

SEQ ID NO: 149480 - protein, 110 aa, Triticum aestivum
  unsure (1)..(110): unsure at all Xaa locations
  Clone ID: PAT_TA_43898.pep
VRSDQLQRLVVAQCRLTGVNPLAQEMAAGALSIKIGKKPRDLLNPKAVNSMQSLFAVKDTLGKRETCEFSALCGLTGSKVREFFASQRTRVXKAVRLSREKALILCGFHD

SEQ ID NO: 149481 - protein, 53 aa, Triticum aestivum
  Clone ID: PAT_TA_43899.pep
WGGILSSSNPNTYIHHFPSIPSTMLRGVRRFFRGRAVFRARRTTLLFQGQCPS

SEQ ID NO: 149482 - protein, 91 aa, Triticum aestivum
  unsure (1)..(91): unsure at all Xaa locations
  Clone ID: PAT_TA_43900.pep
RPWTRGRSYISGYQASKDDXGGYSVFLVAPPSTCTNVARWFNHIDALLKLFGVIVVGQGVKVLSLVVPVTSTTDVVEAPASDDDDDSDVDL

SEQ ID NO: 149483 - protein, 39 aa, Triticum aestivum
  Clone ID: PAT_TA_43901.pep
MNEACDHEREPQVVWIHPPSMDCVCTHILKNGSLSLART

SEQ ID NO: 149484 - protein, 116 aa, Triticum aestivum
  Clone ID: PAT_TA_43902.pep
LGCQMRRGKKFTMGRRYHLTLLSVFSFLLLTGLLAAHQSRGKKAGKIVTLTVLFPAAGSPPGEKIKISAHYVDEHGARERHFNLDCDDDEPLGFGMKYLLSTLEGIRDARESRSEL

SEQ ID NO: 149485 - protein, 111 aa, Triticum aestivum
  unsure (1)..(111): unsure at all Xaa locations
  Clone ID: PAT_TA_43903.pep
VRKYADKLGPGFQEYSKTYPENYCLSQLIYWYSQNAXPESRLTRARKGCMSLPDVSSFYVKSVKPTQERVYGTRTVRFMLSRMVSATSSRLMHLSDGVFLSGCCGSTWSYM

SEQ ID NO: 149486 - protein, 58 aa, Triticum aestivum
  Clone ID: PAT_TA_43904.pep
DFEGRSCSPAIPTCLWRPRYHRRRGAAFTSCCRESRMRLYRSELVLLVGKKGAMIPAV

SEQ ID NO: 149487 - protein, 43 aa, Triticum aestivum
  Clone ID: PAT_TA_43905.pep
LPQMVPITSCSSRFQSNSSKCSSHSLKPPYRLNQRSISVSDAW

SEQ ID NO: 149488 - protein, 139 aa, Triticum aestivum
  unsure (1)..(139): unsure at all Xaa locations
  Clone ID: PAT_TA_43906.pep
VRPRVRQPVLDQLARLFAQLHVQQXAFIDSTPFIKTLVLDNGVQQDSHEFFTLFLSLLERSLSYSKVTVAKTIGQDLFRGSVSHVTRCSIWGRDFEASSNMEDFYELELNIKGLSXLKESLDDYLRVEALNGENQYSCE

SEQ ID NO: 149489 - protein, 143 aa, Triticum aestivum
  Clone ID: PAT_TA_43907.pep
AQPFFLLTLSSPHKRRGRASELVLRDAPARARPFRSAPRSSSSLAPLARSQAPLSGLVAPTSQSLCPPSSWGPSSMSRTSVVRRSFNYYFRSNPGGLSDNARITSSPLATAHSRVNPSHSDPPSCSEQLLNTYVSRAFPTERT

SEQ ID NO: 149490 - protein, 100 aa, Triticum aestivum
  Clone ID: PAT_TA_43908.pep
MAQAVEEWYRQMPIITRSYLTAAVLTTVGCTLEIISPYHLYLNPKLVVQHYEIWRLVTNFLYFRKMGMPMNNNEAHLLSLVQVQGLVKFDRMAWRRARFA

SEQ ID NO: 149491 - protein, 38 aa, Triticum aestivum
  Clone ID: PAT_TA_43909.pep
MAVTDYRCFAGDLGWGADDHNLQHAFIQYGQILCLQYH

SEQ ID NO: 149492 - protein, 116 aa, Triticum aestivum
  unsure (1)..(116): unsure at all Xaa locations
  Clone ID: PAT_TA_43910.pep
MSRGGSAGGGQSSLGYLFGDGEPAKPAAAPAAKPAPAEKPALAAADVTKQIPAGIPGSRANNYYRADGQNTGNFLTDRSSTKVHAAPGXGSSLGYLFGGKGSLLRCCDEIALYLCY

SEQ ID NO: 149493 - protein, 120 aa, Triticum aestivum
  Clone ID: PAT_TA_43911.pep
MDSPARNMTDSMPGEKTAAPAARTEQVKSEAHGDTLPLSGNKRRREEVTATDGHDGAATVSNPRAPSGFDPRSPRSPVPDTHDGDSADWKAAQKILEGLVTPSRERHFAASKPSDVVASS

SEQ ID NO: 149494 - protein, 122 aa, Triticum aestivum
  unsure (1)..(122): unsure at all Xaa locations
  Clone ID: PAT_TA_43912.pep
RPKEVDSSVIQDDNSRFHLNTGSXLLECDCNNSEKALITREIVTSEEIITRTLDPDSALASRDALAKTLYSRLFDWIVEKINGSIGQDPDSKQLIGVLDIYGLESFKINRFEQLCIIYTNEM

SEQ ID NO: 149495 - protein, 66 aa, Triticum aestivum
  Clone ID: PAT_TA_43913.pep
VMLRPEATNVSYQAATQERLWHAPPVQVVEGSLIGEDSRKPTDEQSYLLLTSAPTLTFAPEHTPGG

SEQ ID NO: 149496 - protein, 53 aa, Triticum aestivum
  Clone ID: PAT_TA_43914.pep
GQSYTNYVYWKRIYGTDLLNLVSCFGALLSVLLAINHCVIYWIFPLFYFVLYH

SEQ ID NO: 149497 - protein, 84 aa, Triticum aestivum
  unsure (1)..(84): unsure at all Xaa locations
  Clone ID: PAT_TA_43915.pep
ASVPEDVKANKRYPGSSKWTVKEGAETVKDDFRSIDILVHXLANGPEVTKPLLETSKSGYLAAVSAFKYSFISLLYHFLSIMNP

SEQ ID NO: 149498 - protein, 128 aa, Triticum aestivum
  Clone ID: PAT_TA_43916.pep
LRYRGAVPGLPGGPTHFRTRGRRVPVNPKSSYIKLTAKEDAVTGFPMDPLVGDNGHVRRVPLMNARRSSYTLVRSSGTDPNAQRFYTSHIASAEMSNPSVGTGQARQLLGSLFNLGDRRLVNKDFKKS

SEQ ID NO: 149499 - protein, 94 aa, Triticum aestivum
  Clone ID: PAT_TA_43917.pep
VRPCVRSKRGLFFFFFCGVIGVEHMLADPRNPNPSPPPPPGFSSFALPAGGSYFPLPFHLEEQYPVATYQYQHVYHAQSSFFRGPAIHLPPRRL

SEQ ID NO: 149500 - protein, 52 aa, Triticum aestivum
  Clone ID: PAT_TA_43918.pep
MKLIAAYLLAYLGGNSYPSAVVVKNILDSVGAVADEEKLGFFLADLKGMDIT

SEQ ID NO: 149501 - protein, 98 aa, Triticum aestivum
  unsure (1)..(98): unsure at all Xaa locations
  Clone ID: PAT_TA_43919.pep
ALRSRAGAEMGLTFTKLFIRLFAKKEMRILMVGLDAAGKTTILYKLKLGEIVTTIPTIGFNGQTVYYINIIFNVWECRLVEXIRPLWRHYFHYTQGLI

SEQ ID NO: 149502 - protein, 105 aa, Triticum aestivum
  Clone ID: PAT_TA_43920.pep
SADAWADAWATHAAAAGATHRPACLTQTSPPAMAFPNSRRSDPLPLPSPYHKTREEKREGNRSRLSRSGGDNGAPRPASARVVELGWAAQSRMSRNEGAVGRLPC

SEQ ID NO: 149503 - protein, 60 aa, Triticum aestivum
  Clone ID: PAT_TA_43921.pep
FLVLFIICELPAVVYILWICNNLYLVLLIGSSMLLSKSPLAPKFILKKRLTRYGFKCRGR

SEQ ID NO: 149504 - protein, 66 aa, Triticum aestivum
  Clone ID: PAT_TA_43922.pep
SLLISISRDHYLDIHDHMGDHTACLPDCLISWLLSRSLLLLLLLLWIPLLMFFKNWELDSGTRRRT

SEQ ID NO: 149505 - protein, 49 aa, Triticum aestivum
  Clone ID: PAT_TA_43923.pep
AWNGGGVIGLPLGYAGVSLPAYGGDSMDRGNPLKPLGIRCLVPAHASAD

SEQ ID NO: 149506 - protein, 138 aa, Triticum aestivum
  Clone ID: PAT_TA_43924.pep
SACFSLDGASTRSSRYPRPGWSSCPSPSWRRGARATRAVPGLTPDGAAGDEGGTVFDAGLKYLEAVNDNVLVYPRFITDPFTISLDTILRRVAAHNHRRRWCCGIIRAVQSHTLAFLSTGMTWTFVWRWTGTLSEVTY

SEQ ID NO: 149507 - protein, 101 aa, Triticum aestivum
  unsure (1)..(101): unsure at all Xaa locations
  Clone ID: PAT_TA_43925.pep
MAAILLLIPSFNRVLVDKVVQPKKSAGGILLPVTSKQLNSGKGIAVGPGSRDKEGKLIPVALKXEGDHVLLAEYGGLEVKLASEKEYLLYRDDYIFGTLHE

SEQ ID NO: 149508 - protein, 90 aa, Triticum aestivum
  Clone ID: PAT_TA_43926.pep
IRFNVRGKVAQNPAFAPPENPTARRNLRNPSPEADRPILFIRGRENQRRTEDPWPPPAHRRRRHEPARLLPKQQTARTRGGTPRPRVRGR

SEQ ID NO: 149509 - protein, 110 aa, Triticum aestivum
  unsure (1)..(110): unsure at all Xaa locations
  Clone ID: PAT_TA_43927.pep
XIRHFECLCSISALLTMSDVRVGEPLSKQLNIDPIVRTDHSRDLPATVLFPHRCDCPEDSVLVIPREANLPIDREAKMVVARVSHAVVGVASITVYGDHMWRAFRLYCRI

SEQ ID NO: 149510 - protein, 143 aa, Triticum aestivum
  unsure (1)..(143): unsure at all Xaa locations
  Clone ID: PAT_TA_43928.pep
VRPDSLLLIFFLTHPGAFFREPLRKGRWLFSPATADAAPAASAATGAAGANXSPTWRPPPAPTPWSCPPPPTRGAPAGSRWPAERPAAATAPPASAAPRAAAPAAAATEPAPMRPSGXGEHEDEEDNWTSNXXPPPPPSLADA

SEQ ID NO: 149511 - protein, 57 aa, Triticum aestivum
  Clone ID: PAT_TA_43929.pep
NLGRRSGVVVVGPLGLVGGLRRLWCGVLLLLRNENVSPPLLVWARRTFAFVLSMGVR

SEQ ID NO: 149512 - protein, 130 aa, Triticum aestivum
  Clone ID: PAT_TA_43930.pep
SLSVRSGSWSACTTMLPLPLLLFISEQSLSVFFRCTLFAPLSISHLEHTPPCFSDQPHTPREERFEEGTPGAAKVRPWLPRLQDLAPPALTEGGRRKGERRSEEEGGEAGQPGRWCVQLKWWQPHSDSGR

SEQ ID NO: 149513 - protein, 111 aa, Triticum aestivum
  unsure (1)..(111): unsure at all Xaa locations
  Clone ID: PAT_TA_43931.pep
MPRGGLPGAVSGMGSSSADPDKLMAMAVKLTYLLFTRRYAGRKSATVLGQHAAIAHRSRRDXEKATDSFGKAARGLETIXSPRDAAKHSENAGATAQELGLWNAIPNFYRI

SEQ ID NO: 149514 - protein, 146 aa, Triticum aestivum
  Clone ID: PAT_TA_43932.pep
VRARFLAAKPSVFLPPFLGHAVTPACFGIHPWLGQGSSRYIHLCVHLLPATLLRLARRCTDGQRGRLWDGQTLATWMSFVGERPGSALSFHSGRHASRGATARWAGVAGARNPPSPRSWADSPGSRTDWKSSTTRSSRCLSTPGAP

SEQ ID NO: 149515 - protein, 87 aa, Triticum aestivum
  Clone ID: PAT_TA_43933.pep
LPHLIVSGDQRHWGEVITPGVLFLYIAGWIGWVGRSYLIAVSGEKKPAMREIGLAFPPHSVLGSRSGSVPVGSFGFMYREQEGMADV

SEQ ID NO: 149516 - protein, 145 aa, Triticum aestivum
  Clone ID: PAT_TA_43934.pep
VRPRVRPRVRPRVRGRVGANSSGSGAAPGSGSGPLWWVSDCHGAWYSLAVMLPSLAFVGFLAWQARRSFRRLSYGRSHVVVVAYYALLWAVALLNLLWCFLQAWQCMPDRAFSWNVFSLFTKPGMLFLEVSLIAILLQGNRNQWF

SEQ ID NO: 149517 - protein, 103 aa, Triticum aestivum
  Clone ID: PAT_TA_43935.pep
RPGGPTYGRHITSRPPSAQLLRSGLSLPPSRRPPQSTQVAAPRQLSSFVSSRLAPFQSLPPARERDRSPRTLDPDGLAPPHPPQGHHPRRQRGWEDVLDEPVS

SEQ ID NO: 149518 - protein, 94 aa, Triticum aestivum
  unsure (1)..(94): unsure at all Xaa locations
  Clone ID: PAT_TA_43936.pep
PHSHQRTGTRTLADRKALVPRKKCLTRPVKXAGLQFPVGRISRYLKNCRYTQLVGSGAPVYQAVVLXYLPALLVXLAGNAPMVSWRSRIIPPHL

SEQ ID NO: 149519 - protein, 122 aa, Triticum aestivum
  Clone ID: PAT_TA_43937.pep
RLSGIASPHHRSRQRSPSAALRTTTSRLPPCRSTERRSHDPPSRCSTQQQHRPLLLVAASPSSIMARPEVLVGSQPRGKRSSLEPCSRYQLLEFCPQDRSHQIPMNTHTQKLLPKARVVRRT

SEQ ID NO: 149520 - protein, 142 aa, Triticum aestivum
  Clone ID: PAT_TA_43938.pep
MPIVKVGRMAGQFAKARSNPIETRDGVTLPSYQGDIINNDDFDEKSRAPNPQRLIRAYSQSASTLNLLRAFAHGGYADLQRVTEWNLDFLRHSTQGDRYGELAQRVHDAIGFMLAAGLPPQHPMMTTAEFWTSHECLHLPYE

SEQ ID NO: 149521 - protein, 118 aa, Triticum aestivum
  unsure (1)..(118): unsure at all Xaa locations
  Clone ID: PAT_TA_43939.pep
RPLMVLTLEWSSACRTLSPVADCEILENLQPHQISMELHIVRYIGTTAPSWVQLASLMELNSLHLVNCLSLGKLPALVLLSSLKKLHIEGAVQWLSVIGHXLHGTGDMAFTFPKGLLS

SEQ ID NO: 149522 - protein, 117 aa, Triticum aestivum
  Clone ID: PAT_TA_43940.pep
MGFESSAETERFLCERLLDAAQPIAERFRALFSLRNLRGDGPRRALLQAARDPSNLLAHEAAFALGQMQDAEAIPALEGVLKDLSLHPIVRHEAAEALGAIGLEKSISLLKEKLLAD

SEQ ID NO: 149523 - protein, 101 aa, Triticum aestivum
  Clone ID: PAT_TA_43941.pep
RSWTHVLTRGLLFKPYPIIPIRAAAAPLLLSPFFPLLPSPQSQPRGFAFRFYEIHHLPRFLSVPCCEEAAVGGVTSVRDMLGGGAQPVRLLPVGGKLSMRA

SEQ ID NO: 149524 - protein, 146 aa, Triticum aestivum
  Clone ID: PAT_TA_43942.pep
SAHASAHASVEKKDGAEKANGEGYHRTHMAAGTDHNWGHADLGLKTLGLEKQETESAGTLNGNGKTVNKVPPYSKPYKATSEKSAEEDNNGLYNRARHMGEFGQPVQDRQQMPEKLVNMRPPYVKPNSSTKPAHENPTDQAAANGY

SEQ ID NO: 149525 - protein, 84 aa, Triticum aestivum
  Clone ID: PAT_TA_43943.pep
SAIEKVINPSILNQEHGSFQSSCILHFESGTTWAFPRRAQDELLQLPIDLPLPLQSSSHNGFLGVRRGPGTEGARQGSGVLMEV

SEQ ID NO: 149526 - protein, 75 aa, Triticum aestivum
  Clone ID: PAT_TA_43944.pep
ALSGHPRGTPKEAEQPGMAARSAPCAAASPASRNSPAAAPSPAAGSHISSQHMAACPGPKTHAGGCYRPLGLART

SEQ ID NO: 149527 - protein, 77 aa, Triticum aestivum
  unsure (1)..(77): unsure at all Xaa locations
  Clone ID: PAT_TA_43945.pep
SSADAWVEIVNHLDGFDARGNRKALMATNRPDTLDPALLRPGRLDRMVDIGXPVLEGRTQIFSNHTRTMYLELDILL

SEQ ID NO: 149528 - protein, 93 aa, Triticum aestivum
  Clone ID: PAT_TA_43946.pep
RPRTLGGKRIHLSVGANPSHLGDVDPVVIGKTRAKQYYCNDDDRTKNMGILIHGDVRFAGQGVVYETLHLSALPNYTTGGTIHIVGNIEVTFI

SEQ ID NO: 149529 - protein, 107 aa, Triticum aestivum
  Clone ID: PAT_TA_43947.pep
MAQAWAFLLPVLVFGSYMTSLFFPTYISGPLCGGDGGGRSLFLCAQAPKDQDPSPAVSTMYKTAFHFQPAKNWMNDPSGPMYFNGFYHEFYQYNLNGPIFGDIVWGH

SEQ ID NO: 149530 - protein, 82 aa, Triticum aestivum
  Clone ID: PAT_TA_43948.pep
MEGLLHKLKGLDAYPKVNEDFYKRTLSGGVVTLLSALVMLLLFVSETRSYYYSATETKLVVDTSRGERLRVNFDITFPSIPC

SEQ ID NO: 149531 - protein, 71 aa, Triticum aestivum
  unsure (1)..(71): unsure at all Xaa locations
  Clone ID: PAT_TA_43949.pep
LVGDPATMGKLERLCKTTTVRTWYTVLSKDLLDEHPVLKTDGTTTLXPLLDICNAAVLVLCAVCMFVPALV

SEQ ID NO: 149532 - protein, 137 aa, Triticum aestivum
  Clone ID: PAT_TA_43950.pep
SAKLAMEMGVGMIAKTAAEYEKRRENFVKEIDIVIADVVMAIVADFMLVYLPAPTVSLHPPLARNAGLITSFFHNCPNNAFQIALAGRSFSFLQRLGAIVKNGAKLLAVRPGASLVGTGVTNAPIKAWKAVDKDLVH

SEQ ID NO: 149533 - protein, 69 aa, Triticum aestivum
  Clone ID: PAT_TA_43951.pep
ISTSRRYTEYTNTFSMVTVASLVTESIFRNGAPEKLSDNLSNNILHEYPPQGCERSIIVERQHICCLER

SEQ ID NO: 149534 - protein, 109 aa, Triticum aestivum
  Clone ID: PAT_TA_43952.pep
VVARRRRHCLFSVRHHGPLQHLHQIGRIDPRLPLQLTTVTEGVVLRSLQHVQRRHVSWGRPIRDARGASWAVQHGSSEAAIGGCRATGSEQSTKKSRLDSAASVRSPPH

SEQ ID NO: 149535 - protein, 79 aa, Triticum aestivum
  Clone ID: PAT_TA_43953.pep
FSSVQLIKDHFVMQAPANWLIYVLCGRSSKPHDGRNRALRGGTRRRWGIAADETSVLGWERGDCEEETAAHASAHASAD

SEQ ID NO: 149536 - protein, 122 aa, Triticum aestivum
  unsure (1)..(122): unsure at all Xaa locations
  Clone ID: PAT_TA_43954.pep
VRHALLAFTLGVKQXICCCNKMEAPTPKYLKARYEEIVTGGFSYLKXGGFNHNKDSLSPIHGFGGGNKIWRFTNLDWYKGPTLFGGLDQINEPKRPFDKPLGVSLXDVYKIVGIGNCAVGRC

SEQ ID NO: 149537 - protein, 142 aa, Triticum aestivum
  Clone ID: PAT_TA_43955.pep
VRDAANVSNYKRCITDFTISACDQRSNHDELWSMNIRGSAFLWHQVRCMVAVLFLVGQGLESPCVVDSLLDITKTPRKPQYTMAPELPLILRSCLFDGVSFMCSSDASQALIEHLKDEYHQYMFQAAIFDEALTCLSIPEPN

SEQ ID NO: 149538 - protein, 91 aa, Triticum aestivum
  Clone ID: PAT_TA_43956.pep
RPRTRGFFFYFFFIFFLFSRKDTLTSVNLKLSVPPPQVEYFILGDGGSTKVSLIQSDLIVILNVVRTRGQKTSLAHYSCAYRSRQPLLLIT

SEQ ID NO: 149539 - protein, 73 aa, Triticum aestivum
  Clone ID: PAT_TA_43957.pep
CRHPFSNSGGILPFLLAEYQVICYRDRHVLCLGENFTSESVGMGLTLNSEGAALGDIRWHFRRALAEQQGEIG

SEQ ID NO: 149540 - protein, 53 aa, Triticum aestivum
  Clone ID: PAT_TA_43958.pep
SADFHDKLYDLANVVATLANDDDKTGAADEQPGLLHIDVRRYIHLGKLLPSIW

SEQ ID NO: 149541 - protein, 38 aa, Triticum aestivum
  Clone ID: PAT_TA_43959.pep
RPVLISMVSMIHDEYLKYPTWCGGYTSGVNLLCKSSGM

SEQ ID NO: 149542 - protein, 81 aa, Triticum aestivum
  Clone ID: PAT_TA_43960.pep
SAHASDRITATFFTLDHAGLRVILPRLKPNDETQGTLRSCASPSQHVKEKWANNQFLTSICYGRGAVMETIYLLSAVWKSY

SEQ ID NO: 149543 - protein, 69 aa, Triticum aestivum
  unsure (1)..(69): unsure at all Xaa locations
  Clone ID: PAT_TA_43961.pep
NNSIESINLTDTWXALGDSQNVLYTTRHVPLITITLSKXKSWITSSFVLPLPIPAXDQVRPPTEFDQYA

SEQ ID NO: 149544 - protein, 136 aa, Triticum aestivum
  unsure (1)..(136): unsure at all Xaa locations
  Clone ID: PAT_TA_43962.pep
RPPTLTPTCSSTRTGEDDMEDGDGERKSRMLHMFXKTLTASDTSTHGGFSVPRRAAEDCFPPLDYQQVMPSQELVAKDLHGAKRRLRHIYRGQPRRHFLSTGWSSFVNKKKLVTGDAILXLRGDDGELPLGARKSH

SEQ ID NO: 149545 - protein, 124 aa, Triticum aestivum
  unsure (1)..(124): unsure at all Xaa locations
  Clone ID: PAT_TA_43963.pep
MPLSCRLINFAMVDGGIYRSGFPADANFRFLKSLNLRSIVYLCPVPDPETNTGFLEKNGSKLHHFGIEGRKEPSVGIPDEKXREALKSCPICKXYSLVIHWMKGEHQTVCVVGCMKKLQKSVLS

SEQ ID NO: 149546 - protein, 79 aa, Triticum aestivum
  Clone ID: PAT_TA_43964.pep
MCPPLGTPTEMNYSISDSWSDEELVRFLAERKAEDSLPENVLVGMGLTLIHPLDSYPGNIWDLNQTDDQHPFGDGRGRY

SEQ ID NO: 149547 - protein, 102 aa, Triticum aestivum
  Clone ID: PAT_TA_43965.pep
SKRNANSGGDLRPPEVERWQPATGRRRGRRCRRPSAGARPSRAGGRRGPPPRAAPRAAPSRRPRPTPSAAPAPSPPPTARTPSAPQPGAGAGLWIAAHASAD

SEQ ID NO: 149548 - protein, 45 aa, Triticum aestivum
  Clone ID: PAT_TA_43966.pep
MSGIPTCCLLRAMQPTRSLLHWTNDLHMIFVEAVEYQGGPYGLVS

SEQ ID NO: 149549 - protein, 80 aa, Triticum aestivum
  unsure (1)..(80): unsure at all Xaa locations
  Clone ID: PAT_TA_43967.pep
RPPTRAYTQATDLLYDHMSGSWCSPAIPMEHADELNDIXICDAWILLMYTAEYSNGWQTVDISTDMAIRAASSRTREHAC

SEQ ID NO: 149550 - protein, 76 aa, Triticum aestivum
  unsure (1)..(76): unsure at all Xaa locations
  Clone ID: PAT_TA_43968.pep
MGDRAIHPSVMQKFVGQFHLVSSFSEVVRARNICPSVPSYERRFTXSSYMTQNRLINAPYMASFSKFANAPPEKNR

SEQ ID NO: 149551 - protein, 59 aa, Triticum aestivum
  Clone ID: PAT_TA_43969.pep
ILCLLGMLISCTLRCIGRGLRIACDNRVLPIGILFCILMYSIPTFYDRGIFLHDLDWLS

SEQ ID NO: 149552 - protein, 121 aa, Triticum aestivum
  Clone ID: PAT_TA_43970.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYDGVPAPYDRTK

SEQ ID NO: 149553 - protein, 51 aa, Triticum aestivum
  Clone ID: PAT_TA_43971.pep
IIVQQCTLTALPCGGPAAQSDNSYLLARVDLVGVIKDHFHIVRVSPCKARS

SEQ ID NO: 149554 - protein, 110 aa, Triticum aestivum
  Clone ID: PAT_TA_43972.pep
VRPRVRGDRCGCRCGCGSFLPDPAACSSSTLKPPFLLSNPIFEPITIRALSNLLEVFGEGSVDYQGYYQSVDSGFTRGLVEGKSLFLNSLGSLCSVVHSDSLHRAEHGRS

SEQ ID NO: 149555 - protein, 133 aa, Triticum aestivum
  Clone ID: PAT_TA_43973.pep
FADAFSITPVWTLRVRIGAAGPGRAPCPGRTSALEKAIRWFGDKPGSIVIVPALGTSFDALGEAYDFYNLCSWEKGFGIRYGKSRLNVERTKCMQEIVCGCAGKPGGENTISCRCECPTLIRLFLTKDIVWFI

SEQ ID NO: 149556 - protein, 144 aa, Triticum aestivum
  Clone ID: PAT_TA_43974.pep
VRGRVGSESDVSWDSDQEEVTRMKPAQKWDDLISRVVNSGSGLLLTTYEQLRIIREKLLDVEWGYAVLDEGHRIRNPNAEVTLVCKQLQTVHRIIMTGAPIQNKLSELWSLFDFVFPGKLGVLPVFETEFSVPITVGGYANATP

SEQ ID NO: 149557 - protein, 57 aa, Triticum aestivum
  Clone ID: PAT_TA_43975.pep
VRPRFLPRVRPRVRGRVGAQRATLALDRTKSVHRLSMVPSTFPRALLAVFLVLLVVG

SEQ ID NO: 149558 - protein, 102 aa, Triticum aestivum
  Clone ID: PAT_TA_43976.pep
MATSHFLAAAAAAATSSSAAAFRPPLRFLSLPPPLTLSRRRPFPVICAADADAKETTNPKVPEKAPAAGSSLNQLLGIKGAKQEDNIWMIRLQLTKPVTWPP

SEQ ID NO: 149559 - protein, 61 aa, Triticum aestivum
  unsure (1)..(61): unsure at all Xaa locations
  Clone ID: PAT_TA_43977.pep
MAYPSVLDGIAQGPEDPILGVTVGYNKDPSPVKVNLGGGAYXRTEEGKPLWLNVGRRAEQM

SEQ ID NO: 149560 - protein, 141 aa, Triticum aestivum
  Clone ID: PAT_TA_43978.pep
GATPSGSAGSEISYHADTTLKTNSHSITSVAQLSSSSSSGDSVYRSFRGDSFRDISDLQAAVSETATDLSGTFGGGGGEDARCLAAASISAPRRPPRAVADHHQIHCGAAAGGCCGGATLVAALALPLGWKPTRPRTRGRT

SEQ ID NO: 149561 - protein, 137 aa, Triticum aestivum
  Clone ID: PAT_TA_43979.pep
VRGRVGGAPAEFPLQELYQLLLAGGCFTCVDVLRCSQPFMKKLRDVVADMLNRGSYREAIGVILAFDLQEAFPLDGVLSYIVDKVVRNRKEQESEVECDLAGSKKRDEEELILWRSISRYVQERTPSFSEMSCPSLA

SEQ ID NO: 149562 - protein, 68 aa, Triticum aestivum
  unsure (1)..(68): unsure at all Xaa locations
  Clone ID: PAT_TA_43980.pep
MATGGVHGFDHGRLRRSPEAVDSQACHRPSLLRXRAFKQEAGGDDEKPNEPRKRRKGPVYTLKELCRG

SEQ ID NO: 149563 - protein, 59 aa, Triticum aestivum
  Clone ID: PAT_TA_43981.pep
RPMMTATPNSPQDYSILTSKPPNVQAALRILQQHQQQQQHQLCMARSGTKPTMGMGGLS

SEQ ID NO: 149564 - protein, 78 aa, Triticum aestivum
  Clone ID: PAT_TA_43982.pep
MTNRYLQGMLHPTTMFVRGKVGKGLGKGGAKLHRKVLRDNIQGITKPAIHRLARKGCVKRIFGLIYEETRGGLKIFLE

SEQ ID NO: 149565 - protein, 141 aa, Triticum aestivum
  Clone ID: PAT_TA_43983.pep
RPRIFATLEIPDLIRAGAVCTFWRSAYTSLRTLGKHKQPQTPCLFYTSESSSDNVACLYSLVEKRVYSLTLPEPPLHTRFLIGSSLGLLVTVDERSEMHLVNPITGQQIALPSVTTMQHVKPICDDSGAVHKYAYSKHTAK

SEQ ID NO: 149566 - protein, 53 aa, Triticum aestivum
  Clone ID: PAT_TA_43984.pep
SACESYLFVKLGVLALLNKFRIRDPCITSYTGIYRCFATILSPTFGYLFHCPA

SEQ ID NO: 149567 - protein, 80 aa, Triticum aestivum
  Clone ID: PAT_TA_43985.pep
THITCQVSVVILNTMKLSKWDVLCWTEFYVWTWVNVTRLILSYFVIVDGVRTYNVIKYIRCCDTKIIEIYFLFLLPVTSP

SEQ ID NO: 149568 - protein, 62 aa, Triticum aestivum
  Clone ID: PAT_TA_43986.pep
ILLNWNTVISLTCKLGWIARCIYTYKVPFVLTAKELGSCATNGARACATLITLTGTQFHCYR

SEQ ID NO: 149569 - protein, 87 aa, Triticum aestivum
  Clone ID: PAT_TA_43987.pep
VRSNGERVFLYPQSQKVSSIVSQRYRTAYHFQPPKNWINGMLFICLSASSSSSSACFLSGPSVDFLAVANHRVWSVIWFAFLVLGCY

SEQ ID NO: 149570 - protein, 113 aa, Triticum aestivum
  Clone ID: PAT_TA_43988.pep
RRCSPAAMDRRRNPRVSGFGCSKLSANSSLGGESVNTPAITARYLPTNRRAVQGRLVWHLTTWPSIGQVLSHGSDARNHGATPQATQLAHPCALCHTVYSLYPLFSTVQLCRI

SEQ ID NO: 149571 - protein, 100 aa, Triticum aestivum
  unsure (1)..(100): unsure at all Xaa locations
  Clone ID: PAT_TA_43989.pep
MLTDLLAANLGNRLFIGMQNALRRAMTLANGLSYGYHAIYCPXTNDIVLAIVESAELGEVGIDGCLLGSFFHDCFPEGCDAAGLLTVPNSERNLTADQTL

SEQ ID NO: 149572 - protein, 140 aa, Triticum aestivum
  Clone ID: PAT_TA_43990.pep
SARMLLGKQYFGLQSAGPGEAMEFMHITHELFFLLGLIYLGDYLPAWRWLDPYGCEKKMREVEKKVDDFHQKIIDEHRKARDVRKSGASLDDDGDDSKEGMDFVDVLLSLPGENGNEHMDDVEIKALMQDMIAAATDTSS

SEQ ID NO: 149573 - protein, 60 aa, Triticum aestivum
  Clone ID: PAT_TA_43991.pep
FAFLWIFVVSMVYIFNFFVTRRREFLRCIRMYNSKTYIPYLCRRRHTRPCCTNWACMQKR

SEQ ID NO: 149574 - protein, 141 aa, Triticum aestivum
  Clone ID: PAT_TA_43992.pep
SGLMAPLIADDVYEIIMKNATRLDSEIIYDRDFDYDFFGFKTLERSYLLKVGGKVVERPQHMLMRVSVGIHKDDIESAVKTYHMMSQRWFTHASPTLFNAGTPRPQLSSCFLVCMKDDSIEGIYDTLSECASISKSAGGIG

SEQ ID NO: 149575 - protein, 141 aa, Triticum aestivum
  Clone ID: PAT_TA_43993.pep
SAHASAHASVGLHIGDKEILQSQLTHQKKETEILEKQYCSLEHEMEAVNRSAAALQQLLEEKTCEMEKLSDECLILKKSFSNAIVETEALKEIIKELGASQSSLKYDVCLHSSEKDALARELHILNKKYAAILEQKSMLEI

SEQ ID NO: 149576 - protein, 121 aa, Triticum aestivum
  Clone ID: PAT_TA_43994.pep
SGRLRLPTRRPGARPAPPRLPPPPRSASPPPTRVPAHRPGRLPAWAASHPAAVAASPRAPLPAEKSIRIRLKKEESARPRNEAKERNVRPTARCASDRWLPGRLQRARLMCRSPPAQPTEE

SEQ ID NO: 149577 - protein, 108 aa, Triticum aestivum
  Clone ID: PAT_TA_43995.pep
MAAKGDGPAIGIDLGTTYSCVGVWQHDRVEIIANDQGNRTTPSYVAFTDSERLIGDAAKNQVAMNPINTVFDAKRLIGRRFTDSTVQSDIKLWPFKVVAGPGDKPMIN

SEQ ID NO: 149578 - protein, 141 aa, Triticum aestivum
  Clone ID: PAT_TA_43996.pep
RPDLSLKDDADIDHPSLAVEGDDCSPNTDTLAQDTGTLVNSAGRFSLLQKCSRLFKFSPRTKAEQSSEQEAEINIPFGARLEEASPSEVDYEPTPVYQAANNSFDAEGLPSDSGARGNEESERLDIADDIQIESSVGVADN

SEQ ID NO: 149579 - protein, 143 aa, Triticum aestivum
  Clone ID: PAT_TA_43997.pep
RPRTRGCGAKKAATSLPTSTSTGKKMPQAIITCVPNSASSTPTPGHGCGGSLSRMPQSRRTRAMASSPPSGQPIMCSLLMAVSCAGLTTSAASCYLTSVICAYLGCSTSCLSLEKKSTLQRYVRKGASRRDSVVCPSAKARCA

SEQ ID NO: 149580 - protein, 123 aa, Triticum aestivum
  unsure (1)..(123): unsure at all Xaa locations
  Clone ID: PAT_TA_43998.pep
VRGRVGRGLCGRGRTDNALAGLDDMLRRGCVPDVVTYTILLEATCKRSGYKQAMKLLDEMRDKGCAPDIITYNVVDNGICQEGRVDDAMEFLKSLPYNGCEPNTVSYNXVLKGLCTSERGEDT

SEQ ID NO: 149581 - protein, 76 aa, Triticum aestivum
  Clone ID: PAT_TA_43999.pep
RPFFFFFYNFLLIFINFFIFTGVWVVKNWGSSSLKTTYAWVKNCLLHYILSALFLSVPYFITLLRDLSRVFLHEVK

SEQ ID NO: 149582 - protein, 112 aa, Triticum aestivum
  unsure (1)..(112): unsure at all Xaa locations
  Clone ID: PAT_TA_44000.pep
MAAPARARFVHNRSRRRADEDDSDDEDQRRQDASSSSSDDDGGEEEEEEMEVEGSDEEEEEAXPTSQRXRESPAAAGRGWRKGPITISLKKVCKVCKKTGHEAXGFKGAVYI

SEQ ID NO: 149583 - protein, 43 aa, Triticum aestivum
  Clone ID: PAT_TA_44001.pep
EAGRDVAPEISLSLVVVHKLGLVFWLIHFMFQPDAIPQSQGRC

SEQ ID NO: 149584 - protein, 101 aa, Triticum aestivum
  Clone ID: PAT_TA_44002.pep
EYLDTPHYLKGKAYQLLICLIYLMQVRAYLFMTIIKNIFFTCLNNNLTLLSPFKVWPHTAICKTPGFVKSMGCNAMQFFNCILLPVSRMIYTPNKLFDTVD

SEQ ID NO: 149585 - protein, 125 aa, Triticum aestivum
  Clone ID: PAT_TA_44003.pep
VRGRVGQNRLATDLFQGNKSMGEKISARDVSAVFLQADGEQEGAATMDMEIRMLRERVCDQMDKLVRSLSSADREDEKRQAIPMLQSMSDTIERLCADHGQPPATEELDDEEGQATDKRNLNEEE

SEQ ID NO: 149586 - protein, 138 aa, Triticum aestivum
  Clone ID: PAT_TA_44004.pep
RPPTRPPTRPRTRGCSSNTHGAVRHLAISSNWKGDEREFQSTVELSRIRSLTVYGKYRPFYISNKMRFLRVLDLEDTIGLTDHHLEIIGKLIHLRFLSLRRCLDISYLPDSVGNLRQLETLDIKYTRILVLPKNHYQA

SEQ ID NO: 149587 - protein, 41 aa, Triticum aestivum
  Clone ID: PAT_TA_44005.pep
PLLRRVLSVREPLLLIPHLLVFLGTVGSAFFHSYACFLQAF

SEQ ID NO: 149588 - protein, 138 aa, Triticum aestivum
  Clone ID: PAT_TA_44006.pep
AHPARGWAHRATDGGVEQGVDLNRRRPSTILHNGRAPSCQPASLVVDQGRASSRGGRPASPTTGRGRRLGEVRHPAIRRALLCLSLRPASATPPPPVAPSSTRSGPHSPHPNRRAQPPAPYKCATTRRPTRPPTRPRT

SEQ ID NO: 149589 - protein, 103 aa, Triticum aestivum
  unsure (1)..(103): unsure at all Xaa locations
  Clone ID: PAT_TA_44007.pep
VRDPVHLISGTDDADNYYGRGGYTIGTEIGDLRFDRMRRLSNXCTGIQGSLVYNHAEHGTXGYGRGLILLKRLSVAYGRISKLIFXVYPYYSMSKSDVGSYNS

SEQ ID NO: 149590 - protein, 110 aa, Triticum aestivum
  Clone ID: PAT_TA_44008.pep
RPPTRPRTRGVPDCEMIVCHLKDHVRNLLGFPDDASAMLLHEAPSGIAIFSFDESYLNGLSKDLWTCLPPLILVEFMAYYRVPTLIDLNYGAFGDRLTKEGHGSCVGLEK

SEQ ID NO: 149591 - protein, 99 aa, Triticum aestivum
  unsure (1)..(99): unsure at all Xaa locations
  Clone ID: PAT_TA_44009.pep
MGLGKIEIKRIEYQSIRQVTFSKRMNGILKKAKEISVLCDAEVGVVVFFSVGXLYDFCSPKTSLSIILEKIHTNSGKILWDVIHMSFIAEIDRIQERVC

SEQ ID NO: 149592 - protein, 134 aa, Triticum aestivum
  Clone ID: PAT_TA_44010.pep
MPSPPPSFSSLCRRLFFLLTILFLLCSARSSLEEVRALSVGDELVGEAIPLRYGRRLYRLAGLRPPAWYEIKISYPTSIPSSFSIRLVNDPNAVEDLGSKNRRLLNTEKIVFKAESTRPVYVLVMVEPEGVVAK

SEQ ID NO: 149593 - protein, 75 aa, Triticum aestivum
  Clone ID: PAT_TA_44011.pep
VTGMAGLVGGGARAWRLSDEAANGASGGGAVTDADYMRVAALVTRLGENLLHLRTSLRHIRGLSGTLVCVFRAEL

SEQ ID NO: 149594 - protein, 70 aa, Triticum aestivum
  Clone ID: PAT_TA_44012.pep
FRSSSPLFPQPFYRACPSRRTKEYLVRLFFFHVSGSAWSFYLTNSMRQSNHLLRGQALVETHVIFSLMLT

SEQ ID NO: 149595 - protein, 146 aa, Triticum aestivum
  Clone ID: PAT_TA_44013.pep
RPPTRPHLIAFFSYFAARTTAPSAEDDAELHSRLIRREIQAVLVFLVLFTVKIVKEEHWETFIADSLLYAKGLLLVVTFVIDYWLTVGYLLGFIVIYAMAQQPPYDGLGHLNHLTPLQLESLLTEEPTTRFWLVEFRTSFLTPCIQ

SEQ ID NO: 149596 - protein, 59 aa, Triticum aestivum
  Clone ID: PAT_TA_44014.pep
CYPWSPSSGWRTVLRTKLWIVRTQKIYRGRGLSSSGCVSIHQVVFLVMVHALIVQHAYE

SEQ ID NO: 149597 - protein, 141 aa, Triticum aestivum
  unsure (1)..(141): unsure at all Xaa locations
  Clone ID: PAT_TA_44015.pep
FGKSLRTYFYHISPSWTPRPAAPSPRRRSTWWGCKLGGGLRKKAVARSVKAGLQFPVGRIGRFLKKGRYAQRVGMGAPVYLASVLEYLAAELLELAGNAXAKDNKKSRIIPRHLLLAIRNDQELRKLLAGVTIAHGGVLPN

SEQ ID NO: 149598 - protein, 124 aa, Triticum aestivum
  unsure (1)..(124): unsure at all Xaa locations
  Clone ID: PAT_TA_44016.pep
MARTRQTVRKFTGGKVLWXQLATKAVRKSAPATGGVKKPHRFRPGTVALREIRKYQKSTELLIRKLPFQRLVREIAHDFKTDLRFQSSVVSALQEAVEAYLVGLFEDTNLCAIHAKRVTIMPKD

SEQ ID NO: 149599 - protein, 85 aa, Triticum aestivum
  Clone ID: PAT_TA_44017.pep
RASYSLARKFMMARRVVPLEVLQPNGDCAQVLCIAQGVLPRAPISAPSRTKRIIWCLIPSLRLRSIGLGREPQRQLNRARTRGRT

SEQ ID NO: 149600 - protein, 118 aa, Triticum aestivum
  unsure (1)..(118): unsure at all Xaa locations
  Clone ID: PAT_TA_44018.pep
MGATIQSAKGRQIFDSRGNPTEEVDVCXSNGTFDRGDGSSGASTGVHEALKLRDRGADYLGKGVSNARDNVNLIIEPALIGKDLISYTDLRXFMVHQLDGTINXWGWFKHNSRFNVIL

SEQ ID NO: 149601 - protein, 73 aa, Triticum aestivum
  Clone ID: PAT_TA_44019.pep
SIVISVKLIEFKKLWNCPRYSRKIRNFSYLYVKCPYYKLYNLESPFTPNRSKDLFIMTARTTVRSIILKFLEP

SEQ ID NO: 149602 - protein, 85 aa, Triticum aestivum
  Clone ID: PAT_TA_44020.pep
ESAICDEASSTTCGKYDEKTGEGEAVVEGTERALPRESRPPHLYLPLPHTIRFALPPGLRRSWNVLPPAAVEEKKWPPRPPRPHA

SEQ ID NO: 149603 - protein, 46 aa, Triticum aestivum
  Clone ID: PAT_TA_44021.pep
QKPRRKDGVIYILLSSAGKTEQSPKNIFLDYNILKLFLIIFKTPIF

SEQ ID NO: 149604 - protein, 66 aa, Triticum aestivum
  Clone ID: PAT_TA_44022.pep
GLTHFSTHTPKHSISCGSRLTRRARVFSTTTICEACLVAHLSCLPKVLHCNRDPQGGGAHRISCFT

SEQ ID NO: 149605 - protein, 108 aa, Triticum aestivum
  unsure (1)..(108): unsure at all Xaa locations
  Clone ID: PAT_TA_44023.pep
MANMDMAAVLADMERDAVADARTLRTKLVCTLGPASRSVPMLEKLLRAGMNVARFNFSHGTHEYHMETLDALRQALHNTVILCACMLDTXGPEIRTGFLEDGKPIKLT

SEQ ID NO: 149606 - protein, 108 aa, Triticum aestivum
  Clone ID: PAT_TA_44024.pep
MRSDIVKEVSSYRERVGYNPDKVPYLPISGFEGDIMIDRFTNLDWYKGPTLLEALDQINEPKRPFDKPLLFSLQDVFKIGGIGTVPVCRVVTGDIMPGMGVTFGIYWP

SEQ ID NO: 149607 - protein, 52 aa, Triticum aestivum
  unsure (1)..(52): unsure at all Xaa locations
  Clone ID: PAT_TA_44025.pep
MAVTEYRCFEGGLAWATDDHNLQQVFRQYGEILDAKIINDRXTGKSRGFGFF

SEQ ID NO: 149608 - protein, 84 aa, Triticum aestivum
  Clone ID: PAT_TA_44026.pep
IYSKVTIYLNIIRTMEQCRQGDVHLGRPNAVMSTTGRERYSVIRIFMGSRGRTGQRETCGALTDNGPYLRMNRLQGWQAVKQKR

SEQ ID NO: 149609 - protein, 68 aa, Triticum aestivum
  Clone ID: PAT_TA_44027.pep
VCSLDDDALLTVVWFDVHAEMGATTTNVAEARDCVLQSHNYKGACLSSSNCSAVCRTENFPRRVPHSE

SEQ ID NO: 149610 - protein, 59 aa, Triticum aestivum
  unsure (1)..(59): unsure at all Xaa locations
  Clone ID: PAT_TA_44028.pep
RPDDQSLQNAFSKYGDVIDSKXITVRETGRSRGFGFCTFSLDEAMRQAIEVMNRQDLYG

SEQ ID NO: 149611 - protein, 67 aa, Triticum aestivum
  Clone ID: PAT_TA_44029.pep
MMHLSIESGDVFCWFTIGLLFAFDALGLYWIFQSFHIWFRILKGTLLSLCYFNGPWVTRIDLILITF

SEQ ID NO: 149612 - protein, 97 aa, Triticum aestivum
  Clone ID: PAT_TA_44030.pep
FVHAYRLAPPHLPSSPLGLGSVLTCRCCNPSAAPAASVPGSRLRRRVGRWGMLQLSGACWRQVQASCGALTGGSASLVKLKFKLKIILGIFGLSISS

SEQ ID NO: 149613 - protein, 59 aa, Triticum aestivum
  Clone ID: PAT_TA_44031.pep
MGTTPALHDTLLEYTSRENWYKFFVLRGDGDSLKWHAEWPLIKAPILSLLHGEEGSEIL

SEQ ID NO: 149614 - protein, 53 aa, Triticum aestivum
  Clone ID: PAT_TA_44032.pep
HPLTPSLARSPAVRMSSCSWLRFLTCRHENMDAPLRLYPRSSLPFSFLNYKSL

SEQ ID NO: 149615 - protein, 78 aa, Triticum aestivum
  unsure (1)..(78): unsure at all Xaa locations
  Clone ID: PAT_TA_44033.pep
MTVXTCCLGAGYVSGPTMAGIALRXPDIQVVVVDTTKYRXNAWNRDTLPIYEPGXLDEDPKHCRGKNPFFSSDIEKHS

SEQ ID NO: 149616 - protein, 33 aa, Triticum aestivum
  Clone ID: PAT_TA_44034.pep
IKNPTPNHHLPPAPSSAEPRCVDERVGRKRGRE

SEQ ID NO: 149617 - protein, 41 aa, Triticum aestivum
  Clone ID: PAT_TA_44035.pep
CTPRGLSTATHTSPYSQDPQVCHAHKRYRQCESTIDKGRIV

SEQ ID NO: 149618 - protein, 33 aa, Triticum aestivum
  Clone ID: PAT_TA_44036.pep
IKGYMKWGLGQLVFSFCPNYKLTSTFWILDDNL

SEQ ID NO: 149619 - protein, 134 aa, Triticum aestivum
  Clone ID: PAT_TA_44037.pep
SFLPVLPDHLIEDILERLPSKLVHRCRCLSRAWAAALSLDSFADRYLKLANRRSCPKILFLKTRRTMGPRCTCGRRSTLAAHRSWTSRVISCETAFYTTLYGVPRLLTQPCRGLDALQVTGTGFGIYYVCNPAT

SEQ ID NO: 149620 - protein, 116 aa, Triticum aestivum
  unsure (1)..(116): unsure at all Xaa locations
  Clone ID: PAT_TA_44038.pep
ILTFFNWYYTGLIIFFVGGVLVMVYKQEYMGWVLIFSMPSVLMLSXLMLSQAGLPLYLKTXADRSVLVGIVQXVLYFSYNNRGELLATKSCIASCFHIQSLFQALSSHTMKMGYMN

SEQ ID NO: 149621 - protein, 141 aa, Triticum aestivum
  unsure (1)..(141): unsure at all Xaa locations
  Clone ID: PAT_TA_44039.pep
ILPNPPSAPPFSTTSRRISDSVGRTKQTGRNSTGGKAPRKQLATKAARKSAPATGGVKKPHRYXPGTVSLREIRMYQKSTELLIRKLPFQRLVREIAHDFKTDLRFQSSAVSALQEAAESYLVXGLFEDTNLCAIHAKRVT

SEQ ID NO: 149622 - protein, 44 aa, Triticum aestivum
  Clone ID: PAT_TA_44040.pep
PLEEVEVVIQCLHSEEKGDCRLEVKVTGISSHMFQSQNAGIWRT

SEQ ID NO: 149623 - protein, 78 aa, Triticum aestivum
  unsure (1)..(78): unsure at all Xaa locations
  Clone ID: PAT_TA_44041.pep
VSALLRLRSRELLRVGAHMDQPGQVVVLALSTPGDEHPKIYLMNLWAINEXSAXAKFWYFLRKLKNVYKANCRMLVIN

SEQ ID NO: 149624 - protein, 66 aa, Triticum aestivum
  Clone ID: PAT_TA_44042.pep
MGMLHCIDDRATNNTSITEEADTNDSCRTKTLFMDLLKPIYQQWHLKKLLILAKEDVPCDRETNHD

SEQ ID NO: 149625 - protein, 74 aa, Triticum aestivum
  unsure (1)..(74): unsure at all Xaa locations
  Clone ID: PAT_TA_44043.pep
MGKEKTHINIVVIGHVDSGKSTTTGHLIYKLGRXDKRVDERXXKETANMNKRHFKYAWVLDKLNAERERGIYHL

SEQ ID NO: 149626 - protein, 92 aa, Triticum aestivum
  Clone ID: PAT_TA_44044.pep
VKHQDQIVSNHVKNINRKKRLDSQSAAPLLPIRGQDAEARDGATGEGVDVDGVPHPRQVRHALLGRIVLLPLRIHAHHRPPDQGDGGGVAAD

SEQ ID NO: 149627 - protein, 86 aa, Triticum aestivum
  unsure (1)..(86): unsure at all Xaa locations
  Clone ID: PAT_TA_44045.pep
GLVAVAGLAPTDMLCTRLNFAGSFRYATAAPTGGAQKIVCLFDRFXKKPALKPKPAPVATLSVSIDYELCKGYGPDRRVYWPNGLS

SEQ ID NO: 149628 - protein, 121 aa, Triticum aestivum
  Clone ID: PAT_TA_44046.pep
KKSLAPRHLRSGTDPERSNPRSGKKNSTVENSNSRAAPRLVRPLGRDQTARASEGARGIPVWGRGEEIKERGRGLAVCGLGHELLRVGRRAGHGGERPPSPSSSPMLLLADSLGSTPAGLG

SEQ ID NO: 149629 - protein, 72 aa, Triticum aestivum
  Clone ID: PAT_TA_44047.pep
THIEPVEVPRGASAPTIPKLHRHLLEQRVHHLVRRLVLRRHRGLNTWLPAHLTVDEEVGGGESGVNPSVNGR

SEQ ID NO: 149630 - protein, 77 aa, Triticum aestivum
  Clone ID: PAT_TA_44048.pep
QSSSSPGRSSTCMAQPLRPSGWAPRRANWWNASSLAPKIRSTTKDKGVGSLGRSPPLPQLLHLLPQARERKRNVNGR

SEQ ID NO: 149631 - protein, 124 aa, Triticum aestivum
  unsure (1)..(124): unsure at all Xaa locations
  Clone ID: PAT_TA_44049.pep
MSASRSEGDEALVNEVLTDDELRAVLTRLRPESERDAFGLVCXRWLRIQSSERRRLRARAGPSMLRRLAARFPGILELDLXSQSPSRSFYPGVIDDDLDVIAGGFCNLRVLALQNCKGITDVGM

SEQ ID NO: 149632 - protein, 45 aa, Triticum aestivum
  Clone ID: PAT_TA_44050.pep
IFESNHIVSFHGKQITLSNNATTPLDLRSKNLAGQICYACFSYTD

SEQ ID NO: 149633 - protein, 120 aa, Triticum aestivum
  unsure (1)..(120): unsure at all Xaa locations
  Clone ID: PAT_TA_44051.pep
MVKPLLFLGNPETGGPPPMLDCNXHYAYISYTGDAYAVILPGYASXHVVIPLLNAATNSRGPLPGEPGSEEPMFFYAKHIHSILMRRQNRAKLEGSNKLVKGRKPYLHXSRHPHAMKRAR

SEQ ID NO: 149634 - protein, 71 aa, Triticum aestivum
  unsure (1)..(71): unsure at all Xaa locations
  Clone ID: PAT_TA_44052.pep
NNSSLLMLRLAWHSVGTFYVSSKTGVLFGTMKNPAEQAHSFNAGLDIAPLXLEPINEEIPTIFYADLLPVC

SEQ ID NO: 149635 - protein, 98 aa, Triticum aestivum
  Clone ID: PAT_TA_44053.pep
CLTHQGGPPAATTECKRRTRRRRRSSRRRTTKLDHRRGPLQLKEGLLVPHQPHHHPLHLSGCSVARYVASAVELMHHTRAPTRPPTRPRTRGRTRGRT

SEQ ID NO: 149636 - protein, 75 aa, Triticum aestivum
  Clone ID: PAT_TA_44054.pep
LAFRLLLGRWRDPDRAPSASLSQPVGRLEGARDPPFSRGLSGGAVGVTRYGSHSLGGGPRPVPFFFFPSFLGPSP

SEQ ID NO: 149637 - protein, 94 aa, Triticum aestivum
  unsure (1)..(94): unsure at all Xaa locations
  Clone ID: PAT_TA_44055.pep
MSTDVAADVPAPEVEVAADPVVETTAEAAAGDASXAKETKAKAAKAKKPSAPRKPRATPAHPTYAEVNPESFAESSPILVVSRLNCSLFVRVCA

SEQ ID NO: 149638 - protein, 63 aa, Triticum aestivum
  Clone ID: PAT_TA_44056.pep
RSPTRSRTRGLSFFPLVSWRSRAYRIVRGLVRPVLPPYLVFVERSIWVDWRGFPCILYAAVKP

SEQ ID NO: 149639 - protein, 87 aa, Triticum aestivum
  Clone ID: PAT_TA_44057.pep
WLKKADGESAITLKKTEGKVNLSTKLLHNNGVVSQVRQSLTLRKRRRTIGWRWRLLTDRRIRSFRSSHERRGGAKRCTRVRPSVKER

SEQ ID NO: 149640 - protein, 76 aa, Triticum aestivum
  Clone ID: PAT_TA_44058.pep
SFVLGPVRFRSGRQGLGAVNRKAWRTVESVALWAASPGPPMTSPLQNAFFKYCDVIVSKIITDLVDCLVSADSGSS

SEQ ID NO: 149641 - protein, 53 aa, Triticum aestivum
  Clone ID: PAT_TA_44059.pep
VRCKERVDVWKMYHVKGVIPMSNGTSIGVSEGWSSSDIDAFTELSVAVGSLFC

SEQ ID NO: 149642 - protein, 85 aa, Triticum aestivum
  unsure (1)..(85): unsure at all Xaa locations
  Clone ID: PAT_TA_44060.pep
SFEGPVEHIHKGILFIYDREEVEHAGCICAKATXSCIIVGGSTDGRRGNGVDAAYARMGVLRFRTSILYSSGMLSPRGPHMNYGG

SEQ ID NO: 149643 - protein, 127 aa, Triticum aestivum
  unsure (1)..(127): unsure at all Xaa locations
  Clone ID: PAT_TA_44061.pep
SVHARYQITAAQEQGVFSTIVRSKDLKAGKDDPSVVAIKIIRQNETVYNAAKHEASILHILASADREDRRHXEPYISSFMYRXHLCLVLESLNMNLREALNNFGHNIGLKLTARKSYSKHLSLALKH

SEQ ID NO: 149644 - protein, 146 aa, Triticum aestivum
  Clone ID: PAT_TA_44062.pep
AESISMTIMRMFLALCALGFVAGVVEDGSSFDVSAYPVKWDEDPSVGSGDVAAPPSPGTEAPAPPPKHHMMVKKGMLFLERDLFAGALLPANTRLGYVRRTSSPGPVISSTTSPVPPFREDLGDSPVLRGGRRQGTTRVRNVCGSR

SEQ ID NO: 149645 - protein, 119 aa, Triticum aestivum
  Clone ID: PAT_TA_44063.pep
QNSLSFVAFRSRVAAKMERHYVFPYQSLTCSKNNYRFQLLQMLLLAILLPVATFVFLISSKMTAMAQSVFHPKNKSPGWFHLFVLLVPTFCSVGCSTVFHVLFTLAFGCSTIPCLVKFL

SEQ ID NO: 149646 - protein, 84 aa, Triticum aestivum
  Clone ID: PAT_TA_44064.pep
IIYFSQIKKDYHTQLARSELLLVQDHKSFSQVLLTMLASSPHNKIKMQPKRPKLPKIEPIFCNARMLTMNNKVRVCGSYNGGGR

SEQ ID NO: 149647 - protein, 144 aa, Triticum aestivum
  Clone ID: PAT_TA_44065.pep
SGRPDIDGLTGTESNRLNASDPSSPEIFVTDKAGYVDSDPGHGFEDIREQIFGSADTSAVPPPMSGFAQNARGMGLGMAQNVMSGFAPDSVPVYAALADEFAVFDRRFASVPTSTQPNRLFVHSATSHGLTFNARKDLINGFPQ

SEQ ID NO: 149648 - protein, 112 aa, Triticum aestivum
  unsure (1)..(112): unsure at all Xaa locations
  Clone ID: PAT_TA_44066.pep
ASPPLPFLIKTPCLSSLPPCQTLEPGRWPATTPSYTDQLYSMFTEDIFRVTRLLDNXVRVLNDELHRNNLXLENVNDKIKEXRSKIKFNKQVPYFGCNIVEISEXNPENDAY

SEQ ID NO: 149649 - protein, 71 aa, Triticum aestivum
  Clone ID: PAT_TA_44067.pep
YSGPVFYMQSDKKEGPHVNKETFNIKIVRPLDDNFWVKHSFQIVHPSMATTVTKLSPHGQWKRKYNPSFLL

SEQ ID NO: 149650 - protein, 57 aa, Triticum aestivum
  Clone ID: PAT_TA_44068.pep
AYGLFIAYLLSSRGSYFMSCPYIHAMLGDLLTSFISFMARSTIVGAMGSWIFRQCVL

SEQ ID NO: 149651 - protein, 116 aa, Triticum aestivum
  unsure (1)..(116): unsure at all Xaa locations
  Clone ID: PAT_TA_44069.pep
MGTVPAPAADTAASTARTVKDVNPHEFVKGYSAHLKCSGKMELPEWVDIVKTARFKELSPSDAGWCYIRAAFMGRKIYLRHGIXGIGGFQKIYGGRQRNGLRAPDFCKSSGAGSPN

SEQ ID NO: 149652 - protein, 80 aa, Triticum aestivum
  Clone ID: PAT_TA_44070.pep
IDLLPYALAMTSPSAGYDDLKTPNSIRPKQSSPPRPTPSYAPPGKPLCMYPRLHLQARPSVINQKAVGALKPNPPDRGPE

SEQ ID NO: 149653 - protein, 148 aa, Triticum aestivum
  Clone ID: PAT_TA_44071.pep
GRPTRPPTRPPTRPRTRGEEFEIGGRLIAFETGKMARFANGSVVISMEETNVLSTVAAAKSSDPVRDFLPLTVDYQEKQYAQGVIPTTYMRREGAPKERELLCGRIIDRPIRPLFPRGFYHEVQITVNVLSSDGKQDPDVMAANASSA

SEQ ID NO: 149654 - protein, 105 aa, Triticum aestivum
  Clone ID: PAT_TA_44072.pep
KEAKGVGGNGKQTGGVELILKAVTKTAHGLGVEHQPPRHCGRAQSLPRHRGAEETELDDDDRASARHHHKKPPRRAGAARIAQPPSRLSFGWAGSLGWVLDGSTN

SEQ ID NO: 149655 - protein, 143 aa, Triticum aestivum
  Clone ID: PAT_TA_44073.pep
RPPTRPSTRPLDSAQDQSAGKEASEMARLLSFVPISLLLLASLAAGAGAASAADPGEGGPRISTQYASEEESRWLDRWAEKHLPHGHGSGQAIEIQPGSDEESAQLSRMFPGNVYIGHIDFGRIVVDAFHSKARQAKPNDDSQ

SEQ ID NO: 149656 - protein, 143 aa, Triticum aestivum
  Clone ID: PAT_TA_44074.pep
MLYYGCYSGSSSTTPPVWTPDPDEAVLTNVGRVLEARGSEIIGQAYKDPITSFRDFHKFSNENPEAYWKMVFEEMGITFSVAPSCILRDSDAYPGGEWLPGAVLNAAANSLTAKPGRTPSNVAIVWRDEGKDSEPLNFVTVEE

SEQ ID NO: 149657 - protein, 73 aa, Triticum aestivum
  unsure (1)..(73): unsure at all Xaa locations
  Clone ID: PAT_TA_44075.pep
VRNFYVKVDDDVHLNIHTLDEIGYKQRWRRKVYTACLKYEPVLSDKEVRCYQPXILDNDGISIFPHATAQLYA

SEQ ID NO: 149658 - protein, 34 aa, Triticum aestivum
  Clone ID: PAT_TA_44076.pep
LSSPSIPTIGGSCDILKEGPYPSLLCLYKAIYSL

SEQ ID NO: 149659 - protein, 57 aa, Triticum aestivum
  Clone ID: PAT_TA_44077.pep
RLNPDSRTSETSAQDAGSPTNLSLVARVDTMPGSFCTIEYSTFRSLPRTRGRTRGRT

SEQ ID NO: 149660 - protein, 92 aa, Triticum aestivum
  unsure (1)..(92): unsure at all Xaa locations
  Clone ID: PAT_TA_44078.pep
TNKINDDKKAALAIQFVAEATLRKVHAAHKDDDMPPIEAILSAVESDLKLTRQENAKLPDNNRALDRLTKIKESCFAGNXRTVHIALTKAFL

SEQ ID NO: 149661 - protein, 89 aa, Triticum aestivum
  unsure (1)..(89): unsure at all Xaa locations
  Clone ID: PAT_TA_44079.pep
MIGEMDADMAVGYFDGESMLITGSTGVLXKGLVENILRVSPDVKKLFLLIRAPDVESSKVWIHTEVIGREIFLVLKEKHGXWFYDFIEE

SEQ ID NO: 149662 - protein, 58 aa, Triticum aestivum
  unsure (1)..(58): unsure at all Xaa locations
  Clone ID: PAT_TA_44080.pep
RSRFPSPSHASACRDHLYYVTXLAHPCHATVGWGGPWRIPLLKNYVGLYQCGRKFILS

SEQ ID NO: 149663 - protein, 71 aa, Triticum aestivum
  unsure (1)..(71): unsure at all Xaa locations
  Clone ID: PAT_TA_44081.pep
MPLVHGLRSRTLDLFLQAFRKKGYIPFTTYLRTYKIGEHVDVXVNGAVHKGMPHKFYHGRTGSVWNVTKRA

SEQ ID NO: 149664 - protein, 118 aa, Triticum aestivum
  unsure (1)..(118): unsure at all Xaa locations
  Clone ID: PAT_TA_44082.pep
VRLLVGFGHIPRIGWQIDPFGHCVVQAYLLGAXVGFDALYFFRIDYQDRDTRNGTKELEVVWRGSKTFGSSADIVAGIFPKNYEPLPGEFYFEVYDTSLVVQDDPFLFDYNVELRVYV

SEQ ID NO: 149665 - protein, 103 aa, Triticum aestivum
  unsure (1)..(103): unsure at all Xaa locations
  Clone ID: PAT_TA_44083.pep
MVSRPPNFIDGKGPAGNNVELPSLPFHGDTKRTQLRDELIEPSAGEILEIGSDCECVDLCRHGALXFMQISIFXDAVYLVVAIEGGKELCAVCKPALEVNYIT

SEQ ID NO: 149666 - protein, 78 aa, Triticum aestivum
  unsure (1)..(78): unsure at all Xaa locations
  Clone ID: PAT_TA_44084.pep
RPPTRSSTRSLKDVTMSYPELRDCIADIGELQHXFIVPLRAYYYSXDEKLLVFDYMPMGSLSVLLXGSTGSGRTPLDF

SEQ ID NO: 149667 - protein, 80 aa, Triticum aestivum
  Clone ID: PAT_TA_44085.pep
HHNPKHEDGDERDTEAPHLGDDTEVPPPPGSLLVKAEKSAKRPKNHPLLVLSRHMHRNVHQWHPKKHSTQPENVAVEYEM

SEQ ID NO: 149668 - protein, 48 aa, Triticum aestivum
  Clone ID: PAT_TA_44086.pep
LVRLQNQLILHCLIQPKEGDGFLARSASSPTGGKGKQKKIGFRTRGRT

SEQ ID NO: 149669 - protein, 145 aa, Triticum aestivum
  Clone ID: PAT_TA_44087.pep
RPPTRPHTLEGHTDVVKIAYCHPDLPILITGSWDGSVRLWDSTTYRLERILDFKLGKVNSIACFKGSTRIAIGHDKGLVLADIGLGEFSPCMIRPSLVLQANSSPSVILQDAARRHIELNRQLRLVEHEHGPTMGRRWSMGSYYA

SEQ ID NO: 149670 - protein, 149 aa, Triticum aestivum
  Clone ID: PAT_TA_44088.pep
GKTGNLFLKKKKKKKKKKKKKKKKKKKKKKKKKKKKKKKEKKKKKKKKKKKKKKKKGGGPLKGPKVNSRAGEKKNFFKGAPKKKPRGRVKKKGGWKNPGKNKKKALEKKSHLGGWGKREKARTLCPSKKGANLKGKRDPPFNPPINAGG

SEQ ID NO: 149671 - protein, 102 aa, Triticum aestivum
  Clone ID: PAT_TA_44089.pep
RVRPRVRSHLSPLRPDRRNPLPRLPPPARGARSDLAVPEQQQQQQQQRSASSRLASPSLGLRGRNVNFTTDLKMYSAPGNNSLALAAPRPGMELGNAQQHSN

SEQ ID NO: 149672 - protein, 212 aa, Triticum aestivum
  unsure (1)..(212): unsure at all Xaa locations
  Clone ID: PAT_TA_44090.pep
TGARHHAHGNAGEKTEKHASEHPRGEQRTARERTGTREERRRSRRGKTPPFIKNKGGEKPPPPGPGGNKTPAESPPGEKKKHPPRGGWGKKHPKKGGGLPPRFYKNFFKLFPPPPPGGGGGTPPPXFFKKKKKKPPPPPQKYTRGGGGGPPPPXSKKKKRGPKKKKKKKSGGGXFPPPPPPAGGGGXGXXXQKKKKKKKNLKKKKKKKPFFF

SEQ ID NO: 149673 - protein, 127 aa, Triticum aestivum
  Clone ID: PAT_TA_44091.pep
FLDLASPPTSRWFLACPANGLFASGPATWTSVARGRCSSRPGDLGATRTICTPASWSAWRRSVARNMGTPCSPTSWHGHPPSSLQTQSRLVICKELAHLCLKSALHYGQKKVSSSFLGHYFRATTSG

SEQ ID NO: 149674 - protein, 96 aa, Triticum aestivum
  Clone ID: PAT_TA_44092.pep
LEGFSYMKISLCKAIFCISVWGPEFLEAALWREAINCGCAPFRGCVATASIPPRRVMPSLGIAQAAAVLHVELALLQVMIAIQGNTAAHRTCFPSN

SEQ ID NO: 149675 - protein, 90 aa, Triticum aestivum
  Clone ID: PAT_TA_44093.pep
MATSAMTLAMAAATDASLFHPTFLAQHKLAPASASLPLIFSRAPLLRSTRPRVPLTPLVASSDAAEAGLDWADAEEADETVTEEEPAVGA

SEQ ID NO: 149676 - protein, 67 aa, Triticum aestivum; identical to SEQ ID NO: 114811
  Clone ID: PAT_TA_44094.pep

SEQ ID NO: 149677 - protein, 157 aa, Triticum aestivum
  Clone ID: PAT_TA_44095.pep
VRPRVRPRVRPRVRGRVGEEPGRSSAMSSNPCPSSCHPAGHHARLKGTAVDVESAMPRRPAGYRGHRMPCALVRLPLLLQRRGSPRRLPRPWDAAPPPSASPATSATWAQPCRRRTLSCGVRSAHMQAPLHRHGIFSAIASCCCRGPSSFTAPLCNA

SEQ ID NO: 149678 - protein, 175 aa, Triticum aestivum
  unsure (1)..(175): unsure at all Xaa locations
  Clone ID: PAT_TA_44096.pep
SDLAGARPHAFAGLTSLRLENMTSGELDIPNILSTCMLLEHLRXTHCDSGIYSELHVEHTQLVELEHDQGKLQRVELICLPKLQRMTYHNRLSWEDPMYFGCEPQLSKLSLIKTATRSDMTLKLSQLLANVPSERDLRVDFGSEQIWDLPECPILLMPELSKLLNANLDHLPEGC

SEQ ID NO: 149679 - protein, 205 aa, Triticum aestivum
  Clone ID: PAT_TA_44097.pep
RPIKGIISVYSHFDSTAVLNFILNLSIEEQNLVRRSLKQYTPRIEVDLVNYLQSKKERSRPKSYEYEQIDFGTSEDGYNPTSRNSYPFGRVSASSFDNESGKRMHAVQESTYLTGRTTSDVRTDHANQCFEPSSEADIFTASRESKSNARSVVEAARSWADYPEKSDATIDDENSIGTPRLDFVRRVSDGHNNAAVTTVGKIYRH

SEQ ID NO: 149680 - protein, 77 aa, Triticum aestivum
  Clone ID: PAT_TA_44098.pep
VRFLLSQIWCSSRCLSSSWWRCQLMLKAIHQGGPPLVEGWLLSKGLGIVIELQDNVVGLPRMKKVFLTLPTKGSSAF

SEQ ID NO: 149681 - protein, 99 aa, Triticum aestivum
  Clone ID: PAT_TA_44099.pep
QLNVEREFVASSNGTSVQEAEQRTIESICNQDKTAASLICQLKKRHSAQISTMPMMKDILGVVATLGKTNDDNLSSLLSEYLGIDNMLGLVCKTYDGIK

SEQ ID NO: 149682 - protein, 66 aa, Triticum aestivum
  Clone ID: PAT_TA_44100.pep
PASSIRGADLLQWRCQSTHASFFCLLDATRVDCVSCRWLLLEVRCRAAGAGDAELRVAGTTPPHAG

SEQ ID NO: 149683 - protein, 84 aa, Triticum aestivum
  Clone ID: PAT_TA_44101.pep
MALQNIGALNKDDAFYRYKMPKMLTKIEGHGNGIKTNIVNMVGIAKALARPASYTTKYFGCALGAQSTFDDKTGVCIVNGAHDT

SEQ ID NO: 149684 - protein, 184 aa, Triticum aestivum
  Clone ID: PAT_TA_44102.pep
VRPRVRPRVREVTKQELEFLCGIKPSENSDTKDEKSEFAHYSPEVVMKVWHDNLKVLFVTNGTSKIHYYTEKQNGSVRGTEDAPITPFTSEMSQSGDTIAAALMNMLSINPHLVTDKVYLHKTAKHAIKCGVIDQWLAARERGFLPRGIAEPSSEHEEARFITEREYRTIPDAMQPVNPSGSEL

SEQ ID NO: 149685 - protein, 167 aa, Triticum aestivum
  unsure (1)..(167): unsure at all Xaa locations
  Clone ID: PAT_TA_44103.pep
MIISKKNRNEICKYLFQEGVLYAKKDYNLAKHPQIDVPNLQVIKLMQSFKSKEYVRETFSWQHYYWYLTNDGIEFLRNFLNLPSEIVPATLKKSARPPGRPLGSGPPGDRPRGPPRFEGDRPRYGDRDGYXGGPRGAPGDFGGEKGGAPAEFQPSFRSSGGGGFGRG

SEQ ID NO: 149686 - protein, 176 aa, Triticum aestivum
  Clone ID: PAT_TA_44104.pep
VRGRVGNLQPLEWKRRLSIALDVARGVEYLHSLAQQTFIHRDLKPSNILLGDDMKAKVADFGLVRLAPADGKCVSVETRLAGTFGYLAPEYAVTGRVTTKADVFSFGVILMELVTGRRALDDTQPEDSMHLVTWFRRMQLNNDTFQKAIDTTIDLDEETLASVSTVAQLAGHCWAR

SEQ ID NO: 149687 - protein, 189 aa, Triticum aestivum
  Clone ID: PAT_TA_44105.pep
VRPELLELDNGRIRARISNVGAAVTSLLVPDKNGVLADVVLGFDSLDPYLNGTSPYFGCIVGRVANRIKDGKFTLNGVQYSLGINNPPNTLHGGFKGFDKVIWEVTEYNKGKTPSITLKYYSKDGEEGFPGDVSVMARYSLPSSMELKLEMEAAPLNKATPISLAQHTYWNLAGHDSGDVLAHSIQIRG

SEQ ID NO: 149688 - protein, 151 aa, Triticum aestivum
  Clone ID: PAT_TA_44106.pep
LLSLPVPARSAALRPVPSRLTLDQVDPTTQLLPLPCIGELRPPPLVRGEPDAWDGRPEQCAEAHERGRPTTTATTHEEREHVLGIEEPESVVDAARHRHGQGMPLAPEPTVTPHVEDARQPRHGVPVGHSSATPQQHASRLTASPCRLRTR

SEQ ID NO: 149689 - protein, 59 aa, Triticum aestivum
  Clone ID: PAT_TA_44107.pep
VRQTGQLGTLPPGQRTPEALQRAAEAMRRLDRRAFRGGFILEKILGPVSTGHIELRSTD

SEQ ID NO: 149690 - protein, 113 aa, Triticum aestivum
  Clone ID: PAT_TA_44108.pep
VRFLHARLLFCSVGANFVGPEVRSGRFSRPRRTAPILLRNFGRFWCGGSGTIAAPFRGLLGAISLGTARPLLAACCSACLLPLDPFPVRGSRASSPKCDAFLSPSSRTSEIFT

SEQ ID NO: 149691 - protein, 50 aa, Triticum aestivum
  Clone ID: PAT_TA_44109.pep
GTFYRTYSDVRNDLHVTMGRSLTIVYHMNNITLVYMIKRYRQVTSNQYVP

SEQ ID NO: 149692 - protein, 94 aa, Triticum aestivum
  Clone ID: PAT_TA_44110.pep
RCAGLAKHLVADDFSRGHLRCAHPCDATSFASILSLSARPLLSLLGLNWLNQSFVLSTGSVAHPLAGRAGASRFLQFKEPWISAALLYPAQFFG

SEQ ID NO: 149693 - protein, 207 aa, Triticum aestivum
  Clone ID: PAT_TA_44111.pep
RPRTRGSEAALLAKLGIRPFSYGLVITNIYENGLVFSPEVLDLTDEDLTKKFSSGICMVASLSLALSYPTMAAAAHMFVNGYKNVLAIATETNYSYPHADQIKEYLKDNAETCAEPGATKTGLSELPLDVIEKLLNHISCRGDWARLRCANKFWKAKVDGAKRPMQLPSVILPSTTKPTYYSTDGAVHRLRLPDSVRRAKRITGAHE

SEQ ID NO: 149694 - protein, 90 aa, Triticum aestivum
  Clone ID: PAT_TA_44112.pep
EQLRFAQGSRLVKTRGAARHNPERTLDSARLTARRRPPPGRAREQVATERVWLVHSGPISGAGKGVEGSASGGDAGRSHAPDRFCPTLAD

SEQ ID NO: 149695 - protein, 203 aa, Triticum aestivum
  Clone ID: PAT_TA_44113.pep
SASNQQSLQAPSAAGYDYYNQQQQPQQQQSATGTAAPADASNYNYSQPPASYASQGYGDSTYSQQSGGQQAYDYSGYQTQGQQQSYSEQPGYDQQSYGSAANSTQDGTAPSYGGPGGAGQASPGQQASTPSSGGQPGYPSQPPTSAAASSYPVQGSAPPSGYVAPHTQPGYGTQPPPQGAYGQGAYGQPPQAQKPASSAPTYG

SEQ ID NO: 149696 - protein, 84 aa, Triticum aestivum
  Clone ID: PAT_TA_44114.pep
SWSTTRPRTRGLAGVPAVGAEVHVLPATADLQDNVKDILHPKGYGHYQHASIHDPELITEYNLMAERGGGSMILNPTCYTRGST

SEQ ID NO: 149697 - protein, 177 aa, Triticum aestivum
  unsure (1)..(177): unsure at all Xaa locations
  Clone ID: PAT_TA_44115.pep
RPVAFGFGGKLIVMKETSSMATNFNSGNQGSSIGTVSVLNLSEVVADKVDASRITDGSALSYFHVLCRQPVPGPLVGGSAASKDVNKWLDEMITWYESSTNEHQRGDPRKLLISLLKILCQHYGKLRAPFGSDPSQEDTNGPEMAVTKLFSSCKRSSNHMXDFGSNVPFMQNIPSEI

SEQ ID NO: 149698 - protein, 163 aa, Triticum aestivum
  Clone ID: PAT_TA_44116.pep
LEKGGPAAMIKYWNDPETLQKIGQAMGTTMPFSTVSTAEPSGTEETEEEGEDEDESIVHHTASVGDGEGLKKALDGGADKDEEDSEGRRALHFACGYGEFKCAEILLEAGAAVDAMDKNKNTPLHYAAGYGRKECVDLLLKHGAAVTLQSMMTSMSLHGGQVK

SEQ ID NO: 149699 - protein, 95 aa, Triticum aestivum
  Clone ID: PAT_TA_44117.pep
ESHGKVLAHQATSVRMQFMSSLRTAEFRACSHANSMMRSMPSRWHLLYTSTCARARPASALPFEMQRPWHMWWCLTLTSRANSHQPTSGVVGGRT

SEQ ID NO: 149700 - protein, 53 aa, Triticum aestivum
  Clone ID: PAT_TA_44118.pep
CMVTLALGEQHIRKFVHINVTDLDVIIDPSSVDLISHPFVTNINMSSLSGNIH

SEQ ID NO: 149701 - protein, 76 aa, Triticum aestivum
  Clone ID: PAT_TA_44119.pep
VILDHCSWLYLVGYFVGSRGHGGVGILIFMGCWQLLRRNGTLSLNFCILNFDRNHKPGKFLVSGIRKIHIFDSYLG

SEQ ID NO: 149702 - protein, 61 aa, Triticum aestivum
  Clone ID: PAT_TA_44120.pep
GGAAENSCLISYTSFLGYKHQIMKYHKANSPYLTYRHNYTSSLGYKQKRQVLVLLSTSVPK

SEQ ID NO: 149703 - protein, 161 aa, Triticum aestivum
  Clone ID: PAT_TA_44121.pep
VRPQAVDFAPKPDLPKKMRSKEKYGVNQFPGLTTADNVYSTQTTHLAANRRIEGSGIKAKGTRLERAIRDLENIVGEYKPHTLDVPYIDPNCQGAVKRRLPQEIKQKLAKVARLSANQGKISEDELINRLMGIVGHLVQRRTLKRNMKEMVESGMCAKQEK

SEQ ID NO: 149704 - protein, 115 aa, Triticum aestivum
  unsure (1)..(115): unsure at all Xaa locations
  Clone ID: PAT_TA_44122.pep
ASPPPKASXPXACGSSGPLRSPXAXLVSSPAASSPGGPSLASLAATGASHPGPWAVNSPEEMRAVSSARRFSRTLSGPSPPDAEQRRSGLLRRLAAGARRSRPWPEPRYRGGGGR

SEQ ID NO: 149705 - protein, 139 aa, Triticum aestivum
  unsure (1)..(139): unsure at all Xaa locations
  Clone ID: PAT_TA_44123.pep
RPQSCSSSSGSSPTHQFSEQAEQVRLSIVTSEIIPEAPVIGDLKGKKKLASASGLDVVPEVVTKPNETGDTPLIPGRPFSLSSSHSSSFASSSRAPLAYVSSSDVSKNNNXGAEWRDNRYSIQRKMPRASGPHKRCADY

SEQ ID NO: 149706 - protein, 64 aa, Triticum aestivum
  unsure (1)..(64): unsure at all Xaa locations
  Clone ID: PAT_TA_44124.pep
MDLPTAPSIMIICKKNQNEICKYLLREGVLYAKKGYKLAKHPQIDPSNLEAIXFMQSFKGGGSL

SEQ ID NO: 149707 - protein, 89 aa, Triticum aestivum
  Clone ID: PAT_TA_44125.pep
SEGVDMTDKQLGEVFKKFGVERFDPLNEKFDPDKHFALFQIPDPSKPSGTVASVVKVGYMLHDRVLRPAEVGVTEGGPSEEPEEKSGGD

SEQ ID NO: 149708 - protein, 70 aa, Triticum aestivum
  unsure (1)..(70): unsure at all Xaa locations
  Clone ID: PAT_TA_44126.pep
CLLNVHSESKYYEPDHWKFGTAGNNYFRHATRQLYAITRDLATYVSTNKHILHKYTNGRCIIXSWLIGLD

SEQ ID NO: 149709 - protein, 136 aa, Triticum aestivum
  Clone ID: PAT_TA_44127.pep
MGWSMHIQQIADASLRKADTEPERPPRPQQPRSGGGYAAAIKEEKDAIVSCVLTVIRGSCDVVKSDAAHEGYSSASLASNCYAMSSPSVAGGSREGSSSSSVSPVVLPAPDDMGLGLDFMVESHWFEPLDLGWFVK

SEQ ID NO: 149710 - protein, 85 aa, Triticum aestivum
  Clone ID: PAT_TA_44128.pep
HSLLFLFQKKTFLGVSSHSFGVAGSIWALQKLEKSGSFGAKISGPTRSWSQPVGTPLSYLLVHPGAAAAFQSPEGAAWGRDPRGR

SEQ ID NO: 149711 - protein, 42 aa, Triticum aestivum
  Clone ID: PAT_TA_44129.pep
LFLHMANELLHIQELLLYRKLSPNFLLSSLRVIWFSSSSQQF

SEQ ID NO: 149712 - protein, 187 aa, Triticum aestivum
  unsure (1)..(187): unsure at all Xaa locations
  Clone ID: PAT_TA_44130.pep
SATLVKSLRSRCIELITEIEARLDFEDEMPPLDPMMLLSKINSMRQEVQDALDTAKYDKLLLSGLQIAIIGRPNVGKSSLLNAWTXSERAIVTEIAGTTRDVVEANVSIHGIPVTLLDTAGIRETDDIVEKIGVERSETAALGADMVIMTISAVDGWTGDDTKLIKQSSGSEVPMGLGINKVDCTPF

SEQ ID NO: 149713 - protein, 171 aa, Triticum aestivum
  unsure (1)..(171): unsure at all Xaa locations
  Clone ID: PAT_TA_44131.pep
YVQAGAGVTFXTFPGKGGSSLSLSNVLPQKTVAPSYKKTLRGNQGQFKLGTSRNLAWLKPVPSDNLVISFSDDDIETDPGMSKQVGGKGSKASTQVTHKPGMSVQTRLMREEAPQQKIHAANIGSTKWSANAHTLRNSPAGRGSGATFSTTHPPIPQVTPLNSSQKDGTGM

SEQ ID NO: 149714 - protein, 138 aa, Triticum aestivum
  Clone ID: PAT_TA_44132.pep
MGRIPCCEKEKVKRGEWTDEEEDKLLSYIMQYGARNWRLIPKNAERGLQRCWRSCRLRWANYLRLKLKHGEITDAEEQSIIKLHSVLSDRWSVIAAQLPARTVYDVKNHWNTKLKKKLSGMGTPRGAAALQEQQHNSS

SEQ ID NO: 149715 - protein, 89 aa, Triticum aestivum
  Clone ID: PAT_TA_44133.pep
SRSMRTNMDNHAMNDAWDGNGGLYERKIREINPMIHDITYDITDMDSLIDSLAVVSALEYDDEMHADLPYDRQRMKQKLMQHLKRLSQR

SEQ ID NO: 149716 - protein, 70 aa, Triticum aestivum
  Clone ID: PAT_TA_44134.pep
YLPFSHPHMHTCTHAMSYSNHMASNTILIFYMDNCVSSLVTSYFQSLVTSYFQAIQCLPISTSCPLSQSI

SEQ ID NO: 149717 - protein, 86 aa, Triticum aestivum
  Clone ID: PAT_TA_44135.pep
FISEMSMCCWPKGRHCRPSTPICVTALMNCTLEWRPRSSCPTASVRAVLAFRAQHTPFNIAHLAWCCPLYKHIIVLFPCLLLHINA

SEQ ID NO: 149718 - protein, 156 aa, Triticum aestivum
  Clone ID: PAT_TA_44136.pep
RPPTRPPPCTTTRPCASRDPTPSPTSRPAPAPTPTTSRPPSPAPRRRPSSVLPGKRQQRPPRPFPLPRRRRPRSPSPRRTTPTRSTRSPRPSPPSSVARPARRPVQWTTCTGSSATWPRPLRRPRRGSSTGSSRGGTANRRRRSSTGSCRGGRART

SEQ ID NO: 149719 - protein, 85 aa, Triticum aestivum
  Clone ID: PAT_TA_44137.pep
PPTRACTLTGRGGGNNTTLNKNVTSPTQSINNKPTYHKINNHLPPINILHPSITSHTLFKGGGHKTSISTINSYIHTLLFYLTPL

SEQ ID NO: 149720 - protein, 125 aa, Triticum aestivum
  Clone ID: PAT_TA_44138.pep
ARRLPRVRRVLCLVEALLHGDMLASLRVPARRSTLGSPVMWRSSGGGSRGLGRRRRLGSLAVDLARFLRSAHSLLHVPLLGCRHASATNLATWQQSRRVPHEHYMSRVRADRFRGAGGKEHPAGR

SEQ ID NO: 149721 - protein, 165 aa, Triticum aestivum
  unsure (1)..(165): unsure at all Xaa locations
  Clone ID: PAT_TA_44139.pep
RPPPAAEGPGDDGLRKLEYLSLVSKVCSELETHIGVGDKVLAEFITELGRDAPSVADFDAKLKANGADLPDYFVRTLLTIIHAILPPPSHNPSSAASQSNSKYRALSRPDDADRARELRLELERDANAAAATTPAPSRDRSRDDRSRDRDHDRTRDERGRXRDHD

SEQ ID NO: 149722 - protein, 140 aa, Triticum aestivum
  Clone ID: PAT_TA_44140.pep
RPPTRPEVLVKHHIVATVTACRTSRSIDTAASMKASCLLVVLLIAGTMASRLSLAGREGSTLGGQLGELIGKVASFLTSARHAGAYGWHSDTDAEVDTSHKNAHGHPARPRKRLKKSMLNCIPPDMSRKKKVLCCKPCYK

SEQ ID NO: 149723 - protein, 140 aa, Triticum aestivum
  unsure (1)..(140): unsure at all Xaa locations
  Clone ID: PAT_TA_44141.pep
MKTILASETMEIPEEVTVKVSAKMILVTGPRGTLTRNFKHLNLDFQLQEGGRKLKVDAWFGTRKTMGAIRTAIFHVQNLITGVTKGFSYKMRFVYAHFPINASITAANRGIEIRNFLCEKKVRKGDMLXWVTILPSEKVK

SEQ ID NO: 149724 - protein, 229 aa, Triticum aestivum
  Clone ID: PAT_TA_44142.pep
SGSSKVGFKKATRSNADRAETTEVAELPRAKPASIFDPDSIESMKLTHKSSSGNLKASATTTRSKVKGVQKETSDTNQLERTLSAELKKQSTSEQKVSDSCLANRVPLRELSSTEAQSKAHTSKKPLKRGLLKSPASRELASLFRSEASPVLQSSRRRKRNMSTVRVLISQSMDSETIKDQTKILMHFGLPVATTISEATHFRAEKFARTRNMLEAMAMGIPVGTPSWL

SEQ ID NO: 149725 - protein, 152 aa, Triticum aestivum
  Clone ID: PAT_TA_44143.pep
MATPTTPLLKDELDIVIPTIRNLDFLEMWRPFFQPYHLIIVQDGDPSKVIKVPEGFDYELYNRNDVNRILGPKASCISFKDSACRCFGYMVSKKKYIYTIDDDCFVAKDPSGKDINALEQHIKNLLSPSTPFFFNTLYDPYREGADFVRGTP

SEQ ID NO: 149726 - protein, 105 aa, Triticum aestivum
  Clone ID: PAT_TA_44144.pep
VRPRVRGRVGAQRVGAGAPVYLAAVLEYLAAETLELAGNAARDNKKNRIVPRHIQLAVRNDEELSKLLGSVTIAAGGVLPSIHSTLLPKKAGKGKGDIGSASQEF

SEQ ID NO: 149727 - protein, 135 aa, Triticum aestivum
  Clone ID: PAT_TA_44145.pep
MGEDGQIRRDRVIIDTDPGIDDSMTILMAFGEPSVEIIGLTTIFGNVTTEYATRNALLLCERAGHPEVPVAEGSPEPLKGGEPRVADFVHGSHGLGNLSLPAPTTKKGEESAAQFMVNKGSQFPGEIFGLALGPL

SEQ ID NO: 149728 - protein, 141 aa, Triticum aestivum
  Clone ID: PAT_TA_44146.pep
TIVSLVPTIYTRRRARSLAYRNGQSRLPGPGDSDRVTTSGSSLPQVAYLLQLRVYTHAGTIGPFHSAIVCERSVRGDEGRRRPAGSSGWAGSRWRGRCPRSFSWRSSPRAGRRLTGSWWTRTSTPTTSSPSSTCSSTTAPS

SEQ ID NO: 149729 - protein, 125 aa, Triticum aestivum
  Clone ID: PAT_TA_44147.pep
MEIVRHLLSPSLRRHIDNANNQESANSTPFLGESSIIMQECHDAVQISVDMKCPLCRGSVSGWIPAGEVRKYLDEKLRCCSHDCCKFVGSYEQLREHARTAHLLAKPALVDILRKRSWDRLEREQ

SEQ ID NO: 149730 - protein, 71 aa, Triticum aestivum
  Clone ID: PAT_TA_44148.pep
MAGGLFDMSHPASALAGIAGNIVSFFVFLAPMATFLQIYRKKTTGGFSSVPDVVALFSCSLLIFYALLKTD

SEQ ID NO: 149731 - protein, 64 aa, Triticum aestivum
  unsure (1)..(64): unsure at all Xaa locations
  Clone ID: PAT_TA_44149.pep
VRLPTNSSVAFTPARGGLKRPFPPPSYNKHIRXALLARRNGYAKPNEALIPEGGEPELALPMSF

SEQ ID NO: 149732 - protein, 84 aa, Triticum aestivum
  Clone ID: PAT_TA_44150.pep
GKGFPAPTVLNNGPLIGFRWPPTKTITLQGPGRKLGSSKTAAPFFFFFFFFFFFFFFFFFFFFFFFFFFFFSLLFFFFFPRVRG

SEQ ID NO: 149733 - protein, 37 aa, Triticum aestivum
  Clone ID: PAT_TA_44151.pep
PVSYLTGLQNSGNIVPRVLPTEFNYTNNHHAPTRPRT

SEQ ID NO: 149734 - protein, 143 aa, Triticum aestivum
  unsure (1)..(143): unsure at all Xaa locations
  Clone ID: PAT_TA_44152.pep
VRGRVGEGSEDGDRXLQNKRPKVGAFGEESSGVNASFFGYEAPHLHAFAEHDHLKLSHAPEDELDFGLSLISNDGGNDIPRETNSHGVCDVERSGGTNAEDLEIRMDLSDDLLHLIFSFLCQKELCRAGATCKQWQSASMHED

SEQ ID NO: 149735 - protein, 71 aa, Triticum aestivum
  Clone ID: PAT_TA_44153.pep
LYQFILLCLCYRISFDTIPVKELEVVVTGNRKGHKVVSFSNTIVMEAVESAAIHGVFFEYPRLIPPEFART

SEQ ID NO: 149736 - protein, 181 aa, Triticum aestivum
  unsure (1)..(181): unsure at all Xaa locations
  Clone ID: PAT_TA_44154.pep
VRFSVASPPVAFGQPPPPPPRDLCSSPASNSXAAPSPVPVAPPLKPPAGPLPLVLLPAPXLPCGNPSRCPLPLVLLPAPLPGGAPDRRATSAPPRCRTQVAAPSPVPVAPPLEPPAGALPSPEELGEAVRSGGSGLLQTLLRLPFLPRHLLRLPPLHPSNAASPRQPRLADSLAFYSNRYP

SEQ ID NO: 149737 - protein, 85 aa, Triticum aestivum
  Clone ID: PAT_TA_44155.pep
RSRWIWVKHPRNPPVVYHVVYRAPTGIDGLSGSSLSRLHSLPSWLQGVIQLRNCRCRVYRQQPRVLIEGIAPRESASAPTRPRTR

SEQ ID NO: 149738 - protein, 125 aa, Triticum aestivum
  unsure (1)..(125): unsure at all Xaa locations
  Clone ID: PAT_TA_44156.pep
MAQTQQTAGKSTEGGARRKQLAIKARRQXLPHTGGLKKPKRIRPVTAALRASPQYPTSTAVFIWNLSFQTLAWKIARYYKSDLRXQSHAGLASXNAIEAYSGDSLADTYLSTIDAKRVTIMRKDI

SEQ ID NO: 149739 - protein, 49 aa, Triticum aestivum
  Clone ID: PAT_TA_44157.pep
IIRFLSSSLWRASQHALVNGRHIRSEESRATISYPSSHPLHIERYVSAD

SEQ ID NO: 149740 - protein, 108 aa, Triticum aestivum
  Clone ID: PAT_TA_44158.pep
LAHCVEHLPRAAGAGAEIRRIHAFFSERAASAGLAGAAWLHAVPAVVGTGFSWMDCNGCYMLKSRSIGVADVAFDDPAGGITELPDSIDLAHKQKVSGAWEAKVRDNM

SEQ ID NO: 149741 - protein, 84 aa, Triticum aestivum
  Clone ID: PAT_TA_44159.pep
SGEIARGARSLSAMARIVETGHRRTVKHAPTTPSYLHQAAAITLSAGVVLLPTNALCGSRTRCFVRICASDEHAGGVALTGVSV

SEQ ID NO: 149742 - protein, 78 aa, Triticum aestivum
  Clone ID: PAT_TA_44160.pep
VRGLLRPTSSGSICILCKIYVYAPCCTLTIMARYDARTQQLCTPDSVPRVPTASVRPSGATPTWWQGAATAVTYGTAS

SEQ ID NO: 149743 - protein, 160 aa, Triticum aestivum
  Clone ID: PAT_TA_44161.pep
SASPDGVAAQQGHGDESMQQEQAPSAVARLSRLAKGVAADSQNGSHDADRTARRDEEASNAAALNEVSAVSTLNMPTERSAGQHSHMKGNSETTPGVNASKSSHTGVSMAAGARAGHEVLPSTEGGETGKSGSSLNGGATSEGNKGRLFNEAAASHNTSK

SEQ ID NO: 149744 - protein, 125 aa, Triticum aestivum
  Clone ID: PAT_TA_44162.pep
MDQVSLYYTLETGVVLGRHATKTCAQARAEALTIMRHLHGGQQAHPADGHQPQGEGYREQAGYAHAHGAHRPAPGAYPHEDGAYGGEPGAAGSRPQKHGYGQQGYHGQHGYRPQQHGYPAEQHGY

SEQ ID NO: 149745 - protein, 122 aa, Triticum aestivum
  Clone ID: PAT_TA_44163.pep
MSSVFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAPGMAIGIGRDAGVR

SEQ ID NO: 149746 - protein, 192 aa, Triticum aestivum
  unsure (1)..(192): unsure at all Xaa locations
  Clone ID: PAT_TA_44164.pep
RPPTRPSNDTLGVQVLKSRGIFVDPNWYWIGVGALLGYIMLFNVLFIVFLDLLDPLGKGQNVVSEEELMEKHVNRTGENVELLLLGNDSQNSPSNGGGEITGADTRERGMALPFTPLSITFDNIRYSVDMPQEMKDKGITEDRLVLLKGVSGAFRPGVLTALMGVSXAGKTTLMDVLAGRKTGGYIEGDISI

SEQ ID NO: 149747 - protein, 89 aa, Triticum aestivum
  Clone ID: PAT_TA_44165.pep
HDLHRLILPCQPSWIFIKHILGTEKENLQDLGLENLAFQAIHQRTYTARARFPSGQARKGSETPRSPHPAYLFARSWTSSSRCDPISPD

SEQ ID NO: 149748 - protein, 65 aa, Triticum aestivum
  Clone ID: PAT_TA_44166.pep
WLGRAIRPQPRKAATVAAATAAARRRVEVMGRGSLGDGGGGAMGQRAAAHAGLGKMDAGVVFSRT

SEQ ID NO: 149749 - protein, 111 aa, Triticum aestivum
  Clone ID: PAT_TA_44167.pep
SGNNSADYSVSAWGPSHGGSSVGSTGAFVAIALAFGILAWFVAPHVGKRAAAIILHMLLGGLCSLTIIISLRFVFPRIQFGSMRYWGILFVSWFLVFGVWASRTRSIRRAS

SEQ ID NO: 149750 - protein, 96 aa, Triticum aestivum
  unsure (1)..(96): unsure at all Xaa locations
  Clone ID: PAT_TA_44168.pep
MPGRCTDDHGGPLLMYGRAWKIPLLMTDERCRAIWAIYVRRTRTDELVHGPKAWHMTPXALNRMERRTEDLVAGHLYEMLDALLSNTIDVFLIDVR

SEQ ID NO: 149751 - protein, 82 aa, Triticum aestivum
  Clone ID: PAT_TA_44169.pep
GRSKSSSNSSSSASPAASAASSGLYRFADRISDGVAEMPAAMTANQTPVSGSVRGSARRRDDADTDDHDDDQKTCRTQQSRL

SEQ ID NO: 149752 - protein, 218 aa, Triticum aestivum
  unsure (1)..(218): unsure at all Xaa locations
  Clone ID: PAT_TA_44170.pep
RPLKYADRAKEIKTHVHKNIGTIDNHVEDYQRMIENLQGEVSQLKKELADKEHQLSVKPTEKAADNELSWLNVLSQETGENVQERINLQKALFELEETNKRNRMELQHLDGAIARPQVNEKDYTVLQALTSRRQVILDNIRDNDEAGAGYRKDIELNESRRRQLQDMIEEATSNNGNRTYLQILSQYRLLGMNNAELQXEMAMRDQVIHNQRESLRSL

SEQ ID NO: 149753 - protein, 129 aa, Triticum aestivum
  Clone ID: PAT_TA_44171.pep
RVRGRVGAALDVPPYATPPPDPDSPVAFPAHLQPLFDAFCDHAAAPLGRLLEDLAAEHRRVVVVHDSLVAFPATEASRLPNGEAYALQCVGQSFGAGFKDPSHRLVRALGLPVPAPESLLTGAWMGLEE

SEQ ID NO: 149754 - protein, 113 aa, Triticum aestivum
  unsure (1)..(113): unsure at all Xaa locations
  Clone ID: PAT_TA_44172.pep
VRGRVGADAAASQSRGYMKQQFVNLQXPMQSPQEHCILNPMLQQQILQQASQQQTVSADSQSIQTVLNSSAIQHQLQQLQQLQQVHQVQQAQQAHIDQKQTIHSDQTYHVPTR

SEQ ID NO: 149755 - protein, 149 aa, Triticum aestivum
  unsure (1)..(149): unsure at all Xaa locations
  Clone ID: PAT_TA_44173.pep
MAPKAEKKPAAKKPAEEEPAAEKAPAAKKPKAEKRLPAGKSAAGKDGDKKGKKKAKKSVETYKIYIFKVLKQVHPDIGISSKAMSIMNSFINDIFEKLAGEAAKLARYNKKPTITSREIQTXVRLVLPGELAKHAGSEGTKAXTKFTSS

SEQ ID NO: 149756 - protein, 215 aa, Triticum aestivum
  unsure (1)..(215): unsure at all Xaa locations
  Clone ID: PAT_TA_44174.pep
METIGMAIEDAASGGVKFLADPVDRFPVPDLGSGEAVLDAVTTQTLVCAAAQSSVAGAGDATTTVQLDGDASCEGVSLSAPSSEQSAGKDESKASGWAKRVRIGRAPLERPPCAGRISALGKTLRCYAEKKRETVVVPVVGDSFDSLGEAYDYYNLYSWEIGFGVRYGKSRLNVERTKCMQEIVCGCSGIPKRSNTRSCRCRCXAMIRLLRSKDN

SEQ ID NO: 149757 - protein, 132 aa, Triticum aestivum
  Clone ID: PAT_TA_44175.pep
VRSAHPAPSSPAVHLRAYSLASARFAPAPLSFKRHVSPTALPLHGLPFGLGVRLAGGVNAVALLSLAAGQIWVLAPRMAADGRTLELHKCAVIQLEPTRPVYAMEVAMGRLLLGEAGGVRVFPLRSTMKGGR

SEQ ID NO: 149758 - protein, 109 aa, Triticum aestivum
  unsure (1)..(109): unsure at all Xaa locations
  Clone ID: PAT_TA_44176.pep
MPRDRDEPAAVRVYTVCDESKYLVVRNVPALGCGDELGSVFAAYGPLEECKPMDAEDCEEYTDVYFIKFAQVSYAPQFESLLDTKEKLEVRRNEVXTRIRSPVEADLRA

SEQ ID NO: 149759 - protein, 77 aa, Triticum aestivum
  unsure (1)..(77): unsure at all Xaa locations
  Clone ID: PAT_TA_44177.pep
FSFLRGGQYAIALALLDEGKVVLGVLXCPNLPLTSISNLNGSSSGDQTGALFSATIGCGAEVESLEGSPPXRVITIF

SEQ ID NO: 149760 - protein, 123 aa, Triticum aestivum
  Clone ID: PAT_TA_44178.pep
MACCCFRAAAVPRLLFRAAARPLQLPLAVSRKGFSGQSVLPVTDSVESFQGPSVDHAPRIPLYDDSLPSGVSTILTNPGENVAPADPSKSRIMLVDGTSVMYRSYYKILAQLQHGQLEHADGN

SEQ ID NO: 149761 - protein, 125 aa, Triticum aestivum
  Clone ID: PAT_TA_44179.pep
SAHASDDFLPKDRIEDVIYFSGKYFVGFYVLTNEEDLLMFRPKPDGDGAQLSTFTVRYSFPGHRAAEPAPGQTVSRYLVVSRGELLMIVRFAGPEERTRFDVLVLEEKKIGGADHNDPPRVLAYW

SEQ ID NO: 149762 - protein, 122 aa, Triticum aestivum
  Clone ID: PAT_TA_44180.pep
LRSETAVGVSRRRPATAAAPLGDCRRRLLWQVGAGDPVRPRRRLLWERRQIVPRRQRETADRTLAAIPYLGVGDLVHRQRVDRTRSRQIVRRRRQGSSPVRRQGQRSSFGDRDVIERSVFSD

SEQ ID NO: 149763 - protein, 160 aa, Triticum aestivum
  Clone ID: PAT_TA_44181.pep
SSQHISRQLLAPSGHLVISCRELLAIRRSCGSILWLWNPQARNVELFQLDAVGEPDDKVIILHNLCNLAKLPCVMIKHLGHISNDPSASCLMNNSWLVWPETIAPLHRDRIGLPKTVFQLHDSTPGRGGGGLISNRWGGYGANEVDGWTEGGPAGRVGGR

SEQ ID NO: 149764 - protein, 85 aa, Triticum aestivum
  Clone ID: PAT_TA_44182.pep
SAQSHARLWSARCSGFLQILIFSPLWGHLLRGWGPGSSGCSRRRQRTGRDPGHGVERCGQSGMEVSRGGAAAGGGARRGEEEGGE

SEQ ID NO: 149765 - protein, 90 aa, Triticum aestivum
  Clone ID: PAT_TA_44183.pep
TKRRYTLRAYIGHKAINDLKASLRKHSLRTSTDAHEVMCTSAVSTFIQTLTKSCVHQLYLLLSAKIHIHDQGSLKFSQLLQKMIQPLHSK

SEQ ID NO: 149766 - protein, 172 aa, Triticum aestivum
  Clone ID: PAT_TA_44184.pep
MYPWGNEASPKINGKPSGAASPSPEPKMYPWDNEASPQINGKPSGAASPSPEPKMYPWDNEANPQINGKLGEKFASPLADRVRDMGDDFASPTFATNVNGYHTRSKVLHDDTYSPKYPKSVNRSRSSSFASDPGSEPSDEMDKTYDLPKSESPNSSEERENQKQPDLSLISP

SEQ ID NO: 149767 - protein, 122 aa, Triticum aestivum
  Clone ID: PAT_TA_44185.pep
IQALSERQPQSEKKAPRARPMSGKAVFVLCATSFFVGLLLSGRMTVLTPPASGGHGGSRIALFSDDDCEHRRKLEEESNPNDVMNEVSRTHQAIRSLDKSVSSLEMELAVERAKRNGGPGAA

SEQ ID NO: 149768 - protein, 158 aa, Triticum aestivum
  unsure (1)..(158): unsure at all Xaa locations
  Clone ID: PAT_TA_44186.pep
SAHASALSRVKYALLALGSSTAIPTWITEVVNSYKGDTKCFDLLAKLAIDPAAQPPYTLTSGVLRYKGKILIGNNSALKNSLLTSFHKSELGGHSGERATYHRLKILFTWPGMRKAVQTFVQQCPVCXLNKAQHVHPPGLLQPLPVPDFAWTHISMDF

SEQ ID NO: 149769 - protein, 58 aa, Triticum aestivum
  Clone ID: PAT_TA_44187.pep
CVEIYWFEGNQGFVNLVSLSTHNAVLPVKLFGWITSIFHHLFDRCKAPFSCLHDIYVN

SEQ ID NO: 149770 - protein, 128 aa, Triticum aestivum
  Clone ID: PAT_TA_44188.pep
ASADAWATGELPRNVLLSVDRHLVQTIVPGTRLTVIGIYSVFQASGTNNQKGAVGVKQPYIRIVGLEQSRDDNTNGPSHFTLDEEMEFKEFAQRPDAYAKICSMIGPSIYGHGDVKKAIACLLFGGSK

SEQ ID NO: 149771 - protein, 70 aa, Triticum aestivum
  Clone ID: PAT_TA_44189.pep
IRIISAQAYYTCIRKHSVMSLLNTGYTEMPHADRQFLDCGMRRTRYSFTMAGIGHGHMTGHATLAILERE

SEQ ID NO: 149772 - protein, 98 aa, Triticum aestivum
  Clone ID: PAT_TA_44190.pep
LRMPPNGCKVQLEPNGETQFKYLGGIPNGYKYGSQLGVILKREYPGLVKYMDDSGVTRSRPALEWEDYYLVHDDEGVSNADRVKQEFWRCFEVAEANR

SEQ ID NO: 149773 - protein, 67 aa, Triticum aestivum
  Clone ID: PAT_TA_44191.pep
VRGRVGGHPRPPLCARVQVVVSFGVTLRSKGSRWCLSLGLHFVYYFSHPAGMGDAIPLGLCHHHIHN

SEQ ID NO: 149774 - protein, 35 aa, Triticum aestivum
  Clone ID: PAT_TA_44192.pep
AAKQSPHTCSPLRRFLFTSMAMERTQHTGEPHGEG

SEQ ID NO: 149775 - protein, 60 aa, Triticum aestivum
  Clone ID: PAT_TA_44193.pep
MASHLRLKLGFSDANAFSESFTTCSSGDNMLESGLLQGNLKAVVLIRFNQRAASDQEEDD

SEQ ID NO: 149776 - protein, 79 aa, Triticum aestivum
  Clone ID: PAT_TA_44194.pep
SPQYQDAQQNFQYEDYRVSLAPDRYLPAHPLGCVASRSLSTRIPAARSHVNNPVCIHTIKTLPDRSRSPIGSSWFVPDP

SEQ ID NO: 149777 - protein, 155 aa, Triticum aestivum
  unsure (1)..(155): unsure at all Xaa locations
  Clone ID: PAT_TA_44195.pep
MAPEPEDDFLNEKNPRPLDEDDIALLKTYGLGPYSNSIKKVEKEIKEMAKKINDLCGIKESDTGLAPPSQWDLVSDKQMXCKEQIEKMREVVELPMLHPEKFVKLGIDPPKGVLCYGPPGTGKTLLARAVANRTDACFIRVISSELVHESFVEGA

SEQ ID NO: 149778 - protein, 173 aa, Triticum aestivum
  Clone ID: PAT_TA_44196.pep
RPPTRPVMIGYSDSGKDAGRLSAAWQMYKAQEDLVKVAKQFGVKLTMFHGRGGTVGRGGGPTHLAILSQPPDTINGSLRVTVQGEVIEQSFGEEHLCFRTLQRFTAATLEHGMRPPISPKPEWRALLDEMAVVATEEYRSIVFQEPRFVEYFRLATPETEYGRMNIGSRPSKR

SEQ ID NO: 149779 - protein, 91 aa, Triticum aestivum
  Clone ID: PAT_TA_44197.pep
PLCPRITPSMASSSGMPAHQVVYLVRAAALFGQGPEATHRRDVRQIPIGAEVLLVLMLEVLHGLLLSRTRLARCAYLAYVGQARSHIDGVY

SEQ ID NO: 149780 - protein, 37 aa, Triticum aestivum
  Clone ID: PAT_TA_44198.pep
RYPFAGSMQLAVISVGAPCPHQGIPDPLKSCTIARFP

SEQ ID NO: 149781 - protein, 144 aa, Triticum aestivum
  Clone ID: PAT_TA_44199.pep
SDFNTKTDGLLDELLSDRQIIKQHDDEFKLLLKKWIESYTEEACTPAKSCLNPNCWWGSQRRSLVAFTSKFNKTFDRQKTWKVPDVMLRQVLKDRIQDCILPDYTRCLENCSSSGLFCSCLQIASGDIYTRETLETTGQGFFEG

SEQ ID NO: 149782 - protein, 55 aa, Triticum aestivum
  Clone ID: PAT_TA_44200.pep
AQTAHTAGFRSLPLAPKSRAGAGSRGAPSKKCPDLTRLMRNKEGEMRVFGFFRTR

SEQ ID NO: 149783 - protein, 165 aa, Triticum aestivum
  Clone ID: PAT_TA_44201.pep
MLTSATAPPSSSSCSSHAPTRFASARGRRLRPVLAMAASDDPRARSVAVVGAGVSGLVAAYRLRKSGVRVTVFEAEDRAGGKIRTNSDGGFLWDEGANTMTESALEASRLIDDLGLEDRLQYPNSQHKRYTDKNGAPALIPSDPIAVMKSTGFSTKSMGKVLVEP

SEQ ID NO: 149784 - protein, 112 aa, Triticum aestivum
  Clone ID: PAT_TA_44202.pep
CAWFFQFASSWFCFVIPRVLFNPCVHVCSCLCSLEQLCVGHYTVSHFYSCLLQFFKSFTAHKFFLDMYANMQNRIQWKRFVKLLRGNLLFLKALKFVVAPTSLTLELIHWTW

SEQ ID NO: 149785 - protein, 78 aa, Triticum aestivum
  Clone ID: PAT_TA_44203.pep
RVRPPQQGLVPPWFAQASSGNCRSRTTMAHTPEASPVRTTSGSKDCCLIPGCSTFKEKGSSLRSYRWCKDNVNMVIVV

SEQ ID NO: 149786 - protein, 138 aa, Triticum aestivum
  unsure (1)..(138): unsure at all Xaa locations
  Clone ID: PAT_TA_44204.pep
FCLPCKEGFRRTGDAEVLVMAAANGLAHASAKKPLFTFGVIADVQYADIPDGCSFLGVPRYYRHSISVLQRAVSTWNEQGNINFSINFGDTIDGFCPKDKSLWAMQKVIDEFEKFDGPTYHMFGNHCLYNLXRSKLVA

SEQ ID NO: 149787 - protein, 96 aa, Triticum aestivum
  Clone ID: PAT_TA_44205.pep
ISFLTVRSIGLLLPYLLLLATITFPQRPGKPNPSAPIFLGPERLLLAAHIVGGFLVGAAFPALYILDGLRSGDTTGIAAVAPHTFLPDAWADAWAD

SEQ ID NO: 149788 - protein, 135 aa, Triticum aestivum
  Clone ID: PAT_TA_44206.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIVNAGGECLTFDQLALRAPTGEN

SEQ ID NO: 149789 - protein, 112 aa, Triticum aestivum
  Clone ID: PAT_TA_44207.pep
RPPTRPLKAKGLDAMLELMEDETMTSFSLSSSSSDDDTGRPHLRRPSSGSFGRRSTEEPVVCSPASSLVAVMVQALAHRVSYLWVLDEEDDCRLAGIVTFADILRVFREQLQ

SEQ ID NO: 149790 - protein, 133 aa, Triticum aestivum
  Clone ID: PAT_TA_44208.pep
RKYSCLKCQEYHFLQDKYLLDHIVGTGILAPRRDPDLHVNLPLRPRRVKCLRRIRFPSASSSAAAEDSDCQITGVAGPNRPRGVPRKRDARVPSQVHGDRVKTVPPRGRLPRAAKEKESKLAKELRRELECTL

SEQ ID NO: 149791 - protein, 92 aa, Triticum aestivum
  Clone ID: PAT_TA_44209.pep
VRPRVRLQTLKKVSLKHGVPISTVAVRYILNQTSVAGSMVGVRLGLSEHIRDTNAILSLLLDEEDMGSITEASQRGRNLMEVIGDCGDEYRA

SEQ ID NO: 149792 - protein, 167 aa, Triticum aestivum
  Clone ID: PAT_TA_44210.pep
RPASLGFLPGCFPRAAAAATPLLRIAAMAAAAAAAADQATNLLQKLSLDAKTEAIDAPAAKEKASGGLGGKLNGVAATRNPRASEQWANPQDYSDASMYYGAYPAAYYCAGWGDYSMYLNQDGVETPTAGAYGDMYCYPQYGHDGQMYGSQQYQYPSSYHQPQNTAR

SEQ ID NO: 149793 - protein, 133 aa, Triticum aestivum
  unsure (1)..(133): unsure at all Xaa locations
  Clone ID: PAT_TA_44211.pep
AWACRLFVFSVCRCCWIQTIVERWGPFVLSGLAIFQVFGFFGSMVWLGSKDGHLSMAFCAALLGLDGREVRVGLGSKDDHFSVAFCAALLGLDGKERRVWLGSKYWDLLEVKVLLGRVVLVTKFSXYFEFQLA

SEQ ID NO: 149794 - protein, 177 aa, Triticum aestivum
  Clone ID: PAT_TA_44212.pep
VRKLLLAIPRVLELAEELSLPLAAVKYSRGTFIFPEAQPSPHKNFSAEVAFLNGFFGGLKSGGNAYVIGDPAKPGQKWHVYYATQQPEQPVVNLEMCMTGLDKKKASIFFKTSDDGHTSCAKEMTKLSGISEIIPEMEICDFDFEPCGYSMNAIHGSAFSTIHVTPEDGLSYASYEV

SEQ ID NO: 149795 - protein, 98 aa, Triticum aestivum
  Clone ID: PAT_TA_44213.pep
VRALALMKSINLLGVQQICRNSIALEQALAAIPSIDSEAVQQRLDRVRTFYELLNLPFESLLGFIAEQEYIFSAKEYLSILKVNVPGREIPMDAERRI

SEQ ID NO: 149796 - protein, 55 aa, Triticum aestivum
  Clone ID: PAT_TA_44214.pep
LHSSPYTISPASPMLSDFAHTYRHVDAFNRASHVLQCISHSHSATLTMLPRVRGR

SEQ ID NO: 149797 - protein, 61 aa, Triticum aestivum
  Clone ID: PAT_TA_44215.pep
HSLHQSTLLRPLSQVPVPLLNITFISSFPNQLSWRETPLLNGYSPHREKVVTINQDTIYSS

SEQ ID NO: 149798 - protein, 167 aa, Triticum aestivum
  Clone ID: PAT_TA_44216.pep
VRFCALDLIVNYGLEDVTLLTFGQPRIGNAVFASHFKKYLPNAIRVTNAHDIVPHLPPYYQYFPQKTYHHFPREVWVHNIGLDSLVYPIEQICDDSGEDPTCSRSVSGNSVQDHIHYLGISMHSESRGSCRIVTDDNMLRHKVDTVDGAIVFSKQPGLSVDQLLSTQ

SEQ ID NO: 149799 - protein, 69 aa, Triticum aestivum
  Clone ID: PAT_TA_44217.pep
GLRLVWPPSPLRAVTVRLLRGVVNPLVRPGAPGGRVGSLRLVVGPVGLRSSSWRRGRHLRPSEGGPLGR

SEQ ID NO: 149800 - protein, 96 aa, Triticum aestivum
  Clone ID: PAT_TA_44218.pep
SGDHFGRRQSGRSIYYESYMFTRPGVLYPVWRGRYGHGGALYTGPGPRVPPATATPSGAPPTGWEAWTTAFTLGAASLSSTWYGRAGDPKQGWSAL

SEQ ID NO: 149801 - protein, 86 aa, Triticum aestivum
  Clone ID: PAT_TA_44219.pep
RPLTRAERTVIQLHGLLRTAIPAVLRRGAHIFRTVSKDILTEKDESVIKKVHMLDSFFLGLRDVTCTGTSLLYRMILRIMQTGAWS

SEQ ID NO: 149802 - protein, 132 aa, Triticum aestivum
  Clone ID: PAT_TA_44220.pep
ERADAAQKFHSKEAEEAAKKVAAKAYTPVVMDAQGTTKDQGPKVVAPTPAQITAIKAAIINSQTLDEVTRLEKALSTGQVPAEFALPKPDANMAEASEEAEAEKMETDGQDQEEDGADEQKQADESTPIQED

SEQ ID NO: 149803 - protein, 107 aa, Triticum aestivum
  Clone ID: PAT_TA_44221.pep
ERSEARGSGETQRSWNLRRRRGRGSGVSSPGGPDLGRRQCGNEAPEKPRIHARAASRSRASPLPRLRESRKSAQGRIGDAPFPSFPPPLDPQLLPSSLPPKTDAWAD

SEQ ID NO: 149804 - protein, 40 aa, Triticum aestivum
  Clone ID: PAT_TA_44222.pep
SDTRPFLSALATSDAWHCQFLWPSPIPYQPEQSRITHVHH

SEQ ID NO: 149805 - protein, 81 aa, Triticum aestivum
  unsure (1)..(81): unsure at all Xaa locations
  Clone ID: PAT_TA_44223.pep
IGLFFVWLVLMATSYYVGMSTNSFNIREGKLIARNPRDGLRASPTGPSILSLYVRSDRPDRREKEKRXPTAPLKXASYVRA

SEQ ID NO: 149806 - protein, 216 aa, Triticum aestivum
  Clone ID: PAT_TA_44224.pep
RPKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKGPFVPISGFEGDNMIERSTNLDWYKGPTLLEALDQINEPKRPSDKPLRLPLPDVYK

SEQ ID NO: 149807 - protein, 184 aa, Triticum aestivum
  Clone ID: PAT_TA_44225.pep
RPVGLSERNCNEQMFPLRRRNGDTTETVEITVYDYFVKNRGIELRYSGNLPCINAGRPKRPTYFPVELCTLVPLQRYTKALSTMQRTSLVEKSRQKPHERMSTLNDALKRSNYDADPMLKACGIQIAQNFTQIEGRVLPAPKLKAGNGEEFFARNGRWNIARKKLIRTSSVKRWSVVNFSARCD

SEQ ID NO: 149808 - protein, 108 aa, Triticum aestivum
  Clone ID: PAT_TA_44226.pep
MAARAHNVAAAQQQNRALGGVPAMGKQQKAAMAGRPDPKNTRRALGDIGNVEANNRRAPLGDIANVVNARAAEGKPQPHEPVNRPVTRNFGAQLLKNAQEKAKNPAAR

SEQ ID NO: 149809 - protein, 142 aa, Triticum aestivum
  Clone ID: PAT_TA_44227.pep
KRWCFLVTSCGVAAKTRCTGSSFVCFSVHLLPMVSCPTILYRSVHVLLSSKIRTQQVQHGVRHGGDHREGTPWHLGLHQARAYPLHQLRRRPHPSPRHHGKQPSHLGRLLIMCYSLVQIGIMILELGAGAHVLLPDKVNISC

SEQ ID NO: 149810 - protein, 78 aa, Triticum aestivum
  Clone ID: PAT_TA_44228.pep
MAGIMHKIEEKLHMGGGSDEHKKDEEHKKKDGEHKKDGEHKKDGEHKEGMMEKIKDKISGDGLGDGKKDGEHKEKKDK

SEQ ID NO: 149811 - protein, 88 aa, Triticum aestivum
  unsure (1)..(88): unsure at all Xaa locations
  Clone ID: PAT_TA_44229.pep
RPGGSSTVVIAKYIEDKHKAHLPANFRKFMLTQIKKLVVDGKLTKVKASYKLTKASAVPKMPKTIGASXKKPAANKAPTIIPFASTLS

SEQ ID NO: 149812 - protein, 87 aa, Triticum aestivum
  unsure (1)..(87): unsure at all Xaa locations
  Clone ID: PAT_TA_44230.pep
NDKAEQSKHKGQLQFLNPLLQDINFSTMLTSKSHTYASSIMFFAKLAFSRPFSFLDRSFNRYTTSRKSPEHPSELHGXXIKSNGLLN

SEQ ID NO: 149813 - protein, 115 aa, Triticum aestivum
  Clone ID: PAT_TA_44231.pep
MPDLPGPPNRVLYIMLGQAWRLIVFVRATAEGFYGEDGWFLFPFRGRSVNYLRDELADGVAFIDGQPPAGIAMCVRAVRYGRLTPLVVDLTRYAGHAETLQIVVMLSGTPAYDDL

SEQ ID NO: 149814 - protein, 114 aa, Triticum aestivum
  Clone ID: PAT_TA_44232.pep
MLCVCSVFSSGSGQLHWSQWPPQNSAQPRWFSTSKGLLGAGPSGIMAADAIITESGALHVAGVPLVNPSTVVVWEVMPGLGNGIQATAKINATSPLPPSLNPPSWSGFAPLAAY

SEQ ID NO: 149815 - protein, 43 aa, Triticum aestivum
  Clone ID: PAT_TA_44233.pep
ISATMRTAVGDRVNGVASPTRSVHERLAQRKGCVHHAHALVTN

SEQ ID NO: 149816 - protein, 105 aa, Triticum aestivum
  Clone ID: PAT_TA_44234.pep
SSCYAAEKETAQPGAPQEKKKKRGKAPDRRRARERREKNGATAAGARGGRCAPRERTAASEHANGECSMGKRWARRRAAIAPAPVAPDIGKARMRLSALRRRPGR

SEQ ID NO: 149817 - protein, 62 aa, Triticum aestivum
  Clone ID: PAT_TA_44235.pep
REPPPPCTGSSAAAARRGSCSCYCRMPQSALLLPLPVVILRRRRAPVTMTRLRSIKKNKRTG

SEQ ID NO: 149818 - protein, 93 aa, Triticum aestivum
  unsure (1)..(93): unsure at all Xaa locations
  Clone ID: PAT_TA_44236.pep
MSHSSLRLECLYVVRSLNYGLYLMIALQEEMGNNCGLLYYTCDGQFKIPLXLLVLVKLGIQLKGEHLICLEVYFQPLYCVXVIACSTAFHAKG

SEQ ID NO: 149819 - protein, 68 aa, Triticum aestivum
  Clone ID: PAT_TA_44237.pep
VQTLHALIRYGLQIICMYYHYGKPAKLLPVMLDPQADMRSATVILLLRRKVVAPVCKGRVAASCARGR

SEQ ID NO: 149820 - protein, 115 aa, Triticum aestivum
  Clone ID: PAT_TA_44238.pep
VRGRVGGRVGEFGGLELLLWEPITGAEQRIPLPAEFLSDCPTAAVFCAADGCDHRDCLGGPFRVAFLFVDLLNEETHVTWGRINIGEIVACGENDLYSLQHRVLHGIHRKLQRAR

SEQ ID NO: 149821 - protein, 98 aa, Triticum aestivum
  Clone ID: PAT_TA_44239.pep
PTADTVVKKALATTMKDHGCFHVNFEPPSGSTTVDECLCRPWYCKRGLLVAATCYGFLSAGALHDDACFDHEGIIVLEVNDGPVVQYRHDSPLKLVNM

SEQ ID NO: 149822 - protein, 80 aa, Triticum aestivum
  unsure (1)..(80): unsure at all Xaa locations
  Clone ID: PAT_TA_44240.pep
MRESILIHIGQAGIQVGNACWELNCLEHGIQSDGQMPCDKTVGGGDDSLNTFFRETGSVKHVRSSLLLDFXPTVIDEVRT

SEQ ID NO: 149823 - protein, 85 aa, Triticum aestivum
  Clone ID: PAT_TA_44241.pep
APRGGIPRAVVAIDISKPSALPASVDDPSASFVKGRCRNYKGLGLNYLQDIHAVTRHMPTWTTSVWLSTTRTSTLTPELESSLKR

SEQ ID NO: 149824 - protein, 45 aa, Triticum aestivum
  Clone ID: PAT_TA_44242.pep
PSLGFQKRGREIHGVNRVPMLRGRTHLGHLQQQPSVSLQSVRQVT

SEQ ID NO: 149825 - protein, 109 aa, Triticum aestivum
  unsure (1)..(109): unsure at all Xaa locations
  Clone ID: PAT_TA_44243.pep
LQGPQPNSRRRHAFHSVLQWFIVSNVKVTPGASSGVGGGKNGYGYYLIEEEEGLNDHNVVVKCAEIQTAISEGATXFFFTLYQFVGMFMGVLCAVISSSLWLVVVLTLH

SEQ ID NO: 149826 - protein, 128 aa, Triticum aestivum
  Clone ID: PAT_TA_44244.pep
GLEPDESKPLVVAPVAVAEVADAGHRLRWDGAAAVERQALGHHRVDDESGEGAGCVVDVGQRGLQQGVPPLGVAGVQHQRGRQIATRGGDASLEGGGGSDRVARHRQVHRLPWRRLRHFSLSPRVRGR

SEQ ID NO: 149827 - protein, 84 aa, Triticum aestivum
  Clone ID: PAT_TA_44245.pep
SVCFGAFCFKSLYGFIPFFSGGELLVFATHAPVNYICLHSVKPSLRPLSMAMSTVSIHILGDGPSSPIGGFIQVLGLVLGFNES

SEQ ID NO: 149828 - protein, 107 aa, Triticum aestivum
  unsure (1)..(107): unsure at all Xaa locations
  Clone ID: PAT_TA_44246.pep
MGVHSPGAPLNTQGVFRCICEPHISDLAVEKPNPLAHLQDHLKDARHYALLGLXDTTNIFCYGPLYQIKQHILYLNDTLIPTKGRYIYTAIFLQGETVKGLPNQLNG

SEQ ID NO: 149829 - protein, 125 aa, Triticum aestivum
  Clone ID: PAT_TA_44247.pep
RPPTRPKEADLSNSETRFSQGRCSSSQRQLWIWIHPSMLDEGLDAIRIACDKQMQDSGVLVNCCSLEGKIARLEVMGCKAMQSLKSILHPVSKILDTSDMCKPTDHSLYSSTGPHVLEASVIDHA

SEQ ID NO: 149830 - protein, 114 aa, Triticum aestivum
  unsure (1)..(114): unsure at all Xaa locations
  Clone ID: PAT_TA_44248.pep
DAQFSIRIVIYKGSXSTRFVLICIHVNKIILALQSRCTRFRFSPLDGSHVTERVRHIIKFEGFDLEEGALTVLFRLXNGDMRNYLNILHASHMGFXAYKHKNAFYLCTEIPMPK

SEQ ID NO: 149831 - protein, 110 aa, Triticum aestivum
  Clone ID: PAT_TA_44249.pep
MAPSLAHLVCLLLLLLGLVSVLPLSAAALTPRSAPPFAPSTPVVLALFVISDFTFDVCSNNYLGSLRRADREPYGRVFDTHRPTGRFSNGRILVDYLAVKVGLPFVPSYL

SEQ ID NO: 149832 - protein, 34 aa, Triticum aestivum
  Clone ID: PAT_TA_44250.pep
MDEEYDVIVLGTGLKECILSGLLFVDGLKVLPMD

SEQ ID NO: 149833 - protein, 69 aa, Triticum aestivum
  Clone ID: PAT_TA_44251.pep
KQYSMTIMRMVLAIRALGFARNDLYKTDREVELALTLARWMRTHFLDHVTRTLHRLSVLRRRRRLRSIT

SEQ ID NO: 149834 - protein, 47 aa, Triticum aestivum
  Clone ID: PAT_TA_44252.pep
PNTRWTCFTMISGTQLIVASIASIMDDWGGEPCHSRHHFSVDCLSHV

SEQ ID NO: 149835 - protein, 124 aa, Triticum aestivum
  unsure (1)..(124): unsure at all Xaa locations
  Clone ID: PAT_TA_44253.pep
SAHASAHASGFVSEGDQVDELQQVCEVQSDKATIEITGGFKGTVHQIQFAPGDIVKVGETLLKMIVNDSQVVPHDSLGLSSDISIGVGTFTSSLSQGIASLXGLFFTPAVRHLXKQYGLYIYVI

SEQ ID NO: 149836 - protein, 41 aa, Triticum aestivum
  Clone ID: PAT_TA_44254.pep
HVVTGVHHHALGAHPGAGHHLAILPVGDGASRVWKYGESVG

SEQ ID NO: 149837 - protein, 86 aa, Triticum aestivum
  Clone ID: PAT_TA_44255.pep
SWRSGKGEPPDGKYEASCAGGPSLRNGNKYRAIARRLLGESRLSTLIPVAPVWFSCRRRPLIITAPPPSTCRAILDRISASLDSRK

SEQ ID NO: 149838 - protein, 74 aa, Triticum aestivum
  Clone ID: PAT_TA_44256.pep
VIQRELRDLQKDPATSCRAGAVGEDMFHWQATIMGPSDSPYSGGVILDTIHFPPDYPFKPPKVAFRTMVFHSIH

SEQ ID NO: 149839 - protein, 63 aa, Triticum aestivum
  Clone ID: PAT_TA_44257.pep
MCSSSMCRLGRAVDSCPVQPVLIIFWRSGLPPSEDLSNTAGSWCSCPTPYAARTSSSHGGSCR

SEQ ID NO: 149840 - protein, 60 aa, Triticum aestivum
  Clone ID: PAT_TA_44258.pep
SFDPGVRSRLSTVLPYGRRRGPGRAWSGACRPTYKHTTTHFFVRTGKLGWSSEDDQDMSG

SEQ ID NO: 149841 - protein, 84 aa, Triticum aestivum
  Clone ID: PAT_TA_44259.pep
SAHASDLEVLALVGCVGIEDDALSGPENECSKSLRVLDMSTCRNVTHAGVSSVVKAVPNLLELNLSDWCHVTSSMGRCFQILPK

SEQ ID NO: 149842 - protein, 139 aa, Triticum aestivum
  Clone ID: PAT_TA_44260.pep
VRDDPFRGFGALPPKERAWGALKYFVPALEWVPQYGIDKFKFDLLAGITIASLAIPQGISYARLANLPPIIGLYSSFVPPLLYAVFGSSNNLAVGTVAAASLLLASIIEDEVSPEDNPELYLHLFYTAAFFTGIFQTAL

SEQ ID NO: 149843 - protein, 70 aa, Triticum aestivum
  Clone ID: PAT_TA_44261.pep
NTAGIPSAPGAFRSPISSKCTLYLLGCVFNPKKSVHFGCNSQLNMLTNFFNVCTCHGGKQAKEMIRNERT

SEQ ID NO: 149844 - protein, 91 aa, Triticum aestivum
  Clone ID: PAT_TA_44262.pep
SGSTLAAAAESGKRKLEAAPERRGAWPAKASTLRLSSIRRSMKAGEAEHGEELQVLFGWTKKFNPTWGGKFVVDFFYFFKLCYFFLFYLFF

SEQ ID NO: 149845 - protein, 74 aa, Triticum aestivum
  Clone ID: PAT_TA_44263.pep
FAHAYGQLSAGDDFVLREYGEEYDTIDCPPTVYGNCTGNDGGYSFATIDAGITGRYQEDSGGGTSGLGLLSNIR

SEQ ID NO: 149846 - protein, 64 aa, Triticum aestivum
  Clone ID: PAT_TA_44264.pep
ITLKHHTILSPTITGTFLRACFYRRRIGRSCFVCFVRWTIFKLKDSPWRSRITPNLSSFLCDPF

SEQ ID NO: 149847 - protein, 62 aa, Triticum aestivum
  Clone ID: PAT_TA_44265.pep
VRDVLAFVLLIVICYLRAPCESSQRYAYSGEAVDDEEESQSLTKGSDGDVGMVKIDIDRYAG

SEQ ID NO: 149848 - protein, 124 aa, Triticum aestivum
  Clone ID: PAT_TA_44266.pep
SMGEWCCATSATHANNRPYCCPLHTAANARPTELVGMQHLHHELVSIIMRRYSQSDQEANSKCPYMNWRHNMKPEFATIVLADHEYLTNISIQKLLVGNEIPYDITFCQMFFLPIPSEDGWIIL

SEQ ID NO: 149849 - protein, 69 aa, Triticum aestivum
  Clone ID: PAT_TA_44267.pep
LLMRPLDRSVMYFFFPLSTDLDHAPVRPVNVGIAKKLAKESAASVGAKTEGSCRKFGVTRTRGRTRGRT

SEQ ID NO: 149850 - protein, 67 aa, Triticum aestivum
  Clone ID: PAT_TA_44268.pep
TKLLPPVINIHRHFLRLHPQFPHKISMRLQSLPHLSQLIILLKNCLSCLERGLEARGAHASAHASAD

SEQ ID NO: 149851 - protein, 116 aa, Triticum aestivum
  unsure (1)..(116): unsure at all Xaa locations
  Clone ID: PAT_TA_44269.pep
MVYIKNQNTPAYSKRFQVKFKRRRQGKTDYRARLRLTNQDKNKYNTPKYRFVVRFTNKDVTAQIEYATIAGDIVMADAYFHELSSYGLEVGLTNYAAAXCTGSVLARRVLKNCDLD

SEQ ID NO: 149852 - protein, 38 aa, Triticum aestivum
  Clone ID: PAT_TA_44270.pep
PIKTEPAVTIATRPSQHHRSRLAHGGANVCLRRGHART

SEQ ID NO: 149853 - protein, 58 aa, Triticum aestivum
  Clone ID: PAT_TA_44271.pep
VRPRVRPRVRGNKEKPLEGLDIVVDAGNGVLCSFVCLNPFGVVTVGIYILVLDGLFLN

SEQ ID NO: 149854 - protein, 45 aa, Triticum aestivum
  Clone ID: PAT_TA_44272.pep
FRWWLPPLIPCSPFQSVDWCGRGFKCWSNYLLGHRGVWRISGFCA

SEQ ID NO: 149855 - protein, 45 aa, Triticum aestivum
  Clone ID: PAT_TA_44273.pep
GKVRVRGSKKSHQDAILYPHSSALHSGVHLVSAIRHICMIRSGFR

SEQ ID NO: 149856 - protein, 94 aa, Triticum aestivum
  unsure (1)..(94): unsure at all Xaa locations
  Clone ID: PAT_TA_44274.pep
SADAWVSDVFSVDNRLIVSVFGEVTIKLWYTLCECKYTICGDMGGGXGPHRXVSCVRFSPNIQXPLIGFVFWDMTAKVWNHTNCKLCSTFAGHW

SEQ ID NO: 149857 - protein, 103 aa, Triticum aestivum
  Clone ID: PAT_TA_44275.pep
ALQDSVGSPHRLWRHGIASGTMSMHAGLPCVLGYFPSSSVTEGLRLDHPVHSLQLVKLWLLYRWSGIALSVLSCGSQQLCRLRCQVHSERRCSIGSGARVGGR

SEQ ID NO: 149858 - protein, 61 aa, Triticum aestivum
  Clone ID: PAT_TA_44276.pep
LHLAPAFYASHTALNASMCVRNPMALDRVNNEINRLSPKHETQETRSRDPCRALSGRVGGR

SEQ ID NO: 149859 - protein, 72 aa, Triticum aestivum
  unsure (1)..(72): unsure at all Xaa locations
  Clone ID: PAT_TA_44277.pep
VRFSWSPTDPIILLFVPELGGGNQPARESLVQIPGKEEIRHKNLFSVSXDCIMYWXNIGXYLAVQVDRFTKT

SEQ ID NO: 149860 - protein, 88 aa, Triticum aestivum
  unsure (1)..(88): unsure at all Xaa locations
  Clone ID: PAT_TA_44278.pep
MVRTKQTGRISTGGXVPRMQLATKAARKSAPATGGVIKPHRFRLGTVVLREIRKYQKSTELLIRKXLPFQRLVREIEQDFKTDLMFQS

SEQ ID NO: 149861 - protein, 64 aa, Triticum aestivum
  Clone ID: PAT_TA_44279.pep
AFVVAWAALQFLNLSNNHLDGPVPRSLLRFLDASFAGNSMTRPAPVLSAVSALSLASSAAGASA

SEQ ID NO: 149862 - protein, 91 aa, Triticum aestivum
  unsure (1)..(91): unsure at all Xaa locations
  Clone ID: PAT_TA_44280.pep
MSDTDEHHFKSKGDFCAYKTYPQQAGAIRKGGHIVIKARPCKVVEVTTSKTGKQWHAXXYFVAIDIFNGKKLEDLDSSYNNXNVPHGDRQD

SEQ ID NO: 149863 - protein, 33 aa, Triticum aestivum
  Clone ID: PAT_TA_44281.pep
RDIFPYIHQLWQGVSISHKAHVNEEVGVRVGGR

SEQ ID NO: 149864 - protein, 56 aa, Triticum aestivum
  Clone ID: PAT_TA_44282.pep
PYWCRSFALLQKLYRHCAHGSLICREWNKITLVVYLDMESSWSTKAFLCFHLTVPL

SEQ ID NO: 149865 - protein, 57 aa, Triticum aestivum
  Clone ID: PAT_TA_44283.pep
LQRSILVRPTRPRYLNLTMVVPELDMQSFWADPRDLEDILYVNNFIYFLRDEVLVIS

SEQ ID NO: 149866 - protein, 42 aa, Triticum aestivum
  Clone ID: PAT_TA_44284.pep
KYQRQLQEAKTLLNSQQTHTGIRIIRKQPETLRETLEQRTRG

SEQ ID NO: 149867 - protein, 35 aa, Triticum aestivum
  Clone ID: PAT_TA_44285.pep
MSSRLAGSVLLRRAGAGAGRLFGTTVSPAGSTALV

SEQ ID NO: 149868 - protein, 60 aa, Triticum aestivum
  unsure (1)..(60): unsure at all Xaa locations
  Clone ID: PAT_TA_44286.pep
MRECISIHIGQAGIQVGNACWELYCLEHGIQPVGQMPGDKTVXGGGDDCFNTXFFSETGA

SEQ ID NO: 149869 - protein, 75 aa, Triticum aestivum
  unsure (1)..(75): unsure at all Xaa locations
  Clone ID: PAT_TA_44287.pep
MASSLLRFMAILSARPSCRLVLACLVVAVLQFGXSLELFILXPFKFILXIYHALVFLIWLCGPITDFRVQPFFWC

SEQ ID NO: 149870 - protein, 41 aa, Triticum aestivum
  Clone ID: PAT_TA_44288.pep
STRLNVCANNVDTLHMGVLLSVYLEEGSSPPLVFLSPCDRT

SEQ ID NO: 149871 - protein, 138 aa, Triticum aestivum
  Clone ID: PAT_TA_44289.pep
SAVRCYASPLSNVRVSAVRDFCSGKGEKETRTAYKKVKTEKDDDNQGMPKNGVALAREKAIRSLQDFRLIYKNLLNKLEDRSREGGADLQAYKIFRDRFLAQGNDERFVGNVPGIHVGDIFYARVELCIIGLHRPHRF

SEQ ID NO: 149872 - protein, 113 aa, Triticum aestivum
  unsure (1)..(113): unsure at all Xaa locations
  Clone ID: PAT_TA_44290.pep
MARTKHTXRKSTGGKAPRKQLATKAARKSAPTTGGVKKPHRYRPGTVALREIRKYHKSTELLIRKLPFQRLVREIAQDFKTDLRFQSHAVLALQEACEAYLVGLFEDTKLCAI

SEQ ID NO: 149873 - protein, 140 aa, Triticum aestivum
  Clone ID: PAT_TA_44291.pep
SAHASADAWGRPAFSGGGAGLALATELEGVPAAVPAVPPPSAGLQWRRLELLGMASNCFCSGRGGQSSTHQFFLQPRRHVSENHRTSWPMNPVLLSPSACFRGTNMLPDPRRIAHAFRVGLVFNMGLHVILWMVRIPDRG

SEQ ID NO: 149874 - protein, 124 aa, Triticum aestivum
  Clone ID: PAT_TA_44292.pep
DSFSVRRALDTHASKESPASAVASDRGTPVPSSSSQEKNSLTKAGREKVKENSDSKDKPLPTELNGKGDQAANSKSERSEPNVDRAEERERCRSRGRERDRDIMGSDSDHQKERVIAKRHRSGD

SEQ ID NO: 149875 - protein, 76 aa, Triticum aestivum
  unsure (1)..(76): unsure at all Xaa locations
  Clone ID: PAT_TA_44293.pep
MYRCPVQMMCRLCVCNTDGXERQSSTFLQMPSGRPTSXILHTRVQFLQDQQQCLVVHENQKAIIDATKVETSGYCR

SEQ ID NO: 149876 - protein, 44 aa, Triticum aestivum
  Clone ID: PAT_TA_44294.pep
CVSRLVSSSIYIDAITSQQFHPSSIDDMWSIKDAFRFQSKQSEI

SEQ ID NO: 149877 - protein, 52 aa, Triticum aestivum
  Clone ID: PAT_TA_44295.pep
WMCAMVQILRRISRMGPMCIFNSISLLISQSRKICNVVCKERSKVLEIISKR

SEQ ID NO: 149878 - protein, 73 aa, Triticum aestivum
  unsure (1)..(73): unsure at all Xaa locations
  Clone ID: PAT_TA_44296.pep
VRFSLSLKEGLNLDESEDXKRRQEELKVIFLGLCKVFKVELYCKEEKDIVSVRVXVDSPCCLVTADFGRSANM

SEQ ID NO: 149879 - protein, 66 aa, Triticum aestivum
  Clone ID: PAT_TA_44297.pep
SSSLLLASLTNYKSAADHPESAVRTYPAITHFTAEEDQTRIQSLLRKDISSGDTDHALTCLRQLLP

SEQ ID NO: 149880 - protein, 109 aa, Triticum aestivum
  Clone ID: PAT_TA_44298.pep
MGISRDSMHKRRATGGKQKAWRKKRKYELGRQPANTKLSSNKTVRRVRVRGGNVKWRALRLDTGNFSWCSEAVTRKTRLLDVVYNSSNNELVRTHTLVKNAIVQVDACP

SEQ ID NO: 149881 - protein, 47 aa, Triticum aestivum
  Clone ID: PAT_TA_44299.pep
RPVLSRLNSGSVLNNAMMMGADSGETEDESSRLMSEGMVLIGVGENT

SEQ ID NO: 149882 - protein, 97 aa, Triticum aestivum
  Clone ID: PAT_TA_44300.pep
TRKRTRRRRRPPLTGSATGGSERGRSLGYHAMQGREECKQLRRWTTRKRLGKNYNKKRPTTVRGKSEKGTHRHPLPGNEGEQIEKLKKTSLPTRTRT

SEQ ID NO: 149883 - protein, 93 aa, Triticum aestivum
  Clone ID: PAT_TA_44301.pep
KQWSGVVKRATSYAEQRGHNYDTASIEGASGSFTGINEQVFADYILHTCTFVEGPHYKALPAGDEGKCKVDNTRRRLIDTNHTCTHMLNCAIK

SEQ ID NO: 149884 - protein, 41 aa, Triticum aestivum
  Clone ID: PAT_TA_44302.pep
RPLFPGIYSSKLLLLSHIYAGGGETTTMPPWIIPSPVPDTL

SEQ ID NO: 149885 - protein, 53 aa, Triticum aestivum
  Clone ID: PAT_TA_44303.pep
QVDAKLRPTVSKVKRWQCSLEDRHHKLRLHVARATSISAPTSEDPQSHQNVQP

SEQ ID NO: 149886 - protein, 145 aa, Triticum aestivum
  Clone ID: PAT_TA_44304.pep
HPTAAIRNLPGCILYRSFDRDWIDSATANNRLHGIEWMKDDLLSAPLVGGHVAGGGAVEDEGEGHEQGAEDEREQHQARAPPPLRRRRLHRLRSPAAPLLVIAVGVGAVRASGDASSWATRLRGGVRRFDRNGARACVGGWLRGR

SEQ ID NO: 149887 - protein, 73 aa, Triticum aestivum
  Clone ID: PAT_TA_44305.pep
LIERLQGVWSDKVQEWEVCAMNETACPDMYICLFFFSFFQRKRKKCSLIIRLCIIRSAYYLKKIGSGICYLLY

SEQ ID NO: 149888 - protein, 95 aa, Triticum aestivum
  Clone ID: PAT_TA_44306.pep
NPRPPPPSRPLLRPPPPPTPTRHGSPRHLRRPAGQEPEPGPGQVAAPLPPPSRRPRRPPPRPPPWPAAAAATAREAWGGGVGRDLDSDFADAWAD

SEQ ID NO: 149889 - protein, 52 aa, Triticum aestivum
  Clone ID: PAT_TA_44307.pep
DSAYLQMKMALAILCRFFRFELVEGHPVKYRMMTILSMAHGLKVRVSRAPLA

SEQ ID NO: 149890 - protein, 92 aa, Triticum aestivum
  Clone ID: PAT_TA_44308.pep
MAPSQQVAATKEPSANGTAAPAPKTKTPALNERILSSITRRSVAAHPWHDLEIGPDAPTIFNCVIEIPKGSKVKYELDKKTGLIKVDRVLYS

SEQ ID NO: 149891 - protein, 132 aa, Triticum aestivum
  Clone ID: PAT_TA_44309.pep
SADAWAWASVKDICKDGGIFKKVLVEGQKWENPKDLDEVTVKYEARLEDGSVVSKSEGIEFAVMDGYFCPALSKAVKTMKKGEKVLLTVKPQYWFGEQGRPASEVEAAVPPNSTLHIDLELGFWKTITLIGD

SEQ ID NO: 149892 - protein, 63 aa, Triticum aestivum
  Clone ID: PAT_TA_44310.pep
RGSREHPLSRHGAGWTPHVTVATASRLPSLSPSDIREAPSPASLSSFVPACGTRERPARFGGR

SEQ ID NO: 149893 - protein, 114 aa, Triticum aestivum
  Clone ID: PAT_TA_44311.pep
IHGSGLPDPLIHPWIHLIGTVITTGSTSVAVYFDTNSVTRAVARAVVKPFCCSCWWSWVAWMAALMSLVDSLLDVSSALSSAVKRPTNGRSQGHYTTLYNTLQGLAAGKATSHI

SEQ ID NO: 149894 - protein, 103 aa, Triticum aestivum
  Clone ID: PAT_TA_44312.pep
VRKKPEIENETTPHSPSTLRGDTRRLLFDSADYPRQIPSSSQVEVSSRGSGELGFPRARVCGRGEEEQGWRMRWRSVTVRCPSSRAPTLPLAYLPPTAAPSRS

SEQ ID NO: 149895 - protein, 137 aa, Triticum aestivum
  unsure (1)..(137): unsure at all Xaa locations
  Clone ID: PAT_TA_44313.pep
VRPHVRPRVRRRVREEAKTKGVLINSLEWWFTPRLYELAQTDVQKGXVVVYIPAWAIYHNHTPCLYWLGXLILPFGDQLXSRLLYGWLMRHKVSLLXATLRDAVRNXFHDNDVMHDMLWPLVEVGERLQLWHAEMDV

SEQ ID NO: 149896 - protein, 108 aa, Triticum aestivum
  unsure (1)..(108): unsure at all Xaa locations
  Clone ID: PAT_TA_44314.pep
EKTHIIIVVIGHVNSVKSTTTGHLIYKLGGIDKRVIVRFEKEAFXLNKWSFKYAWLLDKLKAVRERCITIDICLCKLETTKYYXCSVIDAPDHRDFIKNMISGTFHAD

SEQ ID NO: 149897 - protein, 141 aa, Triticum aestivum
  Clone ID: PAT_TA_44315.pep
AFVHAFAEVHDGCPGRFVNLSHGYTRTLGPVLSAAARQCRPTGWSSDRSRRPVSFPFPVFVFRLLDCLGGPDFRSMILETDHSILPPAVSGDYALTLTFPSREELADILEHYDPVSPMLMPSRVFISAMPYDSNVGSCCSR

SEQ ID NO: 149898 - protein, 52 aa, Triticum aestivum
  Clone ID: PAT_TA_44316.pep
EGLCKVMLIRNSTIEGSVREFTNLVKNGSHGRENGRAKRGISGYGWEEKGTD

SEQ ID NO: 149899 - protein, 45 aa, Triticum aestivum
  unsure (1)..(45): unsure at all Xaa locations
  Clone ID: PAT_TA_44317.pep
LLASVTRTQQPLKAGGRSEMERQALECTEAWVDEWVEQGIXDRGC

SEQ ID NO: 149900 - protein, 82 aa, Triticum aestivum
  Clone ID: PAT_TA_44318.pep
FGVIIVRLHRVILILLAVRASRVDKQDAFYLALHKYTVCFHRGTREHHRGSLSPFQFGFHEDSHNIPCFCRQLLLGTSLDLL

SEQ ID NO: 149901 - protein, 64 aa, Triticum aestivum
  unsure (1)..(64): unsure at all Xaa locations
  Clone ID: PAT_TA_44319.pep
MFYLLSHLHSGWAVDQXAILAEEERLVIIRCGHDRDKTCMHMDEVLSWGVETIKNFAVIYLVVI

SEQ ID NO: 149902 - protein, 99 aa, Triticum aestivum
  Clone ID: PAT_TA_44320.pep
RVGSGWTTMLVFGDSTVDPGNNNRLQTVMRANFLPYGAGFLGGRPTGRFSNGRLITDILGTDALFFPCICFAGKSCVHKVPTGLLFQANGGGAYVQLQD

SEQ ID NO: 149903 - protein, 131 aa, Triticum aestivum
  Clone ID: PAT_TA_44321.pep
SSAMYNVDPATGQRAYLSVGSSALPSIYFLFCVVYAALAAGWVSILLRKRTAVFRIHYFMLAVLVLKGFNLLAEAEDKSYIERTGTAHGWDVLFYIFSFLKGISLFTLIVLIGTGWSFLKPYLADREKKVL

SEQ ID NO: 149904 - protein, 153 aa, Triticum aestivum
  Clone ID: PAT_TA_44322.pep
RPPTRPLDDNLAPKITDFGLSRQFDQRQTMSSPNRVGTLGYMAPERIDEGIITPKSDIFSLGVIIMEIITGHRHYPGVSGTSSEDFIELELKKWRNTLEKAQGYTNLEMDCEQNKRCIQIGLICVNPEWTERPTTTKIIKMLQGLESLDRNIS

SEQ ID NO: 149905 - protein, 53 aa, Triticum aestivum
  Clone ID: PAT_TA_44323.pep
YSVNRTNICPNRNLLVIMLINQSAGGSLRGSPPTYHLQSEFQLCSVFILDLLR

SEQ ID NO: 149906 - protein, 35 aa, Triticum aestivum
  Clone ID: PAT_TA_44324.pep
VAGLVLYMPDPLSYVALMVTAGVGMHACVSLGPVQ

SEQ ID NO: 149907 - protein, 86 aa, Triticum aestivum
  Clone ID: PAT_TA_44325.pep
YLPLLILINIHLHPSSWAVILRHSPTLPTSFIAPITSFILSLLSISMPCSTYIPPIPYVFHEHSTAFIYFFFITSLDSEFSIIFHF

SEQ ID NO: 149908 - protein, 110 aa, Triticum aestivum
  Clone ID: PAT_TA_44326.pep
GMRPRFSPTRAAPPKLLAGVGGTGGRSHQKEEAAPRCSTARAAPPVLLAGVRRRRREESSEGGGRTMLLAGGRRRRREESSEGGGRVALLVGVRRRRREEAPEGGGTRAR

SEQ ID NO: 149909 - protein, 134 aa, Triticum aestivum
  Clone ID: PAT_TA_44327.pep
LRSSRRRRRSLLLRLRQEERPELANLDQLEGGFASARGHETEEQRNKFLVLRLYEALNGRDHAAVHSLLAPDLEWWFHGPPAHQHMMRLLTGSSSPSSSSSFRFEPRSVDAFGSTVIAEGVSAAGEDTKAAYWV

SEQ ID NO: 149910 - protein, 103 aa, Triticum aestivum
  Clone ID: PAT_TA_44328.pep
VRGNVAKSLDPKELHKLLEACESMQKRSNAGTSEASNASGNTAAADAAGPSNCKAPFANGGNCWRTSYRVLPAQSNATMAAATETSACKTTNAHSKDTCNDMD

SEQ ID NO: 149911 - protein, 79 aa, Triticum aestivum
  Clone ID: PAT_TA_44329.pep
RMGEHLAWALLGLLKASVLNHDKCSLYPQVARLRHETKLNTAHSGHIGNMGNKVSVRDNESVVLLILYHPCILGLHHSP

SEQ ID NO: 149912 - protein, 109 aa, Triticum aestivum
  Clone ID: PAT_TA_44330.pep
RPRTRGRTRGKKLRSPPPPPPPFPVSLRRWSHHPPPRPALPRTTPPSTVSVPTWPEATAGSAPRRCRRPIEDLVLVRPAGGDGSEGPRARRPSTPATARLTRRPAPAVN

SEQ ID NO: 149913 - protein, 79 aa, Triticum aestivum
  Clone ID: PAT_TA_44331.pep
PEKVSHWRLYSSNRTMQRKLRQVRHGALLVVHAQALDRQPVRSVDVENQLPPVLAVAPVESELPQYEAEHDGVPGVGGR

SEQ ID NO: 149914 - protein, 143 aa, Triticum aestivum
  Clone ID: PAT_TA_44332.pep
VRPSSAAPPPPRAAPLHLEQAGGGADGSSPATVVDPRKGKGIAAVPPSFSPSSAGSIPDSASAFEAGGSSSSAGRRMVVPRDATLQFDYTRVFQQVVRAGQSVIIEECEEEQVESPHAKDALPGKEKEKKLPQVKVRPKPEKG

SEQ ID NO: 149915 - protein, 78 aa, Triticum aestivum
  Clone ID: PAT_TA_44333.pep
MGTMRRTKMGRAIMKREMQTWLAASRALVEMMIFIVPCPSKEQGYCGENLYEGPLGDLYAIAIRELDPEGPFMLDVFK

SEQ ID NO: 149916 - protein, 72 aa, Triticum aestivum
  Clone ID: PAT_TA_44334.pep
GKFENEYRDTFMQTVYNNFLGSWESGMIGEGCLLWQLFPEGAEHMNDGYAVIFAKSPSTFNLLANHSRKLEC

SEQ ID NO: 149917 - protein, 54 aa, Triticum aestivum
  Clone ID: PAT_TA_44335.pep
VAPESFSCCMALIPWTSTQFSIFFHYSPPMFPDHNDAIVLPVPVCNKDNILSFK

SEQ ID NO: 149918 - protein, 115 aa, Triticum aestivum
  Clone ID: PAT_TA_44336.pep
RPCKIYKDWKGGALSDYDGNFVGMNLTSVEERTSFLPTSIIIKHLRQSVPNMEVEGVTPVTLPRFEVIQATPYMHYPRDMYCGLDSVGYPKHATTTISEGLNLGNTFQKTFGQIY

SEQ ID NO: 149919 - protein, 63 aa, Triticum aestivum
  unsure (1)..(63): unsure at all Xaa locations
  Clone ID: PAT_TA_44337.pep
VRLTTWHLKNIGGPRKMLVTKSIKAGLQLPVGRIGRYSKKGRYASARXGSGALVYLVCLPQIP

SEQ ID NO: 149920 - protein, 61 aa, Triticum aestivum
  Clone ID: PAT_TA_44338.pep
SADSMLYGFPFVVEQATNCISQAIYSYILIGKRQQPFVLRHYYLTSTQYYTNHQCYRSVHP

SEQ ID NO: 149921 - protein, 83 aa, Triticum aestivum
  unsure (1)..(83): unsure at all Xaa locations
  Clone ID: PAT_TA_44339.pep
RPLTLWYINAQTEILLQKDPXTLTFKKGWGLPRRVYFNGDNCVMPPADAYPWLPNASPPMKQPWTLKLLVFWTALATLLAYYV

SEQ ID NO: 149922 - protein, 55 aa, Triticum aestivum
  unsure (1)..(55): unsure at all Xaa locations
  Clone ID: PAT_TA_44340.pep
RPLKGSPRVPGDEXEEDVDDLDNEFNYKQGNGKGPEWQGEDLICLIFCMNLNDPW

SEQ ID NO: 149923 - protein, 111 aa, Triticum aestivum
  Clone ID: PAT_TA_44341.pep
RPVNVWNTWDSVSPALPHWPACSAPAAYYALPAAGASSHALPRHLLPPLLSAGCPPTPRPHRLFPSPLWSPQATLPRRMAPHSPPAPALEGPTGLDRELHRRVAELAPRGT

SEQ ID NO: 149924 - protein, 124 aa, Triticum aestivum
  Clone ID: PAT_TA_44342.pep
SAHASARLYDDCAAIPALLDSPVRRRRAQAPPPRHSAWRRRLPNLPAGGQRTWWRNRLPLLPAPSLEAKKLVYLYQSRRIANKRSKKGPGSLSRSLAVLWPVFCLTKCRLPSFFGGSVPTGLRV

SEQ ID NO: 149925 - protein, 155 aa, Triticum aestivum
  Clone ID: PAT_TA_44343.pep
SVELRRMTFRIIVQIFMGGADERTAAELESTYTELNYGMRAMAIDLPGFAYHKAIRARRRLVAALQCVLDERRARGAKTAGVDMMDRLIAAEDEGGRRLQDDEIIDVLVMYLNAGHESSGHITMWATVFLQENPEILAKAKAEQEAIMRSIPSGQ

SEQ ID NO: 149926 - protein, 70 aa, Triticum aestivum
  Clone ID: PAT_TA_44344.pep
SAHAWGKQQSCTLIKKQYLADRICMNGSAFIHTYKPISTTTNEKLQDCLRTVLTSWIRCLLWEEHKGLLP

SEQ ID NO: 149927 - protein, 148 aa, Triticum aestivum
  Clone ID: PAT_TA_44345.pep
RPRLLPDNLKERIRRYEQYRWQETSGVDEEHLLMNLPKDLRRAIKRHLCLSLLKRVPMFEKMDDQLLNALCDCLKPVLYTEGGYIVREGDPVNEMIFITRGNLMSMTTNGGKTGFFNSDVLKSGDFCGEELLTWALDPNSSSSLPSLT

SEQ ID NO: 149928 - protein, 131 aa, Triticum aestivum
  Clone ID: PAT_TA_44346.pep
VRSTKVIDGQQLLCKLAIEGKKGKQQPQQSGPAGQQQPQMLQGGPPDMTGSGLGLGGPQMGGQYGGPGNGMPSFGAFGGPNPYANMPSSMGGGGGAGLGSMGNQMHSGMGSAGAGAFGTGGLGGGSFGGSI

SEQ ID NO: 149929 - protein, 61 aa, Triticum aestivum
  unsure (1)..(61): unsure at all Xaa locations
  Clone ID: PAT_TA_44347.pep
PFPEGVGFDMCRYKALESPVNAPLGTAALAXAAILVSATSLQPAGVRLPFYVPGRCCWWGV

SEQ ID NO: 149930 - protein, 136 aa, Triticum aestivum
  unsure (1)..(136): unsure at all Xaa locations
  Clone ID: PAT_TA_44348.pep
WRXDPRVRFSPSSLPSFLPLTFHSIKNPRERERAAMAPDERRLPDHHHLPSPSGSSEQAGDAAAPPAASLEDLQEASRAAALAGGPVDMATRPVIFPVVWELAPIAYLPRGDVSGDTATAAVLSGPAAAVTAGAPV

SEQ ID NO: 149931 - protein, 108 aa, Triticum aestivum
  unsure (1)..(108): unsure at all Xaa locations
  Clone ID: PAT_TA_44349.pep
MAPTKGEGPAIGIDLGTTYSCVGVWQHDRVEIIGNDQGNRTTPSYVDFTDSERLIGDAXAENQVAMNPINTVFDAKPLIQRRFADAAVQSDIKKWPYKGIPGPTDKPM

SEQ ID NO: 149932 - protein, 148 aa, Triticum aestivum
  unsure (1)..(148): unsure at all Xaa locations
  Clone ID: PAT_TA_44350.pep
VRGRVGKKKKKKKKKKKKKKKKKKKKKDHTKKKGKNSSRSFPIDLVREFARQILESVTFMHDLRLIHTDFKPENILLVXPDTIRVHDYKIPIPPPKDGSVFKNLPKSSAIKLIDFGSTTFDHQDHIFVVSTRHYRAPKVILGLGWKYP

SEQ ID NO: 149933 - protein, 147 aa, Triticum aestivum
  Clone ID: PAT_TA_44351.pep
SGATGGAGEFAQYDGETNTVAVTFANYDVAGNGRSRDFSAYTQDANSGVESFTGYGRTANSVGESFNSYGNHTNSIMSAFINYGDKANSATDTFDSYGVNGNTPQNTFRSYSSGSNGGADDFKGYRDNANGCDDRFTFYANDANGAT

SEQ ID NO: 149934 - protein, 141 aa, Triticum aestivum
  Clone ID: PAT_TA_44352.pep
SAGLTAYNHNLDTSREYYPNIISTRSYDDRLQTLQHVREAGISVCSGGIIGLGEAEEDRVGLLHTLATLPTHPESVPINALIAVKGTPLQDQKPVEIWEMIRMIASARIVMPKAMVRLSAGRVRFSMPEQALCFLAGANSI

SEQ ID NO: 149935 - protein, 144 aa, Triticum aestivum
  Clone ID: PAT_TA_44353.pep
SAISASQSSLLFLRTPVPALLSLRSASPGARLVTAVASKGPELGGGGSGGRDRAGSGGGGSGGSYRHGGLHEGEEDKMGEGLSMSHEHTLLYAALVGAGGVMGYMKSGSQKSLAAGGISALVLLFAHTRLLMRPVFASAIGLCI

SEQ ID NO: 149936 - protein, 120 aa, Triticum aestivum
  unsure (1)..(120): unsure at all Xaa locations
  Clone ID: PAT_TA_44354.pep
MAPKAIDKNPVENTLVAHKPKAVMNVPASKEGGDXNGKKKAMNSVETYKIYIFKVLKHVHPDIGISSKAMSIMNSFINDIFDKLASEFAKLARYIRMPTITYGEIHTFVRLVLPGELFKH

SEQ ID NO: 149937 - protein, 116 aa, Triticum aestivum
  Clone ID: PAT_TA_44355.pep
YADAWADAWGGDVWCAPVIPFAAEASSVDCVVARHQMLGRGRGCNAERPHRERPWLVRRASMQEQMSSFFMESPAATALHQLDGPFFGADLLPFARLRRMRGYRPFPGGLEEEIMM

SEQ ID NO: 149938 - protein, 130 aa, Triticum aestivum
  Clone ID: PAT_TA_44356.pep
MAGSSLWVGRLASLLAVGFVVGSVEASPGDAHPQYRTCVKECQNTGIIGSNIISHCQSRDNDSTSAGSSWYTQGPLYMQLKQQNCMSDCRYYCMIRREEERQLGGLSPVKYHGKWPFKRVSVFQEPLLAG

SEQ ID NO: 149939 - protein, 100 aa, Triticum aestivum
  unsure (1)..(100): unsure at all Xaa locations
  Clone ID: PAT_TA_44357.pep
MTTFLKAAATLMHAXIRGRSVNQRTAEDVYRPCGLDSGAMITCCLKVDIMEVGSNCSDAAKMDGFKLAIFTHLECGWSTQGAPKKMNFDEILSKNYIEGK

SEQ ID NO: 149940 - protein, 136 aa, Triticum aestivum
  unsure (1)..(136): unsure at all Xaa locations
  Clone ID: PAT_TA_44358.pep
LDECLTPGLNIEEYEGNAEATDDNLSVQPYNKRRPYTALLHGXLSATTTEYRVNVALKGAVDGDLDIYHSDTRYAGLKKDETSMDAEIHTSXVQGGHVLDYMRSIAHKEPDTCQTHFSEDITRGSYGAHMAAANKK

SEQ ID NO: 149941 - protein, 43 aa, Triticum aestivum
  Clone ID: PAT_TA_44359.pep
MRFESFKKAYYGAVKDAIGNDVKVLIADLEASQGAFQNYGLEE

SEQ ID NO: 149942 - protein, 100 aa, Triticum aestivum
  Clone ID: PAT_TA_44360.pep
SGGAICLLIHLRTPPGEWAVAVLVAPMCRISDRIRPRWPVPEILTLVSWFGPTLPIVPTVDLIEKSWMGPCERLIVARNPLRYNGRPRLGTAMELLRAID

SEQ ID NO: 149943 - protein, 52 aa, Triticum aestivum
  Clone ID: PAT_TA_44361.pep
MADASSRTDNSTVLDNDGKIYRLEQGQSGGAIMASNSSDRSDRSDKPLDQKT

SEQ ID NO: 149944 - protein, 120 aa, Triticum aestivum
  unsure (1)..(120): unsure at all Xaa locations
  Clone ID: PAT_TA_44362.pep
RTRTLLDLFYLLKSCTNQLRGWYQKGSETINMGNLQWWAXADQNTDANDKTYNQELRRIPRIKPTAFVYYWXSNVGPADITVANSSQGHVKQYKWQGVLHHDLTISLPENRLNTEGNTSA

SEQ ID NO: 149945 - protein, 46 aa, Triticum aestivum
  unsure (1)..(46): unsure at all Xaa locations
  Clone ID: PAT_TA_44363.pep
SRSTHAYVSSXXYLLHFPPLSQRRLYEWGGLTNAMCFLLVWYYFNL

SEQ ID NO: 149946 - protein, 60 aa, Triticum aestivum
  Clone ID: PAT_TA_44364.pep
FAVGARVCITSRVNPEVVPEVARAHIYAFINGSASARVTQRSAWPMRKAQVNVDKGSSAL

SEQ ID NO: 149947 - protein, 145 aa, Triticum aestivum
  Clone ID: PAT_TA_44365.pep
VRQAAACHPAPTAPPPARRRPASLTLREEEATMSPASARALTVDSLNPKVLALADHLRGAVAGRAQRMQKELETNPGLYPFDEIIYCNLSNPHYLGQQPIKFFREVLALCDYPHLLNCSVTSSIFSSDAITRAREILDLIPGRAM

SEQ ID NO: 149948 - protein, 60 aa, Triticum aestivum
  Clone ID: PAT_TA_44366.pep
MEANQSPPRKRPRRDRNREKASFLNSAEAMKLDIWSEFPEDLFETVIARLPVAAIFRFRS

SEQ ID NO: 149949 - protein, 97 aa, Triticum aestivum
  unsure (1)..(97): unsure at all Xaa locations
  Clone ID: PAT_TA_44367.pep
PLRATTYAHAXXLVTWEHTPPEHALSGAVTEKILVVSYGVVLXXLMTALKPCNASRPLGDVRLGKWSIPLFKLTLETGKLEELVDPWLERNFNAGKM

SEQ ID NO: 149950 - protein, 65 aa, Triticum aestivum
  unsure (1)..(65): unsure at all Xaa locations
  Clone ID: PAT_TA_44368.pep
RPHGLCDIXYMAPEYASSGKRTEKSDVFSFGVVLLKLMTGRKPVDASRPIGWIKALVEVGLDTLL

SEQ ID NO: 149951 - protein, 54 aa, Triticum aestivum
  unsure (1)..(54): unsure at all Xaa locations
  Clone ID: PAT_TA_44369.pep
PPLASXLSIFGLYSPLHIPTTRAGGLCLRCTPTTLGTGLRGCQPSTPKRTSDRS

SEQ ID NO: 149952 - protein, 56 aa, Triticum aestivum
  Clone ID: PAT_TA_44370.pep
WDFLAGRKSRMMDRNCFWGWPPAADADPAMGRRGPRPTIPGRSSGRFLELERVFGR

SEQ ID NO: 149953 - protein, 139 aa, Triticum aestivum
  unsure (1)..(139): unsure at all Xaa locations
  Clone ID: PAT_TA_44371.pep
SVEYLNIGGGLGIDYHHTGAGLPTPMDLINTVRESVLSRDLTLIIEPGRSPIANPCCLVNKGTGXVKSNGTKNLIGVDGSMAELIRPSLYGAYHHIELVSPSPGAEVATFDIVGPVCESADFLGKDRELSTPDKGAGLV

SEQ ID NO: 149954 - protein, 63 aa, Triticum aestivum
  Clone ID: PAT_TA_44372.pep
FVTSLLRITNSFSWRSLVGGTSGFKVKNFSLKILNRGLVDSNSKDDLAKGEFNLTSQVIILNH

SEQ ID NO: 149955 - protein, 87 aa, Triticum aestivum
  unsure (1)..(87): unsure at all Xaa locations
  Clone ID: PAT_TA_44373.pep
YAHXXFVPSAAYPIYLTNPVRGTNWKDGINKNKMMVRPRGDSKFEGLLCLASDAVDLLFFGSTHLHSSPCSSSWALLDSLGYIGAPG

SEQ ID NO: 149956 - protein, 82 aa, Triticum aestivum
  unsure (1)..(82): unsure at all Xaa locations
  Clone ID: PAT_TA_44374.pep
MATAGKVIKSIAAVAWEAAKPLSMEEVEVAPSHAMGVXFKILFTCLCHTDVYFWEAKGQTRMFPWIFWHEAGGITDRVREGG

SEQ ID NO: 149957 - protein, 48 aa, Triticum aestivum
  Clone ID: PAT_TA_44375.pep
RRRNPTIQSIRTASLGCRKSTAGSSRPPAQVTTTAMGTRARGLAKERR

SEQ ID NO: 149958 - protein, 50 aa, Triticum aestivum
  unsure (1)..(50): unsure at all Xaa locations
  Clone ID: PAT_TA_44376.pep
GIANTIQDDGDMVTTRNVLPWTVGYEHSAMSADRKRLAVVVVRLQRXGRT

SEQ ID NO: 149959 - protein, 108 aa, Triticum aestivum
  unsure (1)..(108): unsure at all Xaa locations
  Clone ID: PAT_TA_44377.pep
SAHTSEQYLGPGYKINPPPSCLRDLYDHGALAKGPMCFNLLKDRDRVAGAYSHHDAREATCCGDVELNAREGYAQLPXNVWYNVNESDMPYLPFIDEKYSCLDNWTYA

SEQ ID NO: 149960 - protein, 62 aa, Triticum aestivum
  Clone ID: PAT_TA_44378.pep
RPHTVSLGFTTLRPASGGPYIGKRCPFTGTVAIKAILISVTWHMAKVDPTIIGLRYYLHFAA

SEQ ID NO: 149961 - protein, 70 aa, Triticum aestivum
  Clone ID: PAT_TA_44379.pep
QTSLTKQKVIDYQIFVSGLAILLENISCKATVSSPYLPQRPGTAKLAHTAHACVLQFMGDRSRHVKQLFS

SEQ ID NO: 149962 - protein, 145 aa, Triticum aestivum
  Clone ID: PAT_TA_44380.pep
MAAGATVNREEEEDEDADGAAAEEEDPPVRANATASTSGVRLQEITTSNTRITTSTTIIQTTYGNRDEEHEDEEAVLEAACVGGGAAEREAAHHPGSKPATPGGSFPTTAMRSLRLRRRRDGRTSFACSSSRVGGGLPSPRVRGR

SEQ ID NO: 149963 - protein, 83 aa, Triticum aestivum
  unsure (1)..(83): unsure at all Xaa locations
  Clone ID: PAT_TA_44381.pep
MAEQTEKSFLKQPKVFLSTKKADRAKRPGRAGNRFWKSVGLGFKTPREAIDGTYIDTKRPYTGTVAIRRRIIAGTXHSAKMNR

SEQ ID NO: 149964 - protein, 145 aa, Triticum aestivum
  Clone ID: PAT_TA_44382.pep
RPQRSNWEADKMLDVYIYDYLVKRNLHNSAKAFMNEGKVATDPVAIDAPGGFLFEWWSIFWDIFDARTRDKPHDAGGPGAAAPPSMDMKSREHQMRLQLLQQQNAHLQRRDPNQPALNGAMNSDVSAVLASKLMEGMRNHNPMDS

SEQ ID NO: 149965 - protein, 85 aa, Triticum aestivum
  Clone ID: PAT_TA_44383.pep
RPQEMTLEEYEKMQEKKKSLEASKPEERRVAAVDFEGLQLLEKKKIEDDAKSKAENVRKAKEAAAKEAKPRKVKSTNNRHFDAEM

SEQ ID NO: 149966 - protein, 80 aa, Triticum aestivum
  Clone ID: PAT_TA_44384.pep
MMDQEHLDFIMRRHHHQGGMGFVPADRGDSEEALGSSESEPAGRPRGKRARAAEVHNLSEKRRRCKINEKMKALQSLVPN

SEQ ID NO: 149967 - protein, 144 aa, Triticum aestivum
  Clone ID: PAT_TA_44385.pep
SADAWGAVNISAACCSSLNEALDAGRRCLCSLLLANGVLAGLVATLIPTLPMVLPLPGCYLYAPALAACQGDRSFKLSLASARAWTLTPSSCFPFIWLVSVTLLQTSYDAPPASASVAAGVGDAAGGAVDPAPPQADIAPPPKN

SEQ ID NO: 149968 - protein, 147 aa, Triticum aestivum
  Clone ID: PAT_TA_44386.pep
VRGRVVDTAQAAARAYDQAVIKFRGVEADINFVLDDYKEDIGKMSVLSKEELVQVLRRQGAGFVRGSSRFRGVTLHKCGKWEARIGQLMGKKFVYLGLYDTEMDAAKAYDKAALDCSGEEAVTNFEPKAAVTCDGNLGLQAWDGEPD

SEQ ID NO: 149969 - protein, 146 aa, Triticum aestivum
  Clone ID: PAT_TA_44387.pep
VRPHAPTLKPPDAAAPTLHPQREPWRCGKNKRMSKGRKGSKKKAVDPFTKKQWDDIKAPMLFTSRNVGKTLVSRTQGTKIDLEGLKHREFEVSLADLQNDEDQAYRKIRLRADDVQGMNVLTNFRCMDFTTDKLRSLVRKRHTLIE

SEQ ID NO: 149970 - protein, 96 aa, Triticum aestivum
  Clone ID: PAT_TA_44388.pep
MEERGRGGSNKIRDIVRLQQLLKRWKRMAVAPGGRGKNGGGGGGAVPKGSFAVYVGEEMRRFVIPTEYLGHWAFEELLREAEEEFGFRHEGALRIP

SEQ ID NO: 149971 - protein, 101 aa, Triticum aestivum
  unsure (1)..(101): unsure at all Xaa locations
  Clone ID: PAT_TA_44389.pep
MSPAVWASRAGRGVASEEERCLPAYALSGSTAARLKQPPRPMRRLLPRRGRXRVVSGVQPTGMVHLGNYLGAIKNWVALQDLYETFFFIVDLHAITLPYDA

SEQ ID NO: 149972 - protein, 44 aa, Triticum aestivum
  unsure (1)..(44): unsure at all Xaa locations
  Clone ID: PAT_TA_44390.pep
AHAFAHPFSNPNRSGGAIMLRTASXPVAGCRYSRDLDHGGHQRS

SEQ ID NO: 149973 - protein, 136 aa, Triticum aestivum
  unsure (1)..(136): unsure at all Xaa locations
  Clone ID: PAT_TA_44391.pep
VRPRVRPRVRSDLHNANLGTPGDLQITKEEXVSLVDEAEKWCGLASQAVDVASHAGTSLDESLRCHEVLDSFDHEKSLTFDRPIYSQGRDGGLENNLYLLNGLPDLQGVDLGTPIDDLQGVQFYSQESLGSWLDRM

SEQ ID NO: 149974 - protein, 48 aa, Triticum aestivum
  unsure (1)..(48): unsure at all Xaa locations
  Clone ID: PAT_TA_44392.pep
KKALINYGNVTTTPVFYVLKNSRATFXKGAIREKWGLVLAFGPGLPFE

SEQ ID NO: 149975 - protein, 144 aa, Triticum aestivum
  Clone ID: PAT_TA_44393.pep
RPKLKRLEGQPSLTTTEVRLTRAEAPRKISELPGLVCDDISGGQENIPIPATNVVDDPPVPPSGFVYSKSLKISKGMKIPSDCAGCDCEGDCANNKNCSCAQLNGSDLPYVSFKNIGRLVEPKAVVFECGANCSCNRNCVNRTS

SEQ ID NO: 149976 - protein, 80 aa, Triticum aestivum
  Clone ID: PAT_TA_44394.pep
TKGISLSISDAALDTILSESYSPTYGARPIRRWMQKNVMTTLSKMLVKGQASEGSTICIEATDDKKGLEYEVVKKEASPH

SEQ ID NO: 149977 - protein, 128 aa, Triticum aestivum
  Clone ID: PAT_TA_44395.pep
MAGSPEQFRGQSRLPRFAAPLRYDLVLRPDLAACTFSGSASAAVAVSAPTRFLVLNAAELAVDRSSIRFQDWAPTEVAQFEEDEILVLGFGRELPLGEGVLSMDLTGTLNDQMRGFYRSKYEYNGEAR

SEQ ID NO: 149978 - protein, 145 aa, Triticum aestivum
  unsure (1)..(145): unsure at all Xaa locations
  Clone ID: PAT_TA_44396.pep
SGTIFDSLAEAYEFYNLHSWGVGFGIRYGKSRQNVSGTKCMQEIVCGCAGKPERENSSSMRSNCAAMLRLHRTDDGGWYVSENRAAHNHEMLLTCGXEKLHWPSHRHIDTYTRDLVKQLRQNNVNLGKVYSIIGSLFGRMENVPF

SEQ ID NO: 149979 - protein, 115 aa, Triticum aestivum
  Clone ID: PAT_TA_44397.pep
MTAQQELGERQAASLPNGIYEPPMQIMEGSPESGGTTTVERQDLAVRVQEAITDPLCVKDRRSALNGKSYPPSKEEAAHRMENVSLKGKRCNDLADKNITTVKRFMGHYHRDKSG

SEQ ID NO: 149980 - protein, 108 aa, Triticum aestivum
  Clone ID: PAT_TA_44398.pep
MGSRGELLPLPATGSSTATEPRDQGAAPGPQARLSPSLKRRWTEEASSSTAAGEEDRAPESPAPSAAPSGTTTATSTTRAPPPPGEGPALGGGEGDQPEVQGPAQPQP

SEQ ID NO: 149981 - protein, 56 aa, Triticum aestivum
  Clone ID: PAT_TA_44399.pep
MASAARGTRAVATMAKKSVGDLTAADLEGKRVLVRADLNVPLDDNQNITDDTRIRA

SEQ ID NO: 149982 - protein, 119 aa, Triticum aestivum
  Clone ID: PAT_TA_44400.pep
MDQTEALPDDTLASILGRLPPCDLAASRCVRKTWRAVVDARRLLLPHLLPHSLHGIFINYIDYESPRCFSRPSTQKPAIDCNLDFLPGYAEDFDSIVDHCNGLLLYESDMNLCSYVVNP

SEQ ID NO: 149983 - protein, 85 aa, Triticum aestivum
  unsure (1)..(85): unsure at all Xaa locations
  Clone ID: PAT_TA_44401.pep
LVFMLAXAALYMPFMMITVLNLGLYXKVVAGLSVRSGDRFAYYLYRRFLDMFWVVVMDIGNALIEEKLAVMNAVTVIYNDIFSHC

SEQ ID NO: 149984 - protein, 79 aa, Triticum aestivum
  unsure (1)..(79): unsure at all Xaa locations
  Clone ID: PAT_TA_44402.pep
LRGAGPAFGGYWILTDTEYSELVTXPVAGXTPFTTVDIISQEINSRCMTIIKAGTIVAATACSTLRGSGSFEVQPPLRI

SEQ ID NO: 149985 - protein, 117 aa, Triticum aestivum
  unsure (1)..(117): unsure at all Xaa locations
  Clone ID: PAT_TA_44403.pep
SEPRVRNNLARGHYTIGTXIGDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYD

SEQ ID NO: 149986 - protein, 86 aa, Triticum aestivum
  unsure (1)..(86): unsure at all Xaa locations
  Clone ID: PAT_TA_44404.pep
MSPHTSELKIYMLSEQDDWWGTKAFPGIVSAIVSTHKLNTSEYXRLLQHKIYMGPRFLFVTQWHIVIHVYYWLAKLLASYSMIRSI

SEQ ID NO: 149987 - protein, 70 aa, Triticum aestivum
  unsure (1)..(70): unsure at all Xaa locations
  Clone ID: PAT_TA_44405.pep
SAHAGGIVVCSAAAAAEAWEAEPVEKFRLDNLSPQKGARGKAXRKGRGIFAGAGPSLRFGMRGQKLCFGP

SEQ ID NO: 149988 - protein, 129 aa, Triticum aestivum
  Clone ID: PAT_TA_44406.pep
MDQSIDILLANACQGDDNLRSVAEGKLKQLHDLDLSNFLLGLSSQLLREETPEESSILAGIILKNSLDSGEPALDDLGSRKWLSLDPSIQSQIKENLLLTLESNCDSRRRSSKIIAKVIAWVACIEIPR

SEQ ID NO: 149989 - protein, 122 aa, Triticum aestivum
  Clone ID: PAT_TA_44407.pep
SAPPSSPRPRQGAFVFSSEANPNPAVGKVVLALDPLSCAEPSLQLKMEMPQTRETSTCNLPKSGPLNMFFLLRVFAIAILPCSANNATQLVYDTEGNELNSKANYYILPAKPASGGGLKAIP

SEQ ID NO: 149990 - protein, 89 aa, Triticum aestivum
  Clone ID: PAT_TA_44408.pep
VRPRVRPRVRGRVGNVLPSEAEKMPWLLEKMPGMIDDGDVLVFATKKARVDEVENQLNQHGFKVAALYGDKDQAFLMETLDKFKFGIYH

SEQ ID NO: 149991 - protein, 51 aa, Triticum aestivum
  Clone ID: PAT_TA_44409.pep
SIGILCLSGNKRCRCSYLNHHEEEAAEHELVNCHGVRRSTHFAATALLTNT

SEQ ID NO: 149992 - protein, 83 aa, Triticum aestivum
  Clone ID: PAT_TA_44410.pep
TEVSCLAMLWVDMQVCCCCCCCITNLGFVVGSTVSECCLGTSTTGTCMITACYRVDHESLSLGMACEKSVLQSATEWTIRVCL

SEQ ID NO: 149993 - protein, 60 aa, Triticum aestivum
  Clone ID: PAT_TA_44411.pep
KKYIQKPTGSIRRQSDTNSTQKGPIQSWPVLYRLSPVTGCSTLVAGPVYRTCFYCLHSYK

SEQ ID NO: 149994 - protein, 97 aa, Triticum aestivum
  Clone ID: PAT_TA_44412.pep
NSSPQSGGVEGYMAACARVWDYSQRQCLSRSLRLTIGGECGGVQSWSSRAHDTPGASERIAISMKRACPSSGDWPRRWCVLVALIASARRWTNAYPD

SEQ ID NO: 149995 - protein, 152 aa, Triticum aestivum
  Clone ID: PAT_TA_44413.pep
RPSTRPPTRSPTRPPTRPKAVGIIVEYKILQLRGGGDLPIRYLNLRGLETHALNFSDILSHDFARRTLYELRIQMCKMKEIILSHEFAQPSCCFGTLNQILLFHLSDLREIIWMETSPTSLFSRLTCLTVLFCGKLNDLSWAMYLPCLEQLI

SEQ ID NO: 149996 - protein, 152 aa, Triticum aestivum
  Clone ID: PAT_TA_44414.pep
SGSPCSFSPKECEAKFSEIQARYSACDAWFEELRKQRVAELKRELRKSESFIGSLQSVIESLSNSKHDNGNNLGCHTESCSHTENAADTTSSSKELSKDRSSAASFTEEASNSQKSQKVQNTSAETLSKPHAEKKLCAKDGLLWGSRKKRGL

SEQ ID NO: 149997 - protein, 83 aa, Triticum aestivum
  Clone ID: PAT_TA_44415.pep
MAIKRTKAEKKIAYDQKLCQLLEEYTKVLIGVADNVGSKQLQEIRKGLRGDSIVLMGMNTLIRRCIKVHSEKTGNKDFLELSN

SEQ ID NO: 149998 - protein, 152 aa, Triticum aestivum
  Clone ID: PAT_TA_44416.pep
RPSAVVDLSPYLKEAMYVGFSASTEGSTQQHTIKEWTFQTFGLPPATNASSFTNTTSNVSEPAVPGVAASGGATSKKRFGRAITILGPVALAVAFMFFACVSVKKLAELSSKKDAVFLPGLLKGPRKFNHKELSMATRGFHASRVIGRGAFG

SEQ ID NO: 149999 - protein, 141 aa, Triticum aestivum
  unsure (1)..(141): unsure at all Xaa locations
  Clone ID: PAT_TA_44417.pep
MCATFEERTREDQTAMEDQKRLNDALQMELTELKAHTESSLNVIKKFYEVRSRECECPSNITFEEKCSILLDDSADSWSFNLDGETSXFEASLEQENESLKAKISKLQSNLRMSFEIEQHLQRNVRTLEKKQALNDDLMRD

SEQ ID NO: 150000 - protein, 96 aa, Triticum aestivum
  unsure (1)..(96): unsure at all Xaa locations
  Clone ID: PAT_TA_44418.pep
MAHMSEAGDPFEFLPLSILADILGRVAHTRDIASCRLASRELLAVAYQCPRIRLDAFGRAPGLRKGGGGVEGTVFHTLAGNLASRLGSHXRSLVII

SEQ ID NO: 150001 - protein, 72 aa, Triticum aestivum
  Clone ID: PAT_TA_44419.pep
WGDPGYRVPTGWRHGKQGTCKQLTYGANAQFISYITYSFVHGGRPRALYLLSMHFGVGRVIRGKFTFLRQLL

SEQ ID NO: 150002 - protein, 148 aa, Triticum aestivum
  unsure (1)..(148): unsure at all Xaa locations
  Clone ID: PAT_TA_44420.pep
SGASRLSEACNKYMSLCQRRPDRNPQHSXQAPSSHWKXFEDGDLRDSCSSDMXSIDEPQADHGGSSNRSTSCGSVPYIDRLGNSQHSVDVPSGSSAEQQSKPTIQQTVDKQENETDAPPAPAKELSRRLSVQDRISMFENKQKEQTST

SEQ ID NO: 150003 - protein, 76 aa, Triticum aestivum
  Clone ID: PAT_TA_44421.pep
WRRSAASATAWAPGGCSSISGSRAWGHALGRGQGPALNFAGRLAARSKGGATEPPGARGHPVTPRASGSPGGGTGR

SEQ ID NO: 150004 - protein, 102 aa, Triticum aestivum
  Clone ID: PAT_TA_44422.pep
TDRPTVRSLAPPRGPFSRRRGRLQRRPRRCGSFRPRTSFSAWSLSYYSCAYSLPPTPPVFSLTDAVPTGGSSVTPRTSPPSVFTTGPALTTISEETGTRRPS

SEQ ID NO: 150005 - protein, 121 aa, Triticum aestivum
  Clone ID: PAT_TA_44423.pep
MLGHLVGLVKVRVTRGVNLAIRDLRSSDPYVVVRMGKQKLKTRVVRKSINPEWNDELTLSIEDPTIPVKLDVFDKDTFFDDPMGNAELDIGPLVEAVRMRVQLQGVADNTVVKKLVPNRQN

SEQ ID NO: 150006 - protein, 58 aa, Triticum aestivum
  Clone ID: PAT_TA_44424.pep
LQTALVAINLSNQGRKCIDTAEQFWYTAMLYKLSYCVNNQTWLDKFSGHDCTVINMQA

SEQ ID NO: 150007 - protein, 98 aa, Triticum aestivum
  unsure (1)..(98): unsure at all Xaa locations
  Clone ID: PAT_TA_44425.pep
RITKEEKHHKHKEHLGEMGAVAAGAFALYEKHEAKKDPEHAHKHKIEEEGGAPGAGRAGGFVFHEHHEKKQDHKEAQXEPAARKKHHHFGLDHRFTCG

SEQ ID NO: 150008 - protein, 52 aa, Triticum aestivum
  Clone ID: PAT_TA_44426.pep
RSSRSLTATSHLLGVFSRGASVPSAPCSFTAQTTLEIDFVYEGVDFYTTITQ

SEQ ID NO: 150009 - protein, 128 aa, Triticum aestivum
  Clone ID: PAT_TA_44427.pep
IILILLLLLLLLQLLLLLHLKERFLHYGVTTALQQRPPILPIHILEELVDDAADVGFAVSHLGEVVDRGVHPLLPGPRPPPGHCWTPIEGADGGRAFFFFFFLNRLSPGHAGDFISFMGQDTSTVVHI

SEQ ID NO: 150010 - protein, 93 aa, Triticum aestivum
  Clone ID: PAT_TA_44428.pep
LINTSPKYLCSIVYFDNHLKVRASQNNTTIIPLKNIRTQEHHRHTNQISYQTFVLQKYKEQATHSREEANFFKGHTTRRVLKCTTRPRRRGRK

SEQ ID NO: 150011 - protein, 63 aa, Triticum aestivum
  Clone ID: PAT_TA_44429.pep
TGSGGFTPGSLWRTESHTQTRTPWYMRRNLQEVTVAATLRTRVVIRFGQLLRKERSHHMELLI

SEQ ID NO: 150012 - protein, 98 aa, Triticum aestivum
  Clone ID: PAT_TA_44430.pep
SGLEAEVDIVQLFINPWQTHQEEIGKSRYTHASVKANTIDPHRVAHLADAKLTASWRHSRSPSTKESPTLFCTVGQNPATTKSAAHTVGSRKGTTLTS

SEQ ID NO: 150013 - protein, 144 aa, Triticum aestivum
  Clone ID: PAT_TA_44431.pep
RPRTRGLVESLRHVHLVLADEHNARVALFRLDWDKKMWMQDRVRGDRVLLLGRGCSASVPAASGRPPGMLLFAHQPSLSLVDVGGCGAGLAWFWAESWVDDGSDDMLVLKKKMHHRQGEFTAGDSFWFFPAIDPDERAMVASQA

SEQ ID NO: 150014 - protein, 76 aa, Triticum aestivum
  Clone ID: PAT_TA_44432.pep
MGRIPCCEKDNVKRGQWTPEEDNKLLSYITQHGTRNWRLIPKNAGESPAPADALVTSKERALLLFAGAERGCTRDR

SEQ ID NO: 150015 - protein, 77 aa, Triticum aestivum
  Clone ID: PAT_TA_44433.pep
MKTTAAEAAQQQLLDELAAAAKAAEAGNSTGAREILARLNHQLPPLGKPFLRSASYLREALLLALADGHHGASRITL

SEQ ID NO: 150016 - protein, 137 aa, Triticum aestivum
  Clone ID: PAT_TA_44434.pep
RPPSPQVYTSVVEPYNSVLSTHSLLEHTDVSILLDNEAIYDICRRSLDIERPTYTNLNRLVSQVISSLTASLRFDGALNVDVNEFQTNLVPYPRIHFMLFSYAPVISAEKAYHEQLSVAEITNSAFEPSSMMAKCDP

SEQ ID NO: 150017 - protein, 71 aa, Triticum aestivum
  Clone ID: PAT_TA_44435.pep
MASEEIKSKKQRNDECIINCLPEDLIERIFLRLPVSTLLRCVSVCKHWHNFIRDPQFVVSHLSVCAPRCPS

SEQ ID NO: 150018 - protein, 135 aa, Triticum aestivum
  Clone ID: PAT_TA_44436.pep
VRGRVGAGAVKQAPPTSHTDRAATYARIHGLPAKEARIHHGRRDATSAACDCERDRVQLQGDAGRSSSGRCRDCQRVGVLPRLHRLSLLHPALCNHFRTVLVLSADGRGGGGRQGERPTRRDAVLCRTPGGQWRI

SEQ ID NO: 150019 - protein, 111 aa, Triticum aestivum
  unsure (1)..(111): unsure at all Xaa locations
  Clone ID: PAT_TA_44437.pep
MSLTDVRIGEEVWLTCLSHALTNETEEVMGLLLGDVVSSSMGGFTAVIWGASPQMTCERKKDRVEVNPELLTRRVXAQAEVMTATIWKTTCLIGWYHSHPHITGLPFHADV

SEQ ID NO: 150020 - protein, 142 aa, Triticum aestivum
  Clone ID: PAT_TA_44438.pep
SAHASAHACGDDDRHDWYSLGRFDAAANKWTPIDTELELGVGLRYDWGKYYASKSFYDPVKQRRVVWAYVGETDSERADITKGWANLQSIPRTVELDEKTRTNLIQWPVEELDTLRINTTDLSGITVGAGYVVPLHLHQTAQ

SEQ ID NO: 150021 - protein, 71 aa, Triticum aestivum
  unsure (1)..(71): unsure at all Xaa locations
  Clone ID: PAT_TA_44439.pep
GLMYLGSMWFLSRRMTGHRNCSERSSTTSVLLIIIDQSASAHAMRRHPVRLAHRQEQRARHLHTXRGVXGR

SEQ ID NO: 150022 - protein, 60 aa, Triticum aestivum
  Clone ID: PAT_TA_44440.pep
TLETLRSPCKLAHAGSAQHYISGLSYFHSSRHELPDMVTKFWWRDLPYLLDLLALACYFL

SEQ ID NO: 150023 - protein, 74 aa, Triticum aestivum
  Clone ID: PAT_TA_44441.pep
EWTNDSVRAGQIRPSLRPMLLQPGTTAKASWTTTAARAPTGSLLHALRPRRGRRRTCANARGAGDRRSRSYGQH

SEQ ID NO: 150024 - protein, 74 aa, Triticum aestivum
  Clone ID: PAT_TA_44442.pep
SSGGSAAPPSPPGLVSGAGAPGRLVFDPGPPNQLGSRADPRPASVAALAPEFSLIRWIDHYIILVLHPHAGKAA

SEQ ID NO: 150025 - protein, 53 aa, Triticum aestivum
  Clone ID: PAT_TA_44443.pep
PEKVRLCLCTRTVVLSIGPRQISRTRNMIRMPASTGPGCPSLLLGVRELMNEH

SEQ ID NO: 150026 - protein, 109 aa, Triticum aestivum
  Clone ID: PAT_TA_44444.pep
RPATAAATTTAESSTTDSNGGAQAAREPTRVFTCNYCQRKFFSSQALGGHQNAHRRERTLARRAVHRLEAYPYGYADVASLPLYGSPGLYPIGIQARAVAAGPDAVPCG

SEQ ID NO: 150027 - protein, 115 aa, Triticum aestivum
  unsure (1)..(115): unsure at all Xaa locations
  Clone ID: PAT_TA_44445.pep
MLPYCGKYKDERIRNAAYIGTPGTGIRTADRSTWSIGKRFGCINVDNVEDNRRSLRELLLXTLGALQYLSGVILFEETLLQSTKGGKPFFDFLKAGNAPPXLRGVKGTIELAGTN

SEQ ID NO: 150028 - protein, 144 aa, Triticum aestivum
  Clone ID: PAT_TA_44446.pep
VRKTLNTGSLFYATLNALSYFYMVCTWGGYTFIINLIPMHVLLSIVTGRYSSRLYIAYAPLVILGTLLAALVPVVGFNAVLTSEHFASFLVFIILHVVAFLYYIKGLLTPRLFKMAMTLVITVGLADCFADVAILVALVASSPT

SEQ ID NO: 150029 - protein, 80 aa, Triticum aestivum
  Clone ID: PAT_TA_44447.pep
SADSFPYRELENGVLWEVDGHWVVQGAVDVDIGANPSAEGGGDDEGVVEQSLHLIKCSYLGGVIACIFAARFKPFIKWIL

SEQ ID NO: 150030 - protein, 147 aa, Triticum aestivum
  unsure (1)..(147): unsure at all Xaa locations
  Clone ID: PAT_TA_44448.pep
VSSXSYRKKERERFQISINIRVHLTSPKSIIARAPQASGHHSSPTGFRSLKWTPVAGGGGLTERRPGGPVPSLVLPALVPGGDHGGRLRYVLQLKHRLRSCVGWEQQLRWTRSRWGSIGAHGVARLPVRAPGRQLLSFIIAPRVRGR

SEQ ID NO: 150031 - protein, 128 aa, Triticum aestivum
  Clone ID: PAT_TA_44449.pep
RPRCFFLLWSVVHPLPDRGCAERRFAMDGLEFFFEEAESGLVPKTHAGDLLGGGIDVVESVVASIHEGRGRSSGVISSEPMDDSSAKEQFRVVGANLGSQNNGGSEVVCDLNDMVFQETSHASMGDEG

SEQ ID NO: 150032 - protein, 109 aa, Triticum aestivum
  Clone ID: PAT_TA_44450.pep
MAARNRSFVLWLHGLGDSGPVNEPIRTFFAAPEFRHTKWAFPCAPNSPVFCNNGAVMPTWIDIHELPLSPGSPQDESGVLKAVENEHAMIDREVAEEIHPDNIFESEPQ

SEQ ID NO: 150033 - protein, 134 aa, Triticum aestivum
  Clone ID: PAT_TA_44451.pep
MVPVREVVEDDPSGRFADLLDTVEGALPDGSDSDEKKASREYVAMDDKIGWVSRKRRDAMPDERSTSADRVTALEKALTGFADRDSETVVTPSVGLTFDSIIEAYKFYNLYSWETGFGVRYAKSRTNVKWDKMH

SEQ ID NO: 150034 - protein, 56 aa, Triticum aestivum
  Clone ID: PAT_TA_44452.pep
CVKIYSSVLRFLTDSNYNACKKQGLSSFIKHLHLHHTAFTHNPSCYYYYFLYNNVE

SEQ ID NO: 150035 - protein, 73 aa, Triticum aestivum
  unsure (1)..(73): unsure at all Xaa locations
  Clone ID: PAT_TA_44453.pep
YYALVGMRKNASSTDIRAAYRRIGMKWYPDRWASDPCATREAKRLLQPSQXRYFVLSYMGKRSIYDAGFFDTL

SEQ ID NO: 150036 - protein, 72 aa, Triticum aestivum
  unsure (1)..(72): unsure at all Xaa locations
  Clone ID: PAT_TA_44454.pep
RPPTRPATRAGTRTSTRPSKMEGVTTFSIDFPAQXVTEVGDVTPLGVLASVSKVKNAQIWAAAPPTKTDMAV

SEQ ID NO: 150037 - protein, 147 aa, Triticum aestivum
  Clone ID: PAT_TA_44455.pep
RPLGSLLLSSGDWTASHKAVRVTPLSHGHTSNRGLRSPHQIQACATMSCYATCTSYPKFSFPTCEDQYLSQYNGIRNLQRLVHQEPWNQDARYLLVLAIFQKAREEKYPKHICATLKRLVLQIMSSSSNSQEHKLILYEKYLLLLLS

SEQ ID NO: 150038 - protein, 121 aa, Triticum aestivum
  Clone ID: PAT_TA_44456.pep
VRARRQSLLAAAPCRRPPRRLAAPPPSAAASPTPRPNHRAPPPLYHLSDGQKFARKKCHRHKCRRMLASTAEVFHRILLEAAYVFSFPRLSFYIRSHCVIASTVASRLKPSHPSCLIKCRH

SEQ ID NO: 150039 - protein, 164 aa, Triticum aestivum
  Clone ID: PAT_TA_44457.pep
SADAWADAWADAWVRPEQEASCKATEDHRSEFDAAKPPPFRIGDVRAAVPAHCWRKSPLRSLSYVARDVVVVAALAAAAWRADSWALWPLYWAVQGTMFWALFVLGHDCGHGSFSDSGTLNSVVGHLLHTFILVPYNGWRISHRTHHQNHGHIEKDESWHPITE

SEQ ID NO: 150040 - protein, 74 aa, Triticum aestivum
  Clone ID: PAT_TA_44458.pep
PLNQQTNSRKTAPKDEQKLFQLSNLRAFTNFTGKGREVKQFNIKVVVLNRDSTRRRLLGRGLLRGERAHASADA

SEQ ID NO: 150041 - protein, 206 aa, Triticum aestivum
  Clone ID: PAT_TA_44459.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAPAPAAAAPAAAPKKAKK

SEQ ID NO: 150042 - protein, 121 aa, Triticum aestivum
  unsure (1)..(121): unsure at all Xaa locations
  Clone ID: PAT_TA_44460.pep
MEPAEAEAGGGIAAARSSPAAVQATNDDAAASKLSCVTKGYMKDDYVHHFVRRTTKRAPIINRGYYARWSVLRKLMLQFLNAXSGSDDQKRKQILSLGAGFDTTFFQLQDERLAPDLYVEL

SEQ ID NO: 150043 - protein, 128 aa, Triticum aestivum
  unsure (1)..(128): unsure at all Xaa locations
  Clone ID: PAT_TA_44461.pep
MGNRTSRHRRAAADQPATAPPPTAQPKPQPPPKPQTAPAPAPTPEAGQVAMGRVLGRPMEDVRATYTFGRELGRGQFGVTYLVTHKATGQRFACKSIATRKLVHRDDIXGVQREVQIMHHLTDHRIIF

SEQ ID NO: 150044 - protein, 160 aa, Triticum aestivum
  Clone ID: PAT_TA_44462.pep
MPEDFFTLTEMKDGISTTARIAELVSEIQKLRDAADFSTSDFIRQCSTAAKTLGSTNNEECLQHFVQLNGIGYLNQWLQDAQNCSKEVSSSAEGLINAILTALERLPVDDIHKAPCGLIPTVHQLLSHENTEISQKARLLCQKWSSAPNCGKNDRQIDAK

SEQ ID NO: 150045 - protein, 175 aa, Triticum aestivum
  Clone ID: PAT_TA_44463.pep
RPAFHGCAELFQDIHTELIQYRRNQMIKRGTVKEQLTVDSVSIKKNGSCPLMPEEVGLLLQALGYPSTTIIYLAGSETFGGQRILIPLRAMYANLVDRTSLCSQRELSDLAGPESPLSSDLPHPPPPKSEKELIEEWKKAGPRPRPLPPPPARPFYAHEKEGWYGWIGENDTEPD

SEQ ID NO: 150046 - protein, 155 aa, Triticum aestivum
  Clone ID: PAT_TA_44464.pep
VRLEAEVLALAGKALSASSSQRLSDVEIAVFGSRAHLEKQALATRKWYRNFLMKGFHLVVLLTAGPGIRDTQCGFKMFTRSAARKLFTNIRLKRWCFDVEIVYLCKHLRIPMAEVSVSWTEIPGSKVRMTSILHMVFELLLIRVGYGLGIWKIYS

SEQ ID NO: 150047 - protein, 212 aa, Triticum aestivum
  Clone ID: PAT_TA_44465.pep
SGGKAAARERREERRREVTLLRAVPYEPHQRWWDGLAPARAVAVVTGASRGIGYEISRQLAHHGLHVVLASRDAARGRDAAESILREQEAASAEWRQLDVADAASVEAFAAWTARTHGGIHVLINNAGVNFNRGADNSVEFAEQVIETNYFGTKRMIEAMLPLLKPSPYGGRIVNVSSRLGRANGRRNKIGDAILREQLLTDDCLSEELIDG

SEQ ID NO: 150048 - protein, 143 aa, Triticum aestivum
  unsure (1)..(143): unsure at all Xaa locations
  Clone ID: PAT_TA_44466.pep
RPASLRIDGAMNVDXTMNHQTNLLPYPRIHYMLYFYASSDLSCEGLPIERDDRLTEITNSAFERLVMMATSDLRHDKYMDXCFMYRGDVVPKDDIAAVGTIKTMRTIQLGGXRPTGYKCGVNYQRLGEGTRRLTLARFRGLCA

SEQ ID NO: 150049 - protein, 78 aa, Triticum aestivum
  Clone ID: PAT_TA_44467.pep
MRFWRDGGASGSGRDLNGGMPYGQVRVLVVGDSVRQEHANTRVSEQSKHHNQERDAARVVINYQVLMLDMEVDLQALG

SEQ ID NO: 150050 - protein, 156 aa, Triticum aestivum
  unsure (1)..(156): unsure at all Xaa locations
  Clone ID: PAT_TA_44468.pep
RSTPPWPPPPPAPXCPARSTTPPPPLWVDPLQPTTPQLLVLLSGSIRNRFQPSCRRPPPIPASSTPIRATLPTSRPNPSLRPLPPRWPTPPWRPAPGCRWWRGSMPLGPRSATASAWRPSTAWLRPWRRDGSICPGGVGQRETARSSTLWAPPQRR

SEQ ID NO: 150051 - protein, 179 aa, Triticum aestivum
  unsure (1)..(179): unsure at all Xaa locations
  Clone ID: PAT_TA_44469.pep
VRPRVRYCDSALLRRRHLRHGVXLYLRGQRIWEEAIQHLLSIGMASVDRALLTGCSAGGLAGILHCDQFGAFFAGRSTTVKCLVDAGLFLDAVDVTGGRSXRSYYGDIVAMQGVAPNLTATCTDHLDATSCFLPQSIIDSIKTLILLLNAGYDVWQIEESLAQSKADPRRSWRACKFNR

SEQ ID NO: 150052 - protein, 111 aa, Triticum aestivum
  unsure (1)..(111): unsure at all Xaa locations
  Clone ID: PAT_TA_44470.pep
MRPLVLVRSQVTVVFRWRCEWWWCFPVVVCPSELLLPLFSDDDAVDWLLILVRSRWFSCGCGAVPRSSCRTLFSSVTADVIKSSWRGFISDWVCMRHGLPSGRSTXCRCSA

SEQ ID NO: 150053 - protein, 123 aa, Triticum aestivum
  Clone ID: PAT_TA_44471.pep
VRGLYVQMQFFSGCGRVGAALLPLLGIWDLATGPSTHLSLLEFGLLPAPSIYQRQAVLVPGEGRQVGRSRAVFRLSLMLLHARSILMGFSLCCWFFLLGLLGFMLRVCAGLTAGRDSSAVQFG

SEQ ID NO: 150054 - protein, 101 aa, Triticum aestivum
  Clone ID: PAT_TA_44472.pep
MALLKAARVADVPSLDVVVPDHLAAAARVLDAESAAAMKRQQRGAGRRFAVIGHRGKGMNALASPDRRLQEVKENSIRSFNEAARFAVDYVEFDVQCAKMV

SEQ ID NO: 150055 - protein, 109 aa, Triticum aestivum
  Clone ID: PAT_TA_44473.pep
VRGRVGSNYRLYMNGPLGFGTCSYIVQHNPTSTVECTLPPPTAYSSKSRHHPTNATSPAHRIASHGGCGGGLQRGRGARARAPRVRLQRGADEPHRARSGPTLHASVPL

SEQ ID NO: 150056 - protein, 121 aa, Triticum aestivum
  Clone ID: PAT_TA_44474.pep
SAKTAAFSASSSSPWRAPAAGAGSGSRRARRRPRGASGGGRGGRWSSRATSRSRGAPPLTPAPPGLRYICRGKQLHQGTWLLAASPAALCMSSPTHSLAARVLTVSIGSIDYEEHYVSILN

SEQ ID NO: 150057 - protein, 146 aa, Triticum aestivum
  Clone ID: PAT_TA_44475.pep
MHGLGLVAESVVELGEVAADTETGVVENVSPEPLGAKDYSSDIPGDIDNDQSLDVSKKSKDSRSMKLFKVAIADFVKEVLKPSWRQGNMSREAFKMIVKKTVDKVSSSVPGNHIPKTPAKIRQYVQSSQRKVTKLVMGYVDKYVKL

SEQ ID NO: 150058 - protein, 145 aa, Triticum aestivum
  unsure (1)..(145): unsure at all Xaa locations
  Clone ID: PAT_TA_44476.pep
VRPRVRGHTVRHTVRAPEXDPNEEFLWELXGALERVHLLLAVLLAEVFLDASLSAVDSVFHAVFHAVFSYEDSYDAQENLQDPIVNGAVNVLRYCLRSWAPXGLVVFTFSCSCFRYCHHHVHGDVHAGLNESHCNDDCYCRPYWL

SEQ ID NO: 150059 - protein, 180 aa, Triticum aestivum
  Clone ID: PAT_TA_44477.pep
RPDFDKVKATLKGSMKMRFERSDDPLEHITTSDAIRRLFSYYQHSQHYLTARQKVDEMARVKGTVLDAGGSQASFGMQAVTLTKRSFVNMSRDFGYYWLRLVIYIVVTVCIGSIYLNVGTKYNSILARGACASFIFGFVTFMSIGGFPSFVEDMKVFQRERLNGHYGVLAFVISNTLSAM

SEQ ID NO: 150060 - protein, 194 aa, Triticum aestivum
  Clone ID: PAT_TA_44478.pep
YDEHEQEEDEHDRPRIHHSSQQQQPETIYQSPVCGLEGSWWRDELKHRGDGEFDSNWRRPRIEARPGRPSTRTARGIRRRSRPDLNPRRIIKLLLGGGGGRRSNHRRGGPRNRMAGPAEAPGSLASAPPPADQICLCRRLPALATGTNLGDRELRLLPLFLLRSPFRRAAPCFPAPFLSPFVRRSRPNPTRPRT

SEQ ID NO: 150061 - protein, 190 aa, Triticum aestivum
  unsure (1)..(190): unsure at all Xaa locations
  Clone ID: PAT_TA_44479.pep
MSCLALSDLRAGWDKQTVCVRVSRLWHYRGGLENGSVKLLHMILIDAHGNHGYAVVPTYFLVTYIDMLHEGVVYEFSRFSVMSSSXNPVDASLMIQFTQFTIVKNCFDLNDVFPEWAFNLTPLNELPLANDTPQAYIDVIGVIMAISPVKASRVPNTLRQVFRCRLILSDNNGHELEITFGVRVLFELME

SEQ ID NO: 150062 - protein, 73 aa, Triticum aestivum
  Clone ID: PAT_TA_44480.pep
TSFRVQQEPCDFETTTPSASHLLWPLIFSGDIESATTSLPQMYESKISSVMIVSSGCRPRPFSPDSIPPLFAW

SEQ ID NO: 150063 - protein, 190 aa, Triticum aestivum
  Clone ID: PAT_TA_44481.pep
RPRTRGINYQILSNPEFLAEGTAIEDLFKPDRVLIGGRETPEGRKAVQALKEVYAHWVPEENIITTNLWSAELSKLAANAFLAQRISSVNAMSALCEATGANVSEVSYAIGKDSRIGPKFLNASVGFGGSCFQKDILNLVYICECNGLPEVANYWKQVIKINDYQKSRFVNRVVSSMFNTVSGKKVGILG

SEQ ID NO: 150064 - protein, 92 aa, Triticum aestivum
  Clone ID: PAT_TA_44482.pep
ARDALLYRSERLLSTGVALRPTRLVTFVQLVNTYLLHGELKLRISLELRTLLSNSVTYLNGTERVSLASKLDRRILNRESIWSALVCVIEEC

SEQ ID NO: 150065 - protein, 39 aa, Triticum aestivum
  Clone ID: PAT_TA_44483.pep
FSSSESLRTMTSPALSCCCDVSSVLYVWPKLRGKLSNRT

SEQ ID NO: 150066 - protein, 148 aa, Triticum aestivum
  Clone ID: PAT_TA_44484.pep
RPPTRPQPPPSPSVPRRPADHRGPSQRPWPGRSASPPRSSPRAAAFRSAPTPTRWPTPASAAAPAPPSATRPRRRSPCPPPSAPRSSARPSSSSRRRASPTPATSSPPPPHQPPQLFPPRPRPCRSPSLLPTATMTTRTSTSSTASTP

SEQ ID NO: 150067 - protein, 216 aa, Triticum aestivum
  Clone ID: PAT_TA_44485.pep
SAHAVTNGNLPAVKYLIDHGADVHQQRAKGNITLLHAAAVHGYSEIVKFLLARGADVNAVSDLGTALTHAAIRGFPSIVKTLLEHNADPNKASCQFGLLSMALQKSSVSCVKLLIQGGAKVSGDSPRDNLLVKAAEKGLTEAIKCLLEAGANPNVPNTFGRLPIELAAEYGTREDVEILFPFTSPISTVANWSVDGIISHVKMEIKQLEDDNFVKE

SEQ ID NO: 150068 - protein, 58 aa, Triticum aestivum
  unsure (1)..(58): unsure at all Xaa locations
  Clone ID: PAT_TA_44486.pep
MIVSLGHLITVFDRSRAWSDRGAPSPARRSTAGAGAPATRGTWDAGERGGARFWGXPD

SEQ ID NO: 150069 - protein, 88 aa, Triticum aestivum
  Clone ID: PAT_TA_44487.pep
KKSLELALSLFDKGCMAVNVKEFGDAADCFRHALEIRVRHYGGLAHGCASTFYRYGGALLCIAREAANRSGNVSKRAPNEESITPTTN

SEQ ID NO: 150070 - protein, 72 aa, Triticum aestivum
  Clone ID: PAT_TA_44488.pep
PARTAMHEPTRMTREMMSNIWPPLLVYPTGFIQLWWSDLRSFHWLCRFFPSYCLAKPRQLSSYHLCMSIVTF

SEQ ID NO: 150071 - protein, 90 aa, Triticum aestivum
  Clone ID: PAT_TA_44489.pep
RQAIVQTLPPPYSKLPTSASTFRLGRRWRTAKGKTVACRPREQKGKPTARRSGKRRRWKEGVGTQAKGACSWLWGYERGVRMGGQCVRER

SEQ ID NO: 150072 - protein, 100 aa, Triticum aestivum
  unsure (1)..(100): unsure at all Xaa locations
  Clone ID: PAT_TA_44490.pep
RAPGSKMHTYTPSSATSTKAGFSSMLFCHRLRLLHLLKRRRGLRLRLIRHHRDNGGGRHVVRMQERALALKVASEIHGWGLWGIWGLLRTKIKEKRGXXR

SEQ ID NO: 150073 - protein, 109 aa, Triticum aestivum
  Clone ID: PAT_TA_44491.pep
IWEEQTKCEQDKVGNTRSCRCEWPALMRLLGSKDNGCPMHIFVRKCMSLISDRESRKIMRRSGQQSGGPLCEQIWQPRDMLGRYTLELYLSNSVIYYRSVVHIRWKRSK

SEQ ID NO: 150074 - protein, 117 aa, Triticum aestivum
  unsure (1)..(117): unsure at all Xaa locations
  Clone ID: PAT_TA_44492.pep
SALLGCCVDRDLYLVFVFSAGGSVSGNLHDGEEGAPAMGWEARDGVVVGTARGLEYLHKGCRRGIIHRDIKAFNVLVTDDFQPQISDFGLAKXVPTEWTHRAIAPIEGTFGCLAPEY

SEQ ID NO: 150075 - protein, 60 aa, Triticum aestivum
  unsure (1)..(60): unsure at all Xaa locations
  Clone ID: PAT_TA_44493.pep
MKGAKSKGAAKADSKLAVKSKGAEKPAAXGKKGMAGKVPNKPKRAPSAFFVFMGEFREEF

SEQ ID NO: 150076 - protein, 45 aa, Triticum aestivum
  Clone ID: PAT_TA_44494.pep
AVPPTPAQARRTSEEQGTRPGARKERCSAPSYDGGLFLFSQTLAK

SEQ ID NO: 150077 - protein, 76 aa, Triticum aestivum
  Clone ID: PAT_TA_44495.pep
KEVLVNGPQPVGSALEARSRPTITLCDSGGCEKTEHTRLARYRHVIQLVTSKTSKHKNQYLIFLKERHILMRKEKA

SEQ ID NO: 150078 - protein, 43 aa, Triticum aestivum
  Clone ID: PAT_TA_44496.pep
QIGGVLLSGSVLSCDGRFLCWIDYFSGVLLCDFVMYTLKLLGA

SEQ ID NO: 150079 - protein, 91 aa, Triticum aestivum
  Clone ID: PAT_TA_44497.pep
YAVLSAVLFLVPICSAQGRSFTYADTFFPHDDFYRCSMGRTYGCILQTVDDLLLLLQMSKVLIRSLFVVFKICNVRWRPGHVPLYDHQYIF

SEQ ID NO: 150080 - protein, 107 aa, Triticum aestivum
  Clone ID: PAT_TA_44498.pep
NMSLVFSFHLRRRPGLMATNPRCIFVLIRSSNWLQPMFFSCRRRRIHRSPRLDPTDPASAVPLPRASATVAGKLASAPGADDMRGRAGERGSRRTRGRTRGRTRGRT

SEQ ID NO: 150081 - protein, 44 aa, Triticum aestivum
  Clone ID: PAT_TA_44499.pep
FLPLFLIYYTTVGLVGCRLVCVFPVGYTVSPTLSGGLTFDSVSS

SEQ ID NO: 150082 - protein, 66 aa, Triticum aestivum
  unsure (1)..(66): unsure at all Xaa locations
  Clone ID: PAT_TA_44500.pep
ALPRRITLIENVTEPVQREQNPGFPLQVGYRLLKIWIAHARRQQLPNPGRRYHRFLTLDLRTRGRX

SEQ ID NO: 150083 - protein, 143 aa, Triticum aestivum
  Clone ID: PAT_TA_44501.pep
SAHASAIPEFLAAIGRGGWFSASQWAANPVTSPFLWCVGCNFPAKLLWDNLPMCRPCYGQALDKTASYECAKAHIQGEQDVDQALAQIRAEKALAQQQVDAALAQGRRIVIGPQRQLDHGQSFSAAPAHAHAQRCHRFGAPEP

SEQ ID NO: 150084 - protein, 106 aa, Triticum aestivum
  Clone ID: PAT_TA_44502.pep
MACIEPMRVLFTGTVRQIGFALGPMIARGVMLGADQPVILHMLDIEFGGEALKGAKMELIDAAFPLLKGVVATTDGVEACTGENGAGMGGGFPSEEGMGREGGMTK

SEQ ID NO: 150085 - protein, 42 aa, Triticum aestivum
  Clone ID: PAT_TA_44503.pep
LRELLYWVGSMGDTSAYRFKGFKHGLQFNTWDSLMPGPFISH

SEQ ID NO: 150086 - protein, 98 aa, Triticum aestivum
  Clone ID: PAT_TA_44504.pep
RSSTRPPTRPLVFQKVRAILGGRIRFILSGGAPLSGETHRFINICLGASIGHGYGLTETCAGGTFSEYNDSIVGRVGAPLSCSFIKSIDWGECGYLTS

SEQ ID NO: 150087 - protein, 45 aa, Triticum aestivum
  Clone ID: PAT_TA_44505.pep
MAAPRGAALALTKVLAAMLVAPPATVHAISCSTVYSTLMPCLQYV

SEQ ID NO: 150088 - protein, 51 aa, Triticum aestivum
  unsure (1)..(51): unsure at all Xaa locations
  Clone ID: PAT_TA_44506.pep
ISMLSQEDFEEDECNDXFCWLKKELFKRPTGAELEENECTVHADIVNHCLD

SEQ ID NO: 150089 - protein, 72 aa, Triticum aestivum
  unsure (1)..(72): unsure at all Xaa locations
  Clone ID: PAT_TA_44507.pep
MAVEKESTSVPLSQAAEAVDPXDPFKLSSRPSSFTTFTRMACCAVLLSWVSRKSMSGLLVLFSVSCLSCFLI

SEQ ID NO: 150090 - protein, 136 aa, Triticum aestivum
  unsure (1)..(136): unsure at all Xaa locations
  Clone ID: PAT_TA_44508.pep
VRSAYGSENDDLLLFNQFDVGQDFSDHHYALTSAGKMSKDLTQNNSXVWKLLQIDLPGSIYDRGHEDRIDLXRXVIVGPSGTPYYERLYLLDVRFTPEYPGCSTKVIYHXSWLCLNPNLSXRGNGCLILVNTFWGS

SEQ ID NO: 150091 - protein, 125 aa, Triticum aestivum
  Clone ID: PAT_TA_44509.pep
ASGYFFILHIRFFFLYRLSFFLVGKNSWVQIPSSASRRGHAHLTIGDYCIVHACAVMDEVYACLPTRHLLGFEPAVVVAPDERKPGAPAEVVNAVATSRLHYFTAATGANGGGYQPSGSPLGCDV

SEQ ID NO: 150092 - protein, 50 aa, Triticum aestivum
  unsure (1)..(50): unsure at all Xaa locations
  Clone ID: PAT_TA_44510.pep
MAPADAARRLLLLLAVAGAVLRPAAAEIKQESFKDXSRGTILFQKFGFSH

SEQ ID NO: 150093 - protein, 94 aa, Triticum aestivum
  unsure (1)..(94): unsure at all Xaa locations
  Clone ID: PAT_TA_44511.pep
YPLLDEWHSMGFRFTSCTTSCRMGFLLHHLGAYLKALSVAMEWGMPEGADYLGTLSIVHXNEWCXPWALAGFXGTSICLFQGSTKAIFTGVAKQ

SEQ ID NO: 150094 - protein, 108 aa, Triticum aestivum
  Clone ID: PAT_TA_44512.pep
MSGAAINFEEHYDEESINIDASSDSSLEPYDLSDDDTDLQKNFTHLSDLAAALRKPDDLDGVESALSSAEKLVRASPDELRHCSGDLVQALVHVLWSDVAMEGEENSS

SEQ ID NO: 150095 - protein, 112 aa, Triticum aestivum
  Clone ID: PAT_TA_44513.pep
GTLQLLTYPLVCSVPPIVVWVSYRYGIRNQVLFRVFGLIVSHASARSRSAGCIVLLWERVNERGDRPLPSCPSGPTGSTPWTVGGEQGEASAGFDVPRSVGSTKTITLYAQD

SEQ ID NO: 150096 - protein, 56 aa, Triticum aestivum
  Clone ID: PAT_TA_44514.pep
FVNKPTNEDMLLLPIRPSRIKPLAVCMYREKEHAEKERAKLSDRIGSEDHKQLTQG

SEQ ID NO: 150097 - protein, 63 aa, Triticum aestivum
  unsure (1)..(63): unsure at all Xaa locations
  Clone ID: PAT_TA_44515.pep
MAKEVSEEPEHAAPAHKDYFDPPPAPLFDMGELRMWSFYRSLIVEFVATXLLFLYIIVATVIG

SEQ ID NO: 150098 - protein, 105 aa, Triticum aestivum
  unsure (1)..(105): unsure at all Xaa locations
  Clone ID: PAT_TA_44516.pep
LMENAGKMEEQTEENQDXNKSQDDIKHTENGDVVIADGGPQKSQDSSSKTKQGKSVLIKQEERETGVVSTKVLSRYKNAMGGIWAVSVLFLCYTLTRTCPKERMP

SEQ ID NO: 150099 - protein, 112 aa, Triticum aestivum
  unsure (1)..(112): unsure at all Xaa locations
  Clone ID: PAT_TA_44517.pep
MAPTSLQRPRKPRCPSHAMLSLSPALLSLLLLVPFLYLLIHRSACSPPFSNLTTARRSSSSVSGFAGDLRDIEFXSWNHLPFMLSKPPSAKLKIAVFSRKWPVATGPGGMER

SEQ ID NO: 150100 - protein, 75 aa, Triticum aestivum
  Clone ID: PAT_TA_44518.pep
SADAWAVSFRSCEDSFDYVRGSSSWTRSSSLRDFRQDDHHPRYHFYLFLLVASLYHYVVLPITCLPCLPNGHDSL

SEQ ID NO: 150101 - protein, 131 aa, Triticum aestivum
  Clone ID: PAT_TA_44519.pep
RPAEQASDTKPSVVPHENGNDKLSNIDMHKLNDASSPILLSGTRADDLGDDSRQGSLSDEMNARSPSVEWHEKTAIVMTTSSVYCDDVAMDRAENAETKHIKPVQREFDHSEMETLEHQGALLQKAKLLLS

SEQ ID NO: 150102 - protein, 41 aa, Triticum aestivum
  unsure (1)..(41): unsure at all Xaa locations
  Clone ID: PAT_TA_44520.pep
MKAKAGSRAGDSRLAVKKSXGEKDPNKPKRPPSAFFVFMDT

SEQ ID NO: 150103 - protein, 37 aa, Triticum aestivum
  Clone ID: PAT_TA_44521.pep
VASSAQLRVGGGPAIVQGGSGHELEERGRGLCRNQCC

SEQ ID NO: 150104 - protein, 80 aa, Triticum aestivum
  Clone ID: PAT_TA_44522.pep
TRPRTRGRTRGRGLAMSGKTIWRRAGGYLPGRMAPLMRFYVFMSLAYLLVMVVWFSNYIRFLRYLLSIQNWITLLIAFGL

SEQ ID NO: 150105 - protein, 128 aa, Triticum aestivum
  Clone ID: PAT_TA_44523.pep
VRPRVRALQQVLTDDVDFNVMLTFLEFYETLLGFVNFKLYHSINVNYPPILDPRLEALAAELYALSRYMSSGRLPGNPESNGLIEDKETENNKESSKTDESELRLAQLQHQLPANEPCALMHLVEEST

SEQ ID NO: 150106 - protein, 106 aa, Triticum aestivum
  unsure (1)..(106): unsure at all Xaa locations
  Clone ID: PAT_TA_44524.pep
YXKNITLSLYFLSVPTHNTQARKFPVLQRIHIRIPIIGHYSSVSELLQRISADQTRDPSACIQGSSTAPYTVSSIMNTSTTLMTFLRNRIRPARPYPLHPLHLPRP

SEQ ID NO: 150107 - protein, 74 aa, Triticum aestivum
  unsure (1)..(74): unsure at all Xaa locations
  Clone ID: PAT_TA_44525.pep
MAAASSATSVHDFTVKDASGKDXHLSTYKEKDLLIANVASQCGLTNSNYTELSQLYPKYKDQGFENFAFPSNSL

SEQ ID NO: 150108 - protein, 86 aa, Triticum aestivum
  Clone ID: PAT_TA_44526.pep
VRTDASSAVPPGQNLLGCWRTRTVSSLATVSITSPTASPWSRSRAARRSSSFRSLFCQGLGYPPQRPAAIRGTQGRACSVSGPWER

SEQ ID NO: 150109 - protein, 122 aa, Triticum aestivum
  Clone ID: PAT_TA_44527.pep
MMAQPQLEKKAPARARPPLTGKVVAALCVASFAVGLLLSGWMPLLSAPISSRVNKTSAPGCDDNRVSKGLAGERHDPKGIISEVSRTHHAIQSLDKAVSSLEMELAVERARSGDAGAGAGGS

SEQ ID NO: 150110 - protein, 73 aa, Triticum aestivum
  Clone ID: PAT_TA_44528.pep
APRAGGRLQRRLPPELPRRALRQGPRRRLPLQRHLRAGLHLTQLLLHQASCQASWCSLSLRRESRAGASGRGV

SEQ ID NO: 150111 - protein, 90 aa, Triticum aestivum
  Clone ID: PAT_TA_44529.pep
MRSKANGDTAFKAFGKNKTATGGVAKPKRAPTPFFAFLAEFRPQYMEKHPEAKGVAAVTKAVGEKWRIMSDEEKAKYGGMKADAPASKGV

SEQ ID NO: 150112 - protein, 157 aa, Triticum aestivum
  unsure (1)..(157): unsure at all Xaa locations
  Clone ID: PAT_TA_44530.pep
MFQPFEELKGELSLVPQGKDQSLARHKFVDECEAALNEQINVEYNASYAYHSLFAYFDRDNVALKGFAKFFKESSDEERGHAEKLMEYQNKRGGRVRLQSIVTPLTEFDHPEKGDALYAMELALALEKLVNEKLHNLHXVATRCNDPQLTDFVESEF

SEQ ID NO: 150113 - protein, 157 aa, Triticum aestivum
  Clone ID: PAT_TA_44531.pep
SADAWEKVERSQDGQITEIVYKSSHNHPLPPPNRRSGIPLSQINDQQVHVLEKPGSHAGLNTASLWENGKSECIQDMQGVEGRPAAGPPVSAYGDTSIMESQDAADVSSTLSNEIDRATQGTISLDCDVGEDETESKRRKLDALAAVTIPTATTTSS

SEQ ID NO: 150114 - protein, 169 aa, Triticum aestivum
  Clone ID: PAT_TA_44532.pep
MRPSRDLRLAVLLLFSASVLLPAARAQQETEEEEEFSYSLDAENGPANWGEIKEEWSACGKGNMQSPIDLASPRVSLVRGLGYLNHTYAPANATIVNRGHDIMLKFEGDAGSVSIGGTPYFLRQLHWHSPTEHSVNGRRYDMELHMFHESAQGKAAVIGVFYEIGAHDA

SEQ ID NO: 150115 - protein, 117 aa, Triticum aestivum
  Clone ID: PAT_TA_44533.pep
MRKRERENPCGVCGHYHKCEEGEMWGVCGHRPAAADAVAPARVDSAFPSEVLKGFLFLGSYDNASRSEVLKTLNITHILNTVPDCHNLYRNSFTYHCLQDDKTLDFDGATQFLEQCE

SEQ ID NO: 150116 - protein, 165 aa, Triticum aestivum
  Clone ID: PAT_TA_44534.pep
VRKQVWAIADSKRLGYLGFGEFITAMQLVSLAQAGNEISQDSLQREDLISFNPPVMEGLDAQLAKSKHLAKRVDQDMDGFPQAQGPSTNHWFNSKSSKKIPLTAVTSVIDGLKRLYIEKLKPLEVTYKFNDFVSPLLVSTCILCICFLYELKMITSLALRVYIPS

SEQ ID NO: 150117 - protein, 133 aa, Triticum aestivum
  Clone ID: PAT_TA_44535.pep
RRLRQRELGDWEFHTFHKTTEILEDSQPQEIAFHETALGSTLVDHQNVHSTAAVSAGDIGMAEVSLLLGESDTSATGLLPVSFLSCSPRSMVPISVPSSSSLEAILTPNPMYSDVQLKEVMNYNATEMDESTE

SEQ ID NO: 150118 - protein, 60 aa, Triticum aestivum
  Clone ID: PAT_TA_44536.pep
AQLVLLWIAATVSTIYSHKYVLQHTKLYPAQSRIEHGCDITSMLLERYLTAELLQSLACI

SEQ ID NO: 150119 - protein, 138 aa, Triticum aestivum
  unsure (1)..(138): unsure at all Xaa locations
  Clone ID: PAT_TA_44537.pep
TEPSSPRRGHGGAGPPRPLLPLRPPPLPARPLRPGPAPRGRRRRPAAREFRPRPRRRRRRLRRPRLRPARGFLRRGLPPPXPLSGATPPRALPPDPAPPHPRPPPPPPAPAPPSPTPAARSSTRSRTRGGAPPPLAGA

SEQ ID NO: 150120 - protein, 136 aa, Triticum aestivum; identical to SEQ ID NO: 106789
  Clone ID: PAT_TA_44538.pep

SEQ ID NO: 150121 - protein, 61 aa, Triticum aestivum
  unsure (1)..(61): unsure at all Xaa locations
  Clone ID: PAT_TA_44539.pep
SASDPGFLVCTRRGRTGCXAHPISWHPANEIQPEPTGHPLAKIYRPVKTHKSKRSDHRTAD

SEQ ID NO: 150122 - protein, 68 aa, Triticum aestivum
  Clone ID: PAT_TA_44540.pep
DQTSSSSFPLNILCAFGFSLRSPPVSRFVFRSWPAHTSISMSVWLAFRRVEYSWRRKSRAPMHTRPRT

SEQ ID NO: 150123 - protein, 142 aa, Triticum aestivum
  unsure (1)..(142): unsure at all Xaa locations
  Clone ID: PAT_TA_44541.pep
RPVTSALIGYSFLTGFFRIGTIILALHDTSDVFLETAKLCKYXEKELGASLFFGLFALSWLLLRLIYFPFWIIKTSSYQSIISLRKLDRFPTTLYYIFNTMLLTLLVFHVYWGKLIFSMIMKQLNNKGKVGEDVRSDSDDDD

SEQ ID NO: 150124 - protein, 120 aa, Triticum aestivum
  Clone ID: PAT_TA_44542.pep
DCAHAEPHLALPPKKAVTKDLSQLFKGLKNMSFTYLILRFRMSTLEKTTIMPADLPTDESFDAFFVESRARDLQPRCGKKGRTRLGEHHNKRRSITKSREADKTPPLNHHASTSPLPQRA

SEQ ID NO: 150125 - protein, 194 aa, Triticum aestivum
  Clone ID: PAT_TA_44543.pep
VRLTQLGIDKDRVRFRQHLPNEMAHYAADCWDAEIECSYGWIECVGIADRSAYDLRAHSDKSGVPLEAHEKFAEPREVEKLVITPSKKELGLAFKGDQKMVLEALEAMGETEALGMKAALESKGDVDFKVCTLGKDVTIKRNMVSINMEKKKEHQRKFTPSVIEPSFGIGRIIYCLFEHCFYQRTGKTDDEQVN

SEQ ID NO: 150126 - protein, 95 aa, Triticum aestivum
  Clone ID: PAT_TA_44544.pep
PYYLLVSTTTCVSTVSLTGSLGSPCAVAAQSPRCRRGGAGAAVSGALSLLIDLAVTTSSLKPWVASNFPFGVLNANCKSRAGWLAVDLIGGYHMK

SEQ ID NO: 150127 - protein, 104 aa, Triticum aestivum
  Clone ID: PAT_TA_44545.pep
RCIRMTIHHCFFESTRQRHPHPRFSKIYISNDYTKDWGIYAICASVEAQLTHIGEGGQKTTIFNYMPEKAADREETTAGAEPLFLQALGIFLQCPYILHIHITI

SEQ ID NO: 150128 - protein, 90 aa, Triticum aestivum
  Clone ID: PAT_TA_44546.pep
ANRLFENNCFPSFDASSIARSIALRYPSTGAWKELLVLFLCRLIHPSFPGMVGSMAASLACCCSRLQQDPRRLTGDVKVSGYWFWRRWDP

SEQ ID NO: 150129 - protein, 95 aa, Triticum aestivum
  Clone ID: PAT_TA_44547.pep
MAPSTFPRALLAVSLVLLVVGGLGPAAEAQPPGRCVPQLNRLLACRAYLVPGAADPSADCCSALSSISRDCACSTMGIINSLPSRCNIGQVNCSA

SEQ ID NO: 150130 - protein, 94 aa, Triticum aestivum
  unsure (1)..(94): unsure at all Xaa locations
  Clone ID: PAT_TA_44548.pep
TRPPTRAGHSTPAXAPHRPIPNLRISPVPVTPTSPXPRLHPTSPAPPPPTPAPPARRAPPCPGVPLTDLLLPLRGRRGSTHPDAQTLTGDARSG

SEQ ID NO: 150131 - protein, 173 aa, Triticum aestivum
  Clone ID: PAT_TA_44549.pep
VRKFSTRELYLSEEFRVLIRSTERPTEQTRIEYLSLFSHSHFFIPEIFKDLKKVVVLDDDVVVQRDLSFLWKLDMGDKVNGAVEFCGVRLGQVRNLLGKTKYDPKSCAWMSGVNVINLDKWRKHKITENYLLLLKQVKKKDEVSLREAAFSLSLVSFQNLIYPLDGRSTLSGL

SEQ ID NO: 150132 - protein, 121 aa, Triticum aestivum
  unsure (1)..(121): unsure at all Xaa locations
  Clone ID: PAT_TA_44550.pep
MFTPQGKGWNGWSTPSPGNQRAGGGAPPASAPLGKAKGTSQRAAELEQELHEYQYNMGLLLIEKKEWAAKFDEVTHVLTQKEEILKRXQAAHLNAISEYERREXNMRKSLGVEKHCGADLE

SEQ ID NO: 150133 - protein, 129 aa, Triticum aestivum
  Clone ID: PAT_TA_44551.pep
SAHASAHPPPPPYHSSLPTASPLPSASLPPQTDCPSPLLQPPSLSLPTLHSDSRHSQIHPDAGHGGVRAAQARQPLGTGALLGPAQGRGDERGWLAARPPPGDPTSPTGMGPDPPRPSAPSSSTGTTTS

SEQ ID NO: 150134 - protein, 122 aa, Triticum aestivum
  unsure (1)..(122): unsure at all Xaa locations
  Clone ID: PAT_TA_44552.pep
RQASLRXPHVPRPFDAPDEPNRTSASRTSLAHPTSPTTPHAMDSPHAASASAMAAANDKRQKDVAELEHELDHNGDIHLLPMTTARSFARPRSRRARRVRCAPITRTGRARLAAAPRRPRTR

SEQ ID NO: 150135 - protein, 155 aa, Triticum aestivum
  Clone ID: PAT_TA_44553.pep
MLPRGATAALAPPRRSAAAPCHGPPRCRAEPPRPMRPPRRSSAASSSPRPPCSSRARHHNAQPRTRRASPSPRARHAPQPMPPCRPRTPPRATAAPRTLWLWNQLLEPQPSSYLSSHSNGGGRKRTVDTRFFGQRRTPPRAHERPNLFPLYTVSD

SEQ ID NO: 150136 - protein, 69 aa, Triticum aestivum
  Clone ID: PAT_TA_44554.pep
SNLLWSILYSLVQLHIVHSFSIYVINTSTMVLIAEQLVYIIYSCHAEYIFSRGSLAFGCLTYPPLRIKI

SEQ ID NO: 150137 - protein, 92 aa, Triticum aestivum
  Clone ID: PAT_TA_44555.pep
MERTQGFFAALKQEVARGLSPARARRRSESADLDAAALRFSGPGEMLAPLMEGPDPESGDGYGRAAGGARREGWGRWVRGQLARTPSSVAAA

SEQ ID NO: 150138 - protein, 59 aa, Triticum aestivum
  unsure (1)..(59): unsure at all Xaa locations
  Clone ID: PAT_TA_44556.pep
NGPPFFFFFFFFFFFFFFFFFFFXFFFFXXFFFFGHQCDWTFRSSNVIDYTQRTSRRKN

SEQ ID NO: 150139 - protein, 152 aa, Triticum aestivum
  Clone ID: PAT_TA_44557.pep
RPPTRPPTRPERGTLAARGTPRSPRPATMAAVRCAARRLGGSLLQRTQAAVAEEGRLLSPSRLMRSRQLSTKVSGERSQVAERHLLEPGSLMRSRQLSGEHARNIQKKEDDCWAGFIETLKRLDELEKKKKPNVFKQRMISIDRALKSLVYG

SEQ ID NO: 150140 - protein, 121 aa, Triticum aestivum
  Clone ID: PAT_TA_44558.pep
MSAAVMQATAPVGRSGGAEIAYVSYGGEQHLSLVMSLVDAELSEPYSIFTYRYFVYLWPQLTLLAFDAKDGKCVGTVVCKMGEHRGAFRGYIAMLVVLKPYRGRGIATELGTRAIRVKMES

SEQ ID NO: 150141 - protein, 74 aa, Triticum aestivum
  Clone ID: PAT_TA_44559.pep
MHYGHGEQYQYELIALLEGMDSVANTSIRMRPSRYEGMDSTAKKLIGMQLFRQESTARTSIWMDSTSVLDRWMT

SEQ ID NO: 150142 - protein, 148 aa, Triticum aestivum
  Clone ID: PAT_TA_44560.pep
MAADWTSARRAWEKWTGKHVGSSGMPIKAALLLNYDPTGPSRLFPMVAEQEGAKFTAVDLQPSMDFFRRNNLQTEFFSIGSNQYVVTSIHEHWFSARCVNTTQPGGEGVIIMQIGAYLLVSMYDGSVGSASRAMVAVDQFDGTLTGNT

SEQ ID NO: 150143 - protein, 167 aa, Triticum aestivum
  Clone ID: PAT_TA_44561.pep
MPAQIPRVRSLSLSLKQVQKATRRFSPALKLSESGSWEVYKGILPNNQIVAVRRAKKGCDRAAEVHKKVQLLTAINHWSLVRSLCFIDKGNQFIMISEYVPNGSLRQHLDGQHQKILDLDQRISIAIDVAIALTYLHLCAGETMICYDLKTTKILLTESYRAKLGTF

SEQ ID NO: 150144 - protein, 112 aa, Triticum aestivum
  unsure (1)..(112): unsure at all Xaa locations
  Clone ID: PAT_TA_44562.pep
MQRQGRHMERSGSKRALDPGGSGGGGGGDDDERDPKRPHVPALASVIVEALKLDSLQKLCSSLEPILRRVVSEEVERALAKLGPAAAPARIEGGTSPXRIEGPNGSNLQLQF

SEQ ID NO: 150145 - protein, 74 aa, Triticum aestivum
  Clone ID: PAT_TA_44563.pep
RPPTRPPTRTCNVSDGGKLQHSDGVHPSPGARFCGVASNCIWRLTCWFILVVRWLVLCRSFDLVLVRGTTTVLG

SEQ ID NO: 150146 - protein, 61 aa, Triticum aestivum
  Clone ID: PAT_TA_44564.pep
CGEVKSSKSLFGNFVLDRGVFYNHKLIPMLHPCFDSLSSSNYGLTFLEETSKYADYIWAVH

SEQ ID NO: 150147 - protein, 155 aa, Triticum aestivum
  Clone ID: PAT_TA_44565.pep
MSQDKAAGEKAAAEPKRQTPRLNERILSSLSRRSVAAHPGHDLEIGPGAPAVFNVVVEITKGSKVKYELDKKTGMIKDDRILYSSVVYPHNYGFVPRTLCEDNDPIDVLVLMQEPVLPGTFLRARAIGLMPMIDQGEKDDKIIAGCADDPEYPHL

SEQ ID NO: 150148 - protein, 83 aa, Triticum aestivum
  unsure (1)..(83): unsure at all Xaa locations
  Clone ID: PAT_TA_44566.pep
LSSCYKGWHPPNITTTQTYQEPKDPIIPTDWCSDTRLSFLLVVVHLLGSLPHLSALPPPPPQQADTETQSACCAPAATSXMRA

SEQ ID NO: 150149 - protein, 145 aa, Triticum aestivum
  unsure (1)..(145): unsure at all Xaa locations
  Clone ID: PAT_TA_44567.pep
CGRAXKXELDXXASXPAGTRAMDPFAAPSPTAPAPKYQSSSSIDGARNPPPPPVGIARRCWSWWCPASCPIIGIIPIAGGCSWPRPCCSWPSSSCIQSELLNRDSMAAVMAARCEGVWCGNGVGRSWHAAESQRWQSRTEESSGR

SEQ ID NO: 150150 - protein, 151 aa, Triticum aestivum
  Clone ID: PAT_TA_44568.pep
MNTTCRGENKYFLLFRTNRSIMQNQSDRMTSTLVKLLLTQPNVFLQWITYLGNINEPTSFSLTSINFPTPATGAKGPIFEDGPNFDTAFRVFHGRDGVVPLSEGAFAHIEKPLPKPAPEFNPLAAKAATISLSGFGGFFSFRDFSNKRISR

SEQ ID NO: 150151 - protein, 59 aa, Triticum aestivum
  Clone ID: PAT_TA_44569.pep
SGSLSAVCERVLGGCLAPSTMGGDGCDNMTMILVQFKKPVSDKKKADVGEQSAKGKEES

SEQ ID NO: 150152 - protein, 123 aa, Triticum aestivum
  Clone ID: PAT_TA_44570.pep
PTAAARGVGPQVHSSEAGSGIPRRRRRGGASPAAPASLPDDDDMLREILMRLPPQPSSLPRASAVCKRWLRVATDPRFLSSFSAHHRKPPLLGVFERDMYNIVFTPVLDPPNRIPPEKFPTRR

SEQ ID NO: 150153 - protein, 115 aa, Triticum aestivum
  unsure (1)..(115): unsure at all Xaa locations
  Clone ID: PAT_TA_44571.pep
MPPPPTRVHAASLSTPPLSRRAPXTRGKTQQKLTSEAAGRANQWRWHRQHPSSPSPPARPLRSGRAPPPSPRELAGGSAPGRPREASGGRRWSGGPGGRTTWRPGRRPGWSSKRR

SEQ ID NO: 150154 - protein, 79 aa, Triticum aestivum
  Clone ID: PAT_TA_44572.pep
TSPHPFFFFFPFFVFYLCSFISFLPFFFFFFFFFFFFFFFFFFFFFLLTAKFRHTPKGSRFSQAANYHTDQEGGREGGF

SEQ ID NO: 150155 - protein, 109 aa, Triticum aestivum
  unsure (1)..(109): unsure at all Xaa locations
  Clone ID: PAT_TA_44573.pep
EAAGGAEAAKEVGVADXVNGPGVAAGRAALAAATARGGGGGGGXGRKGGVIAASGGFRGEGRRGEGRGGLGFLREERLPRPAPGGEIFLSFFLSLREFRAQTGFHEQRR

SEQ ID NO: 150156 - protein, 146 aa, Triticum aestivum
  unsure (1)..(146): unsure at all Xaa locations
  Clone ID: PAT_TA_44574.pep
MAALRRGSAVALAALVAAAMWAGMASAAVYEVGDKVGWTIMGSPDYGAWAASKKFSLGDTLVFTYNKQFHNVIAVSKADYKNCNVTKPTATWATGKDSVVLNTTGHHYFLCGFPGHCAIGQKVDXRVLSGGPFTGPAKAPRPGAPG

SEQ ID NO: 150157 - protein, 151 aa, Triticum aestivum
  unsure (1)..(151): unsure at all Xaa locations
  Clone ID: PAT_TA_44575.pep
MRGFPLAGVLVALLLAAGELHCAATAAPAPPAKASAPPPQHPGAPPQHAPPGGARRHRPSHGRAPPVPRKQDPPSSPPPPPPKQDPPPPSPPQQQQDPPSPPPQESIPPKQVVPPIQDPDAXAPAQPPRGGNRSAVNTTGFGDSTVDPGNN

SEQ ID NO: 150158 - protein, 163 aa, Triticum aestivum
  Clone ID: PAT_TA_44576.pep
RPPTRPPTRPPHPRPPEQFHHPNQNNLMVGPVAFHLLQPKQQILPVIEEAPAQDDEDEGWGHWAMPQQQHPVDVEIHAGEFLKLNDLMGPLEVHVVQPEDDHSGLTLSLGLPSANVSSAESAIGAPGIPYLDELLAPLVLPEVQPVVPVAHAAFDLNQPIEQL

SEQ ID NO: 150159 - protein, 161 aa, Triticum aestivum
  unsure (1)..(161): unsure at all Xaa locations
  Clone ID: PAT_TA_44577.pep
MAARRAALQVTVCAAVVALALCAAGIGATPAARGAGCRKHVRRVTEYGAVGDGRTLNTKAFVRAVADLGRRAGDGGAALVXAGRWLTGPFNLTSHFTLFLHRGAEILASQDLDDWPLIAPLPSYGRGRGRAXGPRYSNFIGGSNLTDVIISGYNGTHHGQG

SEQ ID NO: 150160 - protein, 116 aa, Triticum aestivum
  Clone ID: PAT_TA_44578.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCE

SEQ ID NO: 150161 - protein, 154 aa, Triticum aestivum
  Clone ID: PAT_TA_44579.pep
MSPSLLGGLTKSLAMTVLSEVGDKTFFAAAILAMRHPRKLVLAGCLSALTVMTALSASLGWVAPNLISRKWTHHITTLLFFVFGIWSLWEGFKEEGESEDLAELEAKLDADFKSNKGESKNKSKATEDTKKKQRPFLMQFFSPIFIKAFSITFF

SEQ ID NO: 150162 - protein, 149 aa, Triticum aestivum
  Clone ID: PAT_TA_44580.pep
MGLRDKKRNQRRVLSRRSAGPKTGEGKDFLPLEGKEQRVREKKQPEEPESTATVLYIGHIPHGFYEDQMQGFFQQFGAVKRVRVARNRKTGKSKHYGFIEFENPEVAKIVADEMNNYLLFEHTLQIAPVPPEKGHAKLWKGVPKGFIPV

SEQ ID NO: 150163 - protein, 182 aa, Triticum aestivum
  Clone ID: PAT_TA_44581.pep
YSPVPIFWRRSPGLLPPVWRRPPTVPQQPEPEAIPSPTAPSSSETPADGSGSGSSSGSACAYDQWTLPEHRCHWKVVTPNTTVAMAFGPLAAQRYGPDMTLREALDGRGDPYRTLLREATAALLNAYYNAPGSPFLYPTTASVLDHLNGALLSSAQRVLIEGARFRRANTGGGGPAAHASAD

SEQ ID NO: 150164 - protein, 82 aa, Triticum aestivum
  Clone ID: PAT_TA_44582.pep
DTGLLIIVVARPQTNGQRSHLGTCNLSIQPNSIQSACNHQRTIRSDKEHVYGAECMIQGKVPLCVRSEMQCTQKTTSKFSSK

SEQ ID NO: 150165 - protein, 136 aa, Triticum aestivum; identical to SEQ ID NO: 106789
  Clone ID: PAT_TA_44583.pep

SEQ ID NO: 150166 - protein, 112 aa, Triticum aestivum
  unsure (1)..(112): unsure at all Xaa locations
  Clone ID: PAT_TA_44584.pep
MPELRRFAPNVXIVLVGTKLDLRDHRAYLADHPGASAITTAQGEELRKQIGAAAYIECSSKTQQNVKAVFDTAIKVVLQPPRRREVMAARKKTRRSSGCSIMHLMCGSTCAA

SEQ ID NO: 150167 - protein, 200 aa, Triticum aestivum
  unsure (1)..(200): unsure at all Xaa locations
  Clone ID: PAT_TA_44585.pep
ASEYILLNVRRDIRWRHXELAMWQSFLLDVADTEEPGQHDKSCADLVRELSYDIEDKIDNSMSLMLHHACPKSGIKKHMSKFKNLLPVKIPYQIAKDIKDIKSQILEVSNRCERYRFEDVCLARTEFVDPRLCTVDTCAADLVGIDGPKHELVKWLRNGEDESVHQQKVVSIVGCAGLGKTTLAKQVYDELRINFEYRAF

SEQ ID NO: 150168 - protein, 147 aa, Triticum aestivum
  unsure (1)..(147): unsure at all Xaa locations
  Clone ID: PAT_TA_44586.pep
MKEFSYQEIEAATGGFAAKNVVGKGSHGCVYXARLRGGAGHGRRLVTVAVKKASHPQGEAKLANEIAVLTAARHHPGVVTLVGAVAAAGRSPLLVMEFMPNGSLHDLLHRSPRPPPWPRRVEIALDVARAMRALHXAAPRVIHRDXK

SEQ ID NO: 150169 - protein, 163 aa, Triticum aestivum
  unsure (1)..(163): unsure at all Xaa locations
  Clone ID: PAT_TA_44587.pep
LKTKYVVRKDYSTTVHSLLLFNGTHSLIYIHQPWDREAPPTPAMESSNRLPXPSQAGTTVPSRRSLWSAAHTSTVSATAGSRPATKPTRTTTVTAAKGNPPPPPRPTPTPSATATPAGSSISIEAPLLRTSAPPMPRRGPDESADLMPAPSPSPMMPTHASAD

SEQ ID NO: 150170 - protein, 126 aa, Triticum aestivum
  Clone ID: PAT_TA_44588.pep
HLASVHIIPWRHLVAPNRPHLTTHSLSLLPLSPALHHQDYRQALAAEGPAASAGTEQGPASASAAPMGWRGGSGCAGEFACVARQNRRPREERGGFATRESSGSELDWRPPRSGTERQHGTTSTGR

SEQ ID NO: 150171 - protein, 113 aa, Triticum aestivum
  Clone ID: PAT_TA_44589.pep
MAAAASTMLESLPAPLLRALRLKTKQQELLLRVSALALIYVLAFAVRLFSVLRYESMIHEFDPYFNYRTTLYLTEHGYSEFWNWFDHESWYPLGRVVGGTLFPGLMVTAALLH

SEQ ID NO: 150172 - protein, 178 aa, Triticum aestivum
  unsure (1)..(178): unsure at all Xaa locations
  Clone ID: PAT_TA_44590.pep
MEESSEEDGDECSDSDDSNFITSSDNLEDVKEGEKVDDHGLPSDDSEDDDYDPAGPDSDEYIEEKQDNADFTSDSDDFCADITKSCHRDEVSSGHKVGGHTNGLEGASVRPSRSMSHLTTKDLEIGQDATXPSRRRQVKPLDYKNLYDAYGKAPSGSSYGEDLSKKCTPETEFTPSPQ

SEQ ID NO: 150173 - protein, 177 aa, Triticum aestivum
  Clone ID: PAT_TA_44591.pep
RPIATLPTSDQAKKFVDQFILLMKRDGYTLCNSTVCNGFSELTQQSTDVSQPGYLTGEHPQYQGFSPSVVKSVVINECKDAGFASEKRLPDVHANARQQGSQQWGLPDVHANVLYQGSRQWGLTDGHANAQHEGSQQWGMPDAHRYAMQQGSTRQRQSYAHTNVPQQGGNQQWGQPY

SEQ ID NO: 150174 - protein, 117 aa, Triticum aestivum
  unsure (1)..(117): unsure at all Xaa locations
  Clone ID: PAT_TA_44592.pep
HQLVVEVSSGINNSKSLGLKNEATSLLVHGCGDPQHLPLPADACGAITKGGAWSSPVASARGVEDAVAGPPSPPPPXAGSRRGHGGVGGXEQEAATXAPPPTGXPAATTPLXHRRXP

SEQ ID NO: 150175 - protein, 169 aa, Triticum aestivum
  unsure (1)..(169): unsure at all Xaa locations
  Clone ID: PAT_TA_44593.pep
RPPTRPPTRPRTRGPVQCKSLWRQFKAETEYTVTQAIAAQEANKRNNNWLPPPWALAAMAVLGFNEFMTLLRNPFYLAVMFVVFLVGKAMWVQLDIANEFRNGFLPALLSLSTKFVPTIMNILKRLADEGAAPAAPERQRETELQPRDNSSNSNXVTSAGSSRLTSSEN

SEQ ID NO: 150176 - protein, 166 aa, Triticum aestivum
  Clone ID: PAT_TA_44594.pep
VRPRVRSIRKRALGLVYLLVNDTNVKPLTKELVDYLQVSDDDFKEDLTAKICSIVEKFSQDKLWYLDQMFKVLTLTGNFVKDDVWHSLIVLISNASELQGYSVRSLYKALQACGTQESLVRVAVWCIGEYGEMLVNHISMLDVEEPITVTESDAVDALELALKRYF

SEQ ID NO: 150177 - protein, 152 aa, Triticum aestivum
  Clone ID: PAT_TA_44595.pep
VRINAGLYARELMDSSKKIVTENQGAPGMRTEEVLAMATVEARSPGSSTILVAHFDGQVLHVSNIGDSGLLVIRNGQVYTQTKPMTYGFNFPLQIENGVDPSRLVQNYAIDLQEGDTIITASDGLFDNVYDHEVADIVSKSLEADRKPTVRT

SEQ ID NO: 150178 - protein, 50 aa, Triticum aestivum
  unsure (1)..(50): unsure at all Xaa locations
  Clone ID: PAT_TA_44596.pep
MDLLRANLHKVRIPEPTNRIHKDECWRCFDTXRAEGGLYVDMNSVVGFGR

SEQ ID NO: 150179 - protein, 140 aa, Triticum aestivum
  Clone ID: PAT_TA_44597.pep
MSRFVDKLPFFDRRASPMEEADDIPRSGLLHLHGGHHHYQHHHQPQTALMAPEPSPPTTKQSSSTLAQLLKRVNDARSDASSPNSSPSHYTIELGASMPGSTGSESEHTSLTGVGVGVGDGTLLPVVLKFTDLTYSVKQR

SEQ ID NO: 150180 - protein, 130 aa, Triticum aestivum
  unsure (1)..(130): unsure at all Xaa locations
  Clone ID: PAT_TA_44598.pep
MVKAMAGCPAKMGFRMPAEWEPHEQCWMGWPERPDNWREHAEPARKTFERTAIAISKFEPVTICASAKQYPRVHELMEHQPNIRVVEMSMNDSWFRDTGPTFITREGXSDIGLAEQTIARIDWEITHGRT

SEQ ID NO: 150181 - protein, 121 aa, Triticum aestivum
  unsure (1)..(121): unsure at all Xaa locations
  Clone ID: PAT_TA_44599.pep
MDKICTQDMKKTYCQVILKFYSNMTVLLDTYMMELEEVSIMEAECITHMVGGFNTHLMRRIXLELERGVCLKLQDEEPENPMLFLPEKSVLEVNKDLLDKVTMDMLAFLGMACLTSFERAP

SEQ ID NO: 150182 - protein, 164 aa, Triticum aestivum
  Clone ID: PAT_TA_44600.pep
MHRQMAVAAWALLLLLSEAASRCAGQALVPGVMIFGDSVVDAGNNNRLATLVRADFPPYGRDFPATHAPTGRFCNGKLATDYTVESLGLSSYPPAYLSEEAQSDNRTLLHGANFASGAAGYLDATAALYGAISLGRQLDYFKEYQSKVAAVAGEKRAAALTSGS

SEQ ID NO: 150183 - protein, 105 aa, Triticum aestivum
  unsure (1)..(105): unsure at all Xaa locations
  Clone ID: PAT_TA_44601.pep
LISXEGRAWLVSQFCPLPNILPKAAQAPKISFFVRQPGIKEVDHEKLKYIAVNTPRLPEKFPIPCRNSTRDLRGHTRHSLSPPKYCIASSLFFIDHSLTQISIFP

SEQ ID NO: 150184 - protein, 166 aa, Triticum aestivum
  unsure (1)..(166): unsure at all Xaa locations
  Clone ID: PAT_TA_44602.pep
MDARDRKGKGVAPIQPRRAAPYPSGGRGEASSSSTPPPPPQQQGGRPIPPVLLGRMPPTPPVGLLDEALRVAPQMRTMDAQTLYLPGVPRVPASVPLAAPPPRIPPPHQHTAAPAANRQALLSGPRPPMAPSPHTANSSTSEPLNAMGSXQPPRAPRAPSPAPTST

SEQ ID NO: 150185 - protein, 68 aa, Triticum aestivum
  Clone ID: PAT_TA_44603.pep
VREHTPASHASPTRSSSPPGHRPRLRRLRHLRPQHSAVGPERFCCFRTFELERWYSPQQLPLRVRSQN

SEQ ID NO: 150186 - protein, 70 aa, Triticum aestivum
  unsure (1)..(70): unsure at all Xaa locations
  Clone ID: PAT_TA_44604.pep
YLCQREFALKYLPEDXCFQLVCTVFEVVPTILTDFGMVKNPLSNVDAHXSGVLLNHFGLTEARYYTVLFG

SEQ ID NO: 150187 - protein, 99 aa, Triticum aestivum
  unsure (1)..(99): unsure at all Xaa locations
  Clone ID: PAT_TA_44605.pep
VRSVARISVYKACWXGCASSDPLAAFDEAIADGVDVISASLGTMKARKFYKDTTAVGAFHAVSKGIVVSASGGNSGPGESTVVNVAPWFLTVGASTINR

SEQ ID NO: 150188 - protein, 136 aa, Triticum aestivum
  Clone ID: PAT_TA_44606.pep
FRPRVRIPGLVAHFSPTPTRGRPSFPPLFLALSPLPSAARFSLAKERGGAGCCHGGAFGGCDGGASGQFQGGADAACRVADRATHGARQDDRGEGGPHLSTRSTPTSPRPFMEALPSPDYWLRVGPVWFPLKGFYN

SEQ ID NO: 150189 - protein, 92 aa, Triticum aestivum
  Clone ID: PAT_TA_44607.pep
FDLEGLFYITAKHWINRKFAPRKKNTTWAESCWPNRKRGSREASYIGPWPSWWRGEAGRALAGRPTRVLDRSCPCRSHWIEAGTSMVNGGAD

SEQ ID NO: 150190 - protein, 48 aa, Triticum aestivum
  Clone ID: PAT_TA_44608.pep
LKMHAQLNVGAFHTLRHEKVTLQVCYIKRFFVPQTSTPLSTRLFVCHS

SEQ ID NO: 150191 - protein, 86 aa, Triticum aestivum
  Clone ID: PAT_TA_44609.pep
SPPRNAAEHTTPLPLPRPPRSPPARHRRPRRSRAAPFPWRPDRGRGIVAGMGGEGRAGGGMGVDARDCARWLDKLAGRVGGRVGGR

SEQ ID NO: 150192 - protein, 86 aa, Triticum aestivum
  Clone ID: PAT_TA_44610.pep
FDGGLPTPVVAVVGLAALVASAPLEEVVDEALDPARRLADLAVDGAQHLPRGVPAAGAAGAIAAAVGISFDRRGHLWSRWRRTRGS

SEQ ID NO: 150193 - protein, 103 aa, Triticum aestivum
  unsure (1)..(103): unsure at all Xaa locations
  Clone ID: PAT_TA_44611.pep
MAFGAAVREGAGDGVVTFLXVLCVSTLGASTAAGTTYLSLHEGIHYALLVTXSILALLLFAFNLLCDALCGASFNPTGVSCFYCGGLTSPFALVHRAPPTSAS

SEQ ID NO: 150194 - protein, 59 aa, Triticum aestivum
  unsure (1)..(59): unsure at all Xaa locations
  Clone ID: PAT_TA_44612.pep
KIFELAIPGKRKEVEATNIVEXHLAIDGINYVIDPAFVKIDVNNLREGIDKLERVGERR

SEQ ID NO: 150195 - protein, 93 aa, Triticum aestivum
  unsure (1)..(93): unsure at all Xaa locations
  Clone ID: PAT_TA_44613.pep
CMVRLDPELLNLGAXLLGAKHENGCLSXSESLHKSIXSPKNQLLSLYTQIAGRFGELHDTSIRMAANGVINNGGYWEDSRTFFYKRLRRRISL

SEQ ID NO: 150196 - protein, 60 aa, Triticum aestivum
  Clone ID: PAT_TA_44614.pep
CSFYTCILQGKLARVTAKAFGTAVSIMIGFQKDLEWFDLVEILLPLDITILIIKLCKDIF

SEQ ID NO: 150197 - protein, 92 aa, Triticum aestivum
  Clone ID: PAT_TA_44615.pep
MAFDKIQVANPIVEMDGDEMTRIIWEWIKDKLIFPFLDLDIKYFDLGLPNRDATGDKVTIESAEATLKYNVAIKCATVTPDEGRVKEFNLKA

SEQ ID NO: 150198 - protein, 60 aa, Triticum aestivum
  Clone ID: PAT_TA_44616.pep
KFTDDKFIIYWFNVEQHLIFVLSAVTLYGNRNFLYAVKGLTQEQTAPTGNPPNKFAICVL

SEQ ID NO: 150199 - protein, 127 aa, Triticum aestivum
  Clone ID: PAT_TA_44617.pep
VRGTTRLSHPFHLPQPTASAIMAGLPQLLLILFPAEVAVLTLLLASAAGARAHASSSSSSATYRCGWCPRRSTASILPPGAGALTGAACGYGGQAADMAVDGGFHIAAVSASFFRGGRPCLALLPAD

SEQ ID NO: 150200 - protein, 68 aa, Triticum aestivum
  Clone ID: PAT_TA_44618.pep
PPAHRRGQNKHDRPSHNPIPSCPRTASSPIQERNTASRSSDQDPLPETMDPLKNQAIFLFLLWRLRGR

SEQ ID NO: 150201 - protein, 114 aa, Triticum aestivum
  Clone ID: PAT_TA_44619.pep
MGPIKIGINGFYRIGRLVARVALQSPDVELVAVNYPFITTDYMTYMFKYDTVHGQWKHHEAKVKDSKTLLFCQKEVAVFGCRNPEEIPWAAAGAEYVVESTGVFTDKDKAAAYI

SEQ ID NO: 150202 - protein, 55 aa, Triticum aestivum
  Clone ID: PAT_TA_44620.pep
ESQSRPTRTPTLTRTCTEREFFACSYASIGAVSCYLVDYHQQRDIAGPSFYKEYT

SEQ ID NO: 150203 - protein, 101 aa, Triticum aestivum
  unsure (1)..(101): unsure at all Xaa locations
  Clone ID: PAT_TA_44621.pep
MHFSVKTLTARTITLVVECSDTINNVXAIIQDMEGIPPDQHRLIFAGKQLEDGRTLADYNIQKESTLHLVLRLRGGMHIFVKTLTGKTITLEVESSDTIDN

SEQ ID NO: 150204 - protein, 77 aa, Triticum aestivum
  Clone ID: PAT_TA_44622.pep
MEPSSQPEPVVGVATAGSQAYPPPAAYPGPAMPAAIPPGSQPAVPFPANPAQLSAQHQLVYQQAQQFHQQLQHQQQQ

SEQ ID NO: 150205 - protein, 48 aa, Triticum aestivum
  Clone ID: PAT_TA_44623.pep
SVLLNKLQELSMAKLRPDFCSSHLPSHALSSVRLALGSNLARAILEEA

SEQ ID NO: 150206 - protein, 56 aa, Triticum aestivum
  Clone ID: PAT_TA_44624.pep
AIVPICQFWGSFTACSSAWGGAVARGRSPATTSYSCCRDHHHCVYKKGSTIPFVAL

SEQ ID NO: 150207 - protein, 63 aa, Triticum aestivum
  Clone ID: PAT_TA_44625.pep
LPFSQTNGTHIRRLRPAPAPRDAAPASLHALSPSPRRAVPRPPQAVPLRLGLRRLRSHQRLVA

SEQ ID NO: 150208 - protein, 93 aa, Triticum aestivum
  Clone ID: PAT_TA_44626.pep
CASAVIRVQVHRCLVGLRGYMYHVARDQHGWRFFQQRLDDGKREVYFIFTGVARHAVDLMVNPVGNYLMHKLVGALREGAYGRASCSPLTKDP

SEQ ID NO: 150209 - protein, 50 aa, Triticum aestivum
  Clone ID: PAT_TA_44627.pep
LRGKYLVRIFLQLSIGLTSIHILIAIVHSFIVATPLHMKPPPWRQHLLYR

SEQ ID NO: 150210 - protein, 59 aa, Triticum aestivum
  unsure (1)..(59): unsure at all Xaa locations
  Clone ID: PAT_TA_44628.pep
IWHGHRREPAPKDVLMLPLLLHDAHARVTHIAMTVVRGPTRHAHEYEDDGVEXGIXERS

SEQ ID NO: 150211 - protein, 111 aa, Triticum aestivum
  Clone ID: PAT_TA_44629.pep
RPPTRPCSPTPDCDPNNAIIVEAYRRSRIKLPTPCMTPLLNQQQRGPRNWENMCSDQYMRRCMRRHKDSCCGAKDRMFSTESMMSYGFFKITEATSVSYYNEAYWTLQQWC

SEQ ID NO: 150212 - protein, 95 aa, Triticum aestivum
  Clone ID: PAT_TA_44630.pep
KLVYIHVLEKAISEYLVKTLATPNVLSSSYIYSKSWCGDESTNRMGPIFPRSKYLPVAALISGRAAWTYWDWDRLLQLPLGRTLTFVALDVITEI

SEQ ID NO: 150213 - protein, 52 aa, Triticum aestivum
  Clone ID: PAT_TA_44631.pep
VARVATQREHQRGNPRSDGIEQRGPEITRPPKRFWGGRMKCCNGTTGPLQIA

SEQ ID NO: 150214 - protein, 61 aa, Triticum aestivum
  unsure (1)..(61): unsure at all Xaa locations
  Clone ID: PAT_TA_44632.pep
MHNEVLDMVDLYIPRKCSATNRIITVMDHSFVQINIGHXVDENGLYDGRFTTFALFGFVRA

SEQ ID NO: 150215 - protein, 38 aa, Triticum aestivum
  Clone ID: PAT_TA_44633.pep
SALSSLAPQPTPSSLPTHAQRAMDAMNEVRNLDLERYM

SEQ ID NO: 150216 - protein, 63 aa, Triticum aestivum
  Clone ID: PAT_TA_44634.pep
QFLPRLATRSPGLPSGNRSAPPHWRRAVVGCRKINDLRPSLSRQIPPLPTNPGLGNAANVRGR

SEQ ID NO: 150217 - protein, 87 aa, Triticum aestivum
  Clone ID: PAT_TA_44635.pep
RCRSIFPFCPASSPPSPCLCGSSLVFSPPPSRPTVGPVRHCLARRKGQACSCRPRSPRRTTTRIDLPTFIRRRVIKRPYWSCRPCQA

SEQ ID NO: 150218 - protein, 40 aa, Triticum aestivum
  Clone ID: PAT_TA_44636.pep
TKSDLSPYLSPRLGLFLLPTTRKIQQEVAKQSTEGKYTGR

SEQ ID NO: 150219 - protein, 65 aa, Triticum aestivum
  unsure (1)..(65): unsure at all Xaa locations
  Clone ID: PAT_TA_44637.pep
MSLIAGEEFQHILRVLNTNVDGXQKIMFALTSIKGVVRRFFNIVCKXSAFDLNMRAGELFAVEMV

SEQ ID NO: 150220 - protein, 72 aa, Triticum aestivum
  Clone ID: PAT_TA_44638.pep
VRGRVGGRVGGRVGFFFFFCIKKGFRSVLYIKFQPTTFCFKHTPSYFTHTPKVSIHSLLTQKYHTQLLLELS

SEQ ID NO: 150221 - protein, 138 aa, Triticum aestivum
  Clone ID: PAT_TA_44639.pep
VADGNFHEEYGRAGAVRLVSSGSHNFSPRTPPSHSARVAMRECRDARRRHAGEGKPRVERRRGVRESEGEMRRRREEEMVELGGTREHLQTVGGKGEGGEASSRVGHGLWSRRGRGEQAGGREGGRREGGDAPRVRGR

SEQ ID NO: 150222 - protein, 93 aa, Triticum aestivum
  Clone ID: PAT_TA_44640.pep
ELDPFACLETSLPPKNCTGWRRSTAMDEDDGAIEDIPMLPSKTGTQAANQPRRAAKSATVRQHLEPKYSNSRLKDARDPSEASRPRSPAAANE

SEQ ID NO: 150223 - protein, 51 aa, Triticum aestivum
  Clone ID: PAT_TA_44641.pep
RSVHSTPCKPLLIRILCIALHEADHGRRLLRHQIYGHLTTALRPPTVLLVL

SEQ ID NO: 150224 - protein, 67 aa, Triticum aestivum
  Clone ID: PAT_TA_44642.pep
RGETTHPRRPSNATRAAPTRSSACISQPRPPPASTSMLRLPPFFLGPAHVLQHKWRLSPSASVSVGK

SEQ ID NO: 150225 - protein, 34 aa, Triticum aestivum
  Clone ID: PAT_TA_44643.pep
YHLKYLQNHDQPNSTPAPVGVLNKTNKVIKHHAS

SEQ ID NO: 150226 - protein, 76 aa, Triticum aestivum
  Clone ID: PAT_TA_44644.pep
LSWTPGFRPHCRFFLQTRVNSRRRGAPPGAMASRSGGGRSSRPAPRAAPERNPAVPDRAAYPPATTQSRGGGIMSG

SEQ ID NO: 150227 - protein, 129 aa, Triticum aestivum
  Clone ID: PAT_TA_44645.pep
VRGRVGGRVGGRVGQKFASDVREGKVPENRLSFGAPWRHPPRADNPDMCYKWAKIQLMDFVQSYVNTEFGLNYLADDSLEILDDPAAVAMMEVGLLYQQRDPSFVRPITRGIQRCLARWLVQQRLELTP

SEQ ID NO: 150228 - protein, 90 aa, Triticum aestivum
  unsure (1)..(90): unsure at all Xaa locations
  Clone ID: PAT_TA_44646.pep
MDSETETFAFQAVIIQLLLLIINNLYFNKGIFLCELISHASDALYXNRFESLTDKEQAGCXTELVISLIPDMVTNTLTLIDCGIGMTMSD

SEQ ID NO: 150229 - protein, 97 aa, Triticum aestivum
  Clone ID: PAT_TA_44647.pep
MAKQKQQQPKPGPAAGDAAPTPREFKTAHSPWFTYASMATLLSLCPPFVILLWYTGAHADGSVARTYEHLRDRGILEGLKAVWPKPTLVGGKIILGF

SEQ ID NO: 150230 - protein, 87 aa, Triticum aestivum
  Clone ID: PAT_TA_44648.pep
QRDPYSLVFIRHCLRHRRDAYAHDGADPAADTGLFPWAGYSAGGQCRNQQGQGHDGAHHDSATSSCYNYCGHAVTRYISLCPSFCGR

SEQ ID NO: 150231 - protein, 73 aa, Triticum aestivum
  Clone ID: PAT_TA_44649.pep
NTSTKGGASPNQGKHDMTPPMNHHESTSPMPQRAFSRINSGRGKEDRTPNPRLALQRSTTKLTSQNRHGSPLS

SEQ ID NO: 150232 - protein, 91 aa, Triticum aestivum
  Clone ID: PAT_TA_44650.pep
LPLSSFLCLLSLLPRPSFSVREPRPCSPPPSRSTWSPLLRWHGGSAHLTTRSPCSWRPSASMTRTAMVVSPPMICEQLFICLGLNPTEADL

SEQ ID NO: 150233 - protein, 108 aa, Triticum aestivum
  Clone ID: PAT_TA_44651.pep
FVYAWADAWVRTLFRRRRFEPPPNQQQSTGGAAMARTKQTARKSTGGMAPRKQLVTKAARKSAPTTGGVNKPHRYRPWTVALREIRKYQKSTELLIQMLPFQLLVREI

SEQ ID NO: 150234 - protein, 102 aa, Triticum aestivum
  Clone ID: PAT_TA_44652.pep
SGLPKLPKVPGEKTKKRRGREHGGLPVLVIERDAGIRELQLTRWESSGVCVIKGEGYMDFINNCGFSVGDVEEIWAFKQKALPFGRRGYLPGGVPGEALSTF

SEQ ID NO: 150235 - protein, 38 aa, Triticum aestivum
  unsure (1)..(38): unsure at all Xaa locations
  Clone ID: PAT_TA_44653.pep
MARTKQTARMFTGGMAPRKQLATXAVWKSAPTTGGCEE

SEQ ID NO: 150236 - protein, 75 aa, Triticum aestivum
  Clone ID: PAT_TA_44654.pep
LHMFIIAQVRRDGAPPRKVRTAPRVVCMCDCNGHNEFDDIQAGGQQLQQQCAVRPIHGQLEQSAYRSVLVKARAN

SEQ ID NO: 150237 - protein, 105 aa, Triticum aestivum
  Clone ID: PAT_TA_44655.pep
SQGVTRYCYNTNHQRVSPCYGITRTEPASACRSSSGERPWVYSTWHNKPNAGTQCNSFVDGFIDNLVNVILCNDKMQEWSDDLVSIHGSKPFETNQSLSKTNQAD

SEQ ID NO: 150238 - protein, 99 aa, Triticum aestivum
  Clone ID: PAT_TA_44656.pep
SSFHAFGSLSAFYFIPLLRPGSGGLPLALLTPVPPHPANGVLRAPGPRRHSLDRPVVVRARDPLRSVRSTELGFFVGLYEFCGLSILGGQLGSSTGRDL

SEQ ID NO: 150239 - protein, 58 aa, Triticum aestivum
  Clone ID: PAT_TA_44657.pep
RSTNGLTSKDNTVTAPKSTHRASGIARALSWGSSRPVQSRGMPHPQRHTSLFTIYTTD

SEQ ID NO: 150240 - protein, 125 aa, Triticum aestivum
  unsure (1)..(125): unsure at all Xaa locations
  Clone ID: PAT_TA_44658.pep
VRGRVGENQGHHDHDSYYGERDTESLVAAMETYVANIPKEAHVLALEDKSNRTVDPAKRPAPMTGGWRIEGFARAKKVPGSVVISARSGSHSFDPSEINVSHYVTXFSFGKRLSSKMFNEPEKTF

SEQ ID NO: 150241 - protein, 78 aa, Triticum aestivum
  unsure (1)..(78): unsure at all Xaa locations
  Clone ID: PAT_TA_44659.pep
MGIDLVYVGRNKRTKRVSPXSDDVYLKLLVKLYRFLVRRTKSKFNAVILKMLLMSKTNRPPLYMRRLYNFMKGKEEKN

SEQ ID NO: 150242 - protein, 67 aa, Triticum aestivum
  Clone ID: PAT_TA_44660.pep
STSLFRKVLYDKMPSKKLNLSQDRTTKNMPSKNLNLSQDHSTQSIVPGPDLKVRSVHFTQLPTRLAD

SEQ ID NO: 150243 - protein, 100 aa, Triticum aestivum
  unsure (1)..(100): unsure at all Xaa locations
  Clone ID: PAT_TA_44661.pep
PSYSLFPSLHPYRLPWRSAKNKRIFKGRNGSLXNVVDPVTKKQWYDIKAPVLFTIRNVSKTLVSRTQGTNIAXXGLIHMVVEVSLADLXTMKDQSYRMIR

SEQ ID NO: 150244 - protein, 52 aa, Triticum aestivum
  Clone ID: PAT_TA_44662.pep
TPQGRAAVVPVVGWPPIRSFRRNLTYGTSFKQSPERQNVEATNRAKPVFKKK

SEQ ID NO: 150245 - protein, 91 aa, Triticum aestivum
  unsure (1)..(91): unsure at all Xaa locations
  Clone ID: PAT_TA_44663.pep
MNIDITVLVKPEYPVEDLNPAFTKVVGNIFALVYMRLFTIXGVFDTVSFLYXVKPVIRVPXMVTWGLICYLDGIMYALPELRSERHDWCSF

SEQ ID NO: 150246 - protein, 53 aa, Triticum aestivum
  Clone ID: PAT_TA_44664.pep
VSPPMMEFLLDIRMLIPVPNRSTYVDNPFSYSSDISKYFRTSGRTCGRKSGRR

SEQ ID NO: 150247 - protein, 81 aa, Triticum aestivum
  unsure (1)..(81): unsure at all Xaa locations
  Clone ID: PAT_TA_44665.pep
MHGGGTCLLNRGWSSRNLVTLDNLPMDDDTTSPSWMRGARHPTERRAACRYRSPPPLPKRSRTRGRTRGRTSGRXSGQXGN

SEQ ID NO: 150248 - protein, 71 aa, Triticum aestivum
  Clone ID: PAT_TA_44666.pep
QTLSSWRGYDPTERRVNRRSLELSAVELPWGTASAPRKPKWRPSSSHHATSTDMDAPKRLQAAVLLSWQRP

SEQ ID NO: 150249 - protein, 78 aa, Triticum aestivum
  Clone ID: PAT_TA_44667.pep
MASSYPSFGTNSSHSSPAAGMDVQMGEPQAVPPPAAAAAAPAPSTIQHLKEIAAVIEAVSVTKEVRRISRAVRLTVVL

SEQ ID NO: 150250 - protein, 106 aa, Triticum aestivum
  Clone ID: PAT_TA_44668.pep
SSAHSSGPLRGRGGMCDAQRSPRARSMPVCGTTILYFVISPCAPPPAAPTTFSVPLHQGSNQSKIQPKSNCLATNCEDPSSDFGDRWRRLTGAGAAGPGTLFFRRE

SEQ ID NO: 150251 - protein, 47 aa, Triticum aestivum
  unsure (1)..(47): unsure at all Xaa locations
  Clone ID: PAT_TA_44669.pep
MGKTRGMXAGRKLKTYRRNQRCADKAYKKSHSSIVWKKPFSESSYAI

SEQ ID NO: 150252 - protein, 45 aa, Triticum aestivum
  Clone ID: PAT_TA_44670.pep
KNGTCPSPAPLQMQRTFLSSCCFRNPLQKVGSVYVNRNPNRVCIN

SEQ ID NO: 150253 - protein, 85 aa, Triticum aestivum
  Clone ID: PAT_TA_44671.pep
GQGELISDASDVLLVCTTYLPIMFSIFFLHVYSSACRTLINYAVLVARYLQIFLKHKYLIRKVNSTQLLCETWPISFLARGRLNA

SEQ ID NO: 150254 - protein, 95 aa, Triticum aestivum
  Clone ID: PAT_TA_44672.pep
SAHASADAWVHSLDSSAASQAARRRPGPPEFLSLLSLRRRHASSSSPLLRASVATPRRRRAVPPSAWLVPSIAGDATRARCGGSRTVSLPGGPRP

SEQ ID NO: 150255 - protein, 79 aa, Triticum aestivum
  Clone ID: PAT_TA_44673.pep
CEVRVRLMHCKRLDVIKYSCSLGTNFRQQRRSFDLWAETRSGKREDDDPGSRCPHRRSSSWRCRWWCVAPRVRKGVRGR

SEQ ID NO: 150256 - protein, 75 aa, Triticum aestivum
  Clone ID: PAT_TA_44674.pep
QCFRDRHLGAHTEATRSHCTGVHCTRRERDPCKPQNVDSPRRCLKEETDVAAVIARFEHLKLEISPEESRTRGRT

SEQ ID NO: 150257 - protein, 77 aa, Triticum aestivum
  Clone ID: PAT_TA_44675.pep
PCHRLSQGRYRLSDRTPAPRNLGPPQKRQDSQGTAATFLGGAPGLASAGGEGEGRRKQGGGARARTTTDAWANAWTE

SEQ ID NO: 150258 - protein, 64 aa, Triticum aestivum
  Clone ID: PAT_TA_44676.pep
SPSVLENSTRSPQHKSAPNRYMEDKRERIIAQPARPLLPDPISTSIPPHPPAPNRPAQPQCNGR

SEQ ID NO: 150259 - protein, 44 aa, Triticum aestivum
  Clone ID: PAT_TA_44677.pep
DKIMAENGDVPTIVIDLGTTYFCVMIWQHDRVEIIPIDQGNRTT

SEQ ID NO: 150260 - protein, 34 aa, Triticum aestivum
  Clone ID: PAT_TA_44678.pep
DPDLSLNQFCRSKAQTIIEAGASRRDTHTTSPRT

SEQ ID NO: 150261 - protein, 44 aa, Triticum aestivum
  Clone ID: PAT_TA_44679.pep
TSKISGPAVGQRYWPTTFRKDLESHPSGATNILHLLLTGRVGGR

SEQ ID NO: 150262 - protein, 65 aa, Triticum aestivum
  Clone ID: PAT_TA_44680.pep
ASSLGSLTVARSVCQAASSDRIRYNAMNTRSDGHAELRHLDRPPHCVCKLIKDVSIYLRPRVRGR

SEQ ID NO: 150263 - protein, 29 aa, Triticum aestivum
  unsure (1)..(29): unsure at all Xaa locations
  Clone ID: PAT_TA_44681.pep
ILISSDLYDGVEVSINFIRNAWEKDRSXV

SEQ ID NO: 150264 - protein, 81 aa, Triticum aestivum
  Clone ID: PAT_TA_44682.pep
DRKRAVVPVGEELAVSRGVQPVGADLAHVIVSVPVELQGDRSRRPWRGSGMHPPSPTELEQLLPNNVRSAESRVHGRVGGR

SEQ ID NO: 150265 - protein, 57 aa, Triticum aestivum
  Clone ID: PAT_TA_44683.pep
FSLAIAFTNELPTKTFSFRIEIVNALIVDRELHCQVLHNITIWLKRGTKKVYEKSTD

SEQ ID NO: 150266 - protein, 56 aa, Triticum aestivum
  Clone ID: PAT_TA_44684.pep
FQCPFVGPFFSVSLSVCLARMAGRTRRRSAPPSARARLSSALSGSRRTSPSSKMSR

SEQ ID NO: 150267 - protein, 99 aa, Triticum aestivum
  Clone ID: PAT_TA_44685.pep
YVKHYGKLVPEPVRELVPALVPLVHTLVHTSEGADEGVEEDDGDGEDEGEYQQVDQRIGKGTRMDRRVVGRLLLLPSRRSWPPEGPHELTKTSTQEWAD

SEQ ID NO: 150268 - protein, 84 aa, Triticum aestivum
  Clone ID: PAT_TA_44686.pep
RYHQFFVASMNMAKSIYVNSLCLRYLPFCSPLKYRIMYSRSIQLVFMRRMHRFRSMLQGLLARPFLLLLDLVHVAEESETLVTL

SEQ ID NO: 150269 - protein, 70 aa, Triticum aestivum
  unsure (1)..(70): unsure at all Xaa locations
  Clone ID: PAT_TA_44687.pep
RAHLNLAHTLLALLFPTVPLSIALEALILLQSFFEPLLXSSPPSPPPSPPYEVRAXDPQLVFGAWLWQRF

SEQ ID NO: 150270 - protein, 102 aa, Triticum aestivum
  Clone ID: PAT_TA_44688.pep
VREGVIQVQGDITNARTAEVVIRHFDGCKADLVVCDGAPDVTGLHDMDEFVQSQLILAALTIVTHVLKVGGKFVAKIFRGKDTSLLYCQLKLFFSQDTSAYA

SEQ ID NO: 150271 - protein, 90 aa, Triticum aestivum
  Clone ID: PAT_TA_44689.pep
SLIISSPLLHRILSIASSGVPLVPWRLPAGSPSASCPAPAGSARARWRSFASGSSLSSSRFVASSPRRTPCFLACARRLPACAFVQPRSR

SEQ ID NO: 150272 - protein, 111 aa, Triticum aestivum
  Clone ID: PAT_TA_44690.pep
SAATPEPVAAKAPIASESPIRVPRNQAKPSYTRSNSMPDSCPRTDRKIDDFELKSGGEIRGPAACTGAPRGDGRGRTGGGNPSPTRTRSGRRSSLRRSPGGSQSRRWCGGK

SEQ ID NO: 150273 - protein, 109 aa, Triticum aestivum
  Clone ID: PAT_TA_44691.pep
RTVRRSSLRTGHISSPSFTCPGKALASMVVLQIFSPAPHSLDVLCFSKTAAWCSADVATELLVLKPTISSEAVSRVIWRNMVVRRLTGKVMVLHTGLAASFMMQGQGVL

SEQ ID NO: 150274 - protein, 128 aa, Triticum aestivum
  Clone ID: PAT_TA_44692.pep
VRAHGDHAVQAWELRLWRSADAVQGGAGAHVRWAAQVNPEEEQRLGRAGCGQRAPGLPSGEVSAGRWGQHAGATSIASELRREQWPGHCCTSEQGREVARILADIFAVAGPPCAYQPGGTYAPTGPVT

SEQ ID NO: 150275 - protein, 76 aa, Triticum aestivum
  Clone ID: PAT_TA_44693.pep
HGQTDPSSTDRDDSHATVQHHRRRNANGGANIGLRRRHACETCGRASDHHLDDQLICTTNTTAIITHKQKRKRGRT

SEQ ID NO: 150276 - protein, 78 aa, Triticum aestivum
  Clone ID: PAT_TA_44694.pep
MARAGVFFVPYWLLMLASLACLATAAVDPEEGVLTVSVHYATEEESRWLRPLGGVIQGSRFRVRLQGPGGHPPGVRCI

SEQ ID NO: 150277 - protein, 98 aa, Triticum aestivum
  Clone ID: PAT_TA_44695.pep
VMYASFIQSTIIITPLCMVSPRQSPELSMRPLTMCAPPQLLIDRSNAASVGVQSLMRSYAKGSHIHTSPCFSHRRTICDSNSMLVIHQQILLRLSSHH

SEQ ID NO: 150278 - protein, 55 aa, Triticum aestivum
  Clone ID: PAT_TA_44696.pep
TYNNGTSCLFEVLITNNVLVKMGFTGYHHGCIETPIKMKGQICYQHSLVHLYCLP

SEQ ID NO: 150279 - protein, 105 aa, Triticum aestivum
  unsure (1)..(105): unsure at all Xaa locations
  Clone ID: PAT_TA_44697.pep
DKDDTGKILINIKDDHHEWYGDNKQKQICHRMPDWTSTDEYATMYKNVTIDWKEHLAWKYCLLKXQIEFKGVLLATKWVLFDLFDTSMKLNNNNSNVRQGFMMEN

SEQ ID NO: 150280 - protein, 113 aa, Triticum aestivum
  unsure (1)..(113): unsure at all Xaa locations
  Clone ID: PAT_TA_44698.pep
MGRRPARCYRQIKNKPYPKSRYCRGVPDPKIRIYDVGMKKKGVDEFSHCVYLVSWEKDIVSSEALEAARIVCNKYMTKHAXKVAFHLMVRVHPFHVLRINKMLSCAVADSLHT

SEQ ID NO: 150281 - protein, 71 aa, Triticum aestivum
  Clone ID: PAT_TA_44699.pep
VRGRVRSTIARQVSVDVPDERGRTEILKAHGNNKRFDADVSLVVIAMKTPDLRGADLTKLLNEASVLSRRR

SEQ ID NO: 150282 - protein, 32 aa, Triticum aestivum
  Clone ID: PAT_TA_44700.pep
LARSLSRLDATGRTRIDQDYNTRWERTRVSER

SEQ ID NO: 150283 - protein, 94 aa, Triticum aestivum
  Clone ID: PAT_TA_44701.pep
TCRCKSSACCFIYHVYESVCVSAGKSLSRLSISLGASLVLRMGSVFVQMMLYQRQMVGHVTGDELILSHRCLFGPGAGLTVPESKAFICALAKE

SEQ ID NO: 150284 - protein, 101 aa, Triticum aestivum
  Clone ID: PAT_TA_44702.pep
TPRLCFLSNNQHDQRVREPPISNKQIVCFIQILSEGTRGQNDMHEGGYFDGFRDALLMARTSDSLFPWTLCETVHILSKESAMVPFFFIENISHFNLSLPL

SEQ ID NO: 150285 - protein, 67 aa, Triticum aestivum
  Clone ID: PAT_TA_44703.pep
SDPLLSCSTAARRCSPVPTHPTQTLRRRGPARHPNPRERERAPSPPSPPPPPSPPPEMGTVFHVNRR

SEQ ID NO: 150286 - protein, 104 aa, Triticum aestivum
  Clone ID: PAT_TA_44704.pep
WHQNAMQTVPPHYRVSGVRPSIPVNLRHTASIAQVTGFATRLRELDLFSIFRLTTGFINGGALLLLPGLIIRNGSTAMAGVFLPDAIICYSSSMWYAWTKKLRL

SEQ ID NO: 150287 - protein, 85 aa, Triticum aestivum
  Clone ID: PAT_TA_44705.pep
AWGRDLTVTDASGATVMRVEGPFFSLLGRSVLLDAEWCPVLTVERSPSLFEITRRWEAFRGDSTSSKDLLFSVAVHSLLTNTGDI

SEQ ID NO: 150288 - protein, 133 aa, Triticum aestivum
  Clone ID: PAT_TA_44706.pep
RPRTRGLAHAHRGHHTIQIRRSSYHDVIRVSDIQRFMDIAGVQTYVINSARVVFLNERPQQKQPGKAGGGAGGANLCEVCSRSLLDNFRFCSLGCKVAGCSSDGGGNDKARMMRSSRPGRAKGSLDSEAVSSS

SEQ ID NO: 150289 - protein, 86 aa, Triticum aestivum
  Clone ID: PAT_TA_44707.pep
RSLTRGLTLGPDFSLWPAPHAGIACRRCRLFLTPASRAVVADLHSSSSNRSCAPYLCSCRFSHYFFFSLYLKSFIPLFQKQRQHVS

SEQ ID NO: 150290 - protein, 104 aa, Triticum aestivum
  Clone ID: PAT_TA_44708.pep
QPPPTGLKPSVAAALFATHTLERERELPLRLSPRPLPIRRPRWSRIFTSTDGEQLFTRVCHRESGGTATFARGKDIPVSSGPPSPGDDAQFGVPRVPIGSTKGT

SEQ ID NO: 150291 - protein, 91 aa, Triticum aestivum
  unsure (1)..(91): unsure at all Xaa locations
  Clone ID: PAT_TA_44709.pep
MRGRHEGGDTPAVVLGAMAHKDPANGKRPTTGTTSTPSSIRLTKIFXDNMAILVKSGGGFIASGVVHKLLVNEKNEVIVGDNILYGSKDNL

SEQ ID NO: 150292 - protein, 60 aa, Triticum aestivum
  unsure (1)..(60): unsure at all Xaa locations
  Clone ID: PAT_TA_44710.pep
ATTQXEIITKTHTHIFQTDRKISALFFYFPSIKINYHLFYLLSTLTSTLIYLQSSINYLI

SEQ ID NO: 150293 - protein, 123 aa, Triticum aestivum
  Clone ID: PAT_TA_44711.pep
MSADAGPMAAMTPPAKTPDHARPETEKADTALGVKNPTVVMRLPAGKTVYKEGGGEKRRRKKGKKSVETYKIYILKVLKQVHPDIGIFSKAMSIMNSFINDIFEKLAGEADKLARFNKKPTIT

SEQ ID NO: 150294 - protein, 41 aa, Triticum aestivum
  Clone ID: PAT_TA_44712.pep
FRRHDARVRGRVRPPRNPSSLQPYPHPSTDCGGGVTWAGGC

SEQ ID NO: 150295 - protein, 61 aa, Triticum aestivum
  Clone ID: PAT_TA_44713.pep
GSELPPRPTRPEVTEENTAHVTTTLGLEDFGITLRQYLTSEYKLCPDIDLAKYCRDLPLLH

SEQ ID NO: 150296 - protein, 86 aa, Triticum aestivum
  unsure (1)..(86): unsure at all Xaa locations
  Clone ID: PAT_TA_44714.pep
LNVDRIGRYLKKGRXYAQRGGSRPQLYLADILXYLGAEALYIAGNTPNDNKKTGIMPCHLMVVVRKDQKLAKLLLTVTIAHGGVIP

SEQ ID NO: 150297 - protein, 81 aa, Triticum aestivum
  Clone ID: PAT_TA_44715.pep
PTTRYNAALRNARAVLTPTKPPYFIPRGQGRPRWTAQEPPTSTACGPLLCLTRTALYPATALHMKDRPGPSSWRARNWTGK

SEQ ID NO: 150298 - protein, 123 aa, Triticum aestivum
  Clone ID: PAT_TA_44716.pep
MATITAPPCSPSPSCMFLTRTYCCSRSAPRAAIRSSAVAAARQTLSSGWDLSGLSGARPAAGKARLEELDTNNMLLRQRIIFLGSPVDDLTADLITRQLLLLDAKDHTKDIKLFINSPGGSIT

SEQ ID NO: 150299 - protein, 59 aa, Triticum aestivum
  Clone ID: PAT_TA_44717.pep
EDRTKSSLARAGTILWPYRMPPPPRDSSVENGFFTAGSRSLDRTTGAFLGLSGMPSTPD

SEQ ID NO: 150300 - protein, 86 aa, Triticum aestivum
  Clone ID: PAT_TA_44718.pep
VRPPPPPPPYVAPTAGAPWPPGTCALPPPSPPPTPPYSYRTRTPLSSFRPPPRLAGLPSRLVLRGLAKRDPVEPRMLKAPVVSDER

SEQ ID NO: 150301 - protein, 76 aa, Triticum aestivum
  unsure (1)..(76): unsure at all Xaa locations
  Clone ID: PAT_TA_44719.pep
QAHPHPPLSCQFSAESMSSVVPCSHLFQMHDFQYLRPSFQSHQVTQRHVLICLSPQVSCLVXPAHISIDYQSFVSL

SEQ ID NO: 150302 - protein, 122 aa, Triticum aestivum
  Clone ID: PAT_TA_44720.pep
LQRPHRPSRDDPRVRSHQGSRAPQCPPSLHYLRSRAGILYPAPIPSPPSISSLRPPSRAAADSLEEPQPIPSPARLGLPSVSSPLRHYHRLVVGAPVNHHHQQIPSTCRSRSATTSASFLNP

SEQ ID NO: 150303 - protein, 90 aa, Triticum aestivum
  Clone ID: PAT_TA_44721.pep
VRGNGYALLLQRPSTDTSARMGAPASPDDLTTPPARRLDHPIGSAHHRPGYDVFEGSSRERGSFSGSISEPTWNGLFNTRQCSYTSTDRL

SEQ ID NO: 150304 - protein, 138 aa, Triticum aestivum
  unsure (1)..(138): unsure at all Xaa locations
  Clone ID: PAT_TA_44722.pep
SVQKQQSVQMQIPQLHAGNDVNEGKVRQGTAMKPGMYQQHLGQRSNYYHQQVKQSGAFPISSPQNNLQASSPQISHHPPEVDQHNPLPSQVKTGTPLHSANSPFVSSPSPFIAPSSIPVDAAXPHSNILILTNTGQAW

SEQ ID NO: 150305 - protein, 67 aa, Triticum aestivum
  Clone ID: PAT_TA_44723.pep
GDELAARDGGTVRPCMRGAPYAVGTQDVCTVAPDRAPAVAAIGQEHHKDDAMFHFYGRLLYLATRIV

SEQ ID NO: 150306 - protein, 67 aa, Triticum aestivum
  Clone ID: PAT_TA_44724.pep
SYCIDDAEESVPTMTNRILIVIHHQYTSGRSRLARTASGRAAWEGPRVPADMLGGWEWGGEGGRVRM

SEQ ID NO: 150307 - protein, 43 aa, Triticum aestivum
  Clone ID: PAT_TA_44725.pep
ENKNSGSRYNCYKQFFTSAQCLVLSSFGALLTLSPRGCQCILV

SEQ ID NO: 150308 - protein, 71 aa, Triticum aestivum
  unsure (1)..(71): unsure at all Xaa locations
  Clone ID: PAT_TA_44726.pep
MGGGGDLTDDXRKALWGSKVAPFPAPTAVYRPNPGMGHPGGPLTTNKGAGLGKCLERNLQESGGVGTVLNP

SEQ ID NO: 150309 - protein, 51 aa, Triticum aestivum
  Clone ID: PAT_TA_44727.pep
RPQSYDICYRTILLFPRSSMRGVPVRPHSNGHSPSSPPTAKSTDSCTPVLS

SEQ ID NO: 150310 - protein, 35 aa, Triticum aestivum
  Clone ID: PAT_TA_44728.pep
HTPTRTLTRTFRRSSHNTLREGLSEKLRSSKIPSL

SEQ ID NO: 150311 - protein, 89 aa, Triticum aestivum
  Clone ID: PAT_TA_44729.pep
VRAQAATGSAPRPPAWSRDGLDPASPPPHEPPPSSTTFHLAPSPSSSSRAPPAATGSASWPPPRSRDSLDPASPPPHEPPPPSPTFLLA

SEQ ID NO: 150312 - protein, 92 aa, Triticum aestivum
  unsure (1)..(92): unsure at all Xaa locations
  Clone ID: PAT_TA_44730.pep
RPPTRSGMTITLDVELXHTMYGVRAMIQDKDGIFLDQLRLIFAGLLLEDGRTLXDYIIEMESTLDLVLTVRGGMHISGKTITGKTITLRVES

SEQ ID NO: 150313 - protein, 112 aa, Triticum aestivum
  Clone ID: PAT_TA_44731.pep
SGSPVLGCGGFHDITTLSPMYFTPCVPGIIPSSAFATQALQIYSFEIFELNDSLKWPLCVYGVDAARDAVDGNRNLLFSRSSTNCQVLTKEDPFFDLTGPSCAILDGDPVDF

SEQ ID NO: 150314 - protein, 71 aa, Triticum aestivum
  Clone ID: PAT_TA_44732.pep
PSQHHSAFYRKAIHHSHHYLKNQLTTSFLLAAPEAILVACPTFFDFSSSSHSLSDSELYEESTFLPTRQRT

SEQ ID NO: 150315 - protein, 43 aa, Triticum aestivum
  Clone ID: PAT_TA_44733.pep
RTRYAWVTIMQTVFCLHSGKLREQGARRALYPPNYKVWRGLTE

SEQ ID NO: 150316 - protein, 44 aa, Triticum aestivum
  Clone ID: PAT_TA_44734.pep
RPTSRTQTRSPFFFITSYLHAAGDLTFQYRPLANTNIPRLGSKF

SEQ ID NO: 150317 - protein, 135 aa, Triticum aestivum
  unsure (1)..(135): unsure at all Xaa locations
  Clone ID: PAT_TA_44735.pep
SDGIQPDGQMPGDKTVGGGDGAFNTFFNETGAGKHVPRALFGDLEPTVIDEVRTGTYRQFFHSEQLIIGKEDASNNFARGHYTIGKEIVDLCLDRITKLAHNCTCLDGFLVFNAVGGXLASGLSSLLLERVFFDY

SEQ ID NO: 150318 - protein, 69 aa, Triticum aestivum
  Clone ID: PAT_TA_44736.pep
MPQVYYIELHQKRHGRRMDYEERKLKKEARAVKKNFMDARMLLSSNVKWFFKKLVAKLVSNLEYPENAR

SEQ ID NO: 150319 - protein, 76 aa, Triticum aestivum
  Clone ID: PAT_TA_44737.pep
MRECIWIHIGQAGFQVGNACWELYWLEHGIQPDGQMPGDKTVGGGDDAFNTFFTETGAGKHGPRACFLDLEPTVID

SEQ ID NO: 150320 - protein, 133 aa, Triticum aestivum
  Clone ID: PAT_TA_44738.pep
SEFSQFFRHKQAFTFCPTWAQPCAPMAAMKPAAKKPEEEEPATEKADTALAVKKPKVVKRLPAGKTVSKEGGGEKRGRKKGKKSVETYKIYIFKVLKQVHPDIGISSKAMSIMNSFINDIFEKLAGEAAKLAR

SEQ ID NO: 150321 - protein, 79 aa, Triticum aestivum
  Clone ID: PAT_TA_44739.pep
RIRARSEVPPAYGAVLANKHSPSRIGLVVGWWQFALRAGVENPILVQDSRRARFACRRQSHRRGRRRVNVGSPSKCLPD

SEQ ID NO: 150322 - protein, 34 aa, Triticum aestivum
  Clone ID: PAT_TA_44740.pep
TLIKPRPHPSISEKMLNVRKDAERAHRRTYPCLI

SEQ ID NO: 150323 - protein, 129 aa, Triticum aestivum
  Clone ID: PAT_TA_44741.pep
RPVAMASMTTPRLPFLPARTCSAAAAFSSLSSSPLQCCPVKRTSVTNANSAPLLSTSRPGAPAADGVGAADLNRLRASAMPVADSPLPAYCNPHELPLGAFFMACVVLYRELGPLTSAALMESSGEGLK

SEQ ID NO: 150324 - protein, 51 aa, Triticum aestivum
  Clone ID: PAT_TA_44742.pep
LPLACDLWIHFLFSSFYAHASGVAVYCKKLNVMMLWLTPVPTSWPNFGYPL

SEQ ID NO: 150325 - protein, 78 aa, Triticum aestivum
  Clone ID: PAT_TA_44743.pep
MGLSIIRSSFMSLVVRQGTLHLTKSLFGNSSSFEVLKFPGGITIIPPQHAFPAETLDATFNFTLNLPTYKVQDRTVEL

SEQ ID NO: 150326 - protein, 68 aa, Triticum aestivum
  unsure (1)..(68): unsure at all Xaa locations
  Clone ID: PAT_TA_44744.pep
RTPTRTRALSRGDEKPGSVPREMRVEDGYGVIERREGGFKFIYWNLIIMHLSXPRLTGFFMDDSLYYF

SEQ ID NO: 150327 - protein, 43 aa, Triticum aestivum
  Clone ID: PAT_TA_44745.pep
RPATRPATPSATPQAKRATTHSACVRQTISITSFYVGQRDANV

SEQ ID NO: 150328 - protein, 101 aa, Triticum aestivum
  unsure (1)..(101): unsure at all Xaa locations
  Clone ID: PAT_TA_44746.pep
RPRTRVRTRTTKNIHQYKDPMGAAGIVEYLNNQVGPACKEIMAPDDATYLVNGKIHIGDVETELSGTXLHHQVAGSETQDTAYAYDHTEFANHLPRRDAAL

SEQ ID NO: 150329 - protein, 121 aa, Triticum aestivum
  unsure (1)..(121): unsure at all Xaa locations
  Clone ID: PAT_TA_44747.pep
AVPVQNYNHPLVRERTLGRTTVLVLPTATLKCCISFTFIGLDPVYDRAIEPFVRHLTDHPRGITMLQRIGAGMATTSITMADAALEETKRLXRVDKDADLLNRTNVAEPMSLCWLVLDYVL

SEQ ID NO: 150330 - protein, 65 aa, Triticum aestivum
  Clone ID: PAT_TA_44748.pep
GTSRHPILRKHRLCWLEQRDTEPPHGAANHRHRHRRRPWASGRSSAARVPTPSSRLRLPVASAGR

SEQ ID NO: 150331 - protein, 71 aa, Triticum aestivum
  Clone ID: PAT_TA_44749.pep
PDIGGVVALTLLIMLHPTVFPMRNHHRPVAERLDRLPVLVGRHGRRSLPPPLRLRQRPTLSACGIESEGAR

SEQ ID NO: 150332 - protein, 90 aa, Triticum aestivum
  unsure (1)..(90): unsure at all Xaa locations
  Clone ID: PAT_TA_44750.pep
MELAAVANQQADPGGRRVSRENRTRSPMVFSEVLEEGIQIVEMAGGVFIQLLLMDKVMENEKNEVIVGDNFFTAXKDNLEKWVGHAIFKL

SEQ ID NO: 150333 - protein, 132 aa, Triticum aestivum
  Clone ID: PAT_TA_44751.pep
IAIRRNTLRDLPLSFLGRTRKARFPADGASPQRQLGQPIKNPVPPPNRSPRTPIRAEFEPHRATGSGELRGSDGAGDSIETRMGRSGFLLRRQIQETPRGRERVISLEIDPPCCWPLEICLPVLVVLPGCGR

SEQ ID NO: 150334 - protein, 49 aa, Triticum aestivum
  Clone ID: PAT_TA_44752.pep
AAPVSYSPASGRAASRSRSGSSTPTRPPTARPGSGPSGNPPTPAASRER

SEQ ID NO: 150335 - protein, 38 aa, Triticum aestivum
  Clone ID: PAT_TA_44753.pep
RACTMNYKLVHYRAPPRIHHLVASRRRELEFYRTSGRK

SEQ ID NO: 150336 - protein, 46 aa, Triticum aestivum
  Clone ID: PAT_TA_44754.pep
TDGVIRSSLALDTRRTRSIEKLIVVGQGVGLRVVAVNNSTSALARR

SEQ ID NO: 150337 - protein, 67 aa, Triticum aestivum
  Clone ID: PAT_TA_44755.pep
MRPASTTIRSTFPPAAPPCQRKAASASIMHFISAFRAPAQASASEGGSCPAHAADHASILSWHSPER

SEQ ID NO: 150338 - protein, 45 aa, Triticum aestivum
  Clone ID: PAT_TA_44756.pep
MTTRFKKNRMKRGHLFVVHGRVGKHRKHPGGRGNAGCMHHHRIIF

SEQ ID NO: 150339 - protein, 64 aa, Triticum aestivum
  Clone ID: PAT_TA_44757.pep
VRASFYQYGTTGALSSLAMARAHGAFLLQLLAVVLQVVSLAATVTVTQMDDPWCRPSLPWWCAV

SEQ ID NO: 150340 - protein, 56 aa, Triticum aestivum
  Clone ID: PAT_TA_44758.pep
SKARYIYSFFSAAAHQSYMLVLESHRSSHFIIQQHQLNPIHPLIQNMLCKRWEDSC

SEQ ID NO: 150341 - protein, 35 aa, Triticum aestivum
  Clone ID: PAT_TA_44759.pep
GTFIRGSCCKSGYAEPRTLLTLLCSLTERATLSMV

SEQ ID NO: 150342 - protein, 34 aa, Triticum aestivum
  Clone ID: PAT_TA_44760.pep
PLERPLAQISLTCHIAYRTEKVCLTDSDGFDPGN

SEQ ID NO: 150343 - protein, 24 aa, Triticum aestivum
  Clone ID: PAT_TA_44761.pep
SAPFPLPITNSLRPQLGFRGSKPS

SEQ ID NO: 150344 - protein, 52 aa, Triticum aestivum
  unsure (1)..(52): unsure at all Xaa locations
  Clone ID: PAT_TA_44762.pep
MKTKAMALSTSYFGDKELNDLTSYAIXEEARVTMRKTVGKAKPMSLDKTRNG

SEQ ID NO: 150345 - protein, 90 aa, Triticum aestivum
  unsure (1)..(90): unsure at all Xaa locations
  Clone ID: PAT_TA_44763.pep
MAEQTEKSFFKQPKVFLSTKKGDKAKRPGKAGNRFWKRVGLGFMTPREAIDGXTYIGKKCPLTGSVAIQXRIIVGTCHSANMNRTIHCLQ

SEQ ID NO: 150346 - protein, 84 aa, Triticum aestivum
  Clone ID: PAT_TA_44764.pep
SSSLPQESVVLRPARRNQFGAPPPVEGVSDPDQRHRRAWKSPGADEDDDQRDLGARLARSWMPPSVTRPPGSRARVGRARYCRR

SEQ ID NO: 150347 - protein, 60 aa, Triticum aestivum
  Clone ID: PAT_TA_44765.pep
MYTGRKKIQKDKGVEPYEFKDTVEHAIFDLENGNQELKSDLKDLYINTAIHMDVDGNRKA

SEQ ID NO: 150348 - protein, 107 aa, Triticum aestivum
  Clone ID: PAT_TA_44766.pep
RGSIRSACSGSLVPHKLISSFKRPSRMAALLGSPGPRYQSHSAFRTVAVTPIPKDRLKHANKQLYATICELFHQSGPEFAVSAKVASHVIMFIHSISVVSRLSSLRG

SEQ ID NO: 150349 - protein, 59 aa, Triticum aestivum
  unsure (1)..(59): unsure at all Xaa locations
  Clone ID: PAT_TA_44767.pep
MSTDVAADVPAPEVEVTADPVVETTAEAAVGYAKPSKETKAXAVKAKKPSAPRMLRSTL

SEQ ID NO: 150350 - protein, 70 aa, Triticum aestivum
  Clone ID: PAT_TA_44768.pep
VRGRVGGTVRYSVDSYLQLKRINVDYNEASGVLFLPRAVLMDLEPCTMYFFRSYPFVQFFLPHFFIFLSI

SEQ ID NO: 150351 - protein, 60 aa, Triticum aestivum
  Clone ID: PAT_TA_44769.pep
RPPTRPFTHHRTQPRRRIIRGGGVLVGALRNQIVILFLITVKPGASCIGSVIYGEAVYGG

SEQ ID NO: 150352 - protein, 84 aa, Triticum aestivum
  Clone ID: PAT_TA_44770.pep
LSTVYALILELIQDVEDLVHHVRRQVPGQLPAHYVVVNVLLNHRSGHVSEHVAQRKAWRRWSRRLSLGTSFLIFFEADWEDVGV

SEQ ID NO: 150353 - protein, 59 aa, Triticum aestivum
  Clone ID: PAT_TA_44771.pep
EARPIISASTMSPCSPIPDDRYANVHHLVVSALVADPKPGLGVLQRTRGRTRGRTRGRT

SEQ ID NO: 150354 - protein, 70 aa, Triticum aestivum
  Clone ID: PAT_TA_44772.pep
AMGSREVLGVLMVPAWADAERVRVDLLRLPWYLSSIPMHYFLITKLLTRSLLVSCTIWPDLAISLSMIFL

SEQ ID NO: 150355 - protein, 98 aa, Triticum aestivum
  Clone ID: PAT_TA_44773.pep
LKVDPNVCTKVKEYSDDNSGGNLKLELQLEHHRQHSVKRAVHVALRVRPPSPRTHQQIQQQMRGSRFERGPNQRRVQAPVQLIQLLRVDCSVCYDVAN

SEQ ID NO: 150356 - protein, 55 aa, Triticum aestivum
  Clone ID: PAT_TA_44774.pep
VRLLSCLRQSLLVLYPLSGKKSEEDPPCSCTSTSISANTLLKDSYPYRELDNAQL

SEQ ID NO: 150357 - protein, 75 aa, Triticum aestivum
  Clone ID: PAT_TA_44775.pep
IQIREAYPKTRSTILLLLFTLKEGRTPKRMPEVGSAARGGEQNRDLTLLLPRPRLLSSAGGLLPGTDGRMGVSGR

SEQ ID NO: 150358 - protein, 139 aa, Triticum aestivum
  Clone ID: PAT_TA_44776.pep
VRQNPRLNSTSHLGEAVKQLAPTTLGGQGSTDRPVNGLSTTSVPLKRNPGSHPVRTLESWGLTGDVIGKIAYTAVLGLALFGTLKLLRFQFGNTKPAPSTRESAATSSLNEAFPSEGSFISSRVREQFEKLSKMLWLNN

SEQ ID NO: 150359 - protein, 47 aa, Triticum aestivum
  Clone ID: PAT_TA_44777.pep
EDKYMPHLVLTQGGASCESRALSGKVGHEEKHPITYCFSVFMLMLKS

SEQ ID NO: 150360 - protein, 42 aa, Triticum aestivum
  Clone ID: PAT_TA_44778.pep
VRVRLVSPHPISFIDKDHRALRASVMDMITQALVPSHQPNHS

SEQ ID NO: 150361 - protein, 121 aa, Triticum aestivum
  Clone ID: PAT_TA_44779.pep
AVGKNGKTDQVKHEAQSKHVDRQSKPRKPQNRREMQSETPSRKLENKKKALMPEAGHMKKKPEYTVVTQQEIEELAKEHVSFSKPAYSTHGEGGLSEPLLIVVRGRNIYWSSLLGPIITEK

SEQ ID NO: 150362 - protein, 78 aa, Triticum aestivum
  Clone ID: PAT_TA_44780.pep
PLPIWKLGREASYGHHRGREPMALQGPRIRFRQVGHVPAPGWRRKVNEAFLAAPPPPSVKGGVDRRGFLGGSGRVGGR

SEQ ID NO: 150363 - protein, 38 aa, Triticum aestivum
  Clone ID: PAT_TA_44781.pep
RRRGRERIRQIRRSLLLMDVVNDGNGRRPCPTQGLGLG

SEQ ID NO: 150364 - protein, 75 aa, Triticum aestivum
  Clone ID: PAT_TA_44782.pep
KDRQRKVKTRRQKGKGQYRVDASRHGGEPAAAEFRDSKDHSGWFANYAALGWRELHAKAVEGSVSELHMVGRTSL

SEQ ID NO: 150365 - protein, 23 aa, Triticum aestivum
  Clone ID: PAT_TA_44783.pep
KRRLKARQSIDHLPSHSNLRLAS

SEQ ID NO: 150366 - protein, 65 aa, Triticum aestivum
  Clone ID: PAT_TA_44784.pep
VWASSDPRFLSGSYIHVNGPGYGPVAMELRVVKERKRPRRKVPRPQNNSRRCARMTSKEKKTLRK

SEQ ID NO: 150367 - protein, 80 aa, Triticum aestivum
  Clone ID: PAT_TA_44785.pep
VSKRQSSLSKPSVLFCSRLLIWGFFLADEPAVVSHGSVPEGGEAAVRRCLSRLTMILITSQGMYLSYIHLLLISFSRLRV

SEQ ID NO: 150368 - protein, 116 aa, Triticum aestivum
  Clone ID: PAT_TA_44786.pep
GNISVVLSPDACYAGVIRIEYSSSFMLCSECPIILHNTTAEELGVKSKPSHQLWAPPRARCPEEVHVPCPRLCFFLPLSVGSPPGAHGVESEAGREPDNVGPPVRSRRYTIGCRKV

SEQ ID NO: 150369 - protein, 119 aa, Triticum aestivum
  unsure (1)..(119): unsure at all Xaa locations
  Clone ID: PAT_TA_44787.pep
SAHASVFLLLLPPIPNQGGTRREEGKGREEEITEPSARTGQQAPRSRTGAEMGLTFTKLFSRLFAKKEMRILMVGLDAAVKTTILYKLKLGEIVTTIPTIGFNVETGXYKNIYFTVWDV

SEQ ID NO: 150370 - protein, 65 aa, Triticum aestivum
  Clone ID: PAT_TA_44788.pep
LAEVLDCTLTTLHKIGLTCDTRTRWLTNTTAPVVVRVTDYAENLFGGEGSPTEEHPCTQVACFHF

SEQ ID NO: 150371 - protein, 63 aa, Triticum aestivum
  Clone ID: PAT_TA_44789.pep
AGVINAHLKGGYEREEYSSEANSVFLGYERDVFIVKQPACGARANIPKHHFVYKSLALGVLGR

SEQ ID NO: 150372 - protein, 35 aa, Triticum aestivum
  Clone ID: PAT_TA_44790.pep
TALFILILECVHLFINYFHQTIMTPSTYMPVSNAW

SEQ ID NO: 150373 - protein, 87 aa, Triticum aestivum
  Clone ID: PAT_TA_44791.pep
FPDSTHAFRRLLWIFSLYTVISDFCPNSVARDWATHIKRVTDYVLDCPRGIKVSPTRPDAQRALMHLVGPGGSPRPSARGASTLYPA

SEQ ID NO: 150374 - protein, 43 aa, Triticum aestivum
  Clone ID: PAT_TA_44792.pep
PSRVMVMPVRVFTKLCIISRPGRSIRREWSRSKTRLGESMFGR

SEQ ID NO: 150375 - protein, 56 aa, Triticum aestivum
  Clone ID: PAT_TA_44793.pep
ATRSRSLGPTPIMCAFHNPIARGLGLVSGHHCALHDFPGHHVLLGWLFHVLCGVFR

SEQ ID NO: 150376 - protein, 42 aa, Triticum aestivum
  Clone ID: PAT_TA_44794.pep
GGSANTWYQRGVVLGVVRPTSCVVAVTKFSGGCGMLRSECRF

SEQ ID NO: 150377 - protein, 39 aa, Triticum aestivum
  Clone ID: PAT_TA_44795.pep
SYRPRFTLTLCSIPKLHRLLNLLGSLHRRHVPLPIIRVG

SEQ ID NO: 150378 - protein, 108 aa, Triticum aestivum
  unsure (1)..(108): unsure at all Xaa locations
  Clone ID: PAT_TA_44796.pep
FVHTTEFTDSPHPTLPLSDLLRPTLLPLPAMVGYSYQPMLMDGHKHFVVLVEAVLKYIGARRELCAITRTSVGPNGLNKMGINYLDKLFIXGDAATIVNEVVVQHPAV

SEQ ID NO: 150379 - protein, 83 aa, Triticum aestivum
  Clone ID: PAT_TA_44797.pep
RLGFFTPPSGEHRHSNQPWWTAAFRAPTRRSTSGPSASNAPSVSPPPPGIQTRLLLARPPGWGTNSGKKRDRKRGRTRGRTRR

SEQ ID NO: 150380 - protein, 65 aa, Triticum aestivum
  Clone ID: PAT_TA_44798.pep
MAPSSSFPIIHMGLLAGEERADAMDLLDDACENWGFFQVLDHSIFTVSEDDVENITLEHYKRVRE

SEQ ID NO: 150381 - protein, 77 aa, Triticum aestivum
  unsure (1)..(77): unsure at all Xaa locations
  Clone ID: PAT_TA_44799.pep
VIAMLTFGLTVLISLEKAGERTFGQVVIVTAAAGGTGQFWVHLAKLAGNMVFVICGGXSKAAFLAFLGGDRVINYYH

SEQ ID NO: 150382 - protein, 85 aa, Triticum aestivum
  Clone ID: PAT_TA_44800.pep
RIISSVRSGCYKAPRKHLSTKAVRKFVPTTGGVNKLYLFRAGTGALRLCRKYHMSTELLIRKLSFQVLVREIVLYFKTDLRFLSS

SEQ ID NO: 150383 - protein, 57 aa, Triticum aestivum
  Clone ID: PAT_TA_44801.pep
LEPLRRPRPWRHPWEDTLEPPTGAGVLHHKGVRRSLFDVESMRTRPCHVYYSVWVRP

SEQ ID NO: 150384 - protein, 49 aa, Triticum aestivum
  Clone ID: PAT_TA_44802.pep
PMSTCDSYSNPDRRMPAVSAVSGNLNGYDDPSRVTNLYDPVSSKSLMTD

SEQ ID NO: 150385 - protein, 64 aa, Triticum aestivum
  Clone ID: PAT_TA_44803.pep
RKTTILTRKKKWRINNYKRAQNAVQEVHEHPEPALPVGVRADGHPSPNRSRKSATGFSSHVTKR

SEQ ID NO: 150386 - protein, 59 aa, Triticum aestivum
  Clone ID: PAT_TA_44804.pep
KKRKDRNANCLLLRTQMHMFHLPTLCSLPLLCMFIPNPCLNGKKQGQPYHEAPPAEHSA

SEQ ID NO: 150387 - protein, 97 aa, Triticum aestivum
  Clone ID: PAT_TA_44805.pep
LNVHLLIGGFYIDGQKSIPEPFILCCGDGRTIKREEKKKIQKKKEEDDDSTWPRREERDKHGAFLTPSGSCKAPPFEIETCLCMRACMHANSKRKRT

SEQ ID NO: 150388 - protein, 30 aa, Triticum aestivum
  Clone ID: PAT_TA_44806.pep
AKICQGNECHHEQNCHSCRHWLSLAQLCCF

SEQ ID NO: 150389 - protein, 79 aa, Triticum aestivum
  Clone ID: PAT_TA_44807.pep
VRPRVRPRVRFIPHNYEESSLPVFVFVYTLVNTGKERAKVSLVMTWANSIGGLSHQSGGHVNEPFIGENGIFGVFLHSQ

SEQ ID NO: 150390 - protein, 75 aa, Triticum aestivum
  Clone ID: PAT_TA_44808.pep
APCLHDNSSCQTRVKLLALIRFLCRLMLKRDSAENNILYLAYSSRQEAGWELGEVHGDLQCFLPPPWSCSPIHPD

SEQ ID NO: 150391 - protein, 41 aa, Triticum aestivum
  Clone ID: PAT_TA_44809.pep
MPDLPVTLPFAFDPIGDAQAEDACARFGAKDYAHVRIQQRN

SEQ ID NO: 150392 - protein, 57 aa, Triticum aestivum
  Clone ID: PAT_TA_44810.pep
FGRTLIPVADHRCRRRRRRRSHADRLHERPKLSHRGTAHTYGAALTFSKRDLEDELV

SEQ ID NO: 150393 - protein, 58 aa, Triticum aestivum
  Clone ID: PAT_TA_44811.pep
CWLGNSILTEQHIILGNCGGFSPSASKKSPFDMIAVKSSNYFDLLSPQSNQNGTTKNL

SEQ ID NO: 150394 - protein, 79 aa, Triticum aestivum
  unsure (1)..(79): unsure at all Xaa locations
  Clone ID: PAT_TA_44812.pep
VRPRVRPIQGQYNFXGRYDLVKFIREIHAQGLYVSLRVGPFREAEWKYGGLPFWLCGVLNITLRCNNEPYMVHNAKICR

SEQ ID NO: 150395 - protein, 74 aa, Triticum aestivum
  Clone ID: PAT_TA_44813.pep
RWGAPSTTLPSSLSPLSSHLEAGARVLCTEWPAMLTAYLDRIGPARQILIRAAGNGWAPGRDWMEARVGFRVRV

SEQ ID NO: 150396 - protein, 36 aa, Triticum aestivum
  Clone ID: PAT_TA_44814.pep
TQKSHIKITLYYIKSKTRIKIHMINILKKIYTRTVH

SEQ ID NO: 150397 - protein, 94 aa, Triticum aestivum
  Clone ID: PAT_TA_44815.pep
VRWTYRLATHRSCLVHVNPQQQPDPSCCRRHGAPKFPVRASPPSLRAWSSAASLAMPTGSAWPPTANRGAPLRGRPIRPRTTRGSPCLTAHYTG

SEQ ID NO: 150398 - protein, 97 aa, Triticum aestivum
  Clone ID: PAT_TA_44816.pep
RESPRQVRRPPTRLRGGAAEASDLAQKQDLPDAKRWKQGSTETPRHHLPASRHGFRRPLLRRRQGAGWGWEGLPRCGLGSPVAARKGDAGEGRSVGR

SEQ ID NO: 150399 - protein, 57 aa, Triticum aestivum
  unsure (1)..(57): unsure at all Xaa locations
  Clone ID: PAT_TA_44817.pep
MVKFLKPGXAVILLQCMYAEKKAVIVRVFEEGTRYRPYGHCLVVGLAMYPNKVIRMV

SEQ ID NO: 150400 - protein, 86 aa, Triticum aestivum
  Clone ID: PAT_TA_44818.pep
RRRSGWRWPSRSRRGWCRGPRSGRFPRSVSKARRRSGSCGGCGSRRRSTGRTTWVRARRMEDVERRRRVRESYGVELMEERTRGRT

SEQ ID NO: 150401 - protein, 84 aa, Triticum aestivum
  Clone ID: PAT_TA_44819.pep
GSTHDHRRRPPRRRRIHGRRPRQRGGRGVASAPSARACKSAPLFLLCGQKTLTLDGAVKFSTGRLPLSILFDRLPSLEELFVAG

SEQ ID NO: 150402 - protein, 48 aa, Triticum aestivum
  Clone ID: PAT_TA_44820.pep
PRVRGRVGAQGYPPAGYPQQGYPSQYAQEPPPHQQQQQSSGPSFMEGW

SEQ ID NO: 150403 - protein, 107 aa, Triticum aestivum
  Clone ID: PAT_TA_44821.pep
APDPPARAPDPPVVVFTPAPVPRAPLQRLLTPIHKQIKDQRMWIQLLLAQQPSPTNKNGSFVWWGAVSGDAEQDAGEREREGASTRRERRRARERKAPGDRRRAPRR

SEQ ID NO: 150404 - protein, 74 aa, Triticum aestivum
  Clone ID: PAT_TA_44822.pep
GQIGTPATGWSGDEAHRGAQTLGQNKKGRVEPKGWTRDPRGVGLYAGGARLEPARPGCCAGGEGTDVPPRVRGR

SEQ ID NO: 150405 - protein, 52 aa, Triticum aestivum
  Clone ID: PAT_TA_44823.pep
MDQYQEGETLLRSFINNVLITLFLIYRFPVMYMVVLLSIAVWTIITVYLFTY

SEQ ID NO: 150406 - protein, 73 aa, Triticum aestivum
  unsure (1)..(73): unsure at all Xaa locations
  Clone ID: PAT_TA_44824.pep
MMSLTKVIVLVTGASGFLAFWLIKRLFESGYFVIGTVRDPWNWXKVGHLLKLPVAYERLQLGRADLLEEGCFL

SEQ ID NO: 150407 - protein, 129 aa, Triticum aestivum
  Clone ID: PAT_TA_44825.pep
GRRSASWLTRAGAAAFTPLPWSVVVPLFVACHSGSFFSYLLRLPRRAIKRVGAAELHATLSPSSGGAEGRGEDWSESGGNAAASGRGGRRREDEGGRGRPLSVAWVVGATAGTRRGEETPRVRPRVRGR

SEQ ID NO: 150408 - protein, 63 aa, Triticum aestivum
  Clone ID: PAT_TA_44826.pep
SYAPTTIRFSICGSPPTVLAYATNIAALDPPASYRVWVWKLAIRNERKMRGVCRNFHHAYRGR

SEQ ID NO: 150409 - protein, 70 aa, Triticum aestivum
  Clone ID: PAT_TA_44827.pep
VLPRLRASSSLRVTRAAPLLPAEQALSLQLPLPSPPPDGLLRSKPLRFRRWWLPVDPGLFYTRRDLVFWW

SEQ ID NO: 150410 - protein, 115 aa, Triticum aestivum
  Clone ID: PAT_TA_44828.pep
LLVCPVGAIDCSNLWFDKWNHASFIQKKKKDATRSSEKIKLLISRGLTLRCYELLISRGLVPLACLWKSDPGIAGDSMLATHSNFYCRYFSRIALRGGLPLVLPCCSSHRSRTGR

SEQ ID NO: 150411 - protein, 52 aa, Triticum aestivum
  Clone ID: PAT_TA_44829.pep
DKNHYPQKHHRQFALDTTAFQGHHLKGSGEPAFTFKNDRSMNMSNRFVRVGE

SEQ ID NO: 150412 - protein, 72 aa, Triticum aestivum
  Clone ID: PAT_TA_44830.pep
SFNPCFLFILAVWNPGFHSHILFPVLARGHETGDRPVKTSSLGASSELDPAGSFSSREQRGGRRGTPIYECT

SEQ ID NO: 150413 - protein, 40 aa, Triticum aestivum
  Clone ID: PAT_TA_44831.pep
TRTLAFAHHTPVHLDHAAAADKTRERTRGKKRELVNGTAG

SEQ ID NO: 150414 - protein, 46 aa, Triticum aestivum
  Clone ID: PAT_TA_44832.pep
YVVQRSYADYRPIAIGSHISRSGKHEALCFTSEEVKATDDLVVRVG

SEQ ID NO: 150415 - protein, 55 aa, Triticum aestivum
  Clone ID: PAT_TA_44833.pep
RSWSRGRTRGVRDHFLISNPGAENIPGERDGYSLVGDQVLCLGGIGCGKACCSWR

SEQ ID NO: 150416 - protein, 119 aa, Triticum aestivum
  unsure (1)..(119): unsure at all Xaa locations
  Clone ID: PAT_TA_44834.pep
RTRLSSSAAFVCSATIAIMGILGKNFPKKEVAQFTCKSERHIGTQSGGMDQAISIMAKPGFAELIDFNPIXATDVQLPSGGTFVIAHCLAETKKAETVATYYNIRVVXCRLAAIVFVIK

SEQ ID NO: 150417 - protein, 39 aa, Triticum aestivum
  Clone ID: PAT_TA_44835.pep
GLLWLNNGTCPCVVFYKTKEYSRWEEIIGRICGDGETIT

SEQ ID NO: 150418 - protein, 36 aa, Triticum aestivum
  Clone ID: PAT_TA_44836.pep
RARLISCLGRQNLSVYCSLLFQVITMRTNVFGCMII

SEQ ID NO: 150419 - protein, 63 aa, Triticum aestivum
  Clone ID: PAT_TA_44837.pep
MAISTDSRSEEEPSQHSQVEKRWVLADFDVGKALGRGKFGHVYLAREKRSFHIVALKVLFMSQ

SEQ ID NO: 150420 - protein, 82 aa, Triticum aestivum
  Clone ID: PAT_TA_44838.pep
GNKKTICLPPPSGPSSTVTCPAGTLSHAVDEMDISATAPGSHPARPRRHAPQQTPLIHRLSHGSEPSPSKKVWRMEEDGDTK

SEQ ID NO: 150421 - protein, 65 aa, Triticum aestivum
  Clone ID: PAT_TA_44839.pep
LFLLVINLLSVEAGKGMGRRRVCLHEYATVIRVEHAPGRVPSPGRSRRGSMDWSRRQQKSKKEIR

SEQ ID NO: 150422 - protein, 28 aa, Triticum aestivum
  Clone ID: PAT_TA_44840.pep
LEAIFHSMVLTNLYFYLICMPSFVCIFI

SEQ ID NO: 150423 - protein, 82 aa, Triticum aestivum
  Clone ID: PAT_TA_44841.pep
HICCKSPRIVLQNPFHSGHTLLLLLPVHPSLQLVLTTHSLLLFPLNYTFASWASCDHQQRRRGRAQRAPGSPDPRACTGPPS

SEQ ID NO: 150424 - protein, 80 aa, Triticum aestivum
  Clone ID: PAT_TA_44842.pep
LTDLSLLVCFLFLIGFLLDFFGLTHVQHCLPYYHQSKLSHIIRLCRLYWVFYHHFSTILFSLGLLSSPVLMEGYQSMAWK

SEQ ID NO: 150425 - protein, 61 aa, Triticum aestivum
  Clone ID: PAT_TA_44843.pep
RSSFLIQLMYGGRGTLINFMYRRGLYWGAVASHQEKRMKLQMTHCEGLLTNGNQEYGCMHF

SEQ ID NO: 150426 - protein, 108 aa, Triticum aestivum
  Clone ID: PAT_TA_44844.pep
FELMKVDALGRYSWIRHLAPPLGPLGRHPKRTGEAHSRSDLRRFVVCLNSDKIPTARWMEGSPLEPGQSIMVDYTPSRQIEVLQTPPSSARHDDQTVVFASSEHTRHG

SEQ ID NO: 150427 - protein, 54 aa, Triticum aestivum
  Clone ID: PAT_TA_44845.pep
GEGVQEHIYRIIFPPVAVPDGVTVPDLVLAGAEAYSVKVALVEADPGCLSYIYG

SEQ ID NO: 150428 - protein, 87 aa, Triticum aestivum
  Clone ID: PAT_TA_44846.pep
CINFVKTLSVKTITLEVESSDTIDIVKAMIHDMEGIPPDQQRFIFAGKQLEDGRTLVVYNIQKESTLHLVLRLCGGMQIFVKTLTGK

SEQ ID NO: 150429 - protein, 47 aa, Triticum aestivum
  unsure (1)..(47): unsure at all Xaa locations
  Clone ID: PAT_TA_44847.pep
CPSSPPSGRTPAARRAPPPAGPWQPXGGPPACRPAAAPPMAGSPPSP

SEQ ID NO: 150430 - protein, 77 aa, Triticum aestivum
  Clone ID: PAT_TA_44848.pep
GQSPPTAAGKNERATRSTRRRAGSKDRLARAETGGVVNEGEWIRGEAVWLRTAERGKRRGGAAHDGNGSGREGLRRT

SEQ ID NO: 150431 - protein, 81 aa, Triticum aestivum
  unsure (1)..(81): unsure at all Xaa locations
  Clone ID: PAT_TA_44849.pep
MVVTIHSVKAGQIFDSRGNPTVEVDVCCSDGTFARAAVPSGASTGVYEALDLRDGGSDYLGXVLLKAVAIVNLIIGPVLIG

SEQ ID NO: 150432 - protein, 61 aa, Triticum aestivum
  unsure (1)..(61): unsure at all Xaa locations
  Clone ID: PAT_TA_44850.pep
FLIRVSAPPRGQRHSRWRRPPSPGHPPSSPSPTPKPXPPSPPSPSSPSPSPRSDPTPHARS

SEQ ID NO: 150433 - protein, 57 aa, Triticum aestivum
  Clone ID: PAT_TA_44851.pep
DRASISSGYRSSWAPSPSVKATPKSVSPSLPRRSVWGGPRGMRSSTPPPARDLFALP

SEQ ID NO: 150434 - protein, 55 aa, Triticum aestivum
  unsure (1)..(55): unsure at all Xaa locations
  Clone ID: PAT_TA_44852.pep
SATVVALNAVILFAKAKLLEEGLPKLQRLALKKVKGXLTKEELATRSDLSAVLLD

SEQ ID NO: 150435 - protein, 64 aa, Triticum aestivum
  unsure (1)..(64): unsure at all Xaa locations
  Clone ID: PAT_TA_44853.pep
MGLKFYVGGIWKCNGTAEQLESIVNTLNAGQIAFTDGVEVNFSPSYCXLPTVKGQLRPEIQVPC

SEQ ID NO: 150436 - protein, 108 aa, Triticum aestivum
  Clone ID: PAT_TA_44854.pep
VRGRVGKKKKVVFVPRKLQCLLKVQEEAAEETSFTVILIAKSGDKHTVFVFSSSTVQWRAGPWTPWTAELSLAFFSYLRYAYGCFYGVTECTEKLLLLDTRTMEFSFA

SEQ ID NO: 150437 - protein, 92 aa, Triticum aestivum
  unsure (1)..(92): unsure at all Xaa locations
  Clone ID: PAT_TA_44855.pep
MAQKDTVNGNGATTRLATTPFPIRLYKFFQANMRILVTGGAGFIGSHLGDXSWRTSKNEVFVADNFFTGSKDNLKMWFCHLRFELILYDVTE

SEQ ID NO: 150438 - protein, 70 aa, Triticum aestivum
  unsure (1)..(70): unsure at all Xaa locations
  Clone ID: PAT_TA_44856.pep
IRPPNGGVLYGPPGTVKSXMARASAAQTNATFLKLAGPKLDQMFIWDGAKVVRDPFKLAKEKAPCIIFID

SEQ ID NO: 150439 - protein, 50 aa, Triticum aestivum
  Clone ID: PAT_TA_44857.pep
LSISCKSVLPSSFSFTTTMLEGPSSNVWVYMLLRHLTYSFGPRFHAIQLS

SEQ ID NO: 150440 - protein, 112 aa, Triticum aestivum
  Clone ID: PAT_TA_44858.pep
HPSTCPLVFIYHLRSLHRGPVVGRHNAIVTPHRMRSRSPTPPASEVRAVTRAVRVPYHQLSLPQQVPPAFGYVVQPTAKVTAPCALNSSTHCFTFPTLTTIAFQRGYQGTVF

SEQ ID NO: 150441 - protein, 43 aa, Triticum aestivum
  Clone ID: PAT_TA_44859.pep
RSVGSVPLKGWPFQSQGSINSGQVYAHMVQLMTSTYLLHILSP

SEQ ID NO: 150442 - protein, 55 aa, Triticum aestivum
  unsure (1)..(55): unsure at all Xaa locations
  Clone ID: PAT_TA_44860.pep
MGRVIRAERMDAVSAFKSHTHHRKGPARFRSLDFGXRNGYLKVRVTDVIHDPWLW

SEQ ID NO: 150443 - protein, 66 aa, Triticum aestivum
  Clone ID: PAT_TA_44861.pep
SDHFYLEYHTDFLPPGAKNKGCGSGDTDRQYRDIWAGHPLTLSLCFLPFGHKLCDLDISLVEKTQV

SEQ ID NO: 150444 - protein, 128 aa, Triticum aestivum
  Clone ID: PAT_TA_44862.pep
MPPGALNNTSGILEMDSPSRESLEGQLLRFSLCFLHLWDVDCELDKLLVDEMQVCKPEGCHIATGVVGDRGSFTVMFPGKEATLELWKSSAEFCAMRSLSIVSLAQRMITLSRSCTNASSALAAFYTR

SEQ ID NO: 150445 - protein, 84 aa, Triticum aestivum
  Clone ID: PAT_TA_44863.pep
TRASSRSPRRPRNSRSGPSTGRTSPSSREGVAPLLARIIVPHRMSLLSSSRRENLKGEAADQRARDDGRVSWELARGRVKMGGV

SEQ ID NO: 150446 - protein, 76 aa, Triticum aestivum
  Clone ID: PAT_TA_44864.pep
NMGQSVLAGQQPGEPQQLPRESQLPTDTEEIRAILSPAEEQSVNDQPKEQTDEDEAASMEATHSQFSPYAAWHKQY

SEQ ID NO: 150447 - protein, 48 aa, Triticum aestivum
  Clone ID: PAT_TA_44865.pep
FLPLRSPDVYLYLVFYILASGVCLESVRALDLTFTLPPSNILARSDFF

SEQ ID NO: 150448 - protein, 49 aa, Triticum aestivum
  Clone ID: PAT_TA_44866.pep
SFGARSLCPLVRFFFVTSLRPGRSPCPTGLHHGHSNLHWCCMDESSLEF

SEQ ID NO: 150449 - protein, 37 aa, Triticum aestivum
  Clone ID: PAT_TA_44867.pep
SLIMCVIASLRASICTLLMESAVEKMFLNEEGWEDRT

SEQ ID NO: 150450 - protein, 101 aa, Triticum aestivum
  unsure (1)..(101): unsure at all Xaa locations
  Clone ID: PAT_TA_44868.pep
SVEHEFLADLNPLGWMHTQPSEASQLSPHDLTLHAKNLENIKQWDGVKCIIFTCSFSLGSCXRLAYKLTPSGFGRARGNXDIGSNPQGFFPTYYEKVQNAF

SEQ ID NO: 150451 - protein, 98 aa, Triticum aestivum
  unsure (1)..(98): unsure at all Xaa locations
  Clone ID: PAT_TA_44869.pep
FFLEALPGDNVGFNVKNVAVKDLKRGFVASNSKDDPAQVAANFTFQVIIMIPPWYDCYGYAPVLVCLTFYISVKXAESVTKIDWLSGKEIEAAPKFPE

SEQ ID NO: 150452 - protein, 37 aa, Triticum aestivum
  unsure (1)..(37): unsure at all Xaa locations
  Clone ID: PAT_TA_44870.pep
PGSLSPPPRAQLRPLPCRTAAFAIKRFWDEKDESRXR

SEQ ID NO: 150453 - protein, 76 aa, Triticum aestivum
  Clone ID: PAT_TA_44871.pep
PVRWLARPKSPVLRTPTRSTTSPHPSVSSLWSPTSTRRSTPRSSPRWQPPPMFSPPLPKPKSPPRSPMIHPQFPLR

SEQ ID NO: 150454 - protein, 50 aa, Triticum aestivum
  Clone ID: PAT_TA_44872.pep
VVKTPSIDSTCPECYLRGMEETRDVQQPSIVTLDQIRGRHRARSSDLTKE

SEQ ID NO: 150455 - protein, 64 aa, Triticum aestivum
  Clone ID: PAT_TA_44873.pep
MPLLPVSTRETKISRVVKRHYYHWRQPEPPTFNFLVHPNISHTIINIEKCIHQLLNSQPTRPRT

SEQ ID NO: 150456 - protein, 124 aa, Triticum aestivum
  unsure (1)..(124): unsure at all Xaa locations
  Clone ID: PAT_TA_44874.pep
RPVQWEDVGGQARIKKQLIEAVQLPQKCPDAFERLGIRPPRGLLMIGPPGCSKTLMARATASEAKMNFLAAKGPELFSKWVGDSEKAVRSLFXAKAKDNAPAILFFDEIDGLGSNLVAMEIMAY

SEQ ID NO: 150457 - protein, 60 aa, Triticum aestivum
  Clone ID: PAT_TA_44875.pep
SLPTPTFTSVASFANTKLARSPLASSTSQASRDGVLCKNQIDHGRYFQSAFLSDSSTSKD

SEQ ID NO: 150458 - protein, 136 aa, Triticum aestivum
  Clone ID: PAT_TA_44876.pep
SGIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEEAKAKKT

SEQ ID NO: 150459 - protein, 86 aa, Triticum aestivum
  unsure (1)..(86): unsure at all Xaa locations
  Clone ID: PAT_TA_44877.pep
MAATIQSVKARQIFDSRGIPIVEVDVSCLYGTFVRGAVPSGVXTGVYEALELIDGGSHYLGKGVCNAADNVYLIIVPACIGLDPIA

SEQ ID NO: 150460 - protein, 69 aa, Triticum aestivum
  Clone ID: PAT_TA_44878.pep
PALSSYGCLSLLKKKRSGDLFVGNKPRAVGKRTPPVPVVSMYRDDKIGPSNRHAQPDAYNGVEEGALAA

SEQ ID NO: 150461 - protein, 44 aa, Triticum aestivum
  Clone ID: PAT_TA_44879.pep
FGVGVDQLTVKLPLLLSKDRPCLNPELRNEHAFTANAWANAWVP

SEQ ID NO: 150462 - protein, 58 aa, Triticum aestivum
  unsure (1)..(58): unsure at all Xaa locations
  Clone ID: PAT_TA_44880.pep
VRGTRGRTRGRFFYRDLKPQSLLIDRRTNSLKLADFGLVRAFGIXVRTFTHEVVTLWH

SEQ ID NO: 150463 - protein, 41 aa, Triticum aestivum
  Clone ID: PAT_TA_44881.pep
MTQKDFRTYLYNMQSLPTYGMAHPKLSCSCSSDALEQGSGR

SEQ ID NO: 150464 - protein, 57 aa, Triticum aestivum
  Clone ID: PAT_TA_44882.pep
LCPKSNFIMFDRVYRKQYEHLQSHVYCENIFNDESNSIDILLSKLKVFYTLGQSLQS

SEQ ID NO: 150465 - protein, 114 aa, Triticum aestivum
  Clone ID: PAT_TA_44883.pep
MATGSNSSSQESKQPGPELPKQLPFDFLKKITNDFGQDRKISDSPFGTLYKGIVPDDGRVIAVKKLHENAPMPADMQFNKEVQNVMFLKHENIVEVVGFCSETQKKLVQFDKRL

SEQ ID NO: 150466 - protein, 69 aa, Triticum aestivum
  Clone ID: PAT_TA_44884.pep
LLEAFIFIYQYKAGYDAVFCDLNATGDLISISSQRELFSTVSATGTGKRLSTVSPMNKAETSICRIQLE

SEQ ID NO: 150467 - protein, 87 aa, Triticum aestivum
  Clone ID: PAT_TA_44885.pep
RPSTRPRLHSHSPPAPQSSPSSPSSPPPPARAERRGLRPPPTAMSRRRPRGGTQRMDAEIDHFAIMGYPKAVVRRVVNRPVRDVNGR

SEQ ID NO: 150468 - protein, 77 aa, Triticum aestivum
  Clone ID: PAT_TA_44886.pep
CVRAVITQLPARQYPSCLTTSSRSYATSTAAYSSDTFSTYFLGVSHLTCLFVQTHNLAVGGYHRMFLRAGRHILCCL

SEQ ID NO: 150469 - protein, 101 aa, Triticum aestivum
  unsure (1)..(101): unsure at all Xaa locations
  Clone ID: PAT_TA_44887.pep
PGQQAVAISRTAKSLAAYPKAPFQLRTSEIVNAPNGEVKSPPXVERTLPNSXYIYICLNFMLQESQDLLINCVSQELGFPVVGVLAACVIYRCLXLHWRSF

SEQ ID NO: 150470 - protein, 46 aa, Triticum aestivum
  Clone ID: PAT_TA_44888.pep
WPATIGIIHAADRRHRHPISRGGKLHTGPLANGGLTNGMIGTDHGF

SEQ ID NO: 150471 - protein, 124 aa, Triticum aestivum
  unsure (1)..(124): unsure at all Xaa locations
  Clone ID: PAT_TA_44889.pep
LXRPTPPRTRGRTLGCQLTRSVSSPLRCYTRPLVSKKSPSVLNLSGGFRAQIQGGEGAFPATLAAALEPSAVARGGRLRRCKARARGGPNEGGSTTFFQGPGACASYTPFRGDRLARFPLPRGK

SEQ ID NO: 150472 - protein, 98 aa, Triticum aestivum
  Clone ID: PAT_TA_44890.pep
RPASSAVLLVDPFRYILAVSTLDLFTRELEFRREMVAAFISFVKERWESIHAAPVIVLPYEGDDNSNKALPAKASRQTESKDVQDQRSDIYVNGIRPS

SEQ ID NO: 150473 - protein, 113 aa, Triticum aestivum
  unsure (1)..(113): unsure at all Xaa locations
  Clone ID: PAT_TA_44891.pep
MGDFMCCYLIYNFEDDPVKEAANFTVQVIIMNHPDQISNGYAPXLYCNTSHIAVKLAEIHTKIDRRFXRMIELFPNFLMNCDAVFVKMILIKPMVVETFSQYPSVGRFVELDM

SEQ ID NO: 150474 - protein, 48 aa, Triticum aestivum
  Clone ID: PAT_TA_44892.pep
MPRAGLSAVSNKLDIAIDLGNPFLNRTVDGFLKIGAVCACMVVVVDAF

SEQ ID NO: 150475 - protein, 123 aa, Triticum aestivum
  unsure (1)..(123): unsure at all Xaa locations
  Clone ID: PAT_TA_44893.pep
ICLLGRGVSMAVNNVNSIIVPALVGKDPTVQTELDNFMVQXLDGTKNEWGWCMQKLGANAILAGLLAVCKAGASVKKIPLYQHIVNLVGNKQLVLPVPAFNVINGGSHAGNKLAMQEFMILST

SEQ ID NO: 150476 - protein, 88 aa, Triticum aestivum
  unsure (1)..(88): unsure at all Xaa locations
  Clone ID: PAT_TA_44894.pep
RGITIDIALRKFETTIYSCTVIVSPGHRDFIKNMIIGTSQVECAVLIIVSITGXFEVVYYIDGXDPVSSLFLAFTFDXKKMICCCIRW

SEQ ID NO: 150477 - protein, 59 aa, Triticum aestivum
  Clone ID: PAT_TA_44895.pep
EIILKIRVMLNDLFALGLLFCSLNLNLKLRGGPFYRYQSFLLRACLRLYVFFIWRILKL

SEQ ID NO: 150478 - protein, 76 aa, Triticum aestivum
  unsure (1)..(76): unsure at all Xaa locations
  Clone ID: PAT_TA_44896.pep
MAVAEVIQPLVCDNGSGMVTAGFAGDDASRAVFPSIVGCPRHTGVMVRMGXKDAYFGDEAQFQRGFLTLKYPIAHG

SEQ ID NO: 150479 - protein, 129 aa, Triticum aestivum
  Clone ID: PAT_TA_44897.pep
VRPRVRHFGMEALFMPYDHKNTTPDGAPSHLMRSVLENVNHRNFQDSCLVGSGGGAVGYLAHGTTTDYLYDIAKVPMPFTFEIYGDEKAFTEDCFKMFNPVDKITFDRVINKWCMAFPHTFRGRAANPT

SEQ ID NO: 150480 - protein, 139 aa, Triticum aestivum
  Clone ID: PAT_TA_44898.pep
VRARCSKLSACWWPPHFKSPRLENGAAGEDGSGVPVFAEYSLDELRAATDGFAADRIVSEHGEKAPNVVYRGTLFSSGATVAIKRFGRSAWPDARQFVEEARAVGLLRSGRLSNLIGCCCEGGERLLVAEFMPHDTLAK

SEQ ID NO: 150481 - protein, 128 aa, Triticum aestivum
  unsure (1)..(128): unsure at all Xaa locations
  Clone ID: PAT_TA_44899.pep
IDQFDRVGGKALIHCCRRTRHQRRVQNLRYSMLTKGXLSLAKACTLLKSVHPPAKPYDGXAKALITLSKKLNGKASMDCQQKRPQMNVCPICGKIVGLSTSSLKLHLQKAHRRLSHCRMYSAMTMEIQ

SEQ ID NO: 150482 - protein, 108 aa, Triticum aestivum
  unsure (1)..(108): unsure at all Xaa locations
  Clone ID: PAT_TA_44900.pep
CNKMDATTLKGXKARYEEIVKEVSLYLKKVGYNPEKVSFVPIFGVEGDNMIERSNNLDWDKGPTLQEVLDQNNEPKMPXYKPLXRILLQDVYMMGGIGTVPVGLVETG

SEQ ID NO: 150483 - protein, 141 aa, Triticum aestivum
  unsure (1)..(141): unsure at all Xaa locations
  Clone ID: PAT_TA_44901.pep
WAPPRQPPPPVPPSWAPPWQAPRPWDRPGPAPPPWAPPWQAPRPWARCSRPXAPRPRPPHRSWPARRSWQVPRPPPWSPAPAPSRPPRPPQPPQRPPAWSPRPCCWKRMEVCACWRWKLGARARGRRICGEREGGREARRT

SEQ ID NO: 150484 - protein, 113 aa, Triticum aestivum
  Clone ID: PAT_TA_44902.pep
SADFSPAGHTLTFLCSRPHVFLCFSVRAACSSGARRKPAAGSRQRPAAGLRGSRPAQKPADRVGGKLASTGAGRPGCREAGQRGSRPAGCREAGRSGGEARVKPAGRVAGEPS

SEQ ID NO: 150485 - protein, 98 aa, Triticum aestivum
  Clone ID: PAT_TA_44903.pep
SCHSCGRSDQTAQTGCLLACRRLSRKEQRWSGRRPPSCTSPPTTPPAGARSSCRSPPLTYCVAPATFWAPGTRVEAFSLFPPSAFVTIATDISCTITT

SEQ ID NO: 150486 - protein, 56 aa, Triticum aestivum
  Clone ID: PAT_TA_44904.pep
RPSIHITLWHCPLGAQAPLTCVGACRGRRLHMHQLDCDLEAIRHNPALGNCRPLAY

SEQ ID NO: 150487 - protein, 68 aa, Triticum aestivum
  unsure (1)..(68): unsure at all Xaa locations
  Clone ID: PAT_TA_44905.pep
VEFDMEGKVCGVTSEGETAKCKKVVCDPSYLANKVRKIGKVARAIAFMSHPISYAXDSHSIXIILPQK

SEQ ID NO: 150488 - protein, 73 aa, Triticum aestivum
  Clone ID: PAT_TA_44906.pep
VVALFKTHHGASSCIELKFLILEMHAFFKNTIHVFISICYGSIASKLVRFKSYILMRHHVWIICLVITQDTKS

SEQ ID NO: 150489 - protein, 142 aa, Triticum aestivum
  Clone ID: PAT_TA_44907.pep
RPPTRSLNPALGAPRISINPDFPKDGKIQDLSLGLFVNSPSPPKESLNKSASKKPKAHFDGSLSLTNQKKKETPHWLLNRNKSGFVAHNRTKDENSSAKEVMPAIQAPLPCTSTGSSKKPSSSTLGACTISGKEITTALAIA

SEQ ID NO: 150490 - protein, 135 aa, Triticum aestivum
  unsure (1)..(135): unsure at all Xaa locations
  Clone ID: PAT_TA_44908.pep
RPPTRPGTCHFCFHAAATALGGLYTFRFXPPLHLKPDESQESYNSEGESQRVDPAKKSPSHRCSAPGITLHPXRYLGCSYGYLILSDWRHCHLGDVYTGTKVKPPKFQXSECNTLIYLGILTGPLNSTKSRAILS

SEQ ID NO: 150491 - protein, 113 aa, Triticum aestivum
  Clone ID: PAT_TA_44909.pep
MAKKGSGTAASLLLCLALAAHAVGAARTMPAAAGGVAEASLPAAAATEKGAGAGGAGAADAKNLFVGVGAMGDLPGFPAVGGGYGGGFGNNGAGVFTGVTGPLGGVWGGVGSV

SEQ ID NO: 150492 - protein, 143 aa, Triticum aestivum
  Clone ID: PAT_TA_44910.pep
RPRRRRLQAPSHFFPPLPGLADAVAVRLHSPLVRFADAFFRPPRGLAGESGSSHGHRVSHRSRVQVQPPRPRLRRHLPGGLQGAPARRSASSALAACTTRPRLQLKPCSSRCRFRSPCHGSAETAGGQKGQGREKRKSHDVPT

SEQ ID NO: 150493 - protein, 71 aa, Triticum aestivum
  Clone ID: PAT_TA_44911.pep
GPCTLTPRTLPTEGRHQNPPPRTSVAGPNGEDCGGAPAVKGSISPLGGWIGGEGARSGGERGAYIRPFGRT

SEQ ID NO: 150494 - protein, 87 aa, Triticum aestivum
  unsure (1)..(87): unsure at all Xaa locations
  Clone ID: PAT_TA_44912.pep
FAAPPCSSAAGSPPPGAAPEAFFCSCREVRFAGARPGGAXALLGAAGGVXLXPGVGGFPPPLEPXFGALXLLEPXXLLGGGFCGRVG

SEQ ID NO: 150495 - protein, 132 aa, Triticum aestivum
  Clone ID: PAT_TA_44913.pep
ASGASHLLSHSARRLARNPSPLPALRLLSLFPASSPLRAFCPRARPSPIACSAYSTASSAMADDTSSNPLLADFDFPPFDRVEPAHVRPGIRALLARLEGELEELEKGVEPAWEKLVHPLERIVDRLDVVWN

SEQ ID NO: 150496 - protein, 136 aa, Triticum aestivum
  Clone ID: PAT_TA_44914.pep
VRSNRIRKTNTRLPSSLDQRRRISSHPRQAGRSGNSSPPLPNLVPSFVSFACAPTDLRREPPARARARVPSVRQAVARYFIWAGRRRGVFFPTLRGGRATEAEPRGGWLISMRYLTKGAQVDSLTAWNLAPNHRPT

SEQ ID NO: 150497 - protein, 106 aa, Triticum aestivum
  Clone ID: PAT_TA_44915.pep
SCPNPSPGGPPICTFPRLLPSGPTAPGPPLPIDWSLHTAYLALCRHQRTRSCRLDFPPFDELARYVRPGSDAPRPSRGRAYELEKGVVPALEKLDHPFERIVNRLY

SEQ ID NO: 150498 - protein, 70 aa, Triticum aestivum
  unsure (1)..(70): unsure at all Xaa locations
  Clone ID: PAT_TA_44916.pep
SRTTLCSLLKLLGNELLSDSLPYRALXNRTLXEVLGHXIVQGAVHVYIGATPSDAGVGDYEAGSCQNMLV

SEQ ID NO: 150499 - protein, 139 aa, Triticum aestivum
  unsure (1)..(139): unsure at all Xaa locations
  Clone ID: PAT_TA_44917.pep
RPLDVAVSAVLPYGWTRYAQLRLSVVNQIHNTFTIRKETQHLLYALDCDWGFTSFTPWSELHNPSXGYLVNDPCVLQAYVAVCKVXDYWSYDSKXETGYVGLKNQGATSYLNAFLQTLYHIPYFRMAGYHMPTTVYDMP

SEQ ID NO: 150500 - protein, 84 aa, Triticum aestivum
  unsure (1)..(84): unsure at all Xaa locations
  Clone ID: PAT_TA_44918.pep
DPRFTVLLIRKLSLQRLALEIGQDFKTDLRFQXSSTVFELDEAAEAYLVGLLVDTNLCSIHXAKRVTIMPNDIHLARRIRGERA

SEQ ID NO: 150501 - protein, 59 aa, Triticum aestivum
  Clone ID: PAT_TA_44919.pep
SSRTNSRPAMSGFRVVFLLLGLAVSCNSTAVASAMYKAKASVICRHDCSIHQGLIPPPC

SEQ ID NO: 150502 - protein, 38 aa, Triticum aestivum
  Clone ID: PAT_TA_44920.pep
VRREKEFNEELMRALLEIHRLVEPLMDKIPNFYYHLLI

SEQ ID NO: 150503 - protein, 73 aa, Triticum aestivum
  Clone ID: PAT_TA_44921.pep
IRGSRLLFASRSPAFCLFTTSTKKARMSYGNTLVTLVPGIDFSFISSLSSSNRALSSDRLTGSMASVAVEASG

SEQ ID NO: 150504 - protein, 57 aa, Triticum aestivum
  Clone ID: PAT_TA_44922.pep
VRPRVRPDARGHPWSMTSIIVLCSTGTQGLSRNRDCYSSRSGLTRIEIIPGDPCCHG

SEQ ID NO: 150505 - protein, 67 aa, Triticum aestivum
  Clone ID: PAT_TA_44923.pep
SAHASVEAMARCIIWLLGLVSAAVLELALIVHTLWYLAEPSGLHHLLLAEPGAGGHQRLAPFSLSSI

SEQ ID NO: 150506 - protein, 126 aa, Triticum aestivum
  Clone ID: PAT_TA_44924.pep
IGFPHAVGCPGKTIGDCIHGEVPPGKAIVGTAGPQLDSDSDKSPTMRMLQNWVNSSHHPFYGQHRDVGGSLGRRWRWRRRALGEGGVVPRPQPQRLVVAWLRRLGLPAGRGHPEVVLDEVVDVART

SEQ ID NO: 150507 - protein, 97 aa, Triticum aestivum
  Clone ID: PAT_TA_44925.pep
IMCEFASQASAVASGRAAILGSAGLLHERCRHLYYMEADKLAGCIQITQSLAWLDAGSAVDAMLCGVATGVGVGVRLERSPLRSPAVVTLRRRQEAD

SEQ ID NO: 150508 - protein, 135 aa, Triticum aestivum
  Clone ID: PAT_TA_44926.pep
TLPLRPPMNKICSSFISRLQSGQQLRGGDREAGEAGRTGGWSRAGPEPARRRPAPGWRSRAGEPGEQRSRAGEQGCSLQGTGRERRSQGRGADEQGSAGESPAGAGGCLGSLEVWNSRRVVRSGRPRVRGRVGGR

SEQ ID NO: 150509 - protein, 55 aa, Triticum aestivum
  unsure (1)..(55): unsure at all Xaa locations
  Clone ID: PAT_TA_44927.pep
PQYPHTCYCIIKRLGDTVARVHGSNRVTSXLGALVAAKFGWSANFDRLMRAQTIG

SEQ ID NO: 150510 - protein, 57 aa, Triticum aestivum
  Clone ID: PAT_TA_44928.pep
KTELINNAGNKHVRCLPVGTNELQCRKITKLKVTTNAPETSCRHKKWRAKACLKKRK

SEQ ID NO: 150511 - protein, 114 aa, Triticum aestivum
  Clone ID: PAT_TA_44929.pep
SDVVPFIKKVNYVYKTIMKFCSVSYFNSNSYSAKIKNCVIAIKRNVLLVPNKGKTKVGKLKNVQSYMFREKSWSEGNALQACAILKFRKGIKMHDCNLLIIFQFLSYEKITSYF

SEQ ID NO: 150512 - protein, 65 aa, Triticum aestivum
  unsure (1)..(65): unsure at all Xaa locations
  Clone ID: PAT_TA_44930.pep
RPLNLSPSGTSMARFLVALLAPSLVAVXAXXHLCHAAPAXADGFWRAVLSHSSLSDAVLRLLKQP

SEQ ID NO: 150513 - protein, 81 aa, Triticum aestivum
  unsure (1)..(81): unsure at all Xaa locations
  Clone ID: PAT_TA_44931.pep
YRWYDIKGPVLFTSLDXXKTLVFRTQGSKIASEGLKHRVFEVXLADLQNDEDQAYRKIRLRAEVVQGMNVLTNFWGMGSTT

SEQ ID NO: 150514 - protein, 74 aa, Triticum aestivum
  unsure (1)..(74): unsure at all Xaa locations
  Clone ID: PAT_TA_44932.pep
PASPLVCCRTPIPITGGSIRKSASSPSPHSSPASPSCSRTFPPPGLHSHSGGKKSPIFCRRPAFTPRRRAXGCA

SEQ ID NO: 150515 - protein, 85 aa, Triticum aestivum
  Clone ID: PAT_TA_44933.pep
MHSWGTRLLAAGTTAVLLLIATCAAASALDAFHVPSVEAQAHVTKINRFHKQINGNDKVTLTFSLSANLESLFTWNTKQVVFTFQ

SEQ ID NO: 150516 - protein, 83 aa, Triticum aestivum
  unsure (1)..(83): unsure at all Xaa locations
  Clone ID: PAT_TA_44934.pep
ALNVDQDRCLHRPRHAGGARWIWICRCGAWLRGRRRAASGSGGCWLWASAXEASGSAAALPPVHARAVFEWGRGGEIGAGTGR

SEQ ID NO: 150517 - protein, 81 aa, Triticum aestivum
  Clone ID: PAT_TA_44935.pep
VRKNRARKTLNPSPPPSPNPPLAAAGDGDHRAAMATLLRRASLRRAIASAGTASCPESYRQVICGSTLHWRECASKAKKKC

SEQ ID NO: 150518 - protein, 114 aa, Triticum aestivum
  unsure (1)..(114): unsure at all Xaa locations
  Clone ID: PAT_TA_44936.pep
VRRRYFKEMKMGYQIEPKAEHYACMIDLLGKSGLLEEALEVANGMPMEAGEAGWGALLNACRVQGNVXIGECAADKLVKLDPLDXGIYVLMCQIYANKSKWDQGKMLRMLMRDI

SEQ ID NO: 150519 - protein, 50 aa, Triticum aestivum
  unsure (1)..(50): unsure at all Xaa locations
  Clone ID: PAT_TA_44937.pep
SLGGAYQPGSXXELSVRSTVATDRAIPNLFFMRRSILYIYYPSFTTLHCD

SEQ ID NO: 150520 - protein, 36 aa, Triticum aestivum
  Clone ID: PAT_TA_44938.pep
MAGRKGGDRKKAVTRSVKAGLQFPVGRIGRYLKMGR

SEQ ID NO: 150521 - protein, 66 aa, Triticum aestivum
  unsure (1)..(66): unsure at all Xaa locations
  Clone ID: PAT_TA_44939.pep
RPVAXXNRRPSLLARCRSRTLGGDYPRTAXXGPSPLTTRTLSAPCPHPLLPARYRHRSLLTRSLPS

SEQ ID NO: 150522 - protein, 144 aa, Triticum aestivum
  unsure (1)..(144): unsure at all Xaa locations
  Clone ID: PAT_TA_44940.pep
VRFLRVRRSGAAAASAQIIDLXEDTRIHPESYALAKNLAKDVCAEDGPEANEMDDDEQEMAIEHVREKQEQLERLDIDEYSRSIGDDKRETLLDIKLELKCGFSDRRTPYAEPSPDEEFXXLSGETEDNISDGXIVQVTVRHIQ

SEQ ID NO: 150523 - protein, 107 aa, Triticum aestivum
  unsure (1)..(107): unsure at all Xaa locations
  Clone ID: PAT_TA_44941.pep
VPLPPLPVDPMGYXRGRGISFRIRISENRREYPPVCYRFGISKPGTSDLAEFLELVDLLTIPFQGGIAAIHHDLFCFCTVYELASHCPPILRIGQTPPTRPPTRPRT

SEQ ID NO: 150524 - protein, 73 aa, Triticum aestivum
  Clone ID: PAT_TA_44942.pep
KGDRAALPGITVLFRCGCVLRPSCVCGTFRLIAASSISSRTSNSCAAISLFRLTSVVLAALFGRTRGRTRGRT

SEQ ID NO: 150525 - protein, 63 aa, Triticum aestivum
  unsure (1)..(63): unsure at all Xaa locations
  Clone ID: PAT_TA_44943.pep
VRQIVIENSTDVMLYRIALTGGEVMXGVQPPDRLSLEEPPSGVGMCSLYAFTDINLHFLLNFI

SEQ ID NO: 150526 - protein, 74 aa, Triticum aestivum
  unsure (1)..(74): unsure at all Xaa locations
  Clone ID: PAT_TA_44944.pep
LRPLNDKEVSLKDKNIVXCSPDEFTIAHPWKDDKSKQHIYDRVFDAYTTQEDVFEDTKYLVQSAVDGYNXCIFA

SEQ ID NO: 150527 - protein, 43 aa, Triticum aestivum
  unsure (1)..(43): unsure at all Xaa locations
  Clone ID: PAT_TA_44945.pep
MAKTYPXVSAEYHEAGEKGRQKLLSVIGERNWSPVMLRLSVDS

SEQ ID NO: 150528 - protein, 134 aa, Triticum aestivum
  unsure (1)..(134): unsure at all Xaa locations
  Clone ID: PAT_TA_44946.pep
CPAETPPAAQPPAHLYPVQKRTLPRAASGAEQSTDFTAAAAHPRRRRRRRLEERASEPPDPTMTKSKNGCLKILCGGAGSDATVGSDPETDAHXDXSKAISDKSRWSFRRRSTRHRVLKNXDIFEPETLSSSKA

SEQ ID NO: 150529 - protein, 71 aa, Triticum aestivum
  unsure (1)..(71): unsure at all Xaa locations
  Clone ID: PAT_TA_44947.pep
SNNXHRDAPTPVSWLYFSXPLEHTHEVTRKNSHVDRTHIMVPIETTSPTRPSHLTRHTPSLGNTPEHGYRT

SEQ ID NO: 150530 - protein, 36 aa, Triticum aestivum
  Clone ID: PAT_TA_44948.pep
MSCAAAEAGLVAMDCVVVCCCCPCLVLQITVFLFVR

SEQ ID NO: 150531 - protein, 46 aa, Triticum aestivum
  unsure (1)..(46): unsure at all Xaa locations
  Clone ID: PAT_TA_44949.pep
PRVRPRVRAHPHHNPVRCATDSSASRSEGNSYXLYTFNWPYITLVI

SEQ ID NO: 150532 - protein, 63 aa, Triticum aestivum
  unsure (1)..(63): unsure at all Xaa locations
  Clone ID: PAT_TA_44950.pep
RPPTRPKHSFSTSNTRSVXLRVEIRLVLSMVXQMTQTNFFGVPLAEGKGLLEQVDLRWALNHM

SEQ ID NO: 150533 - protein, 73 aa, Triticum aestivum
  unsure (1)..(73): unsure at all Xaa locations
  Clone ID: PAT_TA_44951.pep
VRKNEALTIKSKKHLRKGDEEGHIDVLGRRGVXMTFXSGTTISSTPLQRRWAATTLSYWARFPSSQNQLLMTT

SEQ ID NO: 150534 - protein, 44 aa, Triticum aestivum
  unsure (1)..(44): unsure at all Xaa locations
  Clone ID: PAT_TA_44952.pep
LPSKKSELSDDTSFYVNQTDLDIDFRGMVLSYFTPPKXXFSXNI

SEQ ID NO: 150535 - protein, 66 aa, Triticum aestivum
  Clone ID: PAT_TA_44953.pep
VRTPDRDATTACPLGVLQGPDAGVCRTTIFFLTLHFFSLCVLFILYGFFLRPRWFFLFGVAFKNTI

SEQ ID NO: 150536 - protein, 47 aa, Triticum aestivum
  unsure (1)..(47): unsure at all Xaa locations
  Clone ID: PAT_TA_44954.pep
LVHHLRDMVQHPDRHXGAWPPADRTPAGEGWGKAHASAYEWADRGRT

SEQ ID NO: 150537 - protein, 123 aa, Triticum aestivum
  unsure (1)..(123): unsure at all Xaa locations
  Clone ID: PAT_TA_44955.pep
MAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIXLTKGQEITVSTDLYIKGDTNTI

SEQ ID NO: 150538 - protein, 117 aa, Triticum aestivum
  Clone ID: PAT_TA_44956.pep
RPTEASVTRIQAKNCRVAIDTYRSDFPQAYTYGRSPFPALDGFIESIASFGSVSGKIRCWYWFSQDGLMIYSMSRSRYCEHIGREHKSNHGNILLFSVYDFLAQECITLLMLLANVP

SEQ ID NO: 150539 - protein, 53 aa, Triticum aestivum
  unsure (1)..(53): unsure at all Xaa locations
  Clone ID: PAT_TA_44957.pep
PRASHEYPSILGQQGMGIAASXRXXKXEAQHTSHTEDGAAGAGREEIPRVRGR

SEQ ID NO: 150540 - protein, 120 aa, Triticum aestivum
  unsure (1)..(120): unsure at all Xaa locations
  Clone ID: PAT_TA_44958.pep
GRRSRAAGRTVGEDRTRNMSYLXDRLRDPLHSGGPRVGVHQQRVVGMRQGTVWSVHAWRRHPCRHGEVALGEAGRRHACEQRLAALGPAVGARPHPWQAPGCTFISRGATCASTLSHKSD

SEQ ID NO: 150541 - protein, 117 aa, Triticum aestivum
  unsure (1)..(117): unsure at all Xaa locations
  Clone ID: PAT_TA_44959.pep
RPILQPPNEPNDTVVPVQSMGTVLHAEGAGKDASGHNTSTSCXIKHINMTYHITHKSILLSHDVSVPKPXQFNKNRHAASEDKNSGEKSRVTVNTKNAXKSVEVSLDTSTAFVTPHD

SEQ ID NO: 150542 - protein, 96 aa, Triticum aestivum
  Clone ID: PAT_TA_44960.pep
MSTAKPRPTATRGGLAPAPSPSPAQPAVVLRKPVFTTIGKLLPQTHGHNLTARVLSARTVLDKPAVRTRVAECLVGDPTVTVLFTARNGQIEMLKP

SEQ ID NO: 150543 - protein, 48 aa, Triticum aestivum
  Clone ID: PAT_TA_44961.pep
LYLRPEKHLGFSFHYNVLSDYSLSHRNQMISIHYNVCTLKYPSLYFRG

SEQ ID NO: 150544 - protein, 61 aa, Triticum aestivum
  unsure (1)..(61): unsure at all Xaa locations
  Clone ID: PAT_TA_44962.pep
VLKLIVLVINLASCLDHKRFFFSNHAVXSCKKGMPCTGQSSGVPPSGALGCYSDLNGFRHH

SEQ ID NO: 150545 - protein, 46 aa, Triticum aestivum
  unsure (1)..(46): unsure at all Xaa locations
  Clone ID: PAT_TA_44963.pep
RASHFMIQEHELKXIHPLKQHMLSQKLGRLLQILQAPRVRGRVGGR

SEQ ID NO: 150546 - protein, 84 aa, Triticum aestivum
  Clone ID: PAT_TA_44964.pep
CILQIKYDCGNGNRDKCLVETCVLLICVFQGKLLNEHGAMNECMSCTYFVLHTSFLVFVPSIMFVADLAMGCIHILFPIMLAGF

SEQ ID NO: 150547 - protein, 95 aa, Triticum aestivum
  unsure (1)..(95): unsure at all Xaa locations
  Clone ID: PAT_TA_44965.pep
MSTAKPRPTATRGGLAPAPSPSPAQPAVVLRKPVFTTIGKLLPHTHXHNLTVRVLFGRTVLDKPAVRTRVAEXLVGDPTATVLFTAPNGQIEMLK

SEQ ID NO: 150548 - protein, 87 aa, Triticum aestivum
  Clone ID: PAT_TA_44966.pep
EVKTTKTATSHNRNVTHSYKIKVAFSQPSSRSESVSSSYHQYRFQPKCGSPPKPNFIFSFWKKTPANCTHVVRLGWFYKRSDRGFPP

SEQ ID NO: 150549 - protein, 131 aa, Triticum aestivum
  Clone ID: PAT_TA_44967.pep
VRPAFRAAGSLPRIAYVISGSARDASALRRVLLALYHPRNLYVLHLDAEAPESDRRDLAAGLAAHPVIAVAGNVRVVERANLVTYRGPTMVGSTLHADAELLWGHSGAGGSDWDWFINLSDSDYPLVTQTI

SEQ ID NO: 150550 - protein, 37 aa, Triticum aestivum
  Clone ID: PAT_TA_44968.pep
LCGRVGFDVLSLYAIVLKDYDLLLSVALDDMAIDLYC

SEQ ID NO: 150551 - protein, 94 aa, Triticum aestivum
  Clone ID: PAT_TA_44969.pep
GGTTYASIPAAWETKAGGPSGPRLLARVAGPDPFTAARPCPDPDRMAPAGPYPYGIGPDGPDPRARRLTRRAAPATGRRACHGGNTAVVVLHSF

SEQ ID NO: 150552 - protein, 133 aa, Triticum aestivum
  unsure (1)..(133): unsure at all Xaa locations
  Clone ID: PAT_TA_44970.pep
SGEGRRNTECLSWGIDKERVLRXARTAVEVYFDFMRSFRVEFDEYFEDGIISEIEVGLGACGELRYPSYAANHGWKYPGIGEFQCYDRYLQKNLRRAAEARGHAMWAKSPDNAGHYNSEPNNTGFFCDXGDYD

SEQ ID NO: 150553 - protein, 71 aa, Triticum aestivum
  Clone ID: PAT_TA_44971.pep
VRGRVGSGLHPPSSVHRCWMCKLEQPHQQRWWASKERDGGHDFQSEVAFMNYQSTLAQSIYSISSALSRIV

SEQ ID NO: 150554 - protein, 132 aa, Triticum aestivum
  Clone ID: PAT_TA_44972.pep
SIMPPTEYKPVRAYRLDEGLQHDRRKFINVTIIHEQSSHRRKPPSSPHLLSKKIKVWLLNAPTELLPLSSMAQPDRLVPRNSATRTREVLPVVSTGAGEDGRSPEDGAARRRWRGHDKGMRRAHASADEWAP

SEQ ID NO: 150555 - protein, 134 aa, Triticum aestivum
  Clone ID: PAT_TA_44973.pep
RPPTRPAIMAKLLSDNGSQEFGDFKLGIHRMLSMYLYEKRILETAKSGIEDDSFYTLSLLKRGVWHGFAPQTFVWCVCNCSLSKEGAISAVRVFSCGHATHLHCESEQSKSSNKDFKEGCAGCLSMSEHKPETN

SEQ ID NO: 150556 - protein, 130 aa, Triticum aestivum
  Clone ID: PAT_TA_44974.pep
VRGALSGFAGYKVAKPGDASPCALVLPGVKEVIAPEGEGGYNPGQSMMGCSTQCQMLEMMVTNKGRVVRYTEEISMIITVGRWTVTRYMGTCRTRWKMRIQILTLVMPMIPTSLMEKGTQRMCRILHMES

SEQ ID NO: 150557 - protein, 107 aa, Triticum aestivum
  Clone ID: PAT_TA_44975.pep
QNRWSCYLSPLPPGILPTFLVRGLNRSRQASPRSPIQNGGELSPAEIHRLSRVFIVSTILAEWCFSMVIEGKPLKWRFWSSGIGTHTPRSWHHATELHLERLSGSSA

SEQ ID NO: 150558 - protein, 134 aa, Triticum aestivum
  unsure (1)..(134): unsure at all Xaa locations
  Clone ID: PAT_TA_44976.pep
RATTRATIPDGVIFQDMSQDYCGNHWSGQGYNIAYNITHASTGGYDGGYTRGHTHGPQCRYSGNYAHPRSHPRDPPMGTTYDNHFDDXIDHGSNRVVSHGGYHEQSHDVHYQLHARLHAHGHIMAQYYGNPMYS

SEQ ID NO: 150559 - protein, 109 aa, Triticum aestivum
  Clone ID: PAT_TA_44977.pep
VRGRVGGRVGGRVGYDLPKSIGDYVHRSGRTGRAGNAGSATGFFTESNHPIAKGLLELMTEAKQNGPPWLEDYAGKPFYGGSSFCGRGRRSNGDGGSSSGGREYRGGSD

SEQ ID NO: 150560 - protein, 45 aa, Triticum aestivum
  Clone ID: PAT_TA_44978.pep
ATQSIITFQFKFFFFSLYRLLTSSVKILGPYQLYSSQIHLLLFSS

SEQ ID NO: 150561 - protein, 82 aa, Triticum aestivum
  unsure (1)..(82): unsure at all Xaa locations
  Clone ID: PAT_TA_44979.pep
MQTEARVGGVALDGRGAVSASPRQEQQQRHIGTGAHLAAGGFAGVVSKTCTAPFARLTILFXGMHSDASALRKCSIWHRLYG

SEQ ID NO: 150562 - protein, 130 aa, Triticum aestivum
  Clone ID: PAT_TA_44980.pep
AARVRPRVRRPPPPPPPPPRIPLPGGRTAAGSSRRLPDSPAPRPPAARLVSPSRGLVSAGAGRLSIGVGKVRSTFRHRRNHKLDFSRHISFSPQREGFGYSGMDALHGQTSCGSLLQKLQLVWDEVGEND

SEQ ID NO: 150563 - protein, 54 aa, Triticum aestivum
  unsure (1)..(54): unsure at all Xaa locations
  Clone ID: PAT_TA_44981.pep
SSSSTYLAXTHSHIEDQSXDSRGLCDGQQQTSTLLTYIINSYLPQSLPNITHQL

SEQ ID NO: 150564 - protein, 62 aa, Triticum aestivum
  Clone ID: PAT_TA_44982.pep
MAWSFCGLNALYDTVGGGGGYIWVNDYRFRVLRRLGDACPAGSSGFLGKEVGSADGVFDGIR

SEQ ID NO: 150565 - protein, 78 aa, Triticum aestivum
  Clone ID: PAT_TA_44983.pep
VRPTAAAGTEHTTILHRRPRPGHPGRFTMSSTAGDEGHARGSPPYVQKQCHIRLQFHPGSLICIHVSFLISSQSDLFT

SEQ ID NO: 150566 - protein, 133 aa, Triticum aestivum
  unsure (1)..(133): unsure at all Xaa locations
  Clone ID: PAT_TA_44984.pep
VRAVTNGHLKTALVGMNPCALGETVVEVPNVSWTDIGGLDGVKRELQETVQYPVEHPEKFEKFGMSPSKGVLFYGPPGCGKTLLAKAIANECQANFISIKGPELLTMWFGESEANVREIFDKARQSAPXVLFF

SEQ ID NO: 150567 - protein, 132 aa, Triticum aestivum
  Clone ID: PAT_TA_44985.pep
RTRPPTRPPTRPATRRGTRLLNLCDFRDEAHSGSWDHSAFVRTYALYLDQRLEFLLHERKQGSNANGSASLNGPSPRDRWGSPDPYGRRSPSYTSPPGNGYGGYDDNRDSRNGANSDDKRPPTPVRDMKPER

SEQ ID NO: 150568 - protein, 109 aa, Triticum aestivum
  unsure (1)..(109): unsure at all Xaa locations
  Clone ID: PAT_TA_44986.pep
MAGRGKGGKGLCKGGAKRHRKVLRDNIQGITKPAIRRLARRGGVKRISGLIYEETRGVLKIFLENVIRDAVTYTEHARXRKTVTAMDVVYALKRQGRTLYGFXGWEPRR

SEQ ID NO: 150569 - protein, 126 aa, Triticum aestivum
  Clone ID: PAT_TA_44987.pep
PKCPHTRSLPLGATARPSTVTTRNCRISTDPVGNGAQAANMKGRWPDHGARLVAGVPWHRVTAREERRAERKGRTGGSRWEAGGREKRAVRHGGGPVAAACRWFGSHRPRWDSGARRRQGSGALLP

SEQ ID NO: 150570 - protein, 93 aa, Triticum aestivum
  Clone ID: PAT_TA_44988.pep
DHHRIETPEGSGRLNHHITIILILIRFNFHHTLPLRGRDRRRSRRRSHCGGLGVTTRRKEPTSSFSGFIFFEVGRGGDAGDARTAAGWICSRG

SEQ ID NO: 150571 - protein, 119 aa, Triticum aestivum
  Clone ID: PAT_TA_44989.pep
QNSLVEMASLCAHIRTRLEGIILTSPAVRVKPAHPIVGAVAPIFSLIAPKFQFKGANKRGIPVSRDPAALLAKYSDPLVYTGPIRVRTGHEILRISSYLLHNLKKVTVPFVVLHGTADR

SEQ ID NO: 150572 - protein, 36 aa, Triticum aestivum
  Clone ID: PAT_TA_44990.pep
PAPQQLFAPYQARVLVEVKAFKGRSYNRPRAPSTMD

SEQ ID NO: 150573 - protein, 43 aa, Triticum aestivum
  Clone ID: PAT_TA_44991.pep
GLVVAVKRKEWRTSSTAASSAASPCSFTTTFFLIYFSNYFFLF

SEQ ID NO: 150574 - protein, 139 aa, Triticum aestivum
  Clone ID: PAT_TA_44992.pep
SASDPTEAERLRFLASPAGKDEYAQWIVASQRSLLEVMSAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMI

SEQ ID NO: 150575 - protein, 57 aa, Triticum aestivum
  Clone ID: PAT_TA_44993.pep
PIPRLAGRVLLVWNNFLKGLHHRNLTHFLLVDWKEPIIKTSPRLWEADKNHPPTKGV

SEQ ID NO: 150576 - protein, 87 aa, Triticum aestivum
  Clone ID: PAT_TA_44994.pep
SADASFSDGAAFLRTAARRTCRCRRRHLHLSLSACSLLLLPVTLTATFAHITHIYGRSLPDTALDLPDEALSCVGLRHAQLPLVALE

SEQ ID NO: 150577 - protein, 113 aa, Triticum aestivum
  unsure (1)..(113): unsure at all Xaa locations
  Clone ID: PAT_TA_44995.pep
MAAAIAGDAETDLTLPVSDDLDDNGFPASXPTAATTSSFADDFYRSGIDWSSLQAPPSHRRRPAAGTIETVCGPLVQKNLFQAWGIEKPAAGMAQKVCGPQVQKNLFQAWGIE

SEQ ID NO: 150578 - protein, 140 aa, Triticum aestivum
  Clone ID: PAT_TA_44996.pep
RPRTRGFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAE

SEQ ID NO: 150579 - protein, 137 aa, Triticum aestivum
  Clone ID: PAT_TA_44997.pep
RPAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVY

SEQ ID NO: 150580 - protein, 71 aa, Triticum aestivum
  Clone ID: PAT_TA_44998.pep
MLGNGTHHTGDDNNVCDYGPAVVAVRYDGHIKLDALHAKEAQQKTAHAQEEAGSVLPDRDSHSDTQSENYT

SEQ ID NO: 150581 - protein, 139 aa, Triticum aestivum
  Clone ID: PAT_TA_44999.pep
VRPRVRPRVRTIVSTVPELDYIWQGDFELWRTGRSPELCDGFQAHLSCSASPKVLEVAKKFPSRVQLEELPRRNSWPTQFQQNGPTYENIGVFFFARDAQSYEHHYSKLVQNMLINDLALRGNIETAELIIFPSNILSK

SEQ ID NO: 150582 - protein, 89 aa, Triticum aestivum
  Clone ID: PAT_TA_45000.pep
LLRKGPSQLYVQQQPYVSFDAQPDLFFACSFRYQASHSLETVEAIVNTPWCQFARVTSRSHGHERLSFNITVRQRLRCRTACIAGWSAV

SEQ ID NO: 150583 - protein, 30 aa, Triticum aestivum
  Clone ID: PAT_TA_45001.pep
GIGREKGIDSLKNYLQVKAVVTALKNPAWL

SEQ ID NO: 150584 - protein, 43 aa, Triticum aestivum
  Clone ID: PAT_TA_45002.pep
MWECISFHIVQAGIQVGNACCELYCLEHGIHSDGQMPGVKTVG

SEQ ID NO: 150585 - protein, 106 aa, Triticum aestivum
  unsure (1)..(106): unsure at all Xaa locations
  Clone ID: PAT_TA_45003.pep
RDADESPPTWPKGLGTGGSNADMKVLLDNIHCMTKPPIRQMARRSVLKRIXVLIYEETLCVLKIFLENVIHDADTYTEHARRKTVTVXDVFYALKRQGRTLYGFCG

SEQ ID NO: 150586 - protein, 135 aa, Triticum aestivum
  Clone ID: PAT_TA_45004.pep
SGVLRFVNSCPDTDLRTGNDGEYVKVTGVLTYGNFALGLPLDPDPRCVYTSTRLYEYRGWKLKTAHPKHRRFTCGLPTAERHAVDFYISDFQSGLRALVRTGSGARVTPYVDESVVIDVNPENKDMSPEFLRWLR

SEQ ID NO: 150587 - protein, 68 aa, Triticum aestivum
  Clone ID: PAT_TA_45005.pep
GSCAELEEEVARLGTLLVKGSGTTFCADRKKPKLKVGTHPIWESFFEANLADRDTTNSVTSSLNGISE

SEQ ID NO: 150588 - protein, 122 aa, Triticum aestivum
  Clone ID: PAT_TA_45006.pep
RNHPSSLPSFSLRDGATRFRFRFRSCRTGRGGANPKTGLQRLLQRRWGPDRCCAATCPSPLAGRMRRRWVAPRRGGRPPEGQGDRRQSLSATCFPKLRGQHPTTAPPPSEPVGQAPRHGGGC

SEQ ID NO: 150589 - protein, 103 aa, Triticum aestivum; identical to SEQ ID NO: 107316
  Clone ID: PAT_TA_45007.pep

SEQ ID NO: 150590 - protein, 100 aa, Triticum aestivum
  Clone ID: PAT_TA_45008.pep
MHIDDLPRDDANYTALTPLWFLERAALAQPDRASVVHGPVRYTWAETYRRCRRLASALARRSVGHGSTVSTKAIYTGIAKQGVTHFCAAPVVMNNLINAP

SEQ ID NO: 150591 - protein, 67 aa, Triticum aestivum
  Clone ID: PAT_TA_45009.pep
SSHQAWADSWSTLGFHARAVTSPRSTPSLPYYELVMDSVLKEDRAVGRHRPCLRQVPQKILFRSNVV

SEQ ID NO: 150592 - protein, 143 aa, Triticum aestivum
  Clone ID: PAT_TA_45010.pep
SASVGYVNSVEKGNNASEQSPTEVRLNDANLGSGKIPKLRFTRKKKDRSLNHETSSFNPDNLIKVETMEHGALPHKVRNLNAQATRSMEIDTDHPSVGDNLMRNSGDIAMVLKKLIERGNASVSDIASEVGISSASLEAALVG

SEQ ID NO: 150593 - protein, 72 aa, Triticum aestivum
  Clone ID: PAT_TA_45011.pep
SGLAHHHAYVHADERPNVCHSGDPSRWRETGYSASLVTLHYCLLISSALLECTRVTHGQCPDIYHQWSLKGC

SEQ ID NO: 150594 - protein, 99 aa, Triticum aestivum
  Clone ID: PAT_TA_45012.pep
YWMTAKAGQSPIPQEHPFGHNHHLSQLALLIFRPHQIISHIVIICRHQHLELPLVRATNALALNGQHFLLSTLSLHNHAFNLCLHYSTHPLFLLRIIRT

SEQ ID NO: 150595 - protein, 78 aa, Triticum aestivum
  Clone ID: PAT_TA_45013.pep
LLSLISLVFSSPVVFTPGEEIVYTLNVTMFIHLPSNWLLVPNPWRFMFFQVVFLRGGLKHRRMVLNKLLQLFGVGKKK

SEQ ID NO: 150596 - protein, 120 aa, Triticum aestivum
  Clone ID: PAT_TA_45014.pep
TQGGVDQFTPPPCPSKLVAPSSLFHFPPKHGGRIPKSLGFALPASPHPPPPRRRPVKREIKNTPRDREFPHFAFALSICANLLFLLLHQRLVCCFRHHSALGRPRWPRRILPQLRRPSAP

SEQ ID NO: 150597 - protein, 138 aa, Triticum aestivum
  Clone ID: PAT_TA_45015.pep
VRPRVREATAISIGKSVLSGALNYAQSAVAEEVALQLGVHRDHSFISAELEMMQGFLMAAHDERDDNKVVKIWVKQVRDVSYAVEDCLLDFSVRLEKQSWWCLSRKVLARRYVAKQMKDLRAEVEEVSQRNQRFHLHQ

SEQ ID NO: 150598 - protein, 147 aa, Triticum aestivum
  Clone ID: PAT_TA_45016.pep
FVHEQVVNPTSVRCRDVHRRPDRSVEVHLLEQRSSSSGCRRRGVPPPAVILDSEHTRIIVALSRRYIGTAVAAAAAPCDIRGACRRLSLRTDSTRSATGNDGDVGSCCCVGADGGLEDHRHGRRLGRLAAHASAHASAHASAHASAD

SEQ ID NO: 150599 - protein, 88 aa, Triticum aestivum
  Clone ID: PAT_TA_45017.pep
TWTTLVPAAAIADKLAKMATLAIMTIPELSNLLITGPVAYLLEAGLPSRGDDASVLLVPRYYRARRDETARRSSCSLCAHLERLFESR

SEQ ID NO: 150600 - protein, 131 aa, Triticum aestivum
  Clone ID: PAT_TA_45018.pep
RPPTRPPTRPPTRPPTRPRTRGPRTGPPSTTVITAARRPMMNRARAPAPPSGRGTSTTTTTAGATSSVAPTPGRGTLTTTTTAGPTSSVAPPMNTRRRAAASLETVRPWLGAAMRRLPRRSFTRRRCASLR

SEQ ID NO: 150601 - protein, 51 aa, Triticum aestivum
  Clone ID: PAT_TA_45019.pep
MARHEVVMAATGVDFHVPDEILVVIPTDPYEQVDVPRKITYMAIACRVSRL

SEQ ID NO: 150602 - protein, 71 aa, Triticum aestivum
  Clone ID: PAT_TA_45020.pep
SVIAYTGLLAYAHGVTTPLEDWTVTQRFRTDEVHAIWREKEVPVLNNTDSDAAVEVFIDGTSGPTPIAVDS

SEQ ID NO: 150603 - protein, 53 aa, Triticum aestivum
  Clone ID: PAT_TA_45021.pep
MQSQIVCHRCRRVLAYPSGAPSVCCAMCRAITAVPPPAPAVEMAQLICGGRRT

SEQ ID NO: 150604 - protein, 150 aa, Triticum aestivum
  Clone ID: PAT_TA_45022.pep
VRRASWTTAQLDLLVSMMKEYADAARFRGQNGWTKEGWNSMTTRLNNQFPRANFIVCQLKFREQRLKREYFVVKSIVEKSGFGFDLNTKMPTTIDEKWDELSKEQQKWRYKAFPYYDDLHAIYDGKTAEGKGCKRTTDVVEEKSSPATDL

SEQ ID NO: 150605 - protein, 121 aa, Triticum aestivum
  Clone ID: PAT_TA_45023.pep
MAPKADKITAEKKPACEVAENAEKTLAGKKPTAEKRLAAFKCAKEGGDKNGPKKNKKSVETYKIYIFKVLKQVHPDIGISCKAMSIMNFFINDIFEKLAGEAAKLARYNKKPTITSREIQT

SEQ ID NO: 150606 - protein, 105 aa, Triticum aestivum
  unsure (1)..(105): unsure at all Xaa locations
  Clone ID: PAT_TA_45024.pep
KPPNAXNTLAGKNRAGEMRLPAIKCSKAGCDKNGPTTNKMSVETYKIYIFKVLKQVHPDIGISCKAMSIMNSFINNIFQKLAGXAAKLSRYNKKPTITSREIQTS

SEQ ID NO: 150607 - protein, 92 aa, Triticum aestivum
  Clone ID: PAT_TA_45025.pep
VRPRVLGRHQECRTSPPSFFDGAWSRSGSGHRLVQIGLMSSPSRGEQREAVGRSERLPAGRGGEPRRCGQREAVGRSERQSTGRATTMAGVS

SEQ ID NO: 150608 - protein, 120 aa, Triticum aestivum
  unsure (1)..(120): unsure at all Xaa locations
  Clone ID: PAT_TA_45026.pep
SSVRNHNPMIPGAMDIAILLLLLIFAPAGMPSSTSCPSSTFDHVVNSEAALEFPLFHTDHPCVQQYRGRPTSTESITETDDTDLPIDLIRNDSINNFAFVMPVQLGTPPVWNLXAVDTGS

SEQ ID NO: 150609 - protein, 115 aa, Triticum aestivum
  Clone ID: PAT_TA_45027.pep
MALTRIGLAGLAVMGHNLSLNIAEKGFPISVYNRTTSKVDETVQRAKLEGNLPLYGFHDPASFVNSIHKPRVVIMLVKAGAPVDQTIATLAAHLEHGDCIDDGGNEWYENTERRE

SEQ ID NO: 150610 - protein, 103 aa, Triticum aestivum
  Clone ID: PAT_TA_45028.pep
PVALALHEWGDAGAHSPRWRPTAQSTPAASPPQAQASPSPQFPPSSPSPPSSHRPTETLAPDRPRCPRRARPGRPACWARSRRGGRAGASRRRPRRRRGRTRA

SEQ ID NO: 150611 - protein, 62 aa, Triticum aestivum
  Clone ID: PAT_TA_45029.pep
FQSKHEYLYGKIDMQLKLVPGNSAGTVTAYYLSSQGPTHDEIDFYFLGNVTNYPYTLHTNFF

SEQ ID NO: 150612 - protein, 96 aa, Triticum aestivum
  Clone ID: PAT_TA_45030.pep
VRPRVRGRVGGSPAQIPSGSHQPGAGSEQDGGGVLWRRGRTRQRRGPRWLRWSATLLSDAVTRRFTRFLMAQSLRVRYLPTGLLQVEVLDLLILLT

SEQ ID NO: 150613 - protein, 147 aa, Triticum aestivum
  Clone ID: PAT_TA_45031.pep
CAHASADAWASQKRNRPKILQPRRSWAIASLPMVAAGQIRCLAGRLRPVEVQIQHPTVLLPASSLPQQISSRTNTLLHRPAPADRLKGTLLRRPVENLTHSSHVARTPASSSAIWERWRRNLPSSDAWYSDKRKHQDYRWIEKAFIK

SEQ ID NO: 150614 - protein, 150 aa, Triticum aestivum
  Clone ID: PAT_TA_45032.pep
SADAWDDNDKKLGSCTPGGRSERDDTDNYSNERRATPDYSAAPKRKEACQTKSPRQANEHDEDKNRISFSPDRNNWRDADNGHNERDDYFTSSKRKGERLSKSLRLSKEHDKDKKRRSYSRDDRSDCRDADNSFKERRATTDGGKRSCPR

SEQ ID NO: 150615 - protein, 130 aa, Triticum aestivum
  Clone ID: PAT_TA_45033.pep
LLVPLEQPLDVAVPMVNVHHPLLLDRIPLVRVELQPLGGCSSTTSRRRLFFRLDLVVRGSRFGLRLCLVVQLAEDSRLVGRAGGGGGLELPVGEARNWRRRRQRDHSSLHRSLPNHWLCSLKASGGGGRT

SEQ ID NO: 150616 - protein, 89 aa, Triticum aestivum
  unsure (1)..(89): unsure at all Xaa locations
  Clone ID: PAT_TA_45034.pep
PLSSLLSGVRSSVMERXEGXEKMEEVEVYYCCKKPEEGTKPAPVCFKKTAGEDTSILETTKDYLKQLSNTSANTHCDWIKNRGLPVGQY

SEQ ID NO: 150617 - protein, 131 aa, Triticum aestivum
  unsure (1)..(131): unsure at all Xaa locations
  Clone ID: PAT_TA_45035.pep
DACDQTKNFPSPTLSPPLREPXIREGGARRATNLGGSPSDPGGEFQSNPIPTPRAPRLGGRPDSPSCRFRPLAAGGGAAPVRGAGVSGRGSSVLPWFSRHRKNKSVDLPLVSDFSDCLARLGFSGGAKAGF

SEQ ID NO: 150618 - protein, 117 aa, Triticum aestivum
  unsure (1)..(117): unsure at all Xaa locations
  Clone ID: PAT_TA_45036.pep
MAPALGAGTPPFLTKTYAMVDDPETDDTISWNESGTAFVVWRRAEFERDLLPKNFKHSNFASFVRQLNTYGFRKIGLDRWEFANECFXKGEKRLLGAIQRRKGSGAAPAPAMMATPI

SEQ ID NO: 150619 - protein, 75 aa, Triticum aestivum
  Clone ID: PAT_TA_45037.pep
ARVRHRLSPRSSRPRKVLHLQLRLYRLQFLTFQSVRWQLRTLKSLPRQFTKKLRKSILVTSSHRWHCHHSSDGYA

SEQ ID NO: 150620 - protein, 140 aa, Triticum aestivum
  Clone ID: PAT_TA_45038.pep
VRGRVGGALLAVAHGAIPAHRARAAGRSFISGLQPEEVLVLDAVRSGAYRGRLSADELVEGKLETGAARRRGGVGAAKGVAALAPPGSVMDGLGAAVMTECEIRGKAASMVVTWPAGARPSELGVMRRVAAELGVDLKAA

SEQ ID NO: 150621 - protein, 101 aa, Triticum aestivum
  Clone ID: PAT_TA_45039.pep
MSAVITKFAVTSMVMWMAPVAIMYGFIYQIFPGVGQLSPSAQTMASGFLAVISVNLVIGFYIYMAMKETPHQEPQPDPTFLANAKASINQPTSSQVSDDSH

SEQ ID NO: 150622 - protein, 71 aa, Triticum aestivum
  Clone ID: PAT_TA_45040.pep
RPQSPTGEGQLGSRDEKDNKEGDRIAQLESELKDMQDRLLNVSMQYAEVEAQREELVMELKSATARKGRWF

SEQ ID NO: 150623 - protein, 52 aa, Triticum aestivum
  Clone ID: PAT_TA_45041.pep
FISKIYSLYFTQLYHAICISLISTLQTIFIFVIFICNERTNFLLNYYQLFSI

SEQ ID NO: 150624 - protein, 83 aa, Triticum aestivum
  unsure (1)..(83): unsure at all Xaa locations
  Clone ID: PAT_TA_45042.pep
MGPKAAEKKTVATANKATAAKKPKAEKRPPASKEAGGQGKTRGRKKGTXAKRGVETYKIYIFNVLKYAYPNVXISSKAMCIMN

SEQ ID NO: 150625 - protein, 114 aa, Triticum aestivum
  Clone ID: PAT_TA_45043.pep
MKRPPPRDDATAAGSSGGGFNKGKGRWDGKKRNEQRLGGSGGALSLAAFANAKSRSTGYNPALIKKQKEFYRNAKVISKYKKSKKHQNQSNYPPQFPTLEEGGADTTDVPKPHD

SEQ ID NO: 150626 - protein, 93 aa, Triticum aestivum
  Clone ID: PAT_TA_45044.pep
SRVAILLIGEPLSFRVGRKKTSPSLTISFSSLSFTRAWPKDCSAAMRTEEASSVSKGSSSSVSDSSRAVKVKVNIRKYHSLSNQTLLLDIGIV

SEQ ID NO: 150627 - protein, 89 aa, Triticum aestivum
  Clone ID: PAT_TA_45045.pep
MIRSGHFNGPKRPAAGAYLDSPTVSLTPSPLSGVCNTPFKPNKKRKTSEKGGRQIKVSSAAGGADTPVDDGRIWRKYCQKDILGAQHPK

SEQ ID NO: 150628 - protein, 97 aa, Triticum aestivum
  unsure (1)..(97): unsure at all Xaa locations
  Clone ID: PAT_TA_45046.pep
WDHRHRPPFRASPPPPLSPESPPPPLLPPSXESPSVLPPASASLPFPFSPPSSPPSNSASKNSSTXSRPPAPPPPPRPXASETSRSPTAPPRPRVRG

SEQ ID NO: 150629 - protein, 99 aa, Triticum aestivum
  Clone ID: PAT_TA_45047.pep
YRPRTGRVGRNLQNIVRKVKMGKCEYQFIEVMACPSGCLNGGGQIKPAKGQSPKDLIQQLEGVYMQDVSISNPFDNPIAKRLYDDWLVQPGSNNAKRYL

SEQ ID NO: 150630 - protein, 34 aa, Triticum aestivum
  unsure (1)..(34): unsure at all Xaa locations
  Clone ID: PAT_TA_45048.pep
PGDRIGPLIIGTVEXVMEAMHAPVYFESYHLHGY

SEQ ID NO: 150631 - protein, 82 aa, Triticum aestivum
  Clone ID: PAT_TA_45049.pep
MGLHTNTRGTSLVEISSRRERSPSVDQKNTRGRHGAAYYKILGVDKAASGDHLKKAYRKLAMKWHPAKNPTNKKGAGSKFKH

SEQ ID NO: 150632 - protein, 133 aa, Triticum aestivum
  unsure (1)..(133): unsure at all Xaa locations
  Clone ID: PAT_TA_45050.pep
MRSEFLDASKSDRAIKEENAPSLGIGEDANMVNTEIPDASSSSMPFELYMTQTTILISREKFLNIVCDALSSYKYVGPNQKADLLLACXGSRLGITTVVSTDSIRHMMRSFADEKQNPLLYASTYHAGEYLDP

SEQ ID NO: 150633 - protein, 88 aa, Triticum aestivum
  Clone ID: PAT_TA_45051.pep
RSPPPPSASASRSSPSGARSASTTPGSTPTASRCPTPSSTTTAATSSTASTASCARSRTPASTARTTITSPAAPPHPPRPPLPPCCAS

SEQ ID NO: 150634 - protein, 117 aa, Triticum aestivum
  Clone ID: PAT_TA_45052.pep
SAHASADAWAAGSLGNLTALHALSLRLNALRGALPADLAAMAALRSVFLNGNRLSGDFPPAFLALRSHLASVLQSLSQAEGSSAESITALARIDTVKQRMEAAYTTLQDAAGLAQLS

SEQ ID NO: 150635 - protein, 144 aa, Triticum aestivum
  unsure (1)..(144): unsure at all Xaa locations
  Clone ID: PAT_TA_45053.pep
RPPKCTAHIKAIVSFGDVTIELKREVEQLGVSCFSWEEFSTMGEDXKNFLKQKDDICTIMYTSGTTGEPKGVIITNRAIVAGVTTTEHLLQLTDKVVDEYDSYFSYLPLAHIFDQVIGNYCISKGASIGFWQGDIKYLMEDVQV

SEQ ID NO: 150636 - protein, 86 aa, Triticum aestivum
  Clone ID: PAT_TA_45054.pep
RPRTRGFTVYVTNNLFVHMYTHVLTFLSISEVGENVSPLTKGLSLPYLTFSHVPTTAWLHGSGGHHCVGNHNSLSLLSPSVLPEDF

SEQ ID NO: 150637 - protein, 146 aa, Triticum aestivum
  Clone ID: PAT_TA_45055.pep
SGRTYADACSETGDSFIVMDYGGRLNLRGYMQRRVRLRRAFSEDEVRRIMKQLVEGVKAVHGVDILHLDIKPENVLLDDGTEDRTQRPKKGAVEADVRGEVKDNRIVYKIGGFGMSTKGRGKKQPEVIILTPYSAPELLLHSREYD

SEQ ID NO: 150638 - protein, 140 aa, Triticum aestivum
  unsure (1)..(140): unsure at all Xaa locations
  Clone ID: PAT_TA_45056.pep
MLDYHRLQPRRRLLPDRLKKRIFVKTLTVPTITLEVASSDTIXDNGEVMIHDMEGIPPDQQRLIFAGKQLEDGRTLADYNIQKESTLHLVLRLRGGMQIFVKTLTGKTITLEVESSDTIDNVKAKIHDKEGIPPDQQRLI

SEQ ID NO: 150639 - protein, 47 aa, Triticum aestivum
  unsure (1)..(47): unsure at all Xaa locations
  Clone ID: PAT_TA_45057.pep
VNELVVCVIKVLYGSNVYCEGFRYAPAVYKVTEIIELKVVNXHIXER

SEQ ID NO: 150640 - protein, 52 aa, Triticum aestivum
  Clone ID: PAT_TA_45058.pep
RPLRPFRRVIFNALYNRKLASMKAGYTQKTASPFADMLAFRRASRLGAASLL

SEQ ID NO: 150641 - protein, 145 aa, Triticum aestivum
  Clone ID: PAT_TA_45059.pep
SGDRDLLCPICMALIKDAFLTGCGHSFCYMCIVTHLNHKSDCPCCANYLTKAQLYPNFLLDKVVKKMSARQVAKTASPIDQFRHVVQQGNDMSVKELDSLMTLIAEKKRQMEQQESETNMQILLVFLHCLRKQKLEELNEIQTDL

SEQ ID NO: 150642 - protein, 99 aa, Triticum aestivum
  Clone ID: PAT_TA_45060.pep
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDL

SEQ ID NO: 150643 - protein, 82 aa, Triticum aestivum
  Clone ID: PAT_TA_45061.pep
RPEQCLYSSYISCSSVVHTKLLRKGKNMMQSTSMQLLDRNPTNFHMRLPWWMATKTLIANVASSLTWGYCSPMFWRFYTSSP

SEQ ID NO: 150644 - protein, 139 aa, Triticum aestivum
  unsure (1)..(139): unsure at all Xaa locations
  Clone ID: PAT_TA_45062.pep
SEGIVVRFVIGRSGAAEGGGGAADRALDAEEAENKDFLRLDHVEGYHELSSKTRIYFATAVATWDADFYVKVDDDVHLNLGMLATRLAKYRARPRVYVGCMKSGPVLSQRGVKYHEPEYWKFGDVGNKYXRHATGQIYA

SEQ ID NO: 150645 - protein, 147 aa, Triticum aestivum
  Clone ID: PAT_TA_45063.pep
YAHAYAHASALTVVDYEDKQHRQALACVYSSETGVWGDVVLTPLPSKASVRTLVITDKTAVLVRNSLYWLLLGNLDGLLEFDLERQVLAVIRMPMDLVAKGSYDICVMQGEDGGLGLFCVLQLDYIAQLWERKSDCHGVASWVLGRT

SEQ ID NO: 150646 - protein, 58 aa, Triticum aestivum
  Clone ID: PAT_TA_45064.pep
RPRTRGRTRGAAKRTSARFTLNLIENDGRLSQVTNSYMKHTFSPASDNWGFIKFIEKS

SEQ ID NO: 150647 - protein, 110 aa, Triticum aestivum
  Clone ID: PAT_TA_45065.pep
VRKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSFYA

SEQ ID NO: 150648 - protein, 110 aa, Triticum aestivum
  Clone ID: PAT_TA_45066.pep
ISAPKNFCASLTLQLAAANTCLLPHASQFRDPRSHASEQYKILAIPQALPEAPDFCGLAILGFHPRLEPLRSSLFSTALAVQVQQPLPCGGGTTVSCAWRWRRGGARRPA

SEQ ID NO: 150649 - protein, 88 aa, Triticum aestivum
  unsure (1)..(88): unsure at all Xaa locations
  Clone ID: PAT_TA_45067.pep
PGIQTDGQMRGDRTNIRGDHAFNTLLRETDAGKYVPRAVLVDLEPTVIDEERTDDYXQVFDPEQIISVLEDAANKLXRDDDTIGKDIV

SEQ ID NO: 150650 - protein, 55 aa, Triticum aestivum
  Clone ID: PAT_TA_45068.pep
SADAWADAWADAWADAWADAWATVERLPRKSVGVGGSFRFRLPSSAARRRVLHTP

SEQ ID NO: 150651 - protein, 64 aa, Triticum aestivum
  Clone ID: PAT_TA_45069.pep
VRPTPTLPDQAIRTGVHKLSGPPCLIYHVICTEVTVVCFNNSPTTPSLTKFLGPGYISYQVYEI

SEQ ID NO: 150652 - protein, 83 aa, Triticum aestivum
  Clone ID: PAT_TA_45070.pep
SADAWADAWVMRHRELYYRQSKDQRNLQPVYLVEQNNVGFSCRCRCPLGCVRKAQRLPWQEVVHCVDSLCRFVKLVLVYGPQT

SEQ ID NO: 150653 - protein, 86 aa, Triticum aestivum
  Clone ID: PAT_TA_45071.pep
QPPVPPKSPTMSSCRKKKTDDDATFLKDVKEHIDEFIHASMDEHKTCFKKTIQKMFGMSKAVAERSAAAKEAEVESALPLETSVSR

SEQ ID NO: 150654 - protein, 128 aa, Triticum aestivum
  Clone ID: PAT_TA_45072.pep
LGMEEGGKSSTMTLPRGERRPWATRRRHRQSRADSHPEHPKPLQPTQPTIEEPHARTRAGPSTSNMETVPSHARATTSPPADTDEPDPKTDRATSCCSINAQATKRPRKGLQKAGRGAATPPRRAGRT

SEQ ID NO: 150655 - protein, 96 aa, Triticum aestivum
  unsure (1)..(96): unsure at all Xaa locations
  Clone ID: PAT_TA_45073.pep
ETPPAVSADFTRLGIPAIGKLMFAQYLELGNDGCHNPLSYNLSDGRNPSIDYGFKGAEIAXASYCSELQXVSIPVTNHVQIEEQHNQDVNXLGLIS

SEQ ID NO: 150656 - protein, 115 aa, Triticum aestivum
  Clone ID: PAT_TA_45074.pep
ALGLRRHCLRTLKTLPLPDNTMDWEEPATLQVEAEAAAAFDLIARQAVAGEEEVEADTSVNRSIENNQRLTPIAKVVITLVGVEKAFQPASAIKIPESINGVPIIVMEARSRGLC

SEQ ID NO: 150657 - protein, 85 aa, Triticum aestivum
  Clone ID: PAT_TA_45075.pep
SSVCMAMAADDEMLRRYLRWGLPIESGFRYKLTPRPDEPIYVTGVYLLDSASAVGQGAVDARVHTDDTRDLGSALLTAENPRVEL

SEQ ID NO: 150658 - protein, 147 aa, Triticum aestivum
  Clone ID: PAT_TA_45076.pep
SGKGEGEGEDEGEGDGSEESEYEEEGFDEDEEVEDVDLDPAEYEDDEAYARALQDAEEREVAARLMALAGISDWRAVEHVEDQINDAQDSWQEVDPDEYSYEELVALGEVVGTESRGLSADTLACLPSGTYKTKDMQDGNTEQCVIC

SEQ ID NO: 150659 - protein, 148 aa, Triticum aestivum
  Clone ID: PAT_TA_45077.pep
VRFVLRIPCGLIQGSSITIIGTPGGLLGNFKIDLTGAAVPGEPDPPIVLHYNVRLLGDKLTEDPVIVQNTWTIADDWGSEDRCPSSDSDAKDSAKVDDLEKCSSMVGKAHKQILASKSHSNFSSMQPTRKTTAEPKKHYPFKQGYLAI

SEQ ID NO: 150660 - protein, 91 aa, Triticum aestivum
  unsure (1)..(91): unsure at all Xaa locations
  Clone ID: PAT_TA_45078.pep
VRPRVRQDFKTDLRFQSSAVSALQEAVEAYLVNLFXDTNLCAIHAKRVTIMPKDIQLARRIMYGARLCPLLAIGRCLRSVPDAFHICDDTV

SEQ ID NO: 150661 - protein, 153 aa, Triticum aestivum
  Clone ID: PAT_TA_45079.pep
VRGRVGEALGIPADGGHGPLQGSSHGALMPQKLGHGGGNPVDMDAAGFQQLQMVSFHAGNNEGLLEQFSWDDPFQTQPGCGGFQCVGGNYSAGGDAMLSPGVANADYNYSAGGDEMLTLDLANADYNYSAGGDEMLTLGLANADYNYSGGSDE

SEQ ID NO: 150662 - protein, 115 aa, Triticum aestivum
  Clone ID: PAT_TA_45080.pep
LQRRQQRRRRPPPCSLRLATAAPLHKLDLLSLGPGYSVAHRVSRWIVSILFVDFEVLSCTFRTTFPSNEHLIIKFAIVNSTTILRLIAVLCRLVVAPLVVLFFLGHKYWTTRITI

SEQ ID NO: 150663 - protein, 101 aa, Triticum aestivum
  unsure (1)..(101): unsure at all Xaa locations
  Clone ID: PAT_TA_45081.pep
RSPVAAAGRPLRWRRTSCRRLPQTWWCRHRRRPXPPXAAPAASRRRPTARRPSARPSPDPPPPPPRSSPAAWPGLWVWSGRMDRDGGRMDGFGGGGRMGGR

SEQ ID NO: 150664 - protein, 149 aa, Triticum aestivum
  Clone ID: PAT_TA_45082.pep
RPPTRSAAVYVCRDLWHACAGPVVALTRRGNAVDYLPQAHLAGAGGGGDVPADLPSHVACRVVDVELCTDPATDEVYARLAMEAEGEVFEKNMRGGRYEGEDDMEDGDGERKYRMLHMFCKTLTGSDTSTHGGFSVARRAVEDWYYPLD

SEQ ID NO: 150665 - protein, 69 aa, Triticum aestivum
  Clone ID: PAT_TA_45083.pep
MGGRIPASRFPIRFLFYPNPMEAAIMSDPGTSNKRDLIGMSQGEFARTENKTPSGVGDLGIRSRSRWWG

SEQ ID NO: 150666 - protein, 113 aa, Triticum aestivum
  Clone ID: PAT_TA_45084.pep
VRPRVRPRVRGRVGAGICGTLSPEGMGSCITSSADHGQKIGATRMEYLIATPEADKIFDEEDDLLDQECEGDSVDLNDNDKLLFIEALDNHGKVLERIFLYGKSKSYEQRSVF

SEQ ID NO: 150667 - protein, 78 aa, Triticum aestivum
  Clone ID: PAT_TA_45085.pep
CKHVYAAEASALDLLPPLQPRPAAVLLARATIPLSVGRTRAPPRRVKAPELARHMSQAAMDGRVLASYGSRSVRVDGR

SEQ ID NO: 150668 - protein, 137 aa, Triticum aestivum
  Clone ID: PAT_TA_45086.pep
VRGRVGGRVGAAISLRNLILRFTGPEMWILPNLKNQFSLMPNLKKLLVADVPSSWDVSWPRILIQAAPLLESLHVHVSQSQSQSQSQCQHEEEPGRQNVSSYLQTQQPSSSSSWQRHRHLKELVVVGFQSTSRIHHQ

SEQ ID NO: 150669 - protein, 132 aa, Triticum aestivum
  unsure (1)..(132): unsure at all Xaa locations
  Clone ID: PAT_TA_45087.pep
PSFLPSSLPHLHSSFCPGTADSMDLPGKPCSSLPHRHRRPLPRRPPPNRPPQDLPRTDPAPASCSRRRRXASSSRRRRSASSSRRPQPPASFRIEQPPPPAAGVVPHRAAPAPSRSLCMFFFLQRFLRASGR

SEQ ID NO: 150670 - protein, 107 aa, Triticum aestivum
  unsure (1)..(107): unsure at all Xaa locations
  Clone ID: PAT_TA_45088.pep
SGHIDRNSRVAASLSGREEGQRHLIGGANTLRSEEEGDIVSLKNYMNAQYFGEIGVGTPSQKITVIFYTRRCNLWGPSDKCXSRLGXYLHARYKAGAFSTYKKNGKA

SEQ ID NO: 150671 - protein, 129 aa, Triticum aestivum
  Clone ID: PAT_TA_45089.pep
RPRTRGKKKKLKKKKKKKKKKKKKKKPGLGGAGPFFLGNCGKANTDAMAELLNPGGLLLLPGGLLLLIRLFFSDRGAAEFANVFAFGGLPDAGHRVGGSPIGGALMLILILPLLYYRSGLFGGGGYDDK

SEQ ID NO: 150672 - protein, 115 aa, Triticum aestivum
  unsure (1)..(115): unsure at all Xaa locations
  Clone ID: PAT_TA_45090.pep
MSRRSTIWRHKYALVYGADINDPHGQSAPSGKDQPDXKPLSEVEICLGMDAIGGPGNELSEPIDIADAEDHIFGLEVLXDWSARDIEAWENIHFGPLLVKSCRTSGXPWIVTLDA

SEQ ID NO: 150673 - protein, 113 aa, Triticum aestivum
  Clone ID: PAT_TA_45091.pep
MDASAIVATGKGKKGAAGRKAGGPRKKSVSRSVKAGLQFPVRRIGRFLKKGRYAQRVGSGAPGYLAVDLEYLAAYLLELAGNAGKDNKKSRIIPRHLLLAIKNDEELGKLLGG

SEQ ID NO: 150674 - protein, 67 aa, Triticum aestivum
  Clone ID: PAT_TA_45092.pep
GALVGVPDLEQSVTIAGRVAQQAVESALARELRAELRAEQEPLLQHKVQDMVPSLVPTHVCADAWAD

SEQ ID NO: 150675 - protein, 78 aa, Triticum aestivum
  Clone ID: PAT_TA_45093.pep
SARIMDHVVTLEEIQKYFVDFMLGDSLGAISTAHLVYADRYPMKARSQECLQIAGMHPIAVDGFMTGTKTLMPGSLRL

SEQ ID NO: 150676 - protein, 96 aa, Triticum aestivum
  Clone ID: PAT_TA_45094.pep
VRSLVRRLGPGWPRCNSRSRHHRRASPRSTRHIKRPRCISQARDHSRLVRLRSSPTTLTFRLRPTRSETGACWRPSNSAVRGRLSQASSTCSRARG

SEQ ID NO: 150677 - protein, 129 aa, Triticum aestivum
  Clone ID: PAT_TA_45095.pep
VRQSQGFSSESPSIPLLLLPTDGCWSVRSLDRIDLHRVWRPLATTGAYGSFEKSVEYFMVMIRLQRIFRSLSWCFVRASLSPVPSYAWFGRKVPNSIMIASSFIFFDEDSLRELWEHLQDVGLVLRQIQ

SEQ ID NO: 150678 - protein, 94 aa, Triticum aestivum
  Clone ID: PAT_TA_45096.pep
SAVIHFIYYSRLIILLFWLSTGGFSPSYSSLFLTSSTLGSGSTLWTLSSNIKEFVICIQAYSILPIIAKSDYYNYYHHDDDDDDDDYYDHNDYY

SEQ ID NO: 150679 - protein, 75 aa, Triticum aestivum
  unsure (1)..(75): unsure at all Xaa locations
  Clone ID: PAT_TA_45097.pep
KGSMELPVEPEAELEHSLLTQIENFDMNLSEVDAQVKSLKTLCKWKAKTGKEAEXLIMKWCQKLINKRIDSYKGT

SEQ ID NO: 150680 - protein, 50 aa, Triticum aestivum
  Clone ID: PAT_TA_45098.pep
MEAETAAKRARENEGAAAADGAGEQAVISAVIPGWFYEISPMWPGEAHSL

SEQ ID NO: 150681 - protein, 105 aa, Triticum aestivum
  Clone ID: PAT_TA_45099.pep
RLGRSFTGVVFAVFLAESRLIESYYDCKDAQEKLVDPIVKGAGNVLRSCARAAVPARLVVFTCYCSSVRYRHQHVHGGARAALNESYCSDADYCRTYGLRYAYAK

SEQ ID NO: 150682 - protein, 64 aa, Triticum aestivum
  Clone ID: PAT_TA_45100.pep
SNSRLGCNFRLSSSSSSSSKDLMFKAVYMLILQIREKDDDIFCRTLLSVVKLLYRSYVPWKPLR

SEQ ID NO: 150683 - protein, 67 aa, Triticum aestivum
  Clone ID: PAT_TA_45101.pep
GGAGYIRWVGGAPVWGKVFFFRGARPGGPPWWGGGPIPWGPPGLVSICVRTGGGGGGFLALMGASIP

SEQ ID NO: 150684 - protein, 130 aa, Triticum aestivum
  Clone ID: PAT_TA_45102.pep
MQQFAIPALKSLEAVTTKECQEEFSQESLETLGDSFLKYVATQHLYGKYKLQHEGTLTKMKKNLISNAALCQLACSNNLVGYIQGEEFNPKGWIIPGLGYDMCGNSKISFLSSNDMHTLRKMSVRSKRIA

SEQ ID NO: 150685 - protein, 116 aa, Triticum aestivum
  Clone ID: PAT_TA_45103.pep
MSPQTETKAGVGFQAGVKDYKLTYYTPEYETKDTDILAAFRVSPHPGVPPEEAGAAVAAESSTGTWTTVWTDGLTSLDRYKGRCYHIEPVAGEDNQWICYVAYPLDLFEEGSVTNM

SEQ ID NO: 150686 - protein, 81 aa, Triticum aestivum
  Clone ID: PAT_TA_45104.pep
VARFKRQKAAETKLQEIKERKERRGRSLRATALSAPIEAGEEDDLEADGEEEREAWLATISLALCKAFDLVDMLKKEEEML

SEQ ID NO: 150687 - protein, 127 aa, Triticum aestivum
  unsure (1)..(127): unsure at all Xaa locations
  Clone ID: PAT_TA_45105.pep
VREVYRNVKRVDRMKNELHERDEKELERTGQPLCIYEPFYGEGTWPFLHQSSLYRGIGLXYYRDILGEFGAFFALANRIDRIHKNSWIGFQSWRVTARKANLSKNAESAMLEAIQTQKHGXDAFYFW

SEQ ID NO: 150688 - protein, 70 aa, Triticum aestivum
  Clone ID: PAT_TA_45106.pep
VRPRVRPRVRRAVNGICTGCGMMRSPINIDDGHSIFLDPCCCHGLGHCHVGILFTMCWITLSSFCGESSE

SEQ ID NO: 150689 - protein, 61 aa, Triticum aestivum
  Clone ID: PAT_TA_45107.pep
NFTFKTFQYSFLTTRHPPTRPFLKPYIPPPQLTTPTTSSSYTTTTLTYTLTTNPSSSPFPP

SEQ ID NO: 150690 - protein, 142 aa, Triticum aestivum
  unsure (1)..(142): unsure at all Xaa locations
  Clone ID: PAT_TA_45108.pep
VRGRVGSTFVISYVLPRHPEIHYGGASSTTANGHQRQLDHRLRQPSSAALPRARAAVGPLRRAPTDGWCNNCLALTRGVLGSSPLCDVCYNRLFVAGDVPPQHAQTGGHVLPSPVPSYAYAGVPRXPVPAGEQQYRAAAIGP

SEQ ID NO: 150691 - protein, 84 aa, Triticum aestivum
  Clone ID: PAT_TA_45109.pep
MAHGGQPRRAPGGRRPKPSASAPAPSADRKRNRAAFFKTLPLKNQIRFTERLLRKDLFYDMRVGHDKRLEELKIQLEIQTHYAM

SEQ ID NO: 150692 - protein, 142 aa, Triticum aestivum
  Clone ID: PAT_TA_45110.pep
SAHASAHASADAWAQIGGVVSVRVCRDVTSRKSLGYAYVNYNTPADAARALEMLNFTPINGRPIRIMYSNRDPSLRKSGTANIFIKNLDKSIDNKALYDTFCVFGNILSCKVATDPAGESKGYGFVQYERDEAAHAAIEKLN

SEQ ID NO: 150693 - protein, 128 aa, Triticum aestivum
  Clone ID: PAT_TA_45111.pep
RWRFPDATPHRPAFPNLHELGLFHSIMEDREVDALLAHCPKLKIFSFAMAYGPPPPICSRADSHCFLLGSAGGSPFRFCVRSRSLRIVVEWICNFDEIIAEDVPCLERLLFECSYDQRPIKILHVPRL

SEQ ID NO: 150694 - protein, 94 aa, Triticum aestivum
  Clone ID: PAT_TA_45112.pep
MGGALTMAAYCGKYKDELIKNAAYIGTAGKGILAGDQSTGTIGKRLASIYVENGEDNRRALRELLFCTRGALQNLNGVILYEETLDPNTKGGKP

SEQ ID NO: 150695 - protein, 67 aa, Triticum aestivum
  Clone ID: PAT_TA_45113.pep
RTLDHENVKPFLASPQDKDLFFGGRLAGYYSLTLLIACDCGYHSAEFCGANLIHPFVENLNMSYAFY

SEQ ID NO: 150696 - protein, 51 aa, Triticum aestivum
  Clone ID: PAT_TA_45114.pep
IHIFTNTVEMSITVNNQKTRIIALMNIYIKYMRCSQLYVLKHTLINQNYPT

SEQ ID NO: 150697 - protein, 76 aa, Triticum aestivum
  Clone ID: PAT_TA_45115.pep
WYHLLTCLAPPKPRGTDETQYNMVHVTQTHAIDYFKNKTTDKTRLMKADGTADSLSHDDDMDYKQIIHNAIEAGRI

SEQ ID NO: 150698 - protein, 111 aa, Triticum aestivum
  unsure (1)..(111): unsure at all Xaa locations
  Clone ID: PAT_TA_45116.pep
GDAYAHASVDAWVKFYVRQVFIMDRXDDLIPEWLIFVKGIVDSDDLPLNIFRETLQQNKILKVITNNSWKKCIELFFEIAENQRDYNKALLRFYPRTLSVGVHQDSHNKTN

SEQ ID NO: 150699 - protein, 85 aa, Triticum aestivum
  Clone ID: PAT_TA_45117.pep
IGVSVRRAGKHGGRCWGSTYTKRIVVVSFGNWGPGRWAARKTVRAWQSLQPRPAEGPQGPWCGVRRVSGRARIYERPRVRGRVRP

SEQ ID NO: 150700 - protein, 81 aa, Triticum aestivum
  Clone ID: PAT_TA_45118.pep
EHLDAHQHRAIELQFCFPHVVSVHKIDTLLKRCRWLSPGTDHPFILIFLRGQITRLYQPWQAIVMYVLVRGVQEHLEAIPL

SEQ ID NO: 150701 - protein, 107 aa, Triticum aestivum
  Clone ID: PAT_TA_45119.pep
MGQQFMSFSRAHQPAFQCLTRLRLKSLAFGDSDVAALIAASDKLEHLNMNSCGLVDQRHVLKIDTPCSVIQELEFKRFHCKRIHLISVPRLKTELCHSWRSNNPPMR

SEQ ID NO: 150702 - protein, 111 aa, Triticum aestivum
  Clone ID: PAT_TA_45120.pep
CESLDSQPANIRRSRAGVRCHDLLGTTVRGADSVRCVASETLHAQGLARGAGLHGLKRGSGVHSLPRRARAYNCRRLKRSYPSLGETVKATASRGPYLYRGMLTKMLLMHL

SEQ ID NO: 150703 - protein, 131 aa, Triticum aestivum
  Clone ID: PAT_TA_45121.pep
VRGTLTRKLMYHLRDLYVAYDGTGRSSYGQQIMQFTYDTAEDMCSDRDVEGELGAPVGSWAACSISEAAYGALDHPVNSLEESPLMNLQDVLKCQKGGTSMDHVGLLFLSKNLKKYRYGLEYASLEVKDHL

SEQ ID NO: 150704 - protein, 47 aa, Triticum aestivum
  unsure (1)..(47): unsure at all Xaa locations
  Clone ID: PAT_TA_45122.pep
CTFHHPVVLKFFRQFQLAFSFSXGVRARNICPSVPSYERRFNTSIYM

SEQ ID NO: 150705 - protein, 99 aa, Triticum aestivum
  Clone ID: PAT_TA_45123.pep
CSPRSRPSWQSSGCLLFGVCVCVCVEFHHDRVVCVLERDKEIWRLGCERQLRRKKKRCCKERWRQQLASEPCRSEATTAVRPTPCEVEDGGARWRLSVA

SEQ ID NO: 150706 - protein, 51 aa, Triticum aestivum
  Clone ID: PAT_TA_45124.pep
SGWLLLPFRFGFWFGSGSVRERGRVASLVLGLVERKGDPWRRLSTAGLWAV

SEQ ID NO: 150707 - protein, 141 aa, Triticum aestivum
  Clone ID: PAT_TA_45125.pep
VRAAASLSLSLPLSPVRDKRLGFRPPTPAPPSPSLPPASRIPSPPPFLAPPPTASSAAGCFHRAPAPADRRRRARPPRLAAAQLVPGLQLASAQVCTLRVTSICVESSAGHFDRVCAITLNRLGRSVLVRSCVSLLVYEPT

SEQ ID NO: 150708 - protein, 120 aa, Triticum aestivum
  Clone ID: PAT_TA_45126.pep
AGEPPYHRAHGRSPESRALLRPDIRARRAEIWFGPDEFSWLPAHRCGADSYPMLLRPGHAVAAQIDGHDSQGRAGTPCILSWTAAMLGIEPYDVEVTHGVELLGMDSKNRHIQQIELPLS

SEQ ID NO: 150709 - protein, 77 aa, Triticum aestivum
  Clone ID: PAT_TA_45127.pep
MRLPGGARLALLLDRRSLSTGVACCARSSYIHAYRAHRARWGDAARAAPCWRSSLSSSSRFLQLTRPEAGRDYHYAL

SEQ ID NO: 150710 - protein, 143 aa, Triticum aestivum
  unsure (1)..(143): unsure at all Xaa locations
  Clone ID: PAT_TA_45128.pep
VRENGGPIIMVQIENEFGSFGDDKNYLHYLVQLARRYLGNDIVXVDFSTGDDPWPIFRLQKKYNLPGKSAPLSAEFYTGWLTHWGESIATTDASSTAKALKSILCRNGSAVLYMAHGGTNFGFYNGANTGQTEYEYKADLTSY

SEQ ID NO: 150711 - protein, 131 aa, Triticum aestivum
  Clone ID: PAT_TA_45129.pep
MAQTMASMTGLSQGVRLPCPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRANESAHDILNLMPLID

SEQ ID NO: 150712 - protein, 145 aa, Triticum aestivum
  Clone ID: PAT_TA_45130.pep
SEAAQTGLVGINIYSFWSYPFTDSTADLEATQRCKDFMFGWILEPLVFGDYPQMMKKNVGSRLPSFTKVQSELMKGSFDFIGINHYYSLYVSDRQTEPGIRDYNRDMSIYYRAYRTEPSAGQGAPTNVASDPKGLQLVLEYLKEA

SEQ ID NO: 150713 - protein, 83 aa, Triticum aestivum
  unsure (1)..(83): unsure at all Xaa locations
  Clone ID: PAT_TA_45131.pep
MQIFAMTSTCMTITLDVESSDTFDNINVIIQDTEGFTSDQKGLIFXLASKLDDGMTLADYNIQMEYTALPLYYSLLWRQCIIF

SEQ ID NO: 150714 - protein, 91 aa, Triticum aestivum
  Clone ID: PAT_TA_45132.pep
HNRTSAASIMTEPRRHRHGRTAPPPLSYGGASRTETPSRASCARSGRAPSRRCAPSRGPPHRRNPPTPPAPDAPSREGGPSGRARHARPGR

SEQ ID NO: 150715 - protein, 104 aa, Triticum aestivum
  Clone ID: PAT_TA_45133.pep
SQAMLERRPQLWKQKHRGKAFMALVFFPVVVLLSGSSRTMSGLSTSALIPPVEGNLPVRHRPIIVQRSDKLLQRIIPMDKEELAMGRNGTAQCSKSRVQTVADV

SEQ ID NO: 150716 - protein, 34 aa, Triticum aestivum
  Clone ID: PAT_TA_45134.pep
FYHGRFLLLALLRIVGSLDIFSVRHHRHPNEWSD

SEQ ID NO: 150717 - protein, 125 aa, Triticum aestivum
  Clone ID: PAT_TA_45135.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRK

SEQ ID NO: 150718 - protein, 145 aa, Triticum aestivum
  Clone ID: PAT_TA_45136.pep
RPAQHLSEPRRLRRSARPRSPVWLLSQARRGVVALRHGEGEQPTVLKAVRGGCKSRRRLQIEGQCTAALSPSHPLSLERKLRTYWRWPVRGVVLSQRRGEEGEGDGESTEKRHREQIRPSAARKATPSSTSVPSPRFRHSILMQL

SEQ ID NO: 150719 - protein, 73 aa, Triticum aestivum
  Clone ID: PAT_TA_45137.pep
MGGFVEVQGCGTSCQDSMQSVTIRAKMPSWSMGSCLRVKKAVKALSKIEIDDEDELIDEDSLLTEEVFEEPQL

SEQ ID NO: 150720 - protein, 93 aa, Triticum aestivum
  Clone ID: PAT_TA_45138.pep
ISGQTLKILLAENAAIYYIIICSSSSSSSDIVPVAIISSRGVKQPMANMCCLESILMLLKSFTAQHEKSHCQRAHLSVQNPLDLMIETNRVPP

SEQ ID NO: 150721 - protein, 69 aa, Triticum aestivum
  Clone ID: PAT_TA_45139.pep
NSIQRRESRHMPLAKIIVCAWGVLIRCDPTLWIEFQHYIIKLGRFGSLSCPGVYHPLTPRGDRYGRWGA

SEQ ID NO: 150722 - protein, 100 aa, Triticum aestivum
  unsure (1)..(100): unsure at all Xaa locations
  Clone ID: PAT_TA_45140.pep
AXSYPLTLCHPSRPSYTPPDLPPWRTLPLQVSPSLGCRSRPPAAAGHGFNLVAAHRDRGLPRVWSPSVLLQARFQPSIDWIELMGLIPFHNISFTNVADQ

SEQ ID NO: 150723 - protein, 40 aa, Triticum aestivum
  unsure (1)..(40): unsure at all Xaa locations
  Clone ID: PAT_TA_45141.pep
FRWGIYLSALPPAIGSLRTCSRHPSLGGLGCVASPREXRI

SEQ ID NO: 150724 - protein, 99 aa, Triticum aestivum
  unsure (1)..(99): unsure at all Xaa locations
  Clone ID: PAT_TA_45142.pep
RAVWGFYITLTPSEILPEELEAELKXGCVIITGAEFIDLXLIIIRELCDQVXLAFSEVRAQLYXDYLLSSMDSSSLNLTGLVGELVGARLIFYGSSLIN

SEQ ID NO: 150725 - protein, 94 aa, Triticum aestivum
  Clone ID: PAT_TA_45143.pep
MNAFRFLGDMTHLFSVIVLLLKIYANKSCSGVSRKTQELYLAVFVARYLDLFTDYISLYNSVMKIVFITTSAAIVWYMRRHPQVRRTYDRDQDT

SEQ ID NO: 150726 - protein, 78 aa, Triticum aestivum
  Clone ID: PAT_TA_45144.pep
HGLVGEADVGVHLLQHLADVDHVRLPAFIGSLQAIHVVDLLQPGGFGADTRFSGKNFSTVYDSTIGNKGRQHNCMFMA

SEQ ID NO: 150727 - protein, 93 aa, Triticum aestivum
  Clone ID: PAT_TA_45145.pep
TEPDIGRSTGVACMQLFSCSAVECSAVECVVVLTRQRSKCITKISKQATKRKVMFGYQAQLLYMEGPVRVSRIDYIISVNSIFISTRMTRQEV

SEQ ID NO: 150728 - protein, 101 aa, Triticum aestivum
  Clone ID: PAT_TA_45146.pep
RPVDARDQLTRTPLHVAAEAHSKRCIQLLLSVSRNARTDVRLLDGTHLVALEVALMSRKGQVDWALDNLDEDLLAYLQQKDLNAVRLLAEKTREAGEVAYR

SEQ ID NO: 150729 - protein, 120 aa, Triticum aestivum
  unsure (1)..(120): unsure at all Xaa locations
  Clone ID: PAT_TA_45147.pep
VRKGAGNVLRSCARAAVPSLRVVCTFSCVSVHHASPPCALXAPPTLNESXHWSDADYCRTYGLWYSYAKTXAKNDAXLLSTEHGLYLVVANPLIEVETDMVRTAPTSTMLLVLTLLMKTC

SEQ ID NO: 150730 - protein, 80 aa, Triticum aestivum
  Clone ID: PAT_TA_45148.pep
SAHSFAHAFVHAYDPPPQLADAGFRRRRIRSSSPPTPTTRRPDGAADYILRACFYTNTQNMSPLLILRIDLRNTVYIASF

SEQ ID NO: 150731 - protein, 73 aa, Triticum aestivum
  Clone ID: PAT_TA_45149.pep
QHILAVADYGDGLLIPLCTLLGSVVRSLLGVNTFMRVSLPKGHHLLLLYLMLRDRDQNQKLSFCVSPIIAQNV

SEQ ID NO: 150732 - protein, 65 aa, Triticum aestivum
  Clone ID: PAT_TA_45150.pep
MYLHQLLKHILTGANVFCNISTENTTANSFWHSSSLTIALKIYPYTSLYTQLESDNVCDLSNTLN

SEQ ID NO: 150733 - protein, 75 aa, Triticum aestivum
  Clone ID: PAT_TA_45151.pep
WRTLRGFSSRIAGKDECNGHGGHHLPDPAGEFILHSTYPMELGEHCNLIIGQNVWGESATLTAARIAICCSAKNT

SEQ ID NO: 150734 - protein, 147 aa, Triticum aestivum
  Clone ID: PAT_TA_45152.pep
SAHASAQTEVLEGLCPPKHLEALTIHSYHGLRYPSWMMGQHDGCPKYLNQLSLFHCSTELGQELGGFWPHLRSFYMCRCSSSTMPDHMEHLTSLKYLALDWCPNIRSLPTLPRSLEHFDLSFCNEMLMSSCRRAGDPNWEKIQHVPY

SEQ ID NO: 150735 - protein, 109 aa, Triticum aestivum
  Clone ID: PAT_TA_45153.pep
SAHASADAWAGTDIIRPRGQGHPTGSSQPYFGPSQKLDFELEMAAIVGPGNELGKPIDIADAEDHIFGLVVMNDWSARDIQAWETIPLGPFLGKSFSKTPDISSIMFLG

SEQ ID NO: 150736 - protein, 51 aa, Triticum aestivum
  Clone ID: PAT_TA_45154.pep
RPVSSPPPPSSSSPICSDSHPLPRFGAADAVGLRCSWTICLRYVSIHWHDI

SEQ ID NO: 150737 - protein, 127 aa, Triticum aestivum
  Clone ID: PAT_TA_45155.pep
QLISKALNIFYNRQNSAHGRVIKRQLPTERGALRDDDDLLPRDAGSRRQVPHRAERQGQLVRHRERRRHVARPRRNHGWMDLKRARGGGEERKSRGRAGGRARGEGELGFWLRALWKLPFRADAWAD

SEQ ID NO: 150738 - protein, 117 aa, Triticum aestivum
  Clone ID: PAT_TA_45156.pep
ASFWRCVILSNLAFVLCQLSSSSFSISPERATHSWVHSCAESLRPAGPTRRWSLPMWPGLRAMEHGCIYPPRVEPSNNDIRLALRDVARRDRGIRRLGVLRVAPSENKPSERVGGRT

SEQ ID NO: 150739 - protein, 76 aa, Triticum aestivum
  Clone ID: PAT_TA_45157.pep
CTRKPDCLLLHAHHMRILPLRNLIICKCLLTLDFDDAKLYPCTHFLFLLLLVQMTNCYKFLCVLENNSVWSGQALH

SEQ ID NO: 150740 - protein, 71 aa, Triticum aestivum
  unsure (1)..(71): unsure at all Xaa locations
  Clone ID: PAT_TA_45158.pep
GARAVRAFIPLPSTIDVYCDKICHLVDPXPTHVMGRISFHRLHIKNVCRLEGITKMADLVRPFPSPLPSPL

SEQ ID NO: 150741 - protein, 49 aa, Triticum aestivum
  Clone ID: PAT_TA_45159.pep
PHVPYRIAGSSEATPIHNQPMPPLPGLDSHPEQAKGVKLAMASALLFVG

SEQ ID NO: 150742 - protein, 126 aa, Triticum aestivum
  Clone ID: PAT_TA_45160.pep
MEVASLYRRVLPSPPAVEFASAEGKRLFAEALQGGTMEGFFNLISYFQTQSEPAFCGLASLSVVLNALAIDPGRPWKGPWRWFDESMLDCCEPLHKVKSEGITFGKVVCLAHCAVARVQCFRADQT

SEQ ID NO: 150743 - protein, 118 aa, Triticum aestivum
  Clone ID: PAT_TA_45161.pep
SSRRQPCPINRRTSVSSFLSLSPSSPSFTPLQSKHIHQVPAASFMADSARPSTRHPSERFVQQRLTRGRGWTGREGIGGCGEAGERRQEEGEAWEGGGRRRERSADAWADAWADAWAD

SEQ ID NO: 150744 - protein, 92 aa, Triticum aestivum
  unsure (1)..(92): unsure at all Xaa locations
  Clone ID: PAT_TA_45162.pep
ILLSSLGLALLCFTXGGTVLLARAQKTWRMGTPCSDEKVLQASINYSCSNESCAVIHPRGPCYNPYNLLLHTCVTMNIFYADNGXRHSWNCY

SEQ ID NO: 150745 - protein, 74 aa, Triticum aestivum
  Clone ID: PAT_TA_45163.pep
RPRTRGLVQVHATRFGGCTHGEPAVLRILLPQLRNDLAFSTRGREPDFTGGGFECTGQLLNARSGGGNPTRVRR

SEQ ID NO: 150746 - protein, 120 aa, Triticum aestivum
  Clone ID: PAT_TA_45164.pep
RPVHSKESSVTPSAVTLLEGGKRKRGRPKRVPDSSVTPSSHSGLSVDVDSGDTSKRGRPKKIDTSLLHLPSLFSDDPRESADNVLMMFDALRRRLVQVDEVKQVAKQQQNLEAGSIMMNA

SEQ ID NO: 150747 - protein, 102 aa, Triticum aestivum
  unsure (1)..(102): unsure at all Xaa locations
  Clone ID: PAT_TA_45165.pep
GRPWQMEREALDAATHAVRKARGSRRRGKAKQRTGRPEELSWGGGYAARKAAVTGGEGRGNRARGHGEEEASSWRGLRGVVRVSVCVCDGKXSGXXRPWQSG

SEQ ID NO: 150748 - protein, 81 aa, Triticum aestivum
  Clone ID: PAT_TA_45166.pep
LKTMSTTQPTGQIRSRNSGISAFPWSLWDCQGRCRPTFGFNNSRLSHWGATVPIISTPLLDLALSSSFVLSMNLNFCFSRT

SEQ ID NO: 150749 - protein, 114 aa, Triticum aestivum
  unsure (1)..(114): unsure at all Xaa locations
  Clone ID: PAT_TA_45167.pep
RPRTRGAKGRDMASDTAMILNEDRHFVXCRMPRNHHKFFEANVDNMRALHVHNNDDPSTSEARCSRGTMLTADILGARTRSPSPGRKAHAFAGNNVHSKEFSFSPRSPLTLSAG

SEQ ID NO: 150750 - protein, 74 aa, Triticum aestivum
  unsure (1)..(74): unsure at all Xaa locations
  Clone ID: PAT_TA_45168.pep
MATAEADVGAPASVTAPMMLHGRVAIVTGGAGGIGSAVSRHLASLGARVGVAXHWDPAPARDLVAGINAVVHGA

SEQ ID NO: 150751 - protein, 56 aa, Triticum aestivum
  Clone ID: PAT_TA_45169.pep
KVSQWTGNYFWLPTNSSEKPRVSPPLIRLEQEVWGILGWNSPNNKYPIPRPRSLVI

SEQ ID NO: 150752 - protein, 90 aa, Triticum aestivum
  unsure (1)..(90): unsure at all Xaa locations
  Clone ID: PAT_TA_45170.pep
MAMATHTGVAASKVLMLVGACLTGSIVLKNGRLSDVLAELQELMKGVNQGXGFRAYDMVLIQAHIQYLCQEVIDLTLSKPITILSGLLVS

SEQ ID NO: 150753 - protein, 77 aa, Triticum aestivum
  Clone ID: PAT_TA_45171.pep
MVYIKNHNTRAYSKRFQVKFKRRRQGKTDYRARLMLTNHYTNRYNTSKYRLGVRFSNYAVTAHCVYATIAGDTTMAG

SEQ ID NO: 150754 - protein, 75 aa, Triticum aestivum
  Clone ID: PAT_TA_45172.pep
APPSSVIDHLLRHQAPVDEHAVVRPARGGGGGGRSRRHGLAGGGGGVRCLFLTLGVAQRDTTELKLRCAGRVGGR

SEQ ID NO: 150755 - protein, 119 aa, Triticum aestivum
  Clone ID: PAT_TA_45173.pep
SAHASGEIPGWLQPALCVVCFLKGPAWQLYAVGHYRAIHWTLPWTPPSTRTCKGARRLRRRSAAPPTPSPGTPCSNRNASAARDHHPVIKVDPVQKITPSKHLKPSLKIFTLVKIDGKI

SEQ ID NO: 150756 - protein, 103 aa, Triticum aestivum
  unsure (1)..(103): unsure at all Xaa locations
  Clone ID: PAT_TA_45174.pep
RPQESRTVAGIILKNSLDTTDSAXKKELLIQQRVTLDPSVKXKIKESLFRTLEFLMPYARQASSQVISXVASIEXLIAKLLGNMVQHGAFAALQHGTLQVLGY

SEQ ID NO: 150757 - protein, 69 aa, Triticum aestivum
  Clone ID: PAT_TA_45175.pep
MTSKQEPWTRLSHSTKLPGWVAYNPRTMRPPPLSGDTKQMKILSWNVNGLRNIVQSGGFSSALAQRENI

SEQ ID NO: 150758 - protein, 67 aa, Triticum aestivum
  Clone ID: PAT_TA_45176.pep
HASDHTYELIKITLATSQASVPAGATGPMVVPMLAIRIAYEASHAVFSAAYRMTLLNKLLEQLLLSL

SEQ ID NO: 150759 - protein, 74 aa, Triticum aestivum
  Clone ID: PAT_TA_45177.pep
STHASEDVILISYEIIHKKDPGAVARIKQKEVYEQQNKLLLIGERAVLRTLDFVFNVHYPYKPLVVGICILTTA

SEQ ID NO: 150760 - protein, 35 aa, Triticum aestivum
  Clone ID: PAT_TA_45178.pep
RSTSLESEWETYLLYDVPRRVGTTGEIRERVPAGV

SEQ ID NO: 150761 - protein, 76 aa, Triticum aestivum
  Clone ID: PAT_TA_45179.pep
VWKRPSHDWGMSSISVANALRISALIIAQLKVSVGLARSSQHMALAVFHRLRQTAVATVCSMPSLGACSSRTRGRT

SEQ ID NO: 150762 - protein, 67 aa, Triticum aestivum
  Clone ID: PAT_TA_45180.pep
AKVKTCTDRPITSENNLPMPPYLWLQTLPPQMMLSSPQRPDIAALHRRSLACFRFRPTLSAHASADA

SEQ ID NO: 150763 - protein, 58 aa, Triticum aestivum
  Clone ID: PAT_TA_45181.pep
VRLHKTLLAHYNRVHVAPTRVWNDLLDSSHYLIHFNAPIFNECQADKPIYVERSPFII

SEQ ID NO: 150764 - protein, 129 aa, Triticum aestivum
  Clone ID: PAT_TA_45182.pep
KILCSTMDQINNRSHLVPSKHHLLQNNAPMRDNDTEGTVIVRSGRPKSRVSLGSRTARIRRPSRCCCISREKPPPPPQMGSATSTRPETFGTGPAATAGGSGGKRELAALGFRGPWRRLGRGDRTRGRT

SEQ ID NO: 150765 - protein, 124 aa, Triticum aestivum
  Clone ID: PAT_TA_45183.pep
QGAIPVDARERLHLPHVDQHVSVLAVEHVCWPVSSKISMETSVAEAEYGSCLSTQVTMTHTRWPIGCTLTCHRLPQKSIVSTVVISRYLATGTVTMRVFLTAGDERLAVVPIGIDGVIEPLFSE

SEQ ID NO: 150766 - protein, 60 aa, Triticum aestivum
  Clone ID: PAT_TA_45184.pep
MQTLFRIRSLRGYPEVFCVRISSSSCMLFVRRRLSGETSRSGAAGWLWGGRRKGGETDAW

SEQ ID NO: 150767 - protein, 137 aa, Triticum aestivum
  unsure (1)..(137): unsure at all Xaa locations
  Clone ID: PAT_TA_45185.pep
KKKNPQTLKKTSKSQKKYKKKKRKXHKKITIKSQCQRQEWVIQDKKEKQTQQIDEQKGNSNDKKDNXKKKKNQQKTTKKIDNKKQKKRAKKDPQIKPAATSLASDLALASREREGEGEGRRTRAPDRHRLNRSLYTG

SEQ ID NO: 150768 - protein, 88 aa, Triticum aestivum
  unsure (1)..(88): unsure at all Xaa locations
  Clone ID: PAT_TA_45186.pep
SAHASAHASADAFLFGARTVYRDVFIGDGGYVICYEMEDIXKKLGFGRKSLISFALLFGCDYSNGVHGFVLEAACRLVKFGEHDSILY

SEQ ID NO: 150769 - protein, 75 aa, Triticum aestivum
  Clone ID: PAT_TA_45187.pep
TSTDGSAPEPRLAPPPPPAPAEEYGSRFGDAISGHASWAEGDAPGPIRSECDGLAAKGSPRTRGARRELGTGTCG

SEQ ID NO: 150770 - protein, 62 aa, Triticum aestivum
  Clone ID: PAT_TA_45188.pep
VRKIIGAKWFVKGYQAEYGKMNTTDIHEYMSARDAVCHGTHTAFTAVGALVPDANFWGLASG

SEQ ID NO: 150771 - protein, 55 aa, Triticum aestivum
  unsure (1)..(55): unsure at all Xaa locations
  Clone ID: PAT_TA_45189.pep
VRPRVRWKILPWGEXAYSGGSANAPRGDSSYPTARIFCKADYDFSVTALYWYSLF

SEQ ID NO: 150772 - protein, 35 aa, Triticum aestivum
  Clone ID: PAT_TA_45190.pep
ELVAPVEKEAPTARSADLVLEEERPVMSRPRVRGR

SEQ ID NO: 150773 - protein, 110 aa, Triticum aestivum
  Clone ID: PAT_TA_45191.pep
FADHFSKYLALLFRIRPVGYANSGLATLTPSMSSSSIPVQSLLTSLVDVLGCCSSCPACGAYGRHVHELAFQARGGRGTNGSSVAMAAAQWRLEWKEEMSGGSGRRWERR

SEQ ID NO: 150774 - protein, 43 aa, Triticum aestivum
  Clone ID: PAT_TA_45192.pep
VDCHCSVTESWHGGSHLYVSLKMDNARIIGDLVPHTYWCRAQH

SEQ ID NO: 150775 - protein, 68 aa, Triticum aestivum
  Clone ID: PAT_TA_45193.pep
QKLVCPPELRNSQGLASPSWNSRSPEKPRAARKMQRSRSRGRRGESRPGNELGKPRTGANAWTYAWAD

SEQ ID NO: 150776 - protein, 62 aa, Triticum aestivum
  Clone ID: PAT_TA_45194.pep
NLILFPTSEVVADTSSYLPSSFRELSFVEGANWSWLGIPMQIQLGLSDGVISFIRCITVEGY

SEQ ID NO: 150777 - protein, 38 aa, Triticum aestivum
  Clone ID: PAT_TA_45195.pep
VVELEEDKAELGGVDHGNHTLASLTLRISRSMPQSTRT

SEQ ID NO: 150778 - protein, 56 aa, Triticum aestivum
  Clone ID: PAT_TA_45196.pep
KSISHARGCIEKSAHKGHGVGSGQKGRGRATPTRHPNADGEEKKKRRLELERVIGR

SEQ ID NO: 150779 - protein, 57 aa, Triticum aestivum
  Clone ID: PAT_TA_45197.pep
LPNTFKGKVCVTAASGFVASGLGKRLLESVHHVLGSVRDPGNHKIVAHLLELSSRLM

SEQ ID NO: 150780 - protein, 74 aa, Triticum aestivum
  unsure (1)..(74): unsure at all Xaa locations
  Clone ID: PAT_TA_45198.pep
KLKTQMHDSGHAELLRKEIDILLTSLLFMPACFGYGTYIYSYQRITVGTAACAAALKXSKFVWKPNSVSAVNSG

SEQ ID NO: 150781 - protein, 34 aa, Triticum aestivum
  Clone ID: PAT_TA_45199.pep
PLHLSHSMSEINGVYCSTLPARVGVVASIWTFVH

SEQ ID NO: 150782 - protein, 101 aa, Triticum aestivum
  unsure (1)..(101): unsure at all Xaa locations
  Clone ID: PAT_TA_45200.pep
VDPRVRPRVRSTAFAHSVRSEHADVNVTGLRRIEDGSMISNEHTIKWRMCTDKAREFFMEGKLDEAXKLFKAALQETKEGFVLKDPHSVSALYNFVIFLLG

SEQ ID NO: 150783 - protein, 99 aa, Triticum aestivum
  Clone ID: PAT_TA_45201.pep
VRGRVGVTKLCDLGPRDSVCAVHWTREGSYLAVGTSLGDVQIWDSSRSKRIRNMGGHQTRAGVLAWNSTILSSGSRYKNILQLDIRVLTDYISKFSGHR

SEQ ID NO: 150784 - protein, 119 aa, Triticum aestivum
  unsure (1)..(119): unsure at all Xaa locations
  Clone ID: PAT_TA_45202.pep
MGTGTFPLLFLSSLSASLPSPSRAPAFLSLRALAPQARLSTSYAVFPIGGFGASASTGRFRRRRLHVVCCRPASXTGRQADSVKKRERSNDRHRIRNHAPKAEMXPRIKKVFRALIKLM

SEQ ID NO: 150785 - protein, 41 aa, Triticum aestivum
  Clone ID: PAT_TA_45203.pep
ILFQGFYKNIILRPTPLSTLRPFSLLVKCLCNWWNHVTQRT

SEQ ID NO: 150786 - protein, 138 aa, Triticum aestivum
  unsure (1)..(138): unsure at all Xaa locations
  Clone ID: PAT_TA_45204.pep
VREGAWEGPLIELAIDFDLSIGVTGFVGTVIGFGCFFGGVIIAKLMEYLNLGGLLCCVLSILLWMQFCTYIFRHFFGNFMVEVNFEAEIFLGYMVYDTQDIMERTHHRDMDYIKXHALTLLTDFVTDLVRILIIMLKN

SEQ ID NO: 150787 - protein, 55 aa, Triticum aestivum
  Clone ID: PAT_TA_45205.pep
MELKPGMSALVTGGASSIGKALCIGFAQKDLFGTGVDFSETNGREVTSVSQKENK

SEQ ID NO: 150788 - protein, 135 aa, Triticum aestivum
  Clone ID: PAT_TA_45206.pep
SAHASGRPSSSLSLCCASRGLGIFRSGAPQAPPSLHLLHRAPSSSLHIGPVPPSLPPFIAVSPAPPALSFHGSGWTAYSFHSLFNLEDTRGTRHGSRCYSGTGAHPSFFKLCPPSNLFVASALVIPLLSQSLLAH

SEQ ID NO: 150789 - protein, 98 aa, Triticum aestivum
  unsure (1)..(98): unsure at all Xaa locations
  Clone ID: PAT_TA_45207.pep
MAQILLHGNLHVTIFEAFSLSHPGRASGGAPKFIRKFVEGIEETVGVGKGSSKLYATIDLXKARVGRTRMLGNEPVNXCWFESFHIYCAHLAADVFLR

SEQ ID NO: 150790 - protein, 68 aa, Triticum aestivum
  Clone ID: PAT_TA_45208.pep
RPVAFRFEPPPNPQQSTGGEARAMARTKHTVRKSTGGKAPRKQLATKAARKSAPTTGGVKKPHRYRPG

SEQ ID NO: 150791 - protein, 86 aa, Triticum aestivum
  Clone ID: PAT_TA_45209.pep
MARTKHTGRGSTGGKAPRKHLSTKAARKSAPVTGGVKKPHRFRPVTVALREIRKYQKSTELLILKLPFQRLVREIVQDFNTYLRFQ

SEQ ID NO: 150792 - protein, 48 aa, Triticum aestivum
  Clone ID: PAT_TA_45210.pep
VRPLVLGRVGYILLPGVPRFLTSWMILGMIEGSSGSFVSVTTYNAYFL

SEQ ID NO: 150793 - protein, 65 aa, Triticum aestivum
  Clone ID: PAT_TA_45211.pep
SAHSSADACVFLYPANPFAGRGHWRGVLLSLLCTSRVCLHLADALILELLGWFNHHHSVLDPSLV

SEQ ID NO: 150794 - protein, 78 aa, Triticum aestivum
  Clone ID: PAT_TA_45212.pep
QVGYDASFKKGVSVRFTICNGLTLYGTTKRRIQCIRLELLPNRSNIINLHTPGGGGIVIRTLKRGVFQPYLLIRCRIR

SEQ ID NO: 150795 - protein, 90 aa, Triticum aestivum
  Clone ID: PAT_TA_45213.pep
SAAIYHRSTPSPPTPPAPQGRGPSGRGPRRLQKMEAPGSPYASMPESAPKRALCSFPPSPAPRDRHDSVHDAGVLDYDMDNSSHLRFLVA

SEQ ID NO: 150796 - protein, 54 aa, Triticum aestivum
  Clone ID: PAT_TA_45214.pep
LVCDGIHIHIFSRVGGYDANIRTGYYCFFCCPGNFNLWIERVGWVPSHSISIGR

SEQ ID NO: 150797 - protein, 145 aa, Triticum aestivum
  Clone ID: PAT_TA_45215.pep
MAAAGYGGRSAKRCKEKWENINKYFRKAKESGKKRPAHAKTCPYFDELDRLYSRSAHGSGASSAAGNTSAKTNANAIAGADNAANKASSELLDAVVKYPADTHYGPPPGFPTDGDRGGNAETKDDGEGDVDMGRASVRASDEHDD

SEQ ID NO: 150798 - protein, 79 aa, Triticum aestivum
  unsure (1)..(79): unsure at all Xaa locations
  Clone ID: PAT_TA_45216.pep
RFLSLXLGLLWWKPQTGNYGRLEXQVGGIFYICIFXTSFSLFCSVYLFPFEKLGLVKERMADLDRLSAYYSSITLCYSV

SEQ ID NO: 150799 - protein, 113 aa, Triticum aestivum
  unsure (1)..(113): unsure at all Xaa locations
  Clone ID: PAT_TA_45217.pep
VRPRVRAEISSPPAPTVPGSTAGVRFVLKEQRTSGQSLHLLGDMPPLRLXNRQARSLWIGSKALTATXKKDLPDNRVLEFKILLQDYSEKMPXQDGPNRSLQTGEPTQTLAVY

SEQ ID NO: 150800 - protein, 94 aa, Triticum aestivum
  Clone ID: PAT_TA_45218.pep
AGGESRSRPAAWIRSRSRPPRRRRRTGAAPPPEGGSRMRAGAWAWAWIRSRSHPRGRRRAADDARSAAGSRTRAGASGGGRRGRAPRRPRVRER

SEQ ID NO: 150801 - protein, 50 aa, Triticum aestivum
  Clone ID: PAT_TA_45219.pep
WFKTTSMENMNLCGVLCAKYGKFEGAPTLREKFRIQESCFVDTLIRKLDP

SEQ ID NO: 150802 - protein, 128 aa, Triticum aestivum
  Clone ID: PAT_TA_45220.pep
RPFSHKTQTSPPLLSYSSCSSCGWRPTAAGAGVLFSPKQPPACSSPPAPPAISTPLAPPASPPFFSFLTRRQTHPSSRFGRGNHAPAEEDFFFTGTGPSFFRSLADCSVQPPQRRFLLAPETLARGHG

SEQ ID NO: 150803 - protein, 77 aa, Triticum aestivum
  Clone ID: PAT_TA_45221.pep
KLQCHKGISESPLSSLTGQDEAVFQAHCPHDSTLSDLDIYQYNDLGRHSLNLKLGQLYISRCSSLANMLHFYRFSRT

SEQ ID NO: 150804 - protein, 57 aa, Triticum aestivum
  Clone ID: PAT_TA_45222.pep
RTTRQNCHEMCLAWFQLERSFCLHQGRMTYVLKAISNELQCILTRINGPYLLTIMPF

SEQ ID NO: 150805 - protein, 53 aa, Triticum aestivum
  Clone ID: PAT_TA_45223.pep
MGGYSMRFIMRSHLMRKMRSSQIIGERRGDELGWAGEKKKRSVHACLLRDRRR

SEQ ID NO: 150806 - protein, 70 aa, Triticum aestivum
  Clone ID: PAT_TA_45224.pep
VPIPPFCLLQASKHESQKSMCCVGAINEKVRGSPNMREKSLKSQITCLVDPLIKDLDHQIVPSQRNGSNT

SEQ ID NO: 150807 - protein, 57 aa, Triticum aestivum
  Clone ID: PAT_TA_45225.pep
MAANFWTSWHSKHLLDPEEVYVVPAQDRERCVTPVEFRLVKIHMFFHIWRVGPQVKC

SEQ ID NO: 150808 - protein, 48 aa, Triticum aestivum
  Clone ID: PAT_TA_45226.pep
RFLVCGKLRVAEPPLHVCAYAVVRQKIIVNVSGHRQGDHRLPKRSDWF

SEQ ID NO: 150809 - protein, 42 aa, Triticum aestivum
  Clone ID: PAT_TA_45227.pep
IAMNYKVGVITAWDTGAGYRSTLRYMSVERLKDSLRCITLLE

SEQ ID NO: 150810 - protein, 122 aa, Triticum aestivum
  unsure (1)..(122): unsure at all Xaa locations
  Clone ID: PAT_TA_45228.pep
SANSGLTPSRPPQPPTAQSPSEGPPTVLLRPDPPTIVGIWPTTLRSANTHCRPALPPTTPRHPLSVTTLCHPAXPPTTPCYPSRPTTTLHRVPLQPLHAFCPVRIHVLCRCTLGCVGPFYLL

SEQ ID NO: 150811 - protein, 34 aa, Triticum aestivum
  unsure (1)..(34): unsure at all Xaa locations
  Clone ID: PAT_TA_45229.pep
IKPPQEWLFQRKEESLSIIKSNERVGKKEFXRYL

SEQ ID NO: 150812 - protein, 113 aa, Triticum aestivum
  unsure (1)..(113): unsure at all Xaa locations
  Clone ID: PAT_TA_45230.pep
PPRFPPRVPRIHSLTHYILSFFLFNHPHPHSLGVAPKASENKPVEKTLLGKKPKAENMVPAFKEGGGDMKGMNKAKNSVXTYKIYIFKVLKQVHPDIGIFFKVKSIMYFLINH

SEQ ID NO: 150813 - protein, 68 aa, Triticum aestivum
  Clone ID: PAT_TA_45231.pep
RVGEMALLKATLLETRAKLVVRGGLFDSGEELCRTCISIRTVMLGHDHAQTLAAHETLAKVVRYRSKI

SEQ ID NO: 150814 - protein, 66 aa, Triticum aestivum
  Clone ID: PAT_TA_45232.pep
NRYLFLGTIDRHIPRFPIIRLSHILLYLTIILRLKERVNHPLSYKSPPPGYNDSKHKDEVSIHKDP

SEQ ID NO: 150815 - protein, 110 aa, Triticum aestivum
  unsure (1)..(110): unsure at all Xaa locations
  Clone ID: PAT_TA_45233.pep
MAGATVVAPMDIDRAAAPPAFKGKAPVSVAAYVKSSSWVEKHRPQSLADFVVHRDIVDTIDGLTDDNRALHLLLYGPPVTGKTWTILXVLRRIYGAPVITMILEPIASVE

SEQ ID NO: 150816 - protein, 110 aa, Triticum aestivum
  unsure (1)..(110): unsure at all Xaa locations
  Clone ID: PAT_TA_45234.pep
MASIAGSAVFFAKPVKAINTNSLSFSGPRRGNAFLRLQPVPMRLAVCCSAKHDTVDKVCEIVNNQVAFSEGTKVCGTTKFXDLGANSLDTVVIVMGLXEEFQISGDETNA

SEQ ID NO: 150817 - protein, 70 aa, Triticum aestivum
  Clone ID: PAT_TA_45235.pep
SSHPFSNYAPSHLLLLLYAAHPYGGVSTYEESVHHKPIPSPSITSSPPFSIFHMRRMTISFFAHRSCHKQ

SEQ ID NO: 150818 - protein, 41 aa, Triticum aestivum
  Clone ID: PAT_TA_45236.pep
MSTYDPNNILITGAAGSIASHVANPLISSFSHYNIVVLIQE

SEQ ID NO: 150819 - protein, 112 aa, Triticum aestivum
  Clone ID: PAT_TA_45237.pep
RTRPPALPTISHPMIRPYPTPLGNGILFTVCRSLFFPIWRGTRTQSLTPPRSRHARGPPHPSRMHPRDAPLLPLPPQQPARARAPRTHLHGPLLFYQGRLLCLVDLLPSGLP

SEQ ID NO: 150820 - protein, 88 aa, Triticum aestivum
  unsure (1)..(88): unsure at all Xaa locations
  Clone ID: PAT_TA_45238.pep
MVVFDVCVYCNIDNLWDAVAKLGEISXNEKAGFISLVSRYLSGEADQIEWSKIQTLTDEVVVLYDTLAPFSEDLDALKALLDKLVVLK

SEQ ID NO: 150821 - protein, 56 aa, Triticum aestivum
  Clone ID: PAT_TA_45239.pep
CIIHFRGGSERMADSSLNCPYQLTPIRPLREILKMPCRLVSYCKPKLTTLVHFLKE

SEQ ID NO: 150822 - protein, 142 aa, Triticum aestivum
  Clone ID: PAT_TA_45240.pep
MEGNNLPPGNFMQGATYCRGGLHRNPMQMHGPSYYNPVFNHSQILGKFPMPMNHVTASDHLAEFQFIKQRKADHHQVHHHHYSKKDSMSDDDEHGLNEDTTDSHSGKGKKGSVWHRMKWTDSMVKLLITAACYTGEDPGADL

SEQ ID NO: 150823 - protein, 149 aa, Triticum aestivum
  unsure (1)..(149): unsure at all Xaa locations
  Clone ID: PAT_TA_45241.pep
ARVRYGEIVQKVIINFKLNIPXSSWRNKDPKXVLHSEMSQWLPLADAVMAMVVECTPDPVVAQGARVARLMPKRELATEDAAGCAEVVLEAERVRRCVETCDAGADSPVVVYVSKMFAEPCKMLPPKGVHGELLNHQDASESEECFMAF

SEQ ID NO: 150824 - protein, 150 aa, Triticum aestivum
  Clone ID: PAT_TA_45242.pep
SGQITQVYGFYDECLRKYGNASVRKYFTDLFDYLPLTALIENQVFCLHGGLSPSLDTLDNIRALDRIQEVPHEGPMCDLLWSDPDDRCGWGISPRGAGYTCGQDIAQQVNHTNGLSLISRAHQLVMEGFNWCHDNNVVTVFMAPNYCYRC

SEQ ID NO: 150825 - protein, 120 aa, Triticum aestivum
  unsure (1)..(120): unsure at all Xaa locations
  Clone ID: PAT_TA_45243.pep
GRLPPASTLHSHIRPPYLLHIVNILGEEDRXNILRARETVKPALTNPFRXLGLNHLSVELTIATERPDLPANASAEQRVETTVGYLGGSFXMWSSLVENFLSKLAVIQNIWVNVYDVQML

SEQ ID NO: 150826 - protein, 80 aa, Triticum aestivum
  Clone ID: PAT_TA_45244.pep
TNPCLKIEIAKAAMYYVLEKYECIYGSCEPCIGPVNFPSLLIVKLAKPCFKLLSLKVYLRAIAVICTCRWLLLNGLLQHE

SEQ ID NO: 150827 - protein, 147 aa, Triticum aestivum
  unsure (1)..(147): unsure at all Xaa locations
  Clone ID: PAT_TA_45245.pep
SAHAYLDSLSVFYKNTDWFKERGLVYNTVTXYFVTDYRMHIKGWRSRYCSMYPHTFINTAPINLTERLFQVLRLATDFLEIYFFKNNSLLVSTYLHPMQCIVYINITTYPVTAIFLILYTXTVPALFLVTEHFIEQRPNTMFYVYLD

SEQ ID NO: 150828 - protein, 152 aa, Triticum aestivum
  unsure (1)..(152): unsure at all Xaa locations
  Clone ID: PAT_TA_45246.pep
SGTNLHYRGARVWQAVMEDLLAKGMNKAENALISGCSAGGLTSILHCDRFHRLLPAAANVKCLSDAGFFINVKDIAGVNHAAAFFSDVVKTHGSAKNLPSSCTSKLPAGMCLFPQNEVKQIQTPLFILNAAYDSWQVRNIXVPGGSDPRWRS

SEQ ID NO: 150829 - protein, 153 aa, Triticum aestivum
  Clone ID: PAT_TA_45247.pep
VRFTLHREASASVSVPATHRAGKDTALVTTGQHRSNDAPAAARPNPCQAMAFGGGSAGNQQAGGIAIGHAAYAQAHHHIGAGPSNADAAALGGPGPSKRRNKKKVTFALGAPGASGAGCPAQPGAATHSSIIGSAGSTPNKPAKNKKAVNGQQ

SEQ ID NO: 150830 - protein, 139 aa, Triticum aestivum
  unsure (1)..(139): unsure at all Xaa locations
  Clone ID: PAT_TA_45248.pep
CFCLTLFSTLLIGLSRHWTGELLAAAILSVKRAGVMASLVXLMLFLLTGGYYVQHIPKFIRWLRYGSFMHYGFNLLLKAQYHGHVTYNCGSRTGCQRLQSGTSFDTGDLDGGMREVCILLDMAVEYRLLAYLWLLKRIT

SEQ ID NO: 150831 - protein, 81 aa, Triticum aestivum
  Clone ID: PAT_TA_45249.pep
SVHSCCNTFSYTVKIFRITFPAGRVIWGMGFIFALILLAPSYAFHHEICSDNLSDLQTLHISGYTHLISLGGPKSINHFEI

SEQ ID NO: 150832 - protein, 150 aa, Triticum aestivum
  Clone ID: PAT_TA_45250.pep
SAPQPSRDLPEDRGEANVLIEEARGSPPAKEAEAGGAVGWVLSPVAWFRMLVRELHWSFVLGVVATYGISQGLGGGISRVASDYYWKDVQKVQPSAAQVYHGVTSIPWLVKPVWGLLTDVLPVAGYRRRPYFVLAGIMGVIAMLIVSLHS

SEQ ID NO: 150833 - protein, 141 aa, Triticum aestivum
  Clone ID: PAT_TA_45251.pep
RYVRPSALTWNLSRWTSRPERRPVLVVVVVVLERHVVLLVVLMVHVMDVVAVVDAVVVVGVLVGLLLGPGPLVAPLVEHPGERRRRRGRGPGHKAADNDARNHEPDHEFRHLLRVLASLLVFLVCSLVCPFTVIFRVIGRT

SEQ ID NO: 150834 - protein, 141 aa, Triticum aestivum
  Clone ID: PAT_TA_45252.pep
SAHASADPLLAAIFAGALPLPEVRHPAGLHRRRHTTPCCCRLPLPCYHGAAGTPPRCFDLGVGSPKPVGFSHRPQLSGALHQPTDQVAAPPMANNRWYPSVCFPPEGLMSCICAPLPDLSFLSLIAFLLFHCLACATSNLD

SEQ ID NO: 150835 - protein, 55 aa, Triticum aestivum
  unsure (1)..(55): unsure at all Xaa locations
  Clone ID: PAT_TA_45253.pep
VGKNPEAQQDTAMTQPXYSFRKQRLRSNRARAPCRRLRGTNEAGPDPDPPTAPRT

SEQ ID NO: 150836 - protein, 78 aa, Triticum aestivum
  Clone ID: PAT_TA_45254.pep
RVAQFSLGTTVLLWPNIFLLINNIIRTHQTSFSALVCHSQLLQKPSWKGYNWNRCCLPDLLSPNFLTTFTSSFEAYFS

SEQ ID NO: 150837 - protein, 80 aa, Triticum aestivum
  Clone ID: PAT_TA_45255.pep
KAASSAHVATLAAGLGFIRSVLATVAAQHGKAKAFCISQVAIASQACSILPPSPPEDDHHHHHDDDDDDDDDDDDDYDYY

SEQ ID NO: 150838 - protein, 72 aa, Triticum aestivum
  Clone ID: PAT_TA_45256.pep
LKASKQPSPLLASVFPLNFRREKSSFSFSTPTITSKWNPRFICGLLLGICGDPTASLPAQHFLPATPVPQFH

SEQ ID NO: 150839 - protein, 93 aa, Triticum aestivum
  Clone ID: PAT_TA_45257.pep
LPLHDVVVLHSFVMNDLVVVVVGLLVLALDMQIEHGQVDYKRGPVSSPIICIFGCIFTRNDMHAKEFRNPPPASCWPSCLWTHDITSSDEWAD

SEQ ID NO: 150840 - protein, 154 aa, Triticum aestivum
  Clone ID: PAT_TA_45258.pep
RPLFAAAATYLKPIPPPTPTRHHPEEQTPRRSFSARRPTPSRRPRSPPSTAGPPRSSTFHPLPPVRDPTGGNTQPRSQSIAWRPRRGQPPSVAPLAPPRPRHLLRSDHDAAAGSSPCGRDGGWIHDGDNTQRSPSARSGGERKDKEEEEEEHEE

SEQ ID NO: 150841 - protein, 62 aa, Triticum aestivum
  Clone ID: PAT_TA_45259.pep
CVSPTNPTINECLTHSKVPSSLSSPPPLLCLSNVHVGYKNAFTPYRSKLCSGSGSGICSKDS

SEQ ID NO: 150842 - protein, 116 aa, Triticum aestivum
  Clone ID: PAT_TA_45260.pep
MVYIKNQMTRAYSKRFQVKFKRRRQGKTDYRARLRLTNQDKNKYNTPKYRFVVRFTNKDVTAQIVYATIAGDIVMGAAYSHELPCYGLEVGLTNYAATYCTGLLLARRVLKNRCLC

SEQ ID NO: 150843 - protein, 70 aa, Triticum aestivum
  Clone ID: PAT_TA_45261.pep
INRARSDGLRQLTSSVIAQQMQRSGTKGHVGVQVTDGENDFFNASSRGRGDSICRASGQPPACSSCACTR

SEQ ID NO: 150844 - protein, 44 aa, Triticum aestivum
  Clone ID: PAT_TA_45262.pep
SVSSHSFVLAVSLISLSPSSPTRSCRSRAGVMVVRPEIARLLST

SEQ ID NO: 150845 - protein, 49 aa, Triticum aestivum
  Clone ID: PAT_TA_45263.pep
LHFLLCLLAIQPLLYNVLRRALPPSPVFQVLLLISPVHSPSHPQHEQRM

SEQ ID NO: 150846 - protein, 106 aa, Triticum aestivum
  unsure (1)..(106): unsure at all Xaa locations
  Clone ID: PAT_TA_45264.pep
SPPGKLDELSISQVNNTVQRQSGGDENFSSLLYETLRILRSHIADGTAXCGAHHIFTNDTLKEITXRIPWTKEELLEINGFGLVKLNKYGDRVLATIEESLIQFPN

SEQ ID NO: 150847 - protein, 48 aa, Triticum aestivum
  Clone ID: PAT_TA_45265.pep
ATAEGSWAEDGFLSANAARLRICSGRDRPPAHIISPASQHGAWRHVRP

SEQ ID NO: 150848 - protein, 89 aa, Triticum aestivum
  unsure (1)..(89): unsure at all Xaa locations
  Clone ID: PAT_TA_45266.pep
LTYPSLIPGWTPCSIFIITPTGSSITLEFLSWEAIYYGGAGIHHIDFIPSDHHRLIXVGMQLEDGLTLAVYNIHKEFTLHLVLLLLCSN

SEQ ID NO: 150849 - protein, 50 aa, Triticum aestivum
  Clone ID: PAT_TA_45267.pep
SSPNKILNMNPLYSMKNGQIVRVYKYIYLISINYLSRVHPPYLIGLYLHI

SEQ ID NO: 150850 - protein, 50 aa, Triticum aestivum
  Clone ID: PAT_TA_45268.pep
DLLTIRTHLLHLHKVLVEGPHLVVQGVAYPIDRPLALIQCTVMKVIPMPL

SEQ ID NO: 150851 - protein, 108 aa, Triticum aestivum
  unsure (1)..(108): unsure at all Xaa locations
  Clone ID: PAT_TA_45269.pep
MGXIYIGMEGFYLIRKLVASVSLHIPYVKLVTINYPFITTDYMTYIFKYYTVHRHCKHHEVIVKDSKTLLFYEKDVAVFCCKNPYEFPLSFAGSKIHFLNPPRFFHLT

SEQ ID NO: 150852 - protein, 66 aa, Triticum aestivum
  Clone ID: PAT_TA_45270.pep
FTNLTTNNSFPAFTSMYILQSYIYHFMLFYKKLFYHMNYHVLIIILTNVLNHINMSTILKLILIPI

SEQ ID NO: 150853 - protein, 54 aa, Triticum aestivum
  Clone ID: PAT_TA_45271.pep
LHRSFYISHSFLYFFIQINLFYISYDIQYPITQFLLYKTFSRLLPINNLFVFIL

SEQ ID NO: 150854 - protein, 64 aa, Triticum aestivum
  unsure (1)..(64): unsure at all Xaa locations
  Clone ID: PAT_TA_45272.pep
LXLTLGFYYICAVVLIRHPTDAGHLSVGGVSINTNSPTAFNRNERSSSTLRLLTPRQSGIKSAP

SEQ ID NO: 150855 - protein, 74 aa, Triticum aestivum
  unsure (1)..(74): unsure at all Xaa locations
  Clone ID: PAT_TA_45273.pep
EVGLFNIHMSSHIXRLAHLVKVIHIVITTSISYFILCNSRNSLNFYHPFLVFLTCLYLSSYCICITYLSIFFFF

SEQ ID NO: 150856 - protein, 114 aa, Triticum aestivum
  unsure (1)..(114): unsure at all Xaa locations
  Clone ID: PAT_TA_45274.pep
RPWVKASTSSRLYCRHLPGXAIRRGSSFSFLSLLALASVSVVNANFFFHDNCEHGWESRLVKSIWKKDXNMAVXLNHTSGKWHGDAXVKGIQTSLDYRVYSISAEYPLFHLPID

SEQ ID NO: 150857 - protein, 108 aa, Triticum aestivum
  Clone ID: PAT_TA_45275.pep
RLFIHLCTSSCLSPISTISPSGAPSPSEASNDDPPILYHRPPNKQFPLWYLQPPYPSIISISFPSIYRFSNHSSCSTPILRQQSFPYYNQIHALFHIHSPVFHWWLAS

SEQ ID NO: 150858 - protein, 109 aa, Triticum aestivum
  unsure (1)..(109): unsure at all Xaa locations
  Clone ID: PAT_TA_45276.pep
PTNPLDXYHLWFKDMIHICGINYYGGVPSFSLFNNVTGYAIKHSQCVGYPVNLVPYNANYHDDSFLWTXSLYVGACFRFILMVNNIYLNFDSFHGDIEHCGFLDCTFLF

SEQ ID NO: 150859 - protein, 47 aa, Triticum aestivum
  Clone ID: PAT_TA_45277.pep
WGLKSVGEDLTLTKHLISDLHSTHGINNFIPLLLEHFINIMFHFYFF

SEQ ID NO: 150860 - protein, 132 aa, Triticum aestivum
  Clone ID: PAT_TA_45278.pep
VRRAKRAGGISSLVSPSPVTPGGLPTPRMSPSREGLSDMAHQQWGVDGYGSMKGLIRLRASSPRHPGDAEGDDDDSSSGSDVEEHVEVERRLDHDLSRFEMVYPGGMANGGAYVFEDDQYVHVARLEEENLT

SEQ ID NO: 150861 - protein, 125 aa, Triticum aestivum
  unsure (1)..(125): unsure at all Xaa locations
  Clone ID: PAT_TA_45279.pep
HLSHPNWGGSHPWAGCASHKNPLKNTLADTNPIANNNGPTSKAGCYKKGNKKGKMSVETYKIYILIVLLQGLPDIGIFFKAMSIMISFINHFFNNLAGNSSXVALYIYISTITSREIHISFQLFL

SEQ ID NO: 150862 - protein, 83 aa, Triticum aestivum
  unsure (1)..(83): unsure at all Xaa locations
  Clone ID: PAT_TA_45280.pep
FSRGKPKSGVVAQTNHTALNSTILKSPRNQLFTKSHLKSNPTTLLVNNPHLYPPXTIVLPDILKFQTITHLLIMNLPLQKLFM

SEQ ID NO: 150863 - protein, 77 aa, Triticum aestivum
  unsure (1)..(77): unsure at all Xaa locations
  Clone ID: PAT_TA_45281.pep
LQXPSXIPVGSHASVLLLLHNISFHPAKPISEHRGGMRLGGGALSMMFSIQVDSFSPSQFTPSHNAAFYSSPNIFRG

SEQ ID NO: 150864 - protein, 47 aa, Triticum aestivum
  Clone ID: PAT_TA_45282.pep
GGSGNIFPTITYNKNTLFTHNQNNNHITINLNNIIVLFSILFFSKWF

SEQ ID NO: 150865 - protein, 121 aa, Triticum aestivum
  unsure (1)..(121): unsure at all Xaa locations
  Clone ID: PAT_TA_45283.pep
GATRPHTTPASSLGARGGGACRNSDGPGSVGSGRHLLGRPLQSSISRSSSSRKSPFVVRASSSPPAKQNDNRQLWFASKQSLTYLDGTLPGDFGFNPLGLADPXGTGGVIEPRGLAYGEIF

SEQ ID NO: 150866 - protein, 50 aa, Triticum aestivum
  unsure (1)..(50): unsure at all Xaa locations
  Clone ID: PAT_TA_45284.pep
LLGKIXAXGGDHAWGEMENLKAFWKDSGSAEANYLAHWDLNFRGETTGGI

SEQ ID NO: 150867 - protein, 80 aa, Triticum aestivum
  Clone ID: PAT_TA_45285.pep
SYPSGATRFSTRLCLSFSSYPNLTILKTLTGDSPSRTGESHVVLMPYMAALSLSFLKLLRWWGFSVTLQRSLFYLPFPVG

SEQ ID NO: 150868 - protein, 102 aa, Triticum aestivum
  unsure (1)..(102): unsure at all Xaa locations
  Clone ID: PAT_TA_45286.pep
SSYHTIILLPXFDFFTVSPPSMGTXSSRGGPLTKIITYLDGTEDDFPWXVVNCAYNCLFPKVNTKCDFYLHPHQHSPAPNISQGKLNSPRILRFLNFLTIYR

SEQ ID NO: 150869 - protein, 63 aa, Triticum aestivum
  unsure (1)..(63): unsure at all Xaa locations
  Clone ID: PAT_TA_45287.pep
YYDLTAXXRISDFSVLSINLTISHVKMLITKSHCISYLFLEGLMVYHCTSTLHLVLSWIMINC

SEQ ID NO: 150870 - protein, 36 aa, Triticum aestivum
  Clone ID: PAT_TA_45288.pep
NSIGVSSCLNGVPVTLFIYLEKIDAMYVDSNVFTLR

SEQ ID NO: 150871 - protein, 112 aa, Triticum aestivum
  unsure (1)..(112): unsure at all Xaa locations
  Clone ID: PAT_TA_45289.pep
ATRPPTLPPTHPPTRSSTHSSTHAVPPFLGETQTIIFIHILLSKLYFKSEPYPNIFDNSKNLFRTILFXDPTKPLFSYXILCHPIILYYTIAPNKPIYSCFLAILKHFSSYN

SEQ ID NO: 150872 - protein, 110 aa, Triticum aestivum
  unsure (1)..(110): unsure at all Xaa locations
  Clone ID: PAT_TA_45290.pep
KSKSHLRGRGGRGAALEIEIELSHAGLEGEVVEDVGGGEDEEDAARHDDEVKVKLIVKSLIDRIKGYRAEKNIGCSRRLPPLWIHPPRVWVGDLEEERMMKMMIKRXECL

SEQ ID NO: 150873 - protein, 71 aa, Triticum aestivum
  Clone ID: PAT_TA_45291.pep
LPFSITSPSIYYSYHTSSSMTTLISYIYSLHLLLYIINYYYLCNLLISITITHMVFIPNIYHISSSQEYLL

SEQ ID NO: 150874 - protein, 62 aa, Triticum aestivum
  Clone ID: PAT_TA_45292.pep
SVVNFYNVAFLVHLRVSLSIYILINPYFIRKRGTSSFFCVYKDFYGNGALVCPLHLTFCIPN

SEQ ID NO: 150875 - protein, 67 aa, Triticum aestivum
  unsure (1)..(67): unsure at all Xaa locations
  Clone ID: PAT_TA_45293.pep
SSSLLYYKSVTISHIQSVPTLREXTFLEIEHLHPSFSNLDIHISVTINFKWKQLEDHFRFLYHSLNK

SEQ ID NO: 150876 - protein, 75 aa, Triticum aestivum
  unsure (1)..(75): unsure at all Xaa locations
  Clone ID: PAT_TA_45294.pep
RKQDQKVGQAADDARRGRLKARRWRRRYPASGHPPQPRVARTAAREPREQKLVLVGPAAPRRRTRASPGNXDGTR

SEQ ID NO: 150877 - protein, 90 aa, Triticum aestivum
  unsure (1)..(90): unsure at all Xaa locations
  Clone ID: PAT_TA_45295.pep
FFIIFPNPFTPFDTYTWRRPXNRTGWMLLLLLPQTSPDEARNTGISPTLRPWNRTQTLRTSTTNGTPSTISEFMPWNAPFLIRLSTTNPT

SEQ ID NO: 150878 - protein, 93 aa, Triticum aestivum
  Clone ID: PAT_TA_45296.pep
PPSARSGACGIPASVSNKNPSTWGAHQDLGAGRLFVEVSLPAIAFMACLPSHMAFPSPFVAHRRACNGAPPVGAMASTMNNVKTCQKPYSPPR

SEQ ID NO: 150879 - protein, 71 aa, Triticum aestivum
  Clone ID: PAT_TA_45297.pep
EHELVRKVRFDTGKGANGLGNQKEAATIADASNPQTAVVPVHINNVRSPPNLSSMIRIALHAIFRPTRPRT

SEQ ID NO: 150880 - protein, 70 aa, Triticum aestivum
  unsure (1)..(70): unsure at all Xaa locations
  Clone ID: PAT_TA_45298.pep
VRATQPNNAPGLFGQGNAPLVSGMQHGSMYNSGSYKARQQAKXYGGITPNWGSAGRRFNNFDYNSSQQRG

SEQ ID NO: 150881 - protein, 123 aa, Triticum aestivum
  Clone ID: PAT_TA_45299.pep
RPRTRGSGAPLPFPDALLINGMPSATLVGDQGRTYLLRVSNVGMKTSINFRIQGHALKLAEVEGTHPVQNVYDSLDVHVGQSVAFLVTLDQPPMDYAVVASTRFNPADTSPVTAVGTLHYSSA

SEQ ID NO: 150882 - protein, 81 aa, Triticum aestivum
  Clone ID: PAT_TA_45300.pep
VRDAKFFPLNGDFFKSPRVTMGRAGCSKRWVLAKQPNLSYTLGSPTESGVVFTSAGPIFETPKATVRVARIEFDPSELTDY

SEQ ID NO: 150883 - protein, 70 aa, Triticum aestivum
  Clone ID: PAT_TA_45301.pep
VRGRVGFIDFGGLLAGLAQVRRLVLNKCYPPVTKGHILETLSCTFDNLKKLTLLTSLLRNPHHFVNPLFT

SEQ ID NO: 150884 - protein, 109 aa, Triticum aestivum
  unsure (1)..(109): unsure at all Xaa locations
  Clone ID: PAT_TA_45302.pep
RPPRSAHEVIAHLVSRLSRWDDRLFRKYVFGEADEIELKFGNRRNSEDLNLVSIILNQEIRRLATQVIRVKWSLHAREEIILELLRHLKGSATRIILERXRKSAREMLE

SEQ ID NO: 150885 - protein, 43 aa, Triticum aestivum
  unsure (1)..(43): unsure at all Xaa locations
  Clone ID: PAT_TA_45303.pep
GPSIMTYXXQLEYENGVTYIYVSNKEQNAIRWGETGKHERTGR

SEQ ID NO: 150886 - protein, 44 aa, Triticum aestivum
  Clone ID: PAT_TA_45304.pep
TNIPANLRCRKGPLRGRGSMASATAYISSHSIDLRELKAGRIGA

SEQ ID NO: 150887 - protein, 121 aa, Triticum aestivum
  Clone ID: PAT_TA_45305.pep
QADPRTRSYLISLFTWSCSHMHRARLRSPYASISLLAYRKVPTEGTDGHRIDRVRQLLIRTPLHGPATHRLRRGQAGFRGDTPRRQVVGAARQLVREGRLHRGRAAGGGRGRETPEVLRGR

SEQ ID NO: 150888 - protein, 98 aa, Triticum aestivum
  Clone ID: PAT_TA_45306.pep
REGGCWRVPESHESRVDNTLVTDLVFERRIFVRDYLRRCLNNGHHFEVGRRCHVVWWHRHVLKLNDWSRKVDGFLPLKSKRGEGIRQGRVCVPDAWAD

SEQ ID NO: 150889 - protein, 80 aa, Triticum aestivum
  Clone ID: PAT_TA_45307.pep
YRVGSRQTPSERRSPHVLATEAKRCVAHGIILPLAIGGGPAIGVVISASENIFYASGAGESGAGILLCCVARLTTRTRGA

SEQ ID NO: 150890 - protein, 60 aa, Triticum aestivum
  Clone ID: PAT_TA_45308.pep
QKWALVPLVSKSALYIYFGICEGVICGAVSYVKSAPVIHRIKSYIAARSRGNDIAVNADA

SEQ ID NO: 150891 - protein, 51 aa, Triticum aestivum
  unsure (1)..(51): unsure at all Xaa locations
  Clone ID: PAT_TA_45309.pep
SNRRRRWRCGGRCLYRRRSLPVXRLGLSTCILYQSSTHYWLFKLQPCKTWQ

SEQ ID NO: 150892 - protein, 126 aa, Triticum aestivum
  Clone ID: PAT_TA_45310.pep
MATETETFAFQAEINQLLSLIINTFYSNKEIFLRELISNSSDALDKIRFESLTDKSKLDAQPELFIHIILDKATSTLTIVDRGIGMTKSDLVNNLGTIARSGAKEFMEALAVGADVAMNGLAWVCY

SEQ ID NO: 150893 - protein, 141 aa, Triticum aestivum
  Clone ID: PAT_TA_45311.pep
VRGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNPVGSGTGSGLGFLLLE

SEQ ID NO: 150894 - protein, 75 aa, Triticum aestivum
  Clone ID: PAT_TA_45312.pep
VRQIINFRLLESSSPLARPYPVRRFPPDGNRTNRMIQSKELFEATIRQPRFCNTSFVLVLNKYYLVQEKINRAPL

SEQ ID NO: 150895 - protein, 62 aa, Triticum aestivum
  Clone ID: PAT_TA_45313.pep
KNQTRSTLLRTSTTAGRELLRSERSRFSFSPPMVGAPVGPGWTSPPRRRGEEGGRLRESGRT

SEQ ID NO: 150896 - protein, 27 aa, Triticum aestivum
  unsure (1)..(27): unsure at all Xaa locations
  Clone ID: PAT_TA_45314.pep
LGLGPSKLWSRXLIQQELDHVIEELEK

SEQ ID NO: 150897 - protein, 56 aa, Triticum aestivum
  Clone ID: PAT_TA_45315.pep
PGRPRVRPRVRTRIPFGPKDKYLAKEHLLPYVQEFVDGALNHIGHMAKIIGEEIGW

SEQ ID NO: 150898 - protein, 80 aa, Triticum aestivum
  Clone ID: PAT_TA_45316.pep
LCSLLGNELSGSGIGASVGAEQCGKDLVELQKIVDQLYENSSKPLVLAPGGFYDKQWFAKLLDVSGPNVVRGMTHHIYNL

SEQ ID NO: 150899 - protein, 66 aa, Triticum aestivum
  Clone ID: PAT_TA_45317.pep
SFNNFSLWWLRGPRLLGFHLTCFFFVLGIFFFIGASEIFAVPSSYTLCFFTTLALGDFLLFFILPF

SEQ ID NO: 150900 - protein, 65 aa, Triticum aestivum
  Clone ID: PAT_TA_45318.pep
VKVIQEQLRPWSDLLPHIVSAKPDEETDTRGGAGPFVRAFGAHRPKRPGESVRHPRTSWLSLRGR

SEQ ID NO: 150901 - protein, 107 aa, Triticum aestivum
  Clone ID: PAT_TA_45319.pep
MAPIKIGINGFGRIGRLVARVALQSPDVELVAVNDPFITTDYMTYMFKYDTVHGQWKHHEVKVKDSKTLLFGEKEVAVFGCKNPEEIPWAAAGAEYVVESNGVFTDK

SEQ ID NO: 150902 - protein, 110 aa, Triticum aestivum
  unsure (1)..(110): unsure at all Xaa locations
  Clone ID: PAT_TA_45320.pep
VRPQFWRRVDTLLCASQLQICGPRGPLKIGINRFGRIRRLVARVALQSPDVELVAVNXPFITTEYMTYMLKFDTVHRQKKLHERNVKDSKTLLFCEKEVAVFGCRNPDEI

SEQ ID NO: 150903 - protein, 102 aa, Triticum aestivum
  Clone ID: PAT_TA_45321.pep
VRSSTSSQQAANGSSNSDGGGLVTSQSRESSYGSKSQQGTEVSAEKQRLAASLFGSSAAKPNRKGHTGRKAAKESSSTEKVTPQPAKEQVTPAAPPPDLLDL

SEQ ID NO: 150904 - protein, 135 aa, Triticum aestivum
  Clone ID: PAT_TA_45322.pep
VRPRVRKKKKKKKKKKKKKKKKGKGGRSNKIQTYIHEHTGGGPFKWSNLNSAGWPGVFPFFGWQNPNPPALILQRGDWENPGVPHFNGVRNIPLSQQWRNTEEALTVRLSKNFNHLNCEWDPPFYRPLSPGGWGG

SEQ ID NO: 150905 - protein, 59 aa, Triticum aestivum
  Clone ID: PAT_TA_45323.pep
LSYVYFRRNRGARPKEGRVFRRGQKRNLPSIKRNGAKIQIQGQAIQGQIMMQRLRLLRR

SEQ ID NO: 150906 - protein, 76 aa, Triticum aestivum
  Clone ID: PAT_TA_45324.pep
SGEREGGRSSWLRPLAYIEVWERSTTSIKADPLGEDHHKEAFRIEQTARAGDPSPRPRAYLQTPVRQTQVWNVSNV

SEQ ID NO: 150907 - protein, 76 aa, Triticum aestivum
  Clone ID: PAT_TA_45325.pep
VTANVREPRRLNAITRGPPQGGNIRPPGLAITTVRPRLPLHLHHLFLLVIHLLPVGAGRGRGRGRVCLHDNTDGRT

SEQ ID NO: 150908 - protein, 122 aa, Triticum aestivum
  Clone ID: PAT_TA_45326.pep
MAEADAQTQSNAHSSSPPAEASGEPIRPPQVGAPSAASPTFPLMYPMLVPGMFSQQGMDDQPQGPGIYAIQENQFMGAMGGYAPKTFIPLAYNIPTESVGALAGEEQGQDARQQKGPQRQVV

SEQ ID NO: 150909 - protein, 122 aa, Triticum aestivum
  Clone ID: PAT_TA_45327.pep
MRVVSAATGAMGPVMGKLVALLGDEYRRLRSIHTEIKTLTRELETIDAFLENMAEAEEPNPQDKAWMKEVRELSYDVEDNLDEFMARVVADKSFKPEGLVDNIKIKLKRLKARHEIAKAIED

SEQ ID NO: 150910 - protein, 48 aa, Triticum aestivum
  Clone ID: PAT_TA_45328.pep
RPISLNKQRLVKASGFYGADHGQLISLFSCNPKLGDWELSSRKFVGAT

SEQ ID NO: 150911 - protein, 131 aa, Triticum aestivum
  Clone ID: PAT_TA_45329.pep
RPFVPPVVSPIRRLHPNPNGSWSPRRRCLLHLACRIPAVVLACTWQVLRLFLPSGQTRGARSLTLARNPQSWLGFRAGHRLRRRRGSGGFRRHLYVFFLAPTRDCTSRCSWGLPAAEPSFLPGCRRPEQRH

SEQ ID NO: 150912 - protein, 82 aa, Triticum aestivum
  Clone ID: PAT_TA_45330.pep
RPVFDALVIYLLGVQHVVYWFELIEASSQVAVGAAAPSMAPCPYRVSAFKKAVRMFAENPSNNVITPALGTSIDSLGEAYNL

SEQ ID NO: 150913 - protein, 112 aa, Triticum aestivum
  unsure (1)..(112): unsure at all Xaa locations
  Clone ID: PAT_TA_45331.pep
HAFADAWVRILVTGGAGFIGSDRVDKLMENEKNEVIVADNFFTGSKDNLKKWIGHPRFELIRYECTEPLLVGGGQIXQLGWPCLPIFYKHNPCKNIKTNGIGTLDMPGLAKG

SEQ ID NO: 150914 - protein, 48 aa, Triticum aestivum
  Clone ID: PAT_TA_45332.pep
CSDSWADSWPDALLHVQPPISVGGLLHAGALALTVVAAPIPLSLAPTL

SEQ ID NO: 150915 - protein, 82 aa, Triticum aestivum
  Clone ID: PAT_TA_45333.pep
RPDDQSLQNALFKYGDVIDGKVITDRETGRSRGFGFVTFASDEAMRQAIEAMNGQDLDGRIITGNEAQSRRSSGGERMLLLW

SEQ ID NO: 150916 - protein, 94 aa, Triticum aestivum
  Clone ID: PAT_TA_45334.pep
RPPTRTLTRGGRVGQILDMGDGEAHFHMKHSAFLYNLGSQTLPKTHHCFYMRVTLEYFKSPSLDSDVYPARKFNTPNHRHYVILSKNVLAAFVV

SEQ ID NO: 150917 - protein, 94 aa, Triticum aestivum
  Clone ID: PAT_TA_45335.pep
HRHHRPLTQLTHAYLTNYACTRTCSNKLLLATCMAPALEQLLNGRKTEPLHAPKTAARLAAQLHARSLGEYNDVVPTDHAKSRLWLIISPLILT

SEQ ID NO: 150918 - protein, 135 aa, Triticum aestivum
  unsure (1)..(135): unsure at all Xaa locations
  Clone ID: PAT_TA_45336.pep
RPVGSGSKHAAGGSGGGGGGERRKYPIRAEDYELYEEIGQGVSAIVYRALCRPLGETVAVKVLDFEHTNSNLNNIMREAQTMILIDHPNVVKAICSFANNQTLWVVMPYMAGGSCLHIMKSVYPDXFEEAVIATL

SEQ ID NO: 150919 - protein, 113 aa, Triticum aestivum
  Clone ID: PAT_TA_45337.pep
RPRTRGWDLVKSTAWFRDHWYHQHQQLDDMADSLIAFEAEDAIAVEASQPQPQPPAALNIDGVLKALSLASPSPKGGDALRGFSEKPRYTEKPTKYAGSPRSGGAPRFIHQPR

SEQ ID NO: 150920 - protein, 73 aa, Triticum aestivum
  Clone ID: PAT_TA_45338.pep
VRGRVGLRINYHDIHGTSSAPQFLVDCKSIVHRYGGTFLRLPKQISYVFHEPLAFTHFRRTQLSPAVQVWMNG

SEQ ID NO: 150921 - protein, 95 aa, Triticum aestivum
  Clone ID: PAT_TA_45339.pep
LERQPLSSSHSRPNIAARPATHRLLSPIPRASLHLAAGCPGPKPPYAPQHRAGGRGARQRRPVTRARCMNGGRIWPCWSIWGEEEGRSSSVVGRW

SEQ ID NO: 150922 - protein, 145 aa, Triticum aestivum
  Clone ID: PAT_TA_45340.pep
GPRVRAAAGALEHLYLRMGSIRARMPELASLVTLVLSRVRVTGEDLGHLLYSCHRLQSLKLKRCEDLAYLKVPPDRLKQLRTLVVKSCWSMREMDISGSSVESLRFEGRHMPGTLLCGSGGPALRVTSAEFDLEQLIAPAESEAT

SEQ ID NO: 150923 - protein, 121 aa, Triticum aestivum
  Clone ID: PAT_TA_45341.pep
RRALMWSIFLVKLLNLTRKSSIILLSESASSERQCIMTPSSTRWRRSRVSGCGWVSRAPLENTIVVYTKCRYVAFSAGHGEAGVRARTAEEAGRRIHTGGEENAGAAGGGRRAELRRRAAG

SEQ ID NO: 150924 - protein, 114 aa, Triticum aestivum
  Clone ID: PAT_TA_45342.pep
AWGRFSLRRAFPPGQRDRWLRAGSLARLQDLEIAYTRVHGDACHPMPPSALCFAPTLRAAKFGGCEFPELTAPSPKFPRLKQLTLCRVSISEDSLHGMLSGCIALESLSLDRNI

SEQ ID NO: 150925 - protein, 68 aa, Triticum aestivum
  Clone ID: PAT_TA_45343.pep
VRTSLGNFSSLIHSGFPHSGRGGLDLGAAIARRPAVRPFSQRGGRCHNLGIRRWLQRHVLTLNADNFY

SEQ ID NO: 150926 - protein, 83 aa, Triticum aestivum
  Clone ID: PAT_TA_45344.pep
LLSITEHTSYEQLHCSSATYNYSMPCSSLRERTKSHITPHLIHLTKLKHNTIYAISLDRIPCSSSTLLTKAFYPKQAEACASK

SEQ ID NO: 150927 - protein, 98 aa, Triticum aestivum
  Clone ID: PAT_TA_45345.pep
TSAPASVKPCEQAPLLPQLPPCPCTPVPSPYSVPRRSPPAVDRLGDRISGGSPGPARIWGMGPMELNGLVEGLGVSRSRRGFKPSSPAKYDLFVVTGF

SEQ ID NO: 150928 - protein, 75 aa, Triticum aestivum
  Clone ID: PAT_TA_45346.pep
MAKEVSEEPEHAAPAHKDYSDPPPAPLFDMGELRMWSFYRALIAEFVATLLFLYITVATVIGYKVQSAADPCGGV

SEQ ID NO: 150929 - protein, 67 aa, Triticum aestivum
  Clone ID: PAT_TA_45347.pep
MEQGAARQDEARKEREAPPPVPFPRENLERDLKLPSRVVSLVFGGDISTTAQAFEKWVSLVRLRSGT

SEQ ID NO: 150930 - protein, 110 aa, Triticum aestivum
  Clone ID: PAT_TA_45348.pep
FPPLGPRGLTTPSAHLSFSASLVSGLWREITVTAWAMASCRSCRSSSPAATGLLLAGRRNLTSMVRASCLKITLAFALYIALAAAVLLQLAAKASRSKRRRKAAPTRPRT

SEQ ID NO: 150931 - protein, 61 aa, Triticum aestivum
  Clone ID: PAT_TA_45349.pep
VVPQIFSLLKAQRYYFLLEKHNFKSESATTTEQNPRNEIHLQSNTTQKNSSRSCRTRGSFR

SEQ ID NO: 150932 - protein, 103 aa, Triticum aestivum
  unsure (1)..(103): unsure at all Xaa locations
  Clone ID: PAT_TA_45350.pep
ACSVLPGKTHATDHAFGTGSDWFRSFDFCERNGYVMGVVTDVIHEPWRGAPMIKVTLWHPDRYKHQTELYVDAEAMYTDQLRYCGRQATLXSCNVLPIRSAPE

SEQ ID NO: 150933 - protein, 82 aa, Triticum aestivum
  unsure (1)..(82): unsure at all Xaa locations
  Clone ID: PAT_TA_45351.pep
RPARSWATSLETIGCASEICSGETGSLTTNLMXIEELVVIGDALRKVRSLKVDCTSYDPSVGPGPRSSAGRRNANLEMIAKV

SEQ ID NO: 150934 - protein, 78 aa, Triticum aestivum
  Clone ID: PAT_TA_45352.pep
GPITEARIECRPPRVVNRRSIPLTGTMFSSSAPIARGAGMAISSNSFTSLVRSPLDRSTPVFLISASRRPVSHGAKNF

SEQ ID NO: 150935 - protein, 104 aa, Triticum aestivum
  Clone ID: PAT_TA_45353.pep
SNDPGKSPKCMSNQTQRRSPLKAALICLPSISVIPPPPPQTNHSAPPIPPPINMCHHGHRINFAVSLRSPTRDLEDGRRARGLEGIRNIAAHASAHASAHAWVA

SEQ ID NO: 150936 - protein, 124 aa, Triticum aestivum
  Clone ID: PAT_TA_45354.pep
RPSTACPHLIRIDLVVLRHGWADGRAALSSTPPLEDRPLASVLPPAMSSNKVADHWCLSERQGHHLQSNGAIDLELDGGTASLHSEIGVTKGYTRVKRSPQMADLMVPVRTIRPLSCISRGQLI

SEQ ID NO: 150937 - protein, 124 aa, Triticum aestivum
  Clone ID: PAT_TA_45355.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGK

SEQ ID NO: 150938 - protein, 69 aa, Triticum aestivum
  Clone ID: PAT_TA_45356.pep
LASNLVGTDYTVAMVLNRIHADQPPSVEKCQQLYKRGVYTRIFSLPGHYEALRTEVDGVTHLRKNRTEL

SEQ ID NO: 150939 - protein, 44 aa, Triticum aestivum
  Clone ID: PAT_TA_45357.pep
MSDTDEHHFLSKADSGAFKTYPHQAVAIRKGGHIVINARPCKVV

SEQ ID NO: 150940 - protein, 49 aa, Triticum aestivum
  Clone ID: PAT_TA_45358.pep
CRCHGDSIHHHRIFGITLSFISRHPPPKHVRALTRVRPFCSCSPRVRGR

SEQ ID NO: 150941 - protein, 37 aa, Triticum aestivum
  Clone ID: PAT_TA_45359.pep
DVLLIHYRRPSHGVLVSTAVRLPKSQFVELEVCLSVV

SEQ ID NO: 150942 - protein, 67 aa, Triticum aestivum
  Clone ID: PAT_TA_45360.pep
RVGPTPLFALRPTRRTDHGRDRRRCLKCIHSCIVLNVSNYLMGVECGYLLLYFCYTTMLCIKVIYAL

SEQ ID NO: 150943 - protein, 80 aa, Triticum aestivum
  unsure (1)..(80): unsure at all Xaa locations
  Clone ID: PAT_TA_45361.pep
MGPDMETEEAASLSPDDAVLFFGVVLVLGIGSRHLLRGTRVTYTVALLVLGVVLGGLXSVMKHGLGMLGSGILMCAAIKT

SEQ ID NO: 150944 - protein, 169 aa, Triticum aestivum
  unsure (1)..(169): unsure at all Xaa locations
  Clone ID: PAT_TA_45362.pep
KKRRKAKNYNKTKKKKSIKKKKKREKKKKKKRKKKRKKKNKKRKEKKNKKKGKKNEKRKNKKKKREIKKEKKKKKRKEQNEEERVKDKXKKRKKKSKTRNKREREKKRNTEKENRKEKNKQRTRSNRKSFIGTKDHATGALLPLGAGAPWRPWLAGAGGRSGLGWREPG

SEQ ID NO: 150945 - protein, 78 aa, Triticum aestivum
  Clone ID: PAT_TA_45363.pep
EFETMGLFASQPATALQKHCLARWPLIGSRFFGYAPKMRMPCEVSTLCRGYFGPCWRGKNFYRAILKKWLPLAFLHRR

SEQ ID NO: 150946 - protein, 103 aa, Triticum aestivum
  Clone ID: PAT_TA_45364.pep
MRSKANGDTAFKASGKNKTATGGVAKPKRAPTPFFAFLAEFRPQYMEKHPEAKGVAAVTKAAGEKWRTMSDEEKAKHGGKMAYASSSKAVYKKESTSLQEDQD

SEQ ID NO: 150947 - protein, 54 aa, Triticum aestivum
  Clone ID: PAT_TA_45365.pep
SARVRRRLLMLNLKLDSTLLLVCRRPTSPSILYIIIDYLSIQCIYFITFILLSF

SEQ ID NO: 150948 - protein, 58 aa, Triticum aestivum
  Clone ID: PAT_TA_45366.pep
LNVKCQSTGIVGLCESYSGGPPLAHWHTRCESPAGLIHPPCENPKTRQGKPTPRVRGR

SEQ ID NO: 150949 - protein, 128 aa, Triticum aestivum
  Clone ID: PAT_TA_45367.pep
SVLFLRGRGNFQEITQEKPFLCLTGPSRAILAKDHVDLEVQLKLKGPTESEDRVLITKRCQYSGYHTDNGLYTLTLNNRLCTTELSLQQLYCQSVQATFLRVGGFVKGNTSPFIHGGRVACFLPSYGG

SEQ ID NO: 150950 - protein, 67 aa, Triticum aestivum
  Clone ID: PAT_TA_45368.pep
MLFSHAHAAVALRLVEALSRKNQLVLVRRVVRHQLHEVALAGVVRHASFGTLEPFFSSHGLVAGSCF

SEQ ID NO: 150951 - protein, 69 aa, Triticum aestivum
  Clone ID: PAT_TA_45369.pep
RVRRHRHARAPHLRALSFGLWEVLEGGSVHEWGGEGDGGGRWGKAWRSAKRAGRAGWTVAHASAYAWAD

SEQ ID NO: 150952 - protein, 82 aa, Triticum aestivum
  Clone ID: PAT_TA_45370.pep
PPSPLKVLTSRRKRQPNGGPWIRTEKDRRSSDSPRDSCELKSGASIDRSGGQKLVRCSVFPHSPGFFLVQPPPTRPPTRPRT

SEQ ID NO: 150953 - protein, 72 aa, Triticum aestivum
  Clone ID: PAT_TA_45371.pep
RPLATALTRPRRQASRLTDAVDRNTPVKISSACYARQKSLSLQAYRIEYMKTASTVGYPNSRTHACYDIAVL

SEQ ID NO: 150954 - protein, 49 aa, Triticum aestivum
  Clone ID: PAT_TA_45372.pep
NTQPHRGQAKMSHRGKGGNGLFKGGAKHQRMVLCNTIQGITKPALRALD

SEQ ID NO: 150955 - protein, 49 aa, Triticum aestivum
  Clone ID: PAT_TA_45373.pep
VIGVEDTHGLHHGVPPNRQAWQVGEAAHELPVVARRTGRSWRSAYESAD

SEQ ID NO: 150956 - protein, 133 aa, Triticum aestivum
  Clone ID: PAT_TA_45374.pep
VRDNAVDEIKTGATRIMVDKIVNKRNGSPALLVQDDGGGMDPDSMRRCMSFGFSDKQSGSSIGQYGNGFKTSTMRLGADAIVFSRCMKGSGPTQSVGLLSYTFLAETGQKDVVVPMVDYKYDLLTDAIQYERH

SEQ ID NO: 150957 - protein, 59 aa, Triticum aestivum
  unsure (1)..(59): unsure at all Xaa locations
  Clone ID: PAT_TA_45375.pep
MSLIAGEEFQHILRVLNTNVDGKQKIMFALTYIKGVGRRFSNIVXKKGYIDMNKKAGEL

SEQ ID NO: 150958 - protein, 102 aa, Triticum aestivum
  Clone ID: PAT_TA_45376.pep
VRGRVGGRVGNSHDHSLPKVRHKNEDQLEEGFPIPTCLALPVVAALFLPFHTSIISSPRRLRRVLAFAKMALALRLLLVFLAIGSCIAADHIDLWPMPQDGV

SEQ ID NO: 150959 - protein, 50 aa, Triticum aestivum
  Clone ID: PAT_TA_45377.pep
RPGTDSVPSLARTKLLICVVFETVKQWIGTDSILNTVYLMIYHCKKKKNK

SEQ ID NO: 150960 - protein, 114 aa, Triticum aestivum
  Clone ID: PAT_TA_45378.pep
RPATPTDMTARQLAGTSSSGVVNNGIQFVDITCPRNPGVSPFKVVVDKDCGHYKYYDTLIAEEEKVHAQTEDADALKIVNLSTGSFIAHTGHTEAYLNTDLTIKRLLPLYMVHM

SEQ ID NO: 150961 - protein, 93 aa, Triticum aestivum
  Clone ID: PAT_TA_45379.pep
GTVRFGSTRSGPGRARDPDATAAGITPVIDQRERPRHLSVNGAAMRRSAASGRVGRESTMAGASSAGHSTTTPRHLSWVAGERSMAPLLSVER

SEQ ID NO: 150962 - protein, 118 aa, Triticum aestivum
  Clone ID: PAT_TA_45380.pep
VRLTRYCECRALGSQCGTGCGCNASKCSNRMRVVKEEIDDEPPSEKEGSEFGNVSSSGNDAKMKEEVKQGIMLLENAVAEKETQQPKSRKPLADIGNNDAKQAGAKPKQRKNWRKSAT

SEQ ID NO: 150963 - protein, 63 aa, Triticum aestivum
  unsure (1)..(63): unsure at all Xaa locations
  Clone ID: PAT_TA_45381.pep
MSKQGGKAKPIKQAKXARKDYNKNDLPYLQKKKDEQKALNELXAKAGQKGALGGSGLKKSGKK

SEQ ID NO: 150964 - protein, 82 aa, Triticum aestivum
  Clone ID: PAT_TA_45382.pep
RVRRPSRLGPCWDALLPEQHCAGGGAGDASPRLQPAIQTFSNCGGVGGDASPVEDQERPGHPHVRVAHQRRYMHWPLVPLRQ

SEQ ID NO: 150965 - protein, 118 aa, Triticum aestivum
  unsure (1)..(118): unsure at all Xaa locations
  Clone ID: PAT_TA_45383.pep
FDLDNHGHYWCITSLKKDVWKGTLWFERSLYGFQXHDPVHSSGGRHSVCGGVTGLDRGHGAKSGILXNYAAGGASFEKIYLLQDTTDVFFVDHLLKIRLFFLLSSPLGRTFKPPPRVF

SEQ ID NO: 150966 - protein, 89 aa, Triticum aestivum
  unsure (1)..(89): unsure at all Xaa locations
  Clone ID: PAT_TA_45384.pep
MARKRKTDAAPRLDDADLTLYCRFCGADNSLFQLYSQAMAXYKMFFXAGERXALEKFYQWILRKHYEVLXFTVVYIMLHIQHVIDYGGY

SEQ ID NO: 150967 - protein, 109 aa, Triticum aestivum
  Clone ID: PAT_TA_45385.pep
SGRAHTLFPSRCSGLRHQHKDQAPAAFVPNQIFKIYCRASEDYCLAVRDGEVVLAPVNPKDETQHWLKDMRFSTTVKDEEGMPAFALVNKATGLAVKHFIGQSHPVKLV

SEQ ID NO: 150968 - protein, 104 aa, Triticum aestivum
  unsure (1)..(104): unsure at all Xaa locations
  Clone ID: PAT_TA_45386.pep
RPRTRGLRNNALTTIHGIENLTSRVWXLDLSYNIISNFSELEILGSFSLLQNVWLEGNPICCARWYRARVFSFFHNSENLKFDDXGMVTQEFWDKSVCFEADKN

SEQ ID NO: 150969 - protein, 60 aa, Triticum aestivum
  Clone ID: PAT_TA_45387.pep
VRGRVGSPAAASASARAAGGGAGSTFRAFVPAPRCPFWSTFTAAPSCVELGFNPIYYVFL

SEQ ID NO: 150970 - protein, 42 aa, Triticum aestivum
  Clone ID: PAT_TA_45388.pep
MALLRVEIKSLGSAESPLGSFRNHSPLVGYLGCKEFEIISSV

SEQ ID NO: 150971 - protein, 63 aa, Triticum aestivum
  Clone ID: PAT_TA_45389.pep
ADDLFPLFDKYGEVVDIYIPRDRRTGDSRGFAFVRYKYEDEAQKAVDRLDGRLVDGREMMVHF

SEQ ID NO: 150972 - protein, 119 aa, Triticum aestivum
  unsure (1)..(119): unsure at all Xaa locations
  Clone ID: PAT_TA_45390.pep
MFSMNTNGQEDEYPEERVPHLSWMLHPVDIYSFSGCPVTSLHRLDPRLSEVVQGMGIXSFFPVQVFTWLETIGPGAFQRDICXNSPTGSGKTLAYALPIVQMLSTRKVRCLRAFVVLPT

SEQ ID NO: 150973 - protein, 53 aa, Triticum aestivum
  Clone ID: PAT_TA_45391.pep
RPAVDRAAGRVLGRLRGRDQAGGVRAGARRVLRRHGRRSRARACPGTGDGGEG

SEQ ID NO: 150974 - protein, 109 aa, Triticum aestivum
  Clone ID: PAT_TA_45392.pep
RPPTRPRTRGKISSTIGGESICEFRPRAGDGRRRRRRWAVVSAGVRTLCSSVLRSVSPPVIVIFFFLLFLFSLFFFISSFLLFFLLLIFDLFEVIFYSFFVFISIFSLF

SEQ ID NO: 150975 - protein, 72 aa, Triticum aestivum
  unsure (1)..(72): unsure at all Xaa locations
  Clone ID: PAT_TA_45393.pep
VRGRVGGRVGGRVGGQLALASIASVEVDEGLSSQDARAKVQDKIKXLHTVREKTLTQSLKDRLQPYVDGLKD

SEQ ID NO: 150976 - protein, 71 aa, Triticum aestivum
  unsure (1)..(71): unsure at all Xaa locations
  Clone ID: PAT_TA_45394.pep
QSDTYPIRAGVGRTKQTARMSTAWKAPRKQLVTNAGRKLAPXPPACVKNPHLFMPVTVVLREIRKFQKSTE

SEQ ID NO: 150977 - protein, 55 aa, Triticum aestivum
  Clone ID: PAT_TA_45395.pep
SLRSTLDRTRGSPFCITFTGVMSTTLAGEMSPLCAALEGEEPTGRVSGIDKGSAD

SEQ ID NO: 150978 - protein, 72 aa, Triticum aestivum
  unsure (1)..(72): unsure at all Xaa locations
  Clone ID: PAT_TA_45396.pep
VRSRVRKSAAIFIGTGEHIGEXDICDVKPLGCRLLGMGDSTGLMDTTQDVMPADQQPELLAKLAEGTFTQRL

SEQ ID NO: 150979 - protein, 64 aa, Triticum aestivum
  Clone ID: PAT_TA_45397.pep
RPSSRETSSFDHSIDPTFLDRWATIPSVALPASQLRPNSDRDERVEVYGHADLWACGGGRGIVA

SEQ ID NO: 150980 - protein, 43 aa, Triticum aestivum
  Clone ID: PAT_TA_45398.pep
FTAKHHSCLSFYSRQRLPLIRSTARLSDPFMGRLEEVTVYTKE

SEQ ID NO: 150981 - protein, 98 aa, Triticum aestivum
  Clone ID: PAT_TA_45399.pep
SAHAYVHAFAHASDPTDLDRWATTPPLPSPASQLRPNPDRDERVAVHGHADPRARGGGRGIAAFLRWEQRPRPAVRSDSPSPTRGRPDGLTILICPNV

SEQ ID NO: 150982 - protein, 48 aa, Triticum aestivum
  Clone ID: PAT_TA_45400.pep
MDGGGCRGGTSGDDGKQEKHLVLAHKLFLVFHPDVGDLSKVDLRSTFY

SEQ ID NO: 150983 - protein, 50 aa, Triticum aestivum
  Clone ID: PAT_TA_45401.pep
SPVFKERDSPHLSSPIDDDESLPLCVTYSSGYIHLQLLQARYPLQTLICS

SEQ ID NO: 150984 - protein, 91 aa, Triticum aestivum
  Clone ID: PAT_TA_45402.pep
LSHRVGIRGDGAGGDGLQQRQGPRRWGRGPADDSGAGAWGFAAQHPPSGGEDQPHLQQRQDHRALGARHHPRASGYHWAQPIPFGPTLRRR

SEQ ID NO: 150985 - protein, 88 aa, Triticum aestivum
  Clone ID: PAT_TA_45403.pep
LLITNGANLLYYKPALDTGPAAPASGCLRYSWRPRRERRIAGDRRGQTRGGSLFGHGRLGRLSRAVGAHAEGLGVATDTVHSKLGLTR

SEQ ID NO: 150986 - protein, 128 aa, Triticum aestivum
  Clone ID: PAT_TA_45404.pep
RTPHPTQIGATLAGGILLHHRPNGFLQACSASRTSATAEWLAGDSRRRRRERRIAGDRRGESRGGSRFGNGRLRRRPGAVGARAAELGEATARGHCEFGFPRCNCHGGAVDPACAPFCGRADRAFYER

SEQ ID NO: 150987 - protein, 56 aa, Triticum aestivum
  unsure (1)..(56): unsure at all Xaa locations
  Clone ID: PAT_TA_45405.pep
MDSVSAASLPTSSGAGXNLLLILYIVLYYTRLFIRRDRQLGGLSLCVSGTVPFFYL

SEQ ID NO: 150988 - protein, 123 aa, Triticum aestivum
  Clone ID: PAT_TA_45406.pep
VILDRLKPSLEQSDSDSPSHTICRPKPAPRTSSHGSTTQHEWLPVALHCSVDGASKQPRRSFNALRGASMQLWRRFIATRRSFRRRHDASLQLQRSRRWSTPATHQASSMAAPAAGGCCDAGR

SEQ ID NO: 150989 - protein, 64 aa, Triticum aestivum
  Clone ID: PAT_TA_45407.pep
EHIKHTMYIIKLCRSVTVVDRQLIKHSFKMVQNVETTVGNGNVVDAIQFGLCFVLLHIRRMKRV

SEQ ID NO: 150990 - protein, 101 aa, Triticum aestivum
  Clone ID: PAT_TA_45408.pep
FPLGRSVPAISTTSLHIHLLIENKQQSQSRLMPPVSLITLLTESVLWHARVLQVRSVIWYLRINRGTTRSNALGAMVILGRLHGNRRRGLNSSLSGCRRPD

SEQ ID NO: 150991 - protein, 70 aa, Triticum aestivum
  Clone ID: PAT_TA_45409.pep
RVRGCFIGINISFIVIIIFIHVSKFSPALGHFLYRSISVCFHILYITVYRFIQLYDLYHRSSRQGSILGC

SEQ ID NO: 150992 - protein, 55 aa, Triticum aestivum
  unsure (1)..(55): unsure at all Xaa locations
  Clone ID: PAT_TA_45410.pep
LAVVKIVHDANPQRLXEYKVYGLPPFILFKIGQHLPYTSREGAIIKFKLREFVYT

SEQ ID NO: 150993 - protein, 65 aa, Triticum aestivum
  unsure (1)..(65): unsure at all Xaa locations
  Clone ID: PAT_TA_45411.pep
ARLTVVKINHDAYPQLIGEYKVYGLPPLILFKNGQEVPESRRLXAIHNSKLIEYVDALLESKTVS

SEQ ID NO: 150994 - protein, 90 aa, Triticum aestivum
  Clone ID: PAT_TA_45412.pep
RPRTRGFCNQEKHRNEESSSVDASQWRNIKQHVLPYGSSRPLTRKLSLDASSSDSRGMEASTSMSSESTSVVINVPKLAEVREITTLDYC

SEQ ID NO: 150995 - protein, 62 aa, Triticum aestivum
  Clone ID: PAT_TA_45413.pep
MAAAALANGDVRAGGGGAVPRPTNPMVTPLLTDLYQFSMAYAYWKAGKHLDRADFDLYFRKS

SEQ ID NO: 150996 - protein, 65 aa, Triticum aestivum
  Clone ID: PAT_TA_45414.pep
MRSTDSSSRFVQELVLYAASAALSCLVLFAGLRQLDPNRESSKKALQHKKEIAKRLGRPLNSTTP

SEQ ID NO: 150997 - protein, 102 aa, Triticum aestivum
  Clone ID: PAT_TA_45415.pep
VRGRVGGRVGPMVGRWTRQAPPPLLHTRGRARMQAWPPLPREWIYHCWFQSHHLCYNPTHIHGCLKEVFKMNGYRQQRADQLRGAQGCSGAGGCKVISDSSC

SEQ ID NO: 150998 - protein, 91 aa, Triticum aestivum
  Clone ID: PAT_TA_45416.pep
MFYSHQLLARKAPLGQIWMAATLHAKINRKRLVKLDIIKICEEILNPSVPMALRLSGILMGGVVIVYERKVKLFYDDGCRLLIEINRALED

SEQ ID NO: 150999 - protein, 128 aa, Triticum aestivum
  Clone ID: PAT_TA_45417.pep
RPRASFSRLLRKVSIEDAKEYSRMSYLCNIAYMIPKIQPKCLRRYSLQFVTTSVQEKDRANPDRKQEQSTEKGESPDKKPRVVKNAAAALGSKEEEGNGLAINPFGAYQVMSSAASYLHFRAMGINPF

SEQ ID NO: 151000 - protein, 124 aa, Triticum aestivum
  Clone ID: PAT_TA_45418.pep
SGNFGCSEGLIGDGTFDCSVDHEKYSSMYGPTTGDKIRLGDTDLFAEIEKDFAVYGDECIFGGGKVLRDGMGQSAGYTASASLDTVITNAVVIDYTGIYKADIGIKDGLIIAIAKAGNPESWMV

SEQ ID NO: 151001 - protein, 94 aa, Triticum aestivum
  Clone ID: PAT_TA_45419.pep
SADAWADAWARLDGGVGKGVPTTNYVMPLDTTTGMTRPLVEILRDLNKRVRDKIIYPYTNTLPWYHANRMLSFYAPGWCGEARYVLYYNSLSVT

SEQ ID NO: 151002 - protein, 96 aa, Triticum aestivum
  Clone ID: PAT_TA_45420.pep
VRPRVRGRVGDICFEVCDGGLHTDAIHRGGGHDIPTARRGIYASQLTDKPRLLEPVYLAEIQAPENALGGIYGDLNHKRGHVFEEMQRPRTPLVNI

SEQ ID NO: 151003 - protein, 65 aa, Triticum aestivum
  Clone ID: PAT_TA_45421.pep
TVFHCLLPSSYSTMDIEPANPSVLLRMASSSTAPSSLSSMAPSLSFSSSLQDDNPANTPAQHERT

SEQ ID NO: 151004 - protein, 125 aa, Triticum aestivum
  Clone ID: PAT_TA_45422.pep
TRRRHAVAIRPARWRPIHSPTDCNGSAWLRSCSTAAPRRRASSHSSSTPLIPGSTPCKQPQQLDAAPPWLDAMQAAAVARPRARSNTSVQLGTPCGAPPPGVGRGSLGRGLHDGVALLARTRGRT

SEQ ID NO: 151005 - protein, 100 aa, Triticum aestivum
  Clone ID: PAT_TA_45423.pep
VRGERDRESKKKNGMAMAPPRLLRGLIAPLSPLHQELVTSAALLHRWWLARLRCSDGFKLFLVVLLVFGALARVRYVGYASMAPTVRTVDRSGPEKVSYM

SEQ ID NO: 151006 - protein, 112 aa, Triticum aestivum
  Clone ID: PAT_TA_45424.pep
MAMSDALPNVLEDGDLLIEILLRVGSPTTLVRAAIVCKRWYHHAFDPRFLHRFHELNPPRLLGFYFQAMRAHTAPRFIPMLPQPAELASVIRHESFSLESYHNSFVMDWRNG

SEQ ID NO: 151007 - protein, 44 aa, Triticum aestivum
  Clone ID: PAT_TA_45425.pep
SSLLGSTRAYPPMWYAIITGCTETPTDGFEHRERGRGEPTRPRT

SEQ ID NO: 151008 - protein, 101 aa, Triticum aestivum
  unsure (1)..(101): unsure at all Xaa locations
  Clone ID: PAT_TA_45426.pep
SGDDIWSELXRSVTSNMAGSEGTLALFIGRKRCFACAGVFIDCNGSTTRVLTSASVDRTSDDENTAADNLKIVVCLTDSRRTTGTLQHYSLHYHIAVVHIM

SEQ ID NO: 151009 - protein, 51 aa, Triticum aestivum
  Clone ID: PAT_TA_45427.pep
RANVCILSFALHKRMILFFKHGSRYGLSGIPASSPTNRATSKSRMNTSTIH

SEQ ID NO: 151010 - protein, 57 aa, Triticum aestivum
  Clone ID: PAT_TA_45428.pep
SFYRRWTKNQDTVTLEEVLQPGKDMIAAGYCMYGSSCTLVLSTGNGVKREAAHASAD

SEQ ID NO: 151011 - protein, 42 aa, Triticum aestivum
  Clone ID: PAT_TA_45429.pep
MGNIMNQRTWAYYKRFQVKFKRRRQGKTDYRSRLRLTNQYEN

SEQ ID NO: 151012 - protein, 93 aa, Triticum aestivum
  Clone ID: PAT_TA_45430.pep
NMGKKSTRPDKANQWPLPSVKPAKKRSCLCTTTVVLSSGPRPINRTRTTTTLTASTAPACPCSLLLVARPSTRRKRMTSRLTVDPSISSLQAD

SEQ ID NO: 151013 - protein, 72 aa, Triticum aestivum
  Clone ID: PAT_TA_45431.pep
MGDHNLVEKETALIEQFKITGTEVVKKMTAAMSFMSFKMRELFLGQTSADKVVEDATYETLGGPDWAMNLEI

SEQ ID NO: 151014 - protein, 103 aa, Triticum aestivum
  Clone ID: PAT_TA_45432.pep
PHRSHDPCIRSKFLQYCFTSLFSLVLTNIISSAFKYNFMCLSSKALHYCSSDRPNCHHHSSPPWHHLLHLPGIQLERHEKILVLVGEGASEHGSLGNIRWPLG

SEQ ID NO: 151015 - protein, 51 aa, Triticum aestivum
  Clone ID: PAT_TA_45433.pep
VRPRVTATRSIKMAVYGGESSGGEGCSTHSCLFRPPSSKSCKSTQEPVLKN

SEQ ID NO: 151016 - protein, 81 aa, Triticum aestivum
  unsure (1)..(81): unsure at all Xaa locations
  Clone ID: PAT_TA_45434.pep
MADQITDDQIAEFKEDFILFDKDXDRLMTTKELGTDMRTLRHNPTKAELQDMINEVHADENGTIDFTKFLNLMCRKMKDTD

SEQ ID NO: 151017 - protein, 91 aa, Triticum aestivum
  unsure (1)..(91): unsure at all Xaa locations
  Clone ID: PAT_TA_45435.pep
RSEPRRHARSHPSXARSPYPLPRRPLLSGAGHSLSSSPPPSSPRRRPLPLPVAGLFHRPFLPTTPPSLTPVKKIDSFCVFDELLCDGGMDV

SEQ ID NO: 151018 - protein, 57 aa, Triticum aestivum
  Clone ID: PAT_TA_45436.pep
MGGVGVSLALLAAVVLSAAAVAPQLAGAAMSDHSLCFLQVGIFQSVNMGSFALFSAF

SEQ ID NO: 151019 - protein, 57 aa, Triticum aestivum
  Clone ID: PAT_TA_45437.pep
RPANTIDSLATVSADKQTIDPCKMDNSGVDPLTRNLHSVSEPHISIGFFFIYKQIPF

SEQ ID NO: 151020 - protein, 121 aa, Triticum aestivum
  Clone ID: PAT_TA_45438.pep
SADAWVQGDTDRFTSYGRMGYVHIDDVAWSHILVYETPEASGRYLCSSVVLDNNELVGLLTKQFPVFPIPRRLSNPYGKQAYQLNTSKLQGLGLKFKGVQEMFNDCVESLKAQGHLLECPL

SEQ ID NO: 151021 - protein, 76 aa, Triticum aestivum
  Clone ID: PAT_TA_45439.pep
RPIASRPHPKKVRSRGFSEKLKWVPKCAVAKKGDTNAQAVKVSKAVNSVSIKKTANKILTFATYYPAQDPLFGLGP

SEQ ID NO: 151022 - protein, 100 aa, Triticum aestivum
  Clone ID: PAT_TA_45440.pep
RPGEPSQATDWSSLPPDITRVIAEQLLAEDVTDYMCFRAVCSHWRAFTTSPCDLTLQETRFRPRGWGALCDGDGVRPADACEITLFHTFTSRRLHVRLFY

SEQ ID NO: 151023 - protein, 72 aa, Triticum aestivum
  unsure (1)..(72): unsure at all Xaa locations
  Clone ID: PAT_TA_45441.pep
MTWMLSAFSSCFSNPRLIPLARXHMLTISNRLKNYCLRYDDLYDPYFYLYIKYALFKLPLFVGLLLFFIIFL

SEQ ID NO: 151024 - protein, 56 aa, Triticum aestivum
  Clone ID: PAT_TA_45442.pep
MSLIAVEEFQHILRVLNTNVDGKQKIMFALTSIKGVGRRFFNIVCMKACIYMNKRA

SEQ ID NO: 151025 - protein, 94 aa, Triticum aestivum
  Clone ID: PAT_TA_45443.pep
MAVEAMAEKNTGAGAGAAGGVAPESGDRRSRFRRICVYCGSAKGRKASYQDAAVELGKELVERGIDLVYGGGSIGLMGLVFHAVHDGGRHVIGV

SEQ ID NO: 151026 - protein, 59 aa, Triticum aestivum
  Clone ID: PAT_TA_45444.pep
AGDGEGVRPLLEHRVGRLDRFVFRRDRCLVASLKGHLAGGWLRSSGRRRGADGPTCPRT

SEQ ID NO: 151027 - protein, 58 aa, Triticum aestivum
  Clone ID: PAT_TA_45445.pep
KWRVVIIVKNIASVRKYRLRCNLMKGGVIGMNGSGSVWGHIGMKRCGNCYSNMMCTGR

SEQ ID NO: 151028 - protein, 61 aa, Triticum aestivum
  Clone ID: PAT_TA_45446.pep
GGPHHQVLAHPAGQRLVAPQEARRGGVQRVVVVEADVGEVQHAVPPEPGDDGGLAVGLGRT

SEQ ID NO: 151029 - protein, 131 aa, Triticum aestivum
  Clone ID: PAT_TA_45447.pep
VREEASLPSGPAHAKSDQISASNLLAGLFKGGFIPNTSDHAVPHSHGLASLPSSSASENAPLKPHAPNSLRPPLPPGPPPTHSAEKAAAPLSSLLSSLVAKGLISSPSTDSAAVARKPGKSSPSTSDVSAS

SEQ ID NO: 151030 - protein, 137 aa, Triticum aestivum
  Clone ID: PAT_TA_45448.pep
VRTLTRLYLGMWRFPDTAGLPRATCFRNLRDLGLYNVLVERRDLDFILDRSPVLETLCVQGNVLKLRIRLVSQSLRCVQIIGCFIEEIFVLDAPNLERFIYSDAWHPVGNCTTTVKIGHAPKLHLLGYLALDPRKHV

SEQ ID NO: 151031 - protein, 48 aa, Triticum aestivum
  Clone ID: PAT_TA_45449.pep
DIKGVSPAKSPTPGAGAFTSPPSSSTQYLQTSRCPPTAAYVQHTNDRT

SEQ ID NO: 151032 - protein, 73 aa, Triticum aestivum
  Clone ID: PAT_TA_45450.pep
FSFFIRFFLYILLHISFFNPYFLFFFIIIFYLILFILCIIFIICFTYSYYLFILLIFFSLFIFIFILFVFIFI

SEQ ID NO: 151033 - protein, 88 aa, Triticum aestivum
  Clone ID: PAT_TA_45451.pep
MGSDSKELLGIEPLELRFPFEFMKQISCSMELTNKTDDYLAFKVIGIKLFPAFVTARSSAIVYKVSEFDAAFGEMARLLGQDDQPQDV

SEQ ID NO: 151034 - protein, 62 aa, Triticum aestivum
  Clone ID: PAT_TA_45452.pep
TLGLWREGLSTRLPIRQKALIPILIGAMGKEIWSCYGRREASRQIEDRDSYSRTRGRTRGRT

SEQ ID NO: 151035 - protein, 98 aa, Triticum aestivum
  Clone ID: PAT_TA_45453.pep
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNFIEENDE

SEQ ID NO: 151036 - protein, 60 aa, Triticum aestivum
  Clone ID: PAT_TA_45454.pep
INQCATNSQETATKATCQTVVCNRTYPLEIPAVPYKARHAVNAAKGIALASCNITHASAD

SEQ ID NO: 151037 - protein, 134 aa, Triticum aestivum
  Clone ID: PAT_TA_45455.pep
RPLCAGVGTILAPNVAALTGIGLSRSDIARLVLVAGNQFRRRSIVTNLHYCLCIFGSYENLLTAIKRKSYILMSDLERVVKPNVGLLREFGLGPCDIAKLCVAHPWLLTCNVKRIRATVLRVDVLGIPRWSGMF

SEQ ID NO: 151038 - protein, 86 aa, Triticum aestivum
  unsure (1)..(86): unsure at all Xaa locations
  Clone ID: PAT_TA_45456.pep
RPNHTDTNSISTLEEYSKPLMEVLITLGENEKAVLAGHSCTGAXSLSYAAEECAPSTYRTYMLTHTTDNARHWPFYAFSVELECTH

SEQ ID NO: 151039 - protein, 130 aa, Triticum aestivum
  Clone ID: PAT_TA_45457.pep
RPLRLPLQDVYKIGGIGTVPVGRVETGVIKPGMVVTFGPTGLTTEVKSVEMHHESLLEALPGDNVVFNVKNVAVKDLKRGFVASNSNDDPAKEAANFTFQVIIMNQPCQIGIGYAPVVDCHTFHIAVKFW

SEQ ID NO: 151040 - protein, 74 aa, Triticum aestivum
  Clone ID: PAT_TA_45458.pep
PASSRAGQKLENEELRHLPTLSPATSSLLFLFLFFLFHFFSPFSPSSLISGTKVPSSFQRSRNPNKRTTMGSPY

SEQ ID NO: 151041 - protein, 40 aa, Triticum aestivum
  Clone ID: PAT_TA_45459.pep
SHWVTTRTLLMPRKSIDLARDGAMVRLMLPLTIDRSYSRT

SEQ ID NO: 151042 - protein, 79 aa, Triticum aestivum
  unsure (1)..(79): unsure at all Xaa locations
  Clone ID: PAT_TA_45460.pep
HXHQGDGDCSEPGAPLRDPPPSHRRRGLQASFTWIPCYRGEEDVRARAMMSHTTFTPSTCSTLHRVKPYNADLHGLLVL

SEQ ID NO: 151043 - protein, 63 aa, Triticum aestivum
  unsure (1)..(63): unsure at all Xaa locations
  Clone ID: PAT_TA_45461.pep
XDHASFENPSSRPRRXXXVRVVFLPPSSPHMRTWKNTVSSILYDSRRSKIFILRTMDYNFNRY

SEQ ID NO: 151044 - protein, 64 aa, Triticum aestivum
  Clone ID: PAT_TA_45462.pep
ACPGPGELVGTVAGTHVEQGHFLGGLVDAGDAEVALHLADLRVHGALDLLGRGDKVKRTRGSKR

SEQ ID NO: 151045 - protein, 131 aa, Triticum aestivum
  unsure (1)..(131): unsure at all Xaa locations
  Clone ID: PAT_TA_45463.pep
RDALSSALPLLISSPNPNPNHQPPLPVAPPPPLPAAPPPPLPAASPPLLALGSSLPXPRVVASPPPPRHLGAHREEHGSPPQLLRVAAPPLSSCVPIAWRSGGCSSCICSALFPSSVSGSWQFQIHCAAHV

SEQ ID NO: 151046 - protein, 63 aa, Triticum aestivum
  Clone ID: PAT_TA_45464.pep
SIKHQNTKVVLDLAVSAMAISSVAYNQFLFNSGCDGIAWYKRLGPATSCAWVRILLNDMCLRT

SEQ ID NO: 151047 - protein, 54 aa, Triticum aestivum
  Clone ID: PAT_TA_45465.pep
ESINGRYGAGAEGERVRANYQLAGAIDNPPSQANGEAYEAPSVALHYSRGPFEG

SEQ ID NO: 151048 - protein, 106 aa, Triticum aestivum
  Clone ID: PAT_TA_45466.pep
MAEATLEGSEPVDLSKHPSGIIPTLQNIVSTVNLDCKLDLKAIALQARNAEYNPKRFAAVIMRIREPKTTALIFASGKMVCTGAKSEQQSKLAAGKYARIIQKLGF

SEQ ID NO: 151049 - protein, 72 aa, Triticum aestivum
  Clone ID: PAT_TA_45467.pep
MVAFCGLRASRFRAGRAVLPKWFMEDVVVEGFEAMRMSGAAGGRRVCVTRRLPRVMVEGLLRDYLGAEAVVV

SEQ ID NO: 151050 - protein, 88 aa, Triticum aestivum
  Clone ID: PAT_TA_45468.pep
RPPTRSQISSSGGDSRLISSGLGAGPGRGMDSNQPSQPPAPFPYAEDAVVSVYNHLSFEAPPQPVSEEYFQNAFKFLFHPKVRCFFFI

SEQ ID NO: 151051 - protein, 134 aa, Triticum aestivum
  Clone ID: PAT_TA_45469.pep
ALLNWSPLWGQTPREQRCPKQPPFLRQRPGHKSPSHRSTRPRTARAGERTSSNCLPETTATSGLEVSPATGSPLLRPPSWSPRRIERGTRAIPARLAPDQGPARRSELPEAGACHWGREEEATAEAATGRVGGR

SEQ ID NO: 151052 - protein, 51 aa, Triticum aestivum
  Clone ID: PAT_TA_45470.pep
EKKSGRSEDNVQCLEGIPKKEKNQPKTRTRRRRWRTACSTIRLRAAHASAN

SEQ ID NO: 151053 - protein, 70 aa, Triticum aestivum
  Clone ID: PAT_TA_45471.pep
RPPSRAHSWSCPSISWWMPRWSRRPAPQPCLRSVLKEEAEPNPSPKPSTAEPVETVVDCYVRRQWRLLHL

SEQ ID NO: 151054 - protein, 121 aa, Triticum aestivum
  Clone ID: PAT_TA_45472.pep
VRKVEIFPVKNTSLQQEGARACRCVIMKPRGLPAAAAGVPARLRPHLPRVTAFLIVFSVGYSLGIVSSSTRPSTPKPSQTVIRPHAAHLTAASSSGVTASSNGTGTGAAYPRSPAHDPVRF

SEQ ID NO: 151055 - protein, 81 aa, Triticum aestivum
  unsure (1)..(81): unsure at all Xaa locations
  Clone ID: PAT_TA_45473.pep
GLFGGRGGGSEVELIERPEGVEAGRKKETMELFPQSAGLQDAAAPDATREEDKSLLTIFYGGKALVVXDFPAVKAQGLMLL

SEQ ID NO: 151056 - protein, 134 aa, Triticum aestivum
  Clone ID: PAT_TA_45474.pep
SGKAKKKKDPHQQTDPPSIPVDELFPSGDFPEGEIQEYKDDNLWRTTSEEKREQERLQKPMYNSVRRAAEVHRQVRKYMRSIIKPGMLMMELCETLENMVRKLIKENGLQAGIAFPTGCSLNWVAAHWTPNSGD

SEQ ID NO: 151057 - protein, 110 aa, Triticum aestivum
  Clone ID: PAT_TA_45475.pep
MGRRPARCYRQIKNKPYPKSRYCRGVPDPKIRIYDVGMKKKGVDEFFHCVHLVLWEKENVSSEAFEAARIACNKYMTKHAGKDAFHLMVRVYPFHVLRINKMLLCAGAYR

SEQ ID NO: 151058 - protein, 135 aa, Triticum aestivum
  Clone ID: PAT_TA_45476.pep
LPLMLRWNRHCRSPPDGTVTRARKRMREKEAVALLFSSLHQSPLPYDHHQRWSFPPPSSSSSGMGNMLEAACLPPENPNQRFPHESPSRNQAPSNPCPPQERNSRVISTFPSCVIFCLPNPLYESPDISMEPRGR

SEQ ID NO: 151059 - protein, 62 aa, Triticum aestivum
  Clone ID: PAT_TA_45477.pep
KARSAPMFNPKNLDSRFVGHSSCHHSQACLYTIKSCMTKHIKSSKGAVKLLCISYGTCRTTK

SEQ ID NO: 151060 - protein, 70 aa, Triticum aestivum
  Clone ID: PAT_TA_45478.pep
KIYNSLKPAKVTFDPLKRAPPFYFASSLVFMAFYITFFICLSSYLSAAPFVCCRLKYFFFRTRGRTRERT

SEQ ID NO: 151061 - protein, 105 aa, Triticum aestivum
  Clone ID: PAT_TA_45479.pep
RPRTRGSVSSPALSSSEQRGACGFCAESDSSDFGRRLLITTVFSSAMANRGGKGSYPPFKSGAPNGRQNNSNDGIHLSDSDSDSDDYSEEEAPSHTLQVKWVSFI

SEQ ID NO: 151062 - protein, 65 aa, Triticum aestivum
  Clone ID: PAT_TA_45480.pep
VVAVTAPRQAQSRNSERAACGRRRPLGRGPGQKARPGSAEGLSRRRGQGGPAPPWPRPEKGFSSA

SEQ ID NO: 151063 - protein, 125 aa, Triticum aestivum
  Clone ID: PAT_TA_45481.pep
RPGTLNRSSSSHPAMALAATTKKKNKAMAPAAQGEWFIMYGIPKVSGEMSKEFPNAAFTFNEVPLLSHLTVPGNVATPAGSVDYPYIEATDDCGLLLLCGYTFVGLTYYICDPYFRRTLGILPPD

SEQ ID NO: 151064 - protein, 68 aa, Triticum aestivum
  Clone ID: PAT_TA_45482.pep
MGAPLSSWPWAGLGAYKYVLYGPLVAKVAQEWREQGGAPTDSWCLHLLLLLALRSLNHQLWFSYRNML

SEQ ID NO: 151065 - protein, 40 aa, Triticum aestivum
  Clone ID: PAT_TA_45483.pep
NKPPLSASSPCFWRTPLPSLLRTRNSSLTRGVVGWESGIR

SEQ ID NO: 151066 - protein, 96 aa, Triticum aestivum
  Clone ID: PAT_TA_45484.pep
VRLFALRFEEIKDVEVWHDTVRLFSVWDASSSDLLGYFFLDMFSREGKYDHTCVVVLHNGYMCSNGSRKVSVAALLSLCPKEFDGNSLLLPVLWYL

SEQ ID NO: 151067 - protein, 62 aa, Triticum aestivum
  Clone ID: PAT_TA_45485.pep
RKGWRLNRQRRSPPPLGSRQEPPRTPRRPWLLPSPLRISDKEERKNRGITRSEKALGEYDPD

SEQ ID NO: 151068 - protein, 47 aa, Triticum aestivum
  Clone ID: PAT_TA_45486.pep
AELVLRFSPCRKITANFNSEYGRPCLSFWYCDSEKASATAYALASAD

SEQ ID NO: 151069 - protein, 76 aa, Triticum aestivum
  Clone ID: PAT_TA_45487.pep
PWPKSQRVTQNLTRPWPWPWKPKRWYVLSKPKGRRVFVTRLPKRGGAGLVQEKEEGTKDAQPHCGARYKITNAWAD

SEQ ID NO: 151070 - protein, 71 aa, Triticum aestivum
  Clone ID: PAT_TA_45488.pep
RPVIIDRYSGDVYYEYQPIFPTVVPSVMVVDGRHMMNLMVYYDDQHGTRRLRICHHVLSIRPDSGGTACRA

SEQ ID NO: 151071 - protein, 69 aa, Triticum aestivum
  Clone ID: PAT_TA_45489.pep
SADSTGNIFMSYPDWRKTDMLIMAKDSTTPIERLYNEGVYTELFKRLQEIHGIYFQGYIETKIVPLVYD

SEQ ID NO: 151072 - protein, 81 aa, Triticum aestivum
  Clone ID: PAT_TA_45490.pep
CSRTSSQSGRSSTERTTPPSSTHVQLDDVPQTPIHPSVEEEFRQHVGVVTMNDVPPTAGLSLSSATVLSRCNMVEGGTAHG

SEQ ID NO: 151073 - protein, 89 aa, Triticum aestivum
  unsure (1)..(89): unsure at all Xaa locations
  Clone ID: PAT_TA_45491.pep
RPRTRGFSHDPSIHDQVVEDEAFPDGTMLKKGTKVIYAMYSMGRMEXIWGEDCWEYRPEWWLKDGRFMGELFYKLTVFNGVPRLCLGMD

SEQ ID NO: 151074 - protein, 77 aa, Triticum aestivum
  Clone ID: PAT_TA_45492.pep
TAHHDQVVVQEDGRRSQEHGGGKCILVYRAPSVICHLRGTRPTPAIFPSGTLSKINRSAFQRREKNPSTAILFIPAE

SEQ ID NO: 151075 - protein, 52 aa, Triticum aestivum
  Clone ID: PAT_TA_45493.pep
SDRRRAVPMADRSIVMAPVVSLWTSHSTVTNSRVTMAFVLAELFFFERVGGR

SEQ ID NO: 151076 - protein, 64 aa, Triticum aestivum
  Clone ID: PAT_TA_45494.pep
SVRGRGGIAVGRAVMLATSFGLMDKAYFAGRSKILSWVHATLHFSLNKVGGGGLSVGSAAIAGH

SEQ ID NO: 151077 - protein, 117 aa, Triticum aestivum
  Clone ID: PAT_TA_45495.pep
VRGRVGPNAPVDDKIDFAFKLYDLKQQGFIEKQEVKQMVVATLAESGMNLSDEVIEGIIDKTFEEADTKHDGKIDKEEWRNLVLRHPSLLKNMTLPYLRDITTTFPCFVFNSQVEDA

SEQ ID NO: 151078 - protein, 78 aa, Triticum aestivum
  Clone ID: PAT_TA_45496.pep
RPDSPPRPLKCSGSALTVLTWTPSDQSSAACEWNSVVFCSMSLSLHCSFLRLSDRSGSMPSSNMDWMSSSLNRTAMIG

SEQ ID NO: 151079 - protein, 94 aa, Triticum aestivum
  Clone ID: PAT_TA_45497.pep
ASSLMSSGPPSGMDWTGATAGAKKSSARRRRGRRNPTPPSGDRQNQKGNAAGIALTGGESRGAAPTSTERGNGEGPRSPAIGWWEGGGRERQAD

SEQ ID NO: 151080 - protein, 75 aa, Triticum aestivum
  Clone ID: PAT_TA_45498.pep
MASTFCFLHQSTARLADSARPAPAVGRTQLFVCKAQNNDEAASDAAVVTSRRAVLSFLDDAVVIAVKVFLCACRY

SEQ ID NO: 151081 - protein, 97 aa, Triticum aestivum
  Clone ID: PAT_TA_45499.pep
NVRHERRTGRDRPRTRAAPGTTRAGRRPAPPRSRRSRPRRRRSAAATARAIRSRRPCRACARQPASAASCSVRSGCLRSVLCGRTLKDNERETVAAD

SEQ ID NO: 151082 - protein, 49 aa, Triticum aestivum
  Clone ID: PAT_TA_45500.pep
RSNMHEGASNPDHDEELSVRTTTQKTKAQMESRQSSRSRTKGERGIKRT

SEQ ID NO: 151083 - protein, 75 aa, Triticum aestivum
  Clone ID: PAT_TA_45501.pep
RPRTRGLELARPPGTEQVNNGIERHGHRRRRRRGRPRLLSGPPGPQERPARADPRDAARPARPLLPSRTSCPTSC

SEQ ID NO: 151084 - protein, 106 aa, Triticum aestivum
  Clone ID: PAT_TA_45502.pep
RPRTRGLTLGAKSTLSPLSILLLSTQIRIPNPKSPTRRRWLAAAALLGTAVAAFYARAVSWDSCSSSSSSSRSSTPSPSSSTPSTYFPVGRVTSSCILTIFFQTSG

SEQ ID NO: 151085 - protein, 47 aa, Triticum aestivum
  Clone ID: PAT_TA_45503.pep
AGTAAHVTAATHASADARATISTTPVHSLAPSMVLVSPDTLYTPHIP

SEQ ID NO: 151086 - protein, 115 aa, Triticum aestivum
  Clone ID: PAT_TA_45504.pep
MAKRRREGSSQKRCHWGKGGRKHLYLVLDDWDKGFSIHKIDALSFLDDSDDSDDDAGGTLRRLPDPPAVRITEARHSPMLFAGLCTTIFFVNKKQLSPNATGALIYDTETVAMAM

SEQ ID NO: 151087 - protein, 127 aa, Triticum aestivum
  unsure (1)..(127): unsure at all Xaa locations
  Clone ID: PAT_TA_45505.pep
VRPRIRPISISISKPQHLHPIPRLRSAPAAPMARTMQTDRMSTGGKAPRKHLVTKAACKSVPATXGVKKPHRFRPVTVALREILKYQKSTXELLIRKLPLQRLLRXIAQDFKTDLRLQSFCVSFLDE

SEQ ID NO: 151088 - protein, 71 aa, Triticum aestivum
  Clone ID: PAT_TA_45506.pep
ARLPRSSLGPRERRRVERPTVPHRPVLRDPPHVLSAPRRRANAARAQRQQDHRHLKRRSPCGHGDRTRGRT

SEQ ID NO: 151089 - protein, 89 aa, Triticum aestivum
  Clone ID: PAT_TA_45507.pep
CGWLVLLVAIIAVSLVPSCSAAEVKTSPTEWSLHLNLPTGVTGAESLAFDARGQGPYTGVFDGRVLKWGGSSVGWTTFSHHRQLQEVPH

SEQ ID NO: 151090 - protein, 47 aa, Triticum aestivum
  Clone ID: PAT_TA_45508.pep
AADQTVKTGHVRVTVHEPYPVNERLQPAGDAFFSKLADDAIIAARSS

SEQ ID NO: 151091 - protein, 146 aa, Triticum aestivum
  Clone ID: PAT_TA_45509.pep
VRIILINSICGILAFCIAVALYYVTEKESFLVTPLSGFHGALAGFLVGLKQLLPNLELPMCFFWKIKAKWMPFFAMCFSTIMAFIVPDSINFLPTLLSGMYVRWLYLRYFQKNPLTGLKGDPCDDFSFPSLYPDAMRPVTDLVANL

SEQ ID NO: 151092 - protein, 116 aa, Triticum aestivum
  Clone ID: PAT_TA_45510.pep
SAHASGKTNNKSRFVVLDDEDDDDGDQNLIGSKSGAAGLKTQNYGSEPSKPHHYCSLPIDEPIWSGIIRIGSGKFVSLAAHLSTKYCEKVWKLSRSLEPVVEVSKLFRLEGWSKSF

SEQ ID NO: 151093 - protein, 66 aa, Triticum aestivum
  Clone ID: PAT_TA_45511.pep
TKSTFCNCELLRPCRLCSLHIRHQRSESMSGISSILERVIFHTPISFGNIIWCSWSVFSIKRIIGR

SEQ ID NO: 151094 - protein, 85 aa, Triticum aestivum
  Clone ID: PAT_TA_45512.pep
VRGRVGAAVASAITAVLLAAIMARASAAAAGKVWSDEEKGAHNGTARRQVTYDGRCLMLYCSRRMLFTGVIHYLCSTPEMRTRLI

SEQ ID NO: 151095 - protein, 41 aa, Triticum aestivum
  Clone ID: PAT_TA_45513.pep
VRPHFRVRFCDRIDIKVYTSSRLDCRRRPPEMANRLGFYCA

SEQ ID NO: 151096 - protein, 39 aa, Triticum aestivum
  Clone ID: PAT_TA_45514.pep
SALAKQDPFKAHSLAPAGRTYASQAQQPNGHHQRRRGDT

SEQ ID NO: 151097 - protein, 103 aa, Triticum aestivum
  Clone ID: PAT_TA_45515.pep
RPPYCALLRAALFGPDTPDRLGYFVGASSSSAASPVGSPAGGNIFRFKAEVPWNAKRALFAGGDDQDLLFPGIFTPKGSGPRKIPRSPYKVLDAPALHDDFYL

SEQ ID NO: 151098 - protein, 119 aa, Triticum aestivum
  Clone ID: PAT_TA_45516.pep
SADAWAETQNELAKLQIVYEDAAQKSEGTAPSVFMAKENDGSFPGAKHELALVPLHQVNAAQSPAMQFQSCNGLILQQLVPVSFSNQQDQSRSNQPTVYCMQNQGQPERRQAQTFQPAP

SEQ ID NO: 151099 - protein, 73 aa, Triticum aestivum
  Clone ID: PAT_TA_45517.pep
RPLNQIEANILTSQAQNNIDLFHRTRSNINNLLQSMSQIPGIMSKMPRLPISVDEKLCSYLLPGVNLVNALLL

SEQ ID NO: 151100 - protein, 61 aa, Triticum aestivum
  Clone ID: PAT_TA_45518.pep
KKTMGSGASLLWSTSFLVAGSFKNSLKVIISPLCYHQCENNFTGITLLFPILIPLYYFNLL

SEQ ID NO: 151101 - protein, 112 aa, Triticum aestivum
  Clone ID: PAT_TA_45519.pep
MAKNAAATADAGDEVVHDFSPLLLVHRSGRLERPLAMPPVPPGHDAATGVVSKDVSLSPFSFVRLYRPPETGAGAGKKLPVLVYFHGGGFVIGSAASAAYHRWLNDLTAACA

SEQ ID NO: 151102 - protein, 90 aa, Triticum aestivum
  Clone ID: PAT_TA_45520.pep
CAPQQIRRERWMEPPGGSPDLGMRGPWGAHRIWGGEGHGDLGAGKAWCSPQWEHMVVRQREAGRPTEKGGAAGAVEHAGVSSIRTHASAD

SEQ ID NO: 151103 - protein, 91 aa, Triticum aestivum
  Clone ID: PAT_TA_45521.pep
YFKYFAFSWSDSLFKATDTIFNPTSLPLTLYSRPAAESHLTKINLYILHKASSQPHSSYSGIYSIPHELHILIRPTRGCSSSHQTLIYLLQ

SEQ ID NO: 151104 - protein, 66 aa, Triticum aestivum
  Clone ID: PAT_TA_45522.pep
DTNMFLCTNFFSLAWPTQYHHVLTCQNFSRASGTGHHHLLLFFTSELWRRITQNHNLNKTLGQSTF

SEQ ID NO: 151105 - protein, 90 aa, Triticum aestivum
  Clone ID: PAT_TA_45523.pep
TLSSITHQLCLTDSCSTNKKSTLAIRCSPPCHVVTASDSSLMYQFSLPCLAYMRMNTATERTKHAAKTLSGTTLSEALRICTGNTHPPRT

SEQ ID NO: 151106 - protein, 122 aa, Triticum aestivum
  Clone ID: PAT_TA_45524.pep
SAPPPSALSTRTKASSSATMCGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 151107 - protein, 120 aa, Triticum aestivum
  unsure (1)..(120): unsure at all Xaa locations
  Clone ID: PAT_TA_45525.pep
PANINTILASETMEIPEEVTVKVSAKMISGTGPRWTLTRNFKHLNLDFQLQDVGRKLMVDAWFGTXMTMVCIRTVIFHVQNLIXGSPRAFRYKMXRFVYAHFPXINASITVGNXGIEIRN

SEQ ID NO: 151108 - protein, 85 aa, Triticum aestivum
  unsure (1)..(85): unsure at all Xaa locations
  Clone ID: PAT_TA_45526.pep
GGGSLRIAERFIKRLFPYTKVLISSSHMXNLKNIFNAARVPWSDYRPYHSMTVGLYSDSLFARPPGWQIGVFCSDARGCSHSWCA

SEQ ID NO: 151109 - protein, 51 aa, Triticum aestivum
  Clone ID: PAT_TA_45527.pep
PPCPGPSPPAPPPPRSGSPPRAATSRPARPTMRGTTRSTTRTRRTGAVTSG

SEQ ID NO: 151110 - protein, 94 aa, Triticum aestivum
  unsure (1)..(94): unsure at all Xaa locations
  Clone ID: PAT_TA_45528.pep
SLSLLLSPSYFIFINGLGPFGAGVMFYVWRTYRLLVLNVVTRTSLNFLFQGHNLLLVEAVCTYTLXKHYSLFDVHPCQILSVLVAVNLTPKAYY

SEQ ID NO: 151111 - protein, 143 aa, Triticum aestivum
  Clone ID: PAT_TA_45529.pep
RPRLAKSTRRTIITTIHHPGSRMFHMFDKLLLISEGHAIYHGKARDCMHHFSSLGFTPEIPMNPAEFLLDLATGNLEDISVPGLLRDGSPAPQEFRSRVVAYLQAKYRDHAGEDQAKHPARRPGEQLRLAIRMRKDRIINWFQ

SEQ ID NO: 151112 - protein, 88 aa, Triticum aestivum
  Clone ID: PAT_TA_45530.pep
HHAEAASGVLVAPMLLSKTFGQRPRVLPLVESLNEVSDYGLAPAVVPALILPSMLGAKHRPGQAPVLLSLVVSPAAFGYCAWKGFLRP

SEQ ID NO: 151113 - protein, 128 aa, Triticum aestivum
  Clone ID: PAT_TA_45531.pep
TGSYGTTSRPAHQAPVSQVWVVREDDFGPGQHAGQVDPRAETEHVRDVPAEVRLLEQPPCQVHQLLAHARHAPAAPLASIPDGCIRIELPWRRSIPIPTATGLGQRRRGPCLSLDPLVLPDAWAHAWP

SEQ ID NO: 151114 - protein, 107 aa, Triticum aestivum
  Clone ID: PAT_TA_45532.pep
MDASATGAGAKANKGAAVRKAGGPRKKSVTRSVKAGLQFPVGRIGRYLKNGRYAKRVGTGALVYLAGVLEYLAAELLELAGNAVKDNKKSRIVPRHLLLAVRNDQEL

SEQ ID NO: 151115 - protein, 140 aa, Triticum aestivum
  Clone ID: PAT_TA_45533.pep
GHASADAWASIPRHLRPQIPPGLRVRLSLWPPPPCPPSAPPSPPADLAPVPLLLWSPRAGGALAMPASPPAASSSSSPSSSSQPYPPSAGTTPAPGFVTSCTGRASPPRSLPPGRGGTARSCRRCTARRPGAPTFCRTPP

SEQ ID NO: 151116 - protein, 116 aa, Triticum aestivum
  Clone ID: PAT_TA_45534.pep
SIKLQTSVQVRPRGGRAARVGMATAVNEHVLLSQPDKLVLLAEIPAADSCGSSQPDVTFRLLVEQCSDYGGGPLDVDTMEDVSCRVPVRDLGRRGASDRSCSGLGARANNPMLRPE

SEQ ID NO: 151117 - protein, 141 aa, Triticum aestivum
  Clone ID: PAT_TA_45535.pep
VRDYNIQKESTLHLVLRLRGGGQIFVKTLTGKTITLEVESSDTIDNVKAKIQDKEGIPPDQQRLIFAGKQLEDGRTLADYNIQKESTLHLVLRLRGGMQIFVKTLTGQTITLEVEASDTIHNVKAKIQDKEGIPPDQQRFI

SEQ ID NO: 151118 - protein, 146 aa, Triticum aestivum
  unsure (1)..(146): unsure at all Xaa locations
  Clone ID: PAT_TA_45536.pep
RPPTRPVLPLPQVVILIILPRLQGSQFMKAKNILMLIVICQYVPRLIRIRPLYLQITRSAGIITETAWAGAAFNLIIYMLASHCCXVLGAVWYLLSIQRKDACWKHECSLKTGCKAAYLYCGNGDTNAGNAFLQNVCISSTPADNL

SEQ ID NO: 151119 - protein, 70 aa, Triticum aestivum
  Clone ID: PAT_TA_45537.pep
VRGHLHTDNNYDPGDTVCFSRMMAIENWCMCHTSARMAVYMTWVRDVKKLTQVEGCEVTFECRGALLPLG

SEQ ID NO: 151120 - protein, 41 aa, Triticum aestivum
  Clone ID: PAT_TA_45538.pep
LGCLRPYLRISKKIWRGGAPTPGRKHRRGLIGGCREGVAGR

SEQ ID NO: 151121 - protein, 124 aa, Triticum aestivum
  unsure (1)..(124): unsure at all Xaa locations
  Clone ID: PAT_TA_45539.pep
VRGRVGSSGKTPANGSPGNDSPDKKRVKRPYQTKTFKVELSFAARIPMSAIAMALKGQESEHTQEAIRVIDIILRQHSSKQGCLLVRQSFFHNNPSNFWDLGGGVMGCRGFHSXSFRATQKRAF

SEQ ID NO: 151122 - protein, 120 aa, Triticum aestivum
  Clone ID: PAT_TA_45540.pep
MRNRPVWMQRIKPVVLKLKKSQDLILMRIPKFGEELPAHAERRRRANKQHIASITLVDIAPYFHLPIREASRALKIGVSILKQKCRQYGIPRWPHRKIKSLHSLISDLEFVMDDTNGDVV

SEQ ID NO: 151123 - protein, 143 aa, Triticum aestivum
  Clone ID: PAT_TA_45541.pep
VRKALLLNLFTAGTDTTSSTVEWALVELIRHPDVLKKLQHELDDVVGNGHLVTETDLPQLTFLAAVIKETFRLHPSTPLSLPRVAAEDCEVDGYRIPKDTTLLVNVWAIARDPASWGDDVLEFRPTRFLPGGLHESGDVKGGD

SEQ ID NO: 151124 - protein, 57 aa, Triticum aestivum
  Clone ID: PAT_TA_45542.pep
LNKYPFNYKTIPIVSFITFNDKLYFFYIGLFPENTFFYPCVTLTFLNIHLVFLISFF

SEQ ID NO: 151125 - protein, 58 aa, Triticum aestivum
  Clone ID: PAT_TA_45543.pep
MGSSRKITSLLLMFCLAVLVRAEYAKYKDPKQPLAVRINDLLGRMTLAEKIGQMTQIE

SEQ ID NO: 151126 - protein, 54 aa, Triticum aestivum
  Clone ID: PAT_TA_45544.pep
GPSMVVDGSRNPYLFHARSSQSYVDIPKTYISLKIVQVTGGGAWGRESGRTAGG

SEQ ID NO: 151127 - protein, 83 aa, Triticum aestivum
  Clone ID: PAT_TA_45545.pep
VRGRVGGRVGAFSFDRDSANACQLHVCESLAFTDKRAGFLYGRVDAETKEVLVDFIYKPPQQGSSDVDHLMRDAYEEARVDAI

SEQ ID NO: 151128 - protein, 98 aa, Triticum aestivum
  unsure (1)..(98): unsure at all Xaa locations
  Clone ID: PAT_TA_45546.pep
MAIRRGSFCAVPGLLALGSVFAVSAERFFQKRFKRLGKPGVKSEWEKDQNLAGEWNHTFGKWHGNAEDQGIPTSEDYRXFYAILGRSTPEFSNKDKDT

SEQ ID NO: 151129 - protein, 55 aa, Triticum aestivum
  Clone ID: PAT_TA_45547.pep
RTRRPRRSPLNTVVSKSNGDGRVWCRWIGGRCSPARNQNDGARWDVNGKGTAPRT

SEQ ID NO: 151130 - protein, 55 aa, Triticum aestivum
  Clone ID: PAT_TA_45548.pep
NAEVRELETGLHETGHRLIPSTRPYLPAIMLACCFYEDKGSQSEVLTADALDRRT

SEQ ID NO: 151131 - protein, 123 aa, Triticum aestivum
  unsure (1)..(123): unsure at all Xaa locations
  Clone ID: PAT_TA_45549.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLXFEEESVTNIVTSIGG

SEQ ID NO: 151132 - protein, 84 aa, Triticum aestivum
  Clone ID: PAT_TA_45550.pep
THQGGRNLLGSDFIRSAPRGASRAGTAKGSRRLGGAAGGGDPGDARLPIWGAAGAGLSREDREGREDETEARGSPRVRPRVRGR

SEQ ID NO: 151133 - protein, 131 aa, Triticum aestivum
  Clone ID: PAT_TA_45551.pep
RPLCLLPSSLPPLRRCYFSPLPSRPVRRDHAGRIPIDFHPIPATARSLARSICPPSGSVLGLDPAESLLDCFPVVGVPNLFRAGLLPDLQAGSIQGDLLLPFFLPSFLGSPSRLSAPHLPKEIRGEIFLVS

SEQ ID NO: 151134 - protein, 113 aa, Triticum aestivum
  Clone ID: PAT_TA_45552.pep
IRRALPCLRHLCSARRSIRWCSPASDRPRSSTAKPASRARCAGRGGASSGPPMTTTRSRASAEASSASSSRRGAVPPANSVPSSPFTTPPTPVRCCGRHHFLEVCCGHPYNSF

SEQ ID NO: 151135 - protein, 106 aa, Triticum aestivum
  unsure (1)..(106): unsure at all Xaa locations
  Clone ID: PAT_TA_45553.pep
MVSLNQQERLSLSVLMCGKGKVCLDPNEVNQIFLAIFRENIRKXLKDWFNIRKPQKIHSRSRARRSHDAKQNGRHSGYGKRRASREGRLSTKILWMRWMLVPEAPS

SEQ ID NO: 151136 - protein, 68 aa, Triticum aestivum
  Clone ID: PAT_TA_45554.pep
INRVYGRLDSLHRHCSLLVNVDGRLDCLHHRRRRSRSLLDRHRLGYGLYLNGGPRRGVMNRTVRTPAN

SEQ ID NO: 151137 - protein, 114 aa, Triticum aestivum
  Clone ID: PAT_TA_45555.pep
KLKKLTDKHAKTKREQPYPLRNHFNVELHHGQADHADILPHHAGADAHILTVLAALHLSVLAANRRHRARVTDLLDRHAATGLHPLQRHRRRVLAVLLIHRTDVRQPRPRVHGR

SEQ ID NO: 151138 - protein, 130 aa, Triticum aestivum
  Clone ID: PAT_TA_45556.pep
MEADEAPHPPPPWKQNKSAVAVDASLGPLAFAAARLSARSRAIPPARDFHFYNNFPSFKSPVAAAAARAESSLAVLGASMLLPKQQQQPFPTEDLDDAYDWLVARNDDLLEMFAASAAEFKALRENEEAQ

SEQ ID NO: 151139 - protein, 98 aa, Triticum aestivum
  unsure (1)..(98): unsure at all Xaa locations
  Clone ID: PAT_TA_45557.pep
MAHKDAVNGYGATTRPSPTPSPIRFSKFFQANMRILVTGGAGFIGSHLVDKLMENEKNEVIVADNFFTGSNDNXLKKWFGHPIFELIPHEVTEPLFVE

SEQ ID NO: 151140 - protein, 32 aa, Triticum aestivum
  Clone ID: PAT_TA_45558.pep
TPRLKPLLNVSQRVQTPPMETSVAAVIWVSQL

SEQ ID NO: 151141 - protein, 137 aa, Triticum aestivum
  Clone ID: PAT_TA_45559.pep
SADAWADSDDGAGNKDLVHDASLADTKKDDTFARDGDAAAAVEAAKDDDDAAGALLPPLSANGTQEEQGVLEDQELLVPDALAAANSPNKSGNNGGSQPVVQSDPATIPAPVQQTPPTTTIPEAPKHEEAKAPSAQQ

SEQ ID NO: 151142 - protein, 73 aa, Triticum aestivum
  Clone ID: PAT_TA_45560.pep
GHGILRVPRPLSPPWAGQSPDALIRLGPFRCGLWTLKRKSEPNLLGLETATLLSCAKDKVTAPESRMDHASAN

SEQ ID NO: 151143 - protein, 57 aa, Triticum aestivum
  Clone ID: PAT_TA_45561.pep
TSVSMSSSRTARRFSWSLSMHSPMTSVFRRELRRLDIVDSDGPPGHGEDQIALQART

SEQ ID NO: 151144 - protein, 80 aa, Triticum aestivum
  unsure (1)..(80): unsure at all Xaa locations
  Clone ID: PAT_TA_45562.pep
MRRRRRSSRSLEAHPLEDYNLLSEILLRLPPDPSFLPSASLVFKRCLGLISDPCFYCRYLXHHRRNPSFLGFFVHFNFKP

SEQ ID NO: 151145 - protein, 31 aa, Triticum aestivum
  unsure (1)..(31): unsure at all Xaa locations
  Clone ID: PAT_TA_45563.pep
LLLHHRNTVACMGNIAWATTSIPLRIXSAPN

SEQ ID NO: 151146 - protein, 106 aa, Triticum aestivum
  Clone ID: PAT_TA_45564.pep
SPSILPNPRDSEPLSKDSGNLSTERTPPATEGRSPAAGSSTPPPRRGRAPPPPPRGGAPPARGGARRRRPILPDAGVTPPEYWCSPRCVLYGGEFEGCVAGGGFEV

SEQ ID NO: 151147 - protein, 79 aa, Triticum aestivum
  unsure (1)..(79): unsure at all Xaa locations
  Clone ID: PAT_TA_45565.pep
MALWCALLISADISPGRKAELEYLHSISKGQPTESILSTGLDPGGISLSASXASTLSTTHTITSPPPPEKTNFADLKFE

SEQ ID NO: 151148 - protein, 52 aa, Triticum aestivum
  unsure (1)..(52): unsure at all Xaa locations
  Clone ID: PAT_TA_45566.pep
SCHILGKMHKKVWIAXGTIVLVGLRDYQDNKALVILKHMNDEARLLKVYGEF

SEQ ID NO: 151149 - protein, 57 aa, Triticum aestivum
  Clone ID: PAT_TA_45567.pep
LGDIVRWDRRHRRHRRRRRARVGIERVRGVRVDWSACAMADLDSGLDSACRPHASAD

SEQ ID NO: 151150 - protein, 114 aa, Triticum aestivum
  Clone ID: PAT_TA_45568.pep
VRPYTSHSPTSPPVPIRRTATERSSRLASSPLSSPGRIRQAPSIQRRGQEAEEGRAAVPTYLSTPAEWTRDTGSRAWPAASGSTPRSSVTPIGRGCDELVIDGDRDRLHGLDFT

SEQ ID NO: 151151 - protein, 79 aa, Triticum aestivum
  Clone ID: PAT_TA_45569.pep
VSSGNPFLTNHFATAGQKPALGGIPVTTSHSAFSSAGVAAGTSELCVEPFAQLTIFYAGTDNIVGDFSTEKAQAIMSFA

SEQ ID NO: 151152 - protein, 94 aa, Triticum aestivum
  unsure (1)..(94): unsure at all Xaa locations
  Clone ID: PAT_TA_45570.pep
QSRRSASGHLDIAFEAIKRTKAEKKIAYDQKLCQLLEEYTKVLIVVSDIVDSKQLQEIRKGXLRGDSXIVLMGMNTLIRRCIMVHLGDDRLTGL

SEQ ID NO: 151153 - protein, 67 aa, Triticum aestivum
  Clone ID: PAT_TA_45571.pep
PDSRSTTRPQPIADLRLPAASLLRSLVWAGLIGMATQMDTLRMFRRAAEMMMVAPPGASFYEQDEDI

SEQ ID NO: 151154 - protein, 80 aa, Triticum aestivum
  Clone ID: PAT_TA_45572.pep
SGSPPPRIHLRGANIYRHVRQPQNGTGNCLFQGLENTNSRYRHILTHPSSYSEASGAQRPSECECRVVLWQSSDDRTLEE

SEQ ID NO: 151155 - protein, 56 aa, Triticum aestivum
  Clone ID: PAT_TA_45573.pep
NGSLETFEGIFSTDVVQGANQALVRAKHYGRLRLGLTEDDGQEQSESNEKKLAEKP

SEQ ID NO: 151156 - protein, 68 aa, Triticum aestivum
  unsure (1)..(68): unsure at all Xaa locations
  Clone ID: PAT_TA_45574.pep
LSLSXSSTSIAPPSPGLHLNPLSVVLPRSPRTVPPRYRHGAFVAGGDRNFHQHHRRRLGRRCPQARGA

SEQ ID NO: 151157 - protein, 54 aa, Triticum aestivum
  Clone ID: PAT_TA_45575.pep
IMQIEDQNSRLTKTSTDPTMVRRSLLRESYLTHEGRHRAALFMMSNKGEWRRGG

SEQ ID NO: 151158 - protein, 56 aa, Triticum aestivum
  Clone ID: PAT_TA_45576.pep
GGRSPCWSKKVMIMSKRRRLNLAWKEKVSVSVAMPARVPELLKAKEKREGQRERGR

SEQ ID NO: 151159 - protein, 59 aa, Triticum aestivum
  unsure (1)..(59): unsure at all Xaa locations
  Clone ID: PAT_TA_45577.pep
TIKTAAKGILTPASCLTATSWLRVVSTIISTFIGISNFSLGHISVHIHHISSWLCCLXE

SEQ ID NO: 151160 - protein, 86 aa, Triticum aestivum
  Clone ID: PAT_TA_45578.pep
ARSCVFINSSEWLCPSYSRSGASGYSVPSRRRSGTRCFGEGIGTTTSRLLVRVKGGGVPRRSRRHKASDRKEVWGSGWVHAHASAD

SEQ ID NO: 151161 - protein, 91 aa, Triticum aestivum
  Clone ID: PAT_TA_45579.pep
VFSIDLLIRQFQFGFILLGAVPFPIDVPRLKELGVRGVITLNESYETLVPTTLYYAHGIDHLVIPTRDYCFAPSLNDIFRAVDFIHENALS

SEQ ID NO: 151162 - protein, 107 aa, Triticum aestivum
  unsure (1)..(107): unsure at all Xaa locations
  Clone ID: PAT_TA_45580.pep
MASIAGSAVSFAKPVKAINTNSLSFSGARRGNAFLRLQPVPMRFAVCCSAKQDTVEKVCEIVKKQLAVPEGTEVCGTTKFSDLGADSLDTVKIVMGLXEEFQISVEE

SEQ ID NO: 151163 - protein, 85 aa, Triticum aestivum
  unsure (1)..(85): unsure at all Xaa locations
  Clone ID: PAT_TA_45581.pep
PXITWTYPPSSYLSSSSSSYLWWGPASAGVGSHEPLMRATFFVFRVRLIGRGPDDKTTVVVHRHDLSFAGLTDGSGHWHAFPGLV

SEQ ID NO: 151164 - protein, 67 aa, Triticum aestivum
  Clone ID: PAT_TA_45582.pep
MELPWGALLLALLTVSAFSAVATLAVTVPPSAPARAPAPVTAPAPAHAFPQAQDAEGLLMNGIFETA

SEQ ID NO: 151165 - protein, 126 aa, Triticum aestivum
  unsure (1)..(126): unsure at all Xaa locations
  Clone ID: PAT_TA_45583.pep
QLHHTTDESAHVSNQRDGLLRXRGHFSHKVTTLVXQESNTNTTPFFNRFIETLAHYXAIFESIDVTLPRDSKARINVEQHCLARDIVNIIACEGKEWVERHELFRKWKSRLTMAGFRQCSLSTYVN

SEQ ID NO: 151166 - protein, 89 aa, Triticum aestivum
  unsure (1)..(89): unsure at all Xaa locations
  Clone ID: PAT_TA_45584.pep
XFSYSCSRPHLGAFLHTIPPVHSAAAPHSPCGPPTPSPHHPPVHRRRRHTIRRFTVGAAGSPFLPSTAAACLPLPCGRTVLSSAFFLTT

SEQ ID NO: 151167 - protein, 70 aa, Triticum aestivum
  Clone ID: PAT_TA_45585.pep
KITLVRRLDQEPAIPWKNNDMFMTPYPCCLFHHRLHSSMTMHLPHYDKPPSSVFISNKEWRHAARTSGRT

SEQ ID NO: 151168 - protein, 45 aa, Triticum aestivum
  unsure (1)..(45): unsure at all Xaa locations
  Clone ID: PAT_TA_45586.pep
MSDLDVQVPTAFDPVAEGNAEDSGAGAGSKNYVHGAXVQQRNGRK

SEQ ID NO: 151169 - protein, 65 aa, Triticum aestivum
  Clone ID: PAT_TA_45587.pep
MATATMSLCSTFAGKSVNNVASSTLYGEARDTMHKTASKAKPVLSCFPWYVAVRVLYLGPIFKEP

SEQ ID NO: 151170 - protein, 100 aa, Triticum aestivum
  Clone ID: PAT_TA_45588.pep
MELASKMDGSRAMKVAAKKFGGPRKKSVTKSIKAGLQFPVGRIGRYLMKGRYSQRVCSGAPVYLAAVLEFLAAQVLELAGNASKDIMMTRIVPRHLLLFI

SEQ ID NO: 151171 - protein, 104 aa, Triticum aestivum
  unsure (1)..(104): unsure at all Xaa locations
  Clone ID: PAT_TA_45589.pep
SSSHSSASPSRPCVGVGAISDQVTDDQIAEFKEAFXLFYTDGYICITTNELETVMRSLGLNPSEAXAXDMINEXDAVGFGTFDCPDFFNLMARNFKYSDSVEDL

SEQ ID NO: 151172 - protein, 42 aa, Triticum aestivum
  Clone ID: PAT_TA_45590.pep
SGAPGHHLNVVAVVVSPDMRLQQQPPSDGIRMLVSKTTSERT

SEQ ID NO: 151173 - protein, 47 aa, Triticum aestivum
  Clone ID: PAT_TA_45591.pep
AATSVEYRVSRVDRKMTHGSCMSTVSPSIFSLSIQSVSRAPCMCSRT

SEQ ID NO: 151174 - protein, 52 aa, Triticum aestivum
  Clone ID: PAT_TA_45592.pep
SEISMPCKESILLSSCYKGRHAPNISTTQTYHEPNDPIIPTVWGSDTWLSFL

SEQ ID NO: 151175 - protein, 50 aa, Triticum aestivum
  Clone ID: PAT_TA_45593.pep
VMKKKFMGLDKGPFESAKLLQVTPKSGMRCLEDCVLALAFEHLCGYNDNQ

SEQ ID NO: 151176 - protein, 78 aa, Triticum aestivum
  unsure (1)..(78): unsure at all Xaa locations
  Clone ID: PAT_TA_45594.pep
CAITAAPSRSEAAVIDGIGNAPEMLSRDAPYRWQLGAASCPGTYASLAADRDMVADDTRPWFEVERAGWRSXXGGRGG

SEQ ID NO: 151177 - protein, 61 aa, Triticum aestivum
  Clone ID: PAT_TA_45595.pep
RPVRPSSPPLPSPRPPPPRHKSRRPTPPRKPPPPPRLRIPSVSAPAPSPSPSPSPCPCRGR

SEQ ID NO: 151178 - protein, 73 aa, Triticum aestivum
  unsure (1)..(73): unsure at all Xaa locations
  Clone ID: PAT_TA_45596.pep
MVSARDVDTTTAANKQQQATCLAPNPGKATILVLGHAFPQHLVMQDYVRXGFMRNTXCKDPELMEKLTRLCKT

SEQ ID NO: 151179 - protein, 45 aa, Triticum aestivum
  unsure (1)..(45): unsure at all Xaa locations
  Clone ID: PAT_TA_45597.pep
TKSPPIKIRLSSLTDIAHPRLPARPRPRLAGGRGXXGLGHKLHRT

SEQ ID NO: 151180 - protein, 120 aa, Triticum aestivum
  Clone ID: PAT_TA_45598.pep
SAHASAHASANSPHPLSPSMPAASSVQTGHPPPTGLPLAHLPPLTFCSAPPHRAPTPFLTRRCPRRQPAWAASFPTAPAPDPARIHQVVPHLHRRDVSGIYGRGFARAHSFTPPFFRVDS

SEQ ID NO: 151181 - protein, 104 aa, Triticum aestivum
  Clone ID: PAT_TA_45599.pep
PASAGPVQQVRQQREPKDGALTTAGSATAGARRWGSDCSRNGDWQGRRLYVEGAARGRRFGLGVRGEAQGRVDVRLQLGGTGILAPTRWLIDRVEASGNHASAD

SEQ ID NO: 151182 - protein, 110 aa, Triticum aestivum
  Clone ID: PAT_TA_45600.pep
PPYHPRRCPLRLLMAARILRLGSRCSSRWASLSRAPTGTPLSFRSYMSQPHSWARAHWCPLLLLRPRPPDCGVPSWATNTWLSSIFTCPATNLRWIWVCQLFWPFSLLVP

SEQ ID NO: 151183 - protein, 93 aa, Triticum aestivum
  Clone ID: PAT_TA_45601.pep
NHPHLASAHHPHLPAYHLGGFREAAGLPPHHLDGFRDPARLAPGHPDSLRERSSPAGHHFVGHGGGALPPASDMAGALEERIGAGIEGAHALL

SEQ ID NO: 151184 - protein, 97 aa, Triticum aestivum
  unsure (1)..(97): unsure at all Xaa locations
  Clone ID: PAT_TA_45602.pep
MAPKAEKKPAAKKPAEEEPTTEKAEKAPAAKKPNAEKRLPAGKTAFKEGGEKRGLMKGKKSVXTYKIYIFKGLKQVHPDIGFSFKGMCIMNSFINDI

SEQ ID NO: 151185 - protein, 86 aa, Triticum aestivum
  unsure (1)..(86): unsure at all Xaa locations
  Clone ID: PAT_TA_45603.pep
MGWAIALHGGAGDIPRTLPPERREARLATLRRCLDLXSSCYRAGRFSLDVIDLLFSDMVDFSFYNYFKDIIFINFHILIFIYFFLF

SEQ ID NO: 151186 - protein, 90 aa, Triticum aestivum
  unsure (1)..(90): unsure at all Xaa locations
  Clone ID: PAT_TA_45604.pep
RALAAPRVSRRAPPPKPSLPSSPVIGPRAGVAATNKLTLKSSDGEDFXVEVAVAIASQTIXKHMVEDGCXDNIIPVPNITGKILFKVIEY

SEQ ID NO: 151187 - protein, 60 aa, Triticum aestivum
  Clone ID: PAT_TA_45605.pep
MKCHLEHLSACAVLYYQWSFNRVSQGVLFDFILVKIVHQHQICSPQSQVAFFKLLNSRKE

SEQ ID NO: 151188 - protein, 137 aa, Triticum aestivum
  Clone ID: PAT_TA_45606.pep
GCGHLPSRRPALAPLSRRGHGNQQQHEGRRALTLPAPGLASPPRCQDLRGRRPALVPWSRRGHGRQQHDDEEEEEDEDVERAAAAAWRSAPTAAAAARGRRRGGSRGGGRRRRGRARGGSRAPILRAVDVARESIRT

SEQ ID NO: 151189 - protein, 124 aa, Triticum aestivum
  Clone ID: PAT_TA_45607.pep
SGRRGDQTLARPRHTTTARAPYSAAAVFYSHSVLARKSPLGTVWIAAHLERKAINRTQIDGVDVRSYAESIMDPEVPIALRLSAHLLLGLVRIYSWKVNHLFQDCNRMLSAIRTGGGFGPARAD

SEQ ID NO: 151190 - protein, 65 aa, Triticum aestivum
  Clone ID: PAT_TA_45608.pep
NICVLAYKAATNHLHFLLPLHRQNFEIFLWIHRGISNNCFGDNHSLLGAVAEVGNPRVRPRVRGR

SEQ ID NO: 151191 - protein, 86 aa, Triticum aestivum
  Clone ID: PAT_TA_45609.pep
MRKRERENPCGVCGHYHKCEEGEICGVCGHRPAAADAVAPARVDSAFPSEVLKGFLFLGSYDNASRFEGLKTLNITHILNTVAGMP

SEQ ID NO: 151192 - protein, 73 aa, Triticum aestivum
  Clone ID: PAT_TA_45610.pep
RPRTRGLAATHQPLAPRRLLRGAPPLPVPGRAMADLALGAGPEEIWRRRPKTKIVCTLGPALRGVVNFLWIFA

SEQ ID NO: 151193 - protein, 80 aa, Triticum aestivum
  Clone ID: PAT_TA_45611.pep
KKAQNQKEKNPKPTCGKPKINENALQKIKPSICQSHTSRERKTTKKNTKSSIPTTAATSSIATHASADAWANAWADAWAD

SEQ ID NO: 151194 - protein, 36 aa, Triticum aestivum
  Clone ID: PAT_TA_45612.pep
HDLRAGRFSAPFYCPHVCFSSWLLTYAATDARVAGR

SEQ ID NO: 151195 - protein, 43 aa, Triticum aestivum
  Clone ID: PAT_TA_45613.pep
VGSRHWLFWYVLRPLVMLEKLFKTAWEWINRLSLQLLKNIYFF

SEQ ID NO: 151196 - protein, 96 aa, Triticum aestivum
  Clone ID: PAT_TA_45614.pep
MEVFEGVDFVRLLSMQHGGAYVHAAKDGRFVRLQRTGLSWSYNAVWAVQLLIFALGTLYVLLRGAYGRYLGGPYARTRGFLWPFPSPLRVAAQCDF

SEQ ID NO: 151197 - protein, 80 aa, Triticum aestivum
  unsure (1)..(80): unsure at all Xaa locations
  Clone ID: PAT_TA_45615.pep
VRPRVRHASAHAFAHASGGVLSSRRDAAGXSSDEEDNEMEGRIAMYSEKTSDGQRSSKGVFQGINNRGPAASLGAMKDRF

SEQ ID NO: 151198 - protein, 98 aa, Triticum aestivum
  Clone ID: PAT_TA_45616.pep
VRWRTPWETAPWRRPSAPGSPPPASPSSSSRTTTTTPASSTPPPAPAPSGASSTPPPPPRPSPSAGCRCPPSALTTTPLRPRRSGESPDPPRPGPELP

SEQ ID NO: 151199 - protein, 68 aa, Triticum aestivum
  Clone ID: PAT_TA_45617.pep
VRLRVGASTSIAFPRSQIRSGENPAPCLAARSPAPLPPSYSTMTGILITSEKIATGVKGCPESRLKAY

SEQ ID NO: 151200 - protein, 53 aa, Triticum aestivum
  unsure (1)..(53): unsure at all Xaa locations
  Clone ID: PAT_TA_45618.pep
MLVDQDKLSGDELMSDSFPNRELYNGELWEVDDHXLFKEPVDEYIVAIPSVEG

SEQ ID NO: 151201 - protein, 84 aa, Triticum aestivum
  Clone ID: PAT_TA_45619.pep
RPVQRRQILAPLPIGFAVFLVHLATIPITGTGINPARSLGAAIIYNREHAWSDHVSEPKLKPNTPPFLCLNLKAWHLHAWFLQQ

SEQ ID NO: 151202 - protein, 76 aa, Triticum aestivum
  Clone ID: PAT_TA_45620.pep
AVGVPHEPLDDVVLHDDLLRTRVAMETLVASLCMGAHTRHNESCSPGVGRVRPSSAVQGRGGRCIGFTPAGCIFRT

SEQ ID NO: 151203 - protein, 69 aa, Triticum aestivum
  Clone ID: PAT_TA_45621.pep
LTSTLLISQYSIVTKRATIATSYTAKELSFPLASKRNTHLLGGSSKSTVAKFSRTRPALVGFDRRRGGA

SEQ ID NO: 151204 - protein, 82 aa, Triticum aestivum
  unsure (1)..(82): unsure at all Xaa locations
  Clone ID: PAT_TA_45622.pep
MELHRDDLSSPPPLPPNAEPIKAESADDLPPPPPLPAIKPEEAXKISKPKKALIVRPGFGKRGNPIQVGAKHYKALVETTDE

SEQ ID NO: 151205 - protein, 129 aa, Triticum aestivum
  unsure (1)..(129): unsure at all Xaa locations
  Clone ID: PAT_TA_45623.pep
YPLFREFHANKFNLRGVNRSFIVFTPKIECSVRLXDYGPISLVHSLMKQKXMTNRLQLLIWVLVDMIQSWFIRGXSIVENFVLASELVQSANKEETNXLLKLDFQKAFDTVLWDCLFQLCSTGIFLRIG

SEQ ID NO: 151206 - protein, 92 aa, Triticum aestivum
  Clone ID: PAT_TA_45624.pep
HVPQVRPHLFGMPTQDPGPACDDGGGGGLRRPSCADAGGRRRSPRGRAGGAGRGASAAPARAGAGSRAPLAAIGMQGREGRCGKLLQLYLRT

SEQ ID NO: 151207 - protein, 64 aa, Triticum aestivum
  Clone ID: PAT_TA_45625.pep
HPRAFGIWFEAGSRAFCECPEARAWRGRCICRRRAQEEEEPFRLTDLDSGEVAGVEEVGEEKPD

SEQ ID NO: 151208 - protein, 109 aa, Triticum aestivum
  Clone ID: PAT_TA_45626.pep
RAPTRSRTRGGQYGRVCGYIEPLGSNAEGGFEFDNMIIGQAIPVNFIPAIEKGFKEAGNSGLLIGHPVENIRITLTVGASHKVYSREHALKLAAIYAFKQGYTGGKPVI

SEQ ID NO: 151209 - protein, 37 aa, Triticum aestivum
  Clone ID: PAT_TA_45627.pep
CTDPSKYMYWNAVHQAKRMNQIITDYVIMNSIGEIYA

SEQ ID NO: 151210 - protein, 65 aa, Triticum aestivum
  Clone ID: PAT_TA_45628.pep
RPLRLMERSVFSDRMVFVRAVHEANWMNEMDISIYDSWFDPVVSSLPGLIPDGFIYLRASPDTCH

SEQ ID NO: 151211 - protein, 114 aa, Triticum aestivum
  Clone ID: PAT_TA_45629.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHI

SEQ ID NO: 151212 - protein, 63 aa, Triticum aestivum
  unsure (1)..(63): unsure at all Xaa locations
  Clone ID: PAT_TA_45630.pep
VLXLVISTMLSIFTAYSSGSILKGQPPFGLCTLSRCISRAKDDSNYVSTKSFHIFSFKTRMNV

SEQ ID NO: 151213 - protein, 140 aa, Triticum aestivum
  Clone ID: PAT_TA_45631.pep
RPPTRPPTRPRWVAPGRLHPGDGFLHGNEFFTVPTQIFDGFDPFLTSLPRPTLYIFCPTRPSPVFAKISVSCALQSRPDLAGVRRPKLLSPVSFVAVKGSLHISSTLSSSPFTPPLPLPSKARRGAPGRPQRPWSGAQLR

SEQ ID NO: 151214 - protein, 69 aa, Triticum aestivum
  Clone ID: PAT_TA_45632.pep
STDAWALSRSRGREIESENKKERRGLCWPRSPAPAPAMALVVRLVSRSRQLYSVQPALAKGGLTQVRSF

SEQ ID NO: 151215 - protein, 39 aa, Triticum aestivum
  Clone ID: PAT_TA_45633.pep
TKKKKKPRLGFYLLIMRLETDLAWKIFIYDVAACVVAGV

SEQ ID NO: 151216 - protein, 135 aa, Triticum aestivum
  Clone ID: PAT_TA_45634.pep
SAHASADAWAETEKPLFSPTDVSLHASTKDCWVVIHGKVYDVTKFLEDHPGGEDVLLHASASGDATEAFEDVGHSTLAISMMSSYLIGSIEDYVPSRATKDPTAIGSDGLPDSRTMQRNKGLSRFQHIYGLRAPF

SEQ ID NO: 151217 - protein, 98 aa, Triticum aestivum
  Clone ID: PAT_TA_45635.pep
TTDGTSGSLGDTASGSTSVAGSVSLASSVSMGDRRLFFGCFILAEGRSFAFGLSWPGDSFSIGGHLGVYGSIPGESSCSQSGRPVLAITAGHFCRVYK

SEQ ID NO: 151218 - protein, 70 aa, Triticum aestivum
  Clone ID: PAT_TA_45636.pep
PTLYLMYYSGNLAFPLSQNVRRSVSEKVLHSETEGVVYSTPVSIKVIAVPLLRTKVKYSLPHASADAWAD

SEQ ID NO: 151219 - protein, 142 aa, Triticum aestivum
  Clone ID: PAT_TA_45637.pep
VRSVLAHHFIAAGSHHDEKVAMYAIDSLRQLGMKYLERAELNKFTFQNDILKPFVILMRNSRSEKIRGLIVDCIVQLIKSKVGSIKSGWRCVFMIFTAAADDENEYIVESAFENVEQVILEHFDQVVGDCFMYCVNCLIGFS

SEQ ID NO: 151220 - protein, 103 aa, Triticum aestivum
  Clone ID: PAT_TA_45638.pep
RPRTRGLSRPMERERARARLLPSRSPPPPPSGGARRRPPRILPPPRQQSRALSPRIHGAAQRRRGHGGVGMPRHAAAPYSRRPLHPSFTGDLPPFIPRGRPKP

SEQ ID NO: 151221 - protein, 132 aa, Triticum aestivum
  unsure (1)..(132): unsure at all Xaa locations
  Clone ID: PAT_TA_45639.pep
TTTAFLLLAGLHKFMVILLDFLSHIFIYWWILLAPDEPRLWXSSAQTLYQVRNYYRMHYWLVEYLSKHRTVTVDMPFTYYAYMVELCNLQHVLKNNXNYYPKVEVYSSYLVVLVFYGIFNADSELLRKQRKT

SEQ ID NO: 151222 - protein, 93 aa, Triticum aestivum
  Clone ID: PAT_TA_45640.pep
KQGVRNHLKPCVSLHGFGRLTLSTSSCCCSTEMSSIAGTGFYLVSFILAVLRSESLNSKLLFSSLALLTPELYVRSHMSCQHSNPNITAHFLH

SEQ ID NO: 151223 - protein, 55 aa, Triticum aestivum
  Clone ID: PAT_TA_45641.pep
KELIREPSFACNFHCTFTMSGSRIFPDMSECQIHFTKLAYQAISRRTRGRTRGRT

SEQ ID NO: 151224 - protein, 123 aa, Triticum aestivum
  Clone ID: PAT_TA_45642.pep
VRGNASPRAAFHLLPPISSTPAIFFAGHGSPPPTGRDLAGGIRWKEGAALASGSWSSSGLICASATSWEEEEGDWRVAPAGSQTGMERASAGKIEASVQAAEVYLSSIPQIHSDIVMSGLPLV

SEQ ID NO: 151225 - protein, 62 aa, Triticum aestivum
  Clone ID: PAT_TA_45643.pep
VATGILTRSANSHNSSPRTVAERKRDPSKPPTRLEIRGGGRERENTWLFYRGERHRSSPFFG

SEQ ID NO: 151226 - protein, 85 aa, Triticum aestivum
  Clone ID: PAT_TA_45644.pep
VLHNCNSAHVYPCRQEKQLSMLNYCYTRAQMKHRFFFREQNRTTSPTIVSAVRAEVVKNLYAHGCESRELAAVHVKYLTTCSPLV

SEQ ID NO: 151227 - protein, 50 aa, Triticum aestivum
  Clone ID: PAT_TA_45645.pep
ATNLYFKHRYIHVLMGLFVYIKTERSNIYTSYMKHAKQNKIINCSKNACF

SEQ ID NO: 151228 - protein, 97 aa, Triticum aestivum
  Clone ID: PAT_TA_45646.pep
LPRTAQLGRVGGRARAGVHHVLDRPGLRREAAGPGRRRARRYRVHQLGGGRGAAQGAGRRGVELAAAQGAVARHGRGCAWASHRRGRQEARPRVRGR

SEQ ID NO: 151229 - protein, 81 aa, Triticum aestivum
  Clone ID: PAT_TA_45647.pep
MGISRDCMHKRRATGGKQKAWRKKRKYELGRQPANTKLSSNKTVRRVRVRGGNVKWRALRLDTGNFSWGSEAVTRKTRLLD

SEQ ID NO: 151230 - protein, 122 aa, Triticum aestivum
  unsure (1)..(122): unsure at all Xaa locations
  Clone ID: PAT_TA_45648.pep
ETPTARPFRSDPLSSRPPTPRRRRGFGSRRPPPRXRAAPPLPEPRLPSATGGREPSPLPPPDPSSSSSGTCPGAQPAGTPEMSYSGSGGRKRLRTSPSEAEGSPRRRRGSPSVYSPSPSSLP

SEQ ID NO: 151231 - protein, 65 aa, Triticum aestivum
  Clone ID: PAT_TA_45649.pep
LSHCKNHWIGHLCKRRPSSKRNAKPKQTDRQGFPLSCQEIRASLASRRSTRAAEFSEPISIYMQK

SEQ ID NO: 151232 - protein, 73 aa, Triticum aestivum
  Clone ID: PAT_TA_45650.pep
NKDRGAAGTPKITHNGGGGRKGGGSNEKNSIRALTMDQRGRLTEKTLLQILALDRRRKRGRGGKQTDPRVRGR

SEQ ID NO: 151233 - protein, 91 aa, Triticum aestivum
  Clone ID: PAT_TA_45651.pep
LWRRILGDSAVESKENHGYVLKIKNCSKFRQEQNCSSNERRRIIDRSNSRRGSWRTHRAMIGRHGRLSRDGLDASDLPFRSPAREYGGEVY

SEQ ID NO: 151234 - protein, 123 aa, Triticum aestivum
  Clone ID: PAT_TA_45652.pep
IVCLHRPYSIAVRVEIERVKQADQVGHGLRADYYGSHQSTDLIKLVPRLLQDLDLCLIIRTPAIPLLFPLALPLESPLLLLLALPSSLSLPGNTSSMPVKTANMSSTTESPQRSSNSLVSTGR

SEQ ID NO: 151235 - protein, 39 aa, Triticum aestivum
  Clone ID: PAT_TA_45653.pep
KKMTNAVSGLHGCTDQALFILPVFRLSDVTLLEILRLHY

SEQ ID NO: 151236 - protein, 121 aa, Triticum aestivum
  unsure (1)..(121): unsure at all Xaa locations
  Clone ID: PAT_TA_45654.pep
MGFLRDSMHKRRTTGGKQKAWRKKRKYELGRQPVNTKLSSNKTVRRVRVRGGNVKWRALRLDTGNFSWGSEAATRKTRLLDVVYNSPNNELGRTQTVVKNAIVQVDAAPFXEWYLTDYGVE

SEQ ID NO: 151237 - protein, 133 aa, Triticum aestivum
  Clone ID: PAT_TA_45655.pep
RPPTRPPTRPRTRGAVWGRLHEFGDMAWLPQQRKVLYREDDRVDVSSPGDGLWDSLLGRSIPTRLLINGRAAEERLQEGSTNDTALCAAGRLQADSLERQAYGFKNDCLNFTGYPVGGYQYRIQAVRHSALTA

SEQ ID NO: 151238 - protein, 73 aa, Triticum aestivum
  Clone ID: PAT_TA_45656.pep
MVSAVLRTILVTGGAGYIGSHTVLQLLLQGFRVLVVDSLDNASEEAIRRVRQLANAPQNSLDFRKVDLRDKEA

SEQ ID NO: 151239 - protein, 39 aa, Triticum aestivum
  unsure (1)..(39): unsure at all Xaa locations
  Clone ID: PAT_TA_45657.pep
RSPLXRSHXFTRIIYKGTAYMGEGTVTGSVDFYKLFCSY

SEQ ID NO: 151240 - protein, 95 aa, Triticum aestivum
  Clone ID: PAT_TA_45658.pep
MGGPLGAIIGRYPSAAATAGPGGDDADHPGGAGGLGIIRHDRRCRDLAFLVLFAAFWVAMIVNSSFAFNQGNPLRLTYELDYKGNVCGDRHCDPG

SEQ ID NO: 151241 - protein, 143 aa, Triticum aestivum
  Clone ID: PAT_TA_45659.pep
SGTAVSLKQRQLNDLTEALRKIILEIVQVEWLHDFSSPHAQKAKIFSQNILGDDKFMSVLLNLSRRNLLDKIQSSMSLITRSIECLQACESTCVSAEGQLERAMGWACAGPNTSGAGRSTAKGSGIPPEFHDHLSKRRKLLGG

SEQ ID NO: 151242 - protein, 139 aa, Triticum aestivum
  unsure (1)..(139): unsure at all Xaa locations
  Clone ID: PAT_TA_45660.pep
VRPRXRALVSSGLAVLGYKYINLDDCWAELNRDHQGNMVPKALTFSSGIKALAHYVHGKGLKLGIYSDAGNQTCSKRMPGSLGHEEQDAKTFASWGVDYLXYDNCENNGILSTERYPPMSEALLKTGRPIFFSMCEWRW

SEQ ID NO: 151243 - protein, 114 aa, Triticum aestivum
  Clone ID: PAT_TA_45661.pep
VGWWRCSHTAEPRFRVVFSHGFTGFHLDDVHAPPVSGSTCVMRHLAHAAPAQTPQGEGRRSRQQKAQLGASYKAPTVAAEEVGEEELVVQAPEAVGVNQDTSEGFALKDQLEVP

SEQ ID NO: 151244 - protein, 113 aa, Triticum aestivum
  unsure (1)..(113): unsure at all Xaa locations
  Clone ID: PAT_TA_45662.pep
RPRTRGQTHKQTRWLSYLTHNRASTPPGQSKTFPSSWTCARHPTPGGEDTLSPEPEDDMMTEKNPLPLDEDDIGLLKTYSLGPYSTSIKTXDKEIKGLSKRINDLMWIKESDT

SEQ ID NO: 151245 - protein, 80 aa, Triticum aestivum
  Clone ID: PAT_TA_45663.pep
SGFMLAIALLSACIALGRESPAQALLAGVARPGMGLTLVEQSGPVDGERLRLPHCVQKTGGMELSCCVIPVVNPHVHRWL

SEQ ID NO: 151246 - protein, 49 aa, Triticum aestivum
  Clone ID: PAT_TA_45664.pep
RPKKLHLFTSTAHQLPSDLLCLQPGRWPGKIVSWSKQERRGEERRGGRT

SEQ ID NO: 151247 - protein, 32 aa, Triticum aestivum
  Clone ID: PAT_TA_45665.pep
HLCSCKMCSVNAKDDVSATDIYVRCAKSLILA

SEQ ID NO: 151248 - protein, 33 aa, Triticum aestivum
  Clone ID: PAT_TA_45666.pep
RPGIPLCWIRRYMHWQLTLPLGLVPCDTGHAKL

SEQ ID NO: 151249 - protein, 111 aa, Triticum aestivum
  Clone ID: PAT_TA_45667.pep
ASRYLVIPRFAVSKILSFQQKNYFCKEQPDEAYAIHQQLTGWSGEVARDVARFARALRSVGIRKGHVVVVALPNLAVYPVVSLGVMAAGAVFSGVNPRFLAAEIRKQVEDS

SEQ ID NO: 151250 - protein, 130 aa, Triticum aestivum
  unsure (1)..(130): unsure at all Xaa locations
  Clone ID: PAT_TA_45668.pep
RPRTRGIPTQPSPSEPPVQPGGPPLIPXPPSILALTPHAPGSRPDIARRRRRPDNPRRHRPKKPPIRMHRSPPVPASCRRPIHPXPPASSSPPSANASPPTVDFAEPPIIQHAPDASAVLREHRCAWIRQ

SEQ ID NO: 151251 - protein, 145 aa, Triticum aestivum
  Clone ID: PAT_TA_45669.pep
VRDLAKNLLAGHLPVCSEETKKLNRSIRALVLYENNLSGEFPSFLKSCSELVLLDLAHNNFVGELPAWLANKLPNLSYLRLRHNKFSGSIPGQLTQLEHLQYVDLADNRISGSIPHSLANLKAMIQEDQTIWNPLVWSYERPANP

SEQ ID NO: 151252 - protein, 93 aa, Triticum aestivum
  Clone ID: PAT_TA_45670.pep
GRGRRRSRWCTCTSWLRRWCGRRRRPACQRGRTPTVGVRRGAGYAEEASGWGDIGEDQPPSPWQSRSAAAASYGESQHSTAETGEGRELLGRT

SEQ ID NO: 151253 - protein, 108 aa, Triticum aestivum
  Clone ID: PAT_TA_45671.pep
MLGTIDGRVASLLAASGAMMAQPQLEKKAPPRAKPPLTGKAVAALCVASFAVGLLLSGWVPLLSAPIGKVNKTSAPSGCDDNRVSKELAGERHDPMGIMSEVFRTHHA

SEQ ID NO: 151254 - protein, 57 aa, Triticum aestivum
  Clone ID: PAT_TA_45672.pep
SAHASGWLLLPTYSSVPGPVPFRSLGFSSIGEEEGMADVQYRCFVGGLACATDYHSL

SEQ ID NO: 151255 - protein, 76 aa, Triticum aestivum
  Clone ID: PAT_TA_45673.pep
RPPTRPRTQNAQASSARTEPATTTTMAVTTAHLPQPRALAALLVLVLLITLGGAAEAQPPFGTCGAQLSQLAPCAR

SEQ ID NO: 151256 - protein, 87 aa, Triticum aestivum
  Clone ID: PAT_TA_45674.pep
RGHTPHSKNCWSQRNSGRPGAPRRKEGRAPHSRLGPRRRLPRRRGRRGRTSRCVSVRVYAATVRCVRRFRGARGRHVPGSPGRVGGR

SEQ ID NO: 151257 - protein, 114 aa, Triticum aestivum
  Clone ID: PAT_TA_45675.pep
SSSQNKKATITNQCSQRFSSSDNSSPPQENILGGAVMATAGSEQPETKPTLRVGILAIILALCIGGLILGFQKGDASIHRDPRFFVRLTEVHGLDPARNPGIRPDFNLELHVDN

SEQ ID NO: 151258 - protein, 114 aa, Triticum aestivum
  Clone ID: PAT_TA_45676.pep
VRGRVGAYLLAYLSGNASPSAEDLTSILESVGCEIDNEKMELMLSQVKGKDITELLAAGREKFAAVPSGGGGVAVSPAASAVGGAAAPAAESKKEEKVLDKEKSDYYMGFILVY

SEQ ID NO: 151259 - protein, 74 aa, Triticum aestivum
  Clone ID: PAT_TA_45677.pep
GHQRLHGRVAAKLESMEPCSSLKERRNGSSSQARCAVVGSVSSLSVFCRPLCHVAPAVLFEVGYKTGMEARQVA

SEQ ID NO: 151260 - protein, 105 aa, Triticum aestivum
  Clone ID: PAT_TA_45678.pep
IPALQISGNITTNEMANAMRYSYLRGPGGRFRNPFDHRVRKNCSDFFLKGYNEDIEKVEQTSHPDEEMAIIHMTRGAGLQNGESVPLHANGADHVCADSPTHSKL

SEQ ID NO: 151261 - protein, 85 aa, Triticum aestivum
  Clone ID: PAT_TA_45679.pep
MAQDDPVVSAQWLQQHLGQLDIKVLDAYWYMPQESTDPWQEYQVAHIPGALFFDIDGIVNRATDLPHMLPSEEAFAAAVSALGIN

SEQ ID NO: 151262 - protein, 102 aa, Triticum aestivum
  Clone ID: PAT_TA_45680.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCH

SEQ ID NO: 151263 - protein, 74 aa, Triticum aestivum
  Clone ID: PAT_TA_45681.pep
LARPTPSMATIPTTGYASLLRSSAALQRDGRSTRPSSAARPLPGRRARSLSVVRAFAKDIAFDQASRSALQAGA

SEQ ID NO: 151264 - protein, 100 aa, Triticum aestivum
  Clone ID: PAT_TA_45682.pep
RAGAGAVSGETTSASPSSSSSARTRPLSSRRGSARRVGRGAWYSARMLVMRKSRSLLLSSAPAPPAPAAAAAPPPSSGSRFRRRLGIGGEMGGEGKLSPD

SEQ ID NO: 151265 - protein, 120 aa, Triticum aestivum
  Clone ID: PAT_TA_45683.pep
ARAVTRPNAGYGAGGVAKGDRSRVSDAMTAGAAPALRWPVGPGVWSYKTSATRRVRRCKKHEHLWPVTAAAAKPSGGRSTATVVVRYGAHVVAGRWGKHGDAHSDDGGKLGEVQGWSERS

SEQ ID NO: 151266 - protein, 89 aa, Triticum aestivum
  Clone ID: PAT_TA_45684.pep
LDPDLMACCVPAQEKRSCSHSTLREPRAPQSLDAHSPGGPVGRPFANHHRLGTSMAVALLPPSLCDALHETPMCRHPTCAWQIFSLNHQ

SEQ ID NO: 151267 - protein, 62 aa, Triticum aestivum
  Clone ID: PAT_TA_45685.pep
QTRARQITNSRKTLTLTPLPPHENTILTCCCCPPPVIEPPSPSPCLSRMLPPHSPSLVMMPD

SEQ ID NO: 151268 - protein, 109 aa, Triticum aestivum
  Clone ID: PAT_TA_45686.pep
SGRFLPHASYSLPPSRSHLAACRAPPLLPPPPAATSPPAPPASPLGRTPLLFPRLASLPSPVQTLGPRPPAADAAARPGHPPAVKEADREEGRRRVCMCLRGFVPRLPE

SEQ ID NO: 151269 - protein, 96 aa, Triticum aestivum
  Clone ID: PAT_TA_45687.pep
MPEYCVTGGTGFIASHLIRALLAAGHTVRATVRDPSDEAKVGFLWDLEGADERLQLLRADLLVEGSFDAAVSGVDGVFHAFYPVVVSFYDGKDAQE

SEQ ID NO: 151270 - protein, 100 aa, Triticum aestivum
  Clone ID: PAT_TA_45688.pep
YHTYPRLGGPFWSLEEAEKAIKSHLDGLRSPIMCRDGLSPAEVAVRHRLYWPDGTRKKSSEGNPGRRNMNLLVQALLDKYNEDHHLLGDLAYELDNVVCS

SEQ ID NO: 151271 - protein, 72 aa, Triticum aestivum
  Clone ID: PAT_TA_45689.pep
TNRLKQYFTPRGQPSIMFICIFNCKCIQMGVGMKVQVSPVRHKILDHTHISWCNFSKGVFLTAHMSGVKKIS

SEQ ID NO: 151272 - protein, 101 aa, Triticum aestivum
  Clone ID: PAT_TA_45690.pep
PHVIPFRFFLQAPLLSHFLQLLDPFHHTSTTNLVTIARRQAAKHSPSLPPSLPPFFPSIHTHTPCSCAGSGTTPIYACILHRPLARKRFRLGASGQANPQR

SEQ ID NO: 151273 - protein, 88 aa, Triticum aestivum
  Clone ID: PAT_TA_45691.pep
VRVRVGPPTEPLARAAPDALTLASPASASLSELPWPSTPAAMAARSDGPPTRGRVALCGRRGGLSGVEVCDEVRTGRRSTVAVFWRRC

SEQ ID NO: 151274 - protein, 103 aa, Triticum aestivum
  Clone ID: PAT_TA_45692.pep
MKLEIMPRQRALEAGQREEAMEMSGLELWKHEKPPKIFPMPPPLPPMLAAPGAGGYDEATLVPPLNFAMVDDGIYRSGFPAAANFRFLKSLNLRSIVYLCPEP

SEQ ID NO: 151275 - protein, 106 aa, Triticum aestivum
  Clone ID: PAT_TA_45693.pep
MATAHYYPPPPPPIAHPLPRPHAADNAVPDDGGSDSESVAESSCPHQHPRRPTARDEEEEEDGCSGSCVEADEYWGYYYQQQQHPQEADDEEEVSTASVWWKKKRA

SEQ ID NO: 151276 - protein, 106 aa, Triticum aestivum
  Clone ID: PAT_TA_45694.pep
MASPALLRYLVVLLLLVGCLGWPVPPPPRMVDGITAIYNFGDSISDTGNFIREGAVGLMEHTGKLPYGSAIGGPTGRCSDGYLMIDFLAQDLGLPLLSPYLVKVAD

SEQ ID NO: 151277 - protein, 79 aa, Triticum aestivum
  Clone ID: PAT_TA_45695.pep
MANGDETLVSPPAAGTAEVEKAAPNGGAEGEEVTVGVAVHPVKSYAVYAANAVIEDLRAIKLDLEEQLANASQENKTLA

SEQ ID NO: 151278 - protein, 80 aa, Triticum aestivum
  Clone ID: PAT_TA_45696.pep
SADAWADAWAAFCLVAPIGSIEDLLSVSSFFPLPLLFLPYFTLCNLFQCYDALYVSSASFSLLYLLRPIVGAFILLGCYI

SEQ ID NO: 151279 - protein, 110 aa, Triticum aestivum
  Clone ID: PAT_TA_45697.pep
SSTVGASDRPQSPAPSVGPRQRDRGGPRVGVELVALHGANERALGVEWLDLDLGVGVPAILVDDIVEEGGIRGGRRCGRRRWRSPRAGTARRHWRGRGRGRAARGRVGGR

SEQ ID NO: 151280 - protein, 86 aa, Triticum aestivum
  Clone ID: PAT_TA_45698.pep
RPPTRTRLLIRLPFSAPTPRPRLITRRIFCLLLLVLPRYPASSSAASYLDASSAAPRHTSHNPTASPCVQFYCLDLCWNLYDYSLP

SEQ ID NO: 151281 - protein, 130 aa, Triticum aestivum
  Clone ID: PAT_TA_45699.pep
SVCALCALQNHVKTALQSTGKIVTPSQIVKNLRCISRSFRNSRQEDAHELMVNLLESMHKCCLPSGVPSESASAYEKSLVHRIFGGRLRSQVKCTRCSHCSNTFDPFLDLSLDIGKATTLVRALQNFTED

SEQ ID NO: 151282 - protein, 115 aa, Triticum aestivum
  Clone ID: PAT_TA_45700.pep
RPNRLKYALTYREVQSILMQRHIMVDGKVRTDKTYPAGFMDIISIPKTGENYRLLYDTKGRFRFHSVRDEDAKFKLCKVRSVQFVQKVIPYLNTYDGRTIRYPYPLIKANDTIKL

SEQ ID NO: 151283 - protein, 82 aa, Triticum aestivum
  Clone ID: PAT_TA_45701.pep
MDIDSEPPAESKPTQMDLEDQADADGKGEDEELADSIGSLSIAPGRTSFKKKPVVVLVIGMAGTGKTTFMHRLVCHMQASTN

SEQ ID NO: 151284 - protein, 130 aa, Triticum aestivum
  Clone ID: PAT_TA_45702.pep
IFSFLKLLQDTCQCIIDLGHASSGPRESGMVQIVPAIDFLSKPSVSRVLQPNEVGSSCMPPNDHIIHGGVCSSGSFAGEQISSSNMLVIANRPAHDVNDITKGEEHVSIPIINKVGSGILPPPFPHASAD

SEQ ID NO: 151285 - protein, 58 aa, Triticum aestivum
  Clone ID: PAT_TA_45703.pep
MRVCILIHIGQAVIQVGNACWELYCLEHGIQPDGQIPGDMTVGGGDYAFNTFFSVTGA

SEQ ID NO: 151286 - protein, 107 aa, Triticum aestivum
  Clone ID: PAT_TA_45704.pep
RPSRSSRTYPASDLRQPPESGHRTPDHFLPRGGAPTIDDPAAVPPPSSSSIRALPHPASFLQHGRFGPAPSQLPAHSTAMAGSGRHWPPTRPPLPDPAPTSPYDHYR

SEQ ID NO: 151287 - protein, 81 aa, Triticum aestivum
  Clone ID: PAT_TA_45705.pep
ARDPSLPKGPAPFSTARRSARSVRAAYCHIIRTVSSPSLMFASTNAFALASMKTSTAPAPGAGAAITGRGELHASAHASAD

SEQ ID NO: 151288 - protein, 115 aa, Triticum aestivum
  Clone ID: PAT_TA_45706.pep
LQQMQQQMQMKGLKLPPQFMGAAAAKMPFPAGAPAKDPKSVKFNLPDDGWGDDGGSEFDDEFDEFDDDEDYDDEGFEDDYYDDPKMMMKHMGMPPNAGGGDKNGADIGGKKGGGG

SEQ ID NO: 151289 - protein, 90 aa, Triticum aestivum
  Clone ID: PAT_TA_45707.pep
RPPTRPWSLTENHYLKSKHRKLNVGTILWSLTESRQTTPILLFTPSVPQYKTILQAMLACKKILYYGTEGVIDRNTEHKVDAYAHAPSKH

SEQ ID NO: 151290 - protein, 124 aa, Triticum aestivum
  Clone ID: PAT_TA_45708.pep
VRASAYTTCWVGTGCAERLVAPNATAPDAIVFTSSAEVEGLLKGLDAAGWSWPRLRARWTDMVVAVHGPVTADGVRRLGIEVDVVSSRFSSFHGVLDALAATFCSQQLKISSRFSAGSPDAWRT

SEQ ID NO: 151291 - protein, 79 aa, Triticum aestivum
  Clone ID: PAT_TA_45709.pep
RSWTRGLTHVLSRVLVPFLYFWGVVLAMVVVSRLHDGDRLRPVPACGHRSLRIRVQAYDGHRLRYLSLLPTRLGRPGWS

SEQ ID NO: 151292 - protein, 95 aa, Triticum aestivum
  Clone ID: PAT_TA_45710.pep
RADIQRIFRLGSRNLHTWILSLKGCPDCSRQYRDGTDFYLSAETILNAKAACIGGTEHYDFLRDASYFTRCGYMKTQQLTGLEAYRECTNASRLR

SEQ ID NO: 151293 - protein, 121 aa, Triticum aestivum
  Clone ID: PAT_TA_45711.pep
VRPRVRRRNTSFDPAQWWSSHGSDSPNLRVLAMRILSLTCSSSACERNFSVFQQIHTKIRNRLLHNKMRDLVFIKLNSKLKQKRRIPIGDPTVDHTFVDVVEDEDTEWITGIAPHEPDEAA

SEQ ID NO: 151294 - protein, 102 aa, Triticum aestivum
  Clone ID: PAT_TA_45712.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGMEDASNN

SEQ ID NO: 151295 - protein, 58 aa, Triticum aestivum
  Clone ID: PAT_TA_45713.pep
AKCGPCIHEYALDPAVSVEEALEPRVARVVVQVLLEEGPHPSRLPETSPYRAPPQGGV

SEQ ID NO: 151296 - protein, 128 aa, Triticum aestivum
  unsure (1)..(128): unsure at all Xaa locations
  Clone ID: PAT_TA_45714.pep
MSVLQSDGVNDASTGTGLEAREKKREVTETVELXIELRDYDPEKGKRFSXECXLAHIPRPKMRVCMLGDAQHVHQAEKLALDYMDVVSLKKMNRIKMLVKKLAKKYHAFLASEAIIMQIPSLLGPGLK

SEQ ID NO: 151297 - protein, 88 aa, Triticum aestivum
  Clone ID: PAT_TA_45715.pep
RAPPPRARRQIDPPPSASRFPAARARRNPLIQQQQQRVSRVHRGPNGLRRKLREALSSPRALAGLRARIHGPRRGSEEGLESRATPFG

SEQ ID NO: 151298 - protein, 47 aa, Triticum aestivum
  Clone ID: PAT_TA_45716.pep
SLRSRPSSQRLMHLSKPSIFASFCKVRWIDQFLFSRTNRIEPTRPRT

SEQ ID NO: 151299 - protein, 89 aa, Triticum aestivum
  Clone ID: PAT_TA_45717.pep
TVPEFQVEHASGSTSGVVAFHRKRKLPSPSLCDATVDEDDYSYLPLFPVTFLSSSYSPSYSSYSHSDEDDVYSFTTFTVDCLYAVPVSS

SEQ ID NO: 151300 - protein, 87 aa, Triticum aestivum
  Clone ID: PAT_TA_45718.pep
YDRLPCYHRLAICLYTDRYHGLVCANQAVYTLSSFIGQHSVRAYKYGGYVGESCMLPTRAHYMVGEQAYAARELYIGGRIAKAKMEK

SEQ ID NO: 151301 - protein, 120 aa, Triticum aestivum
  Clone ID: PAT_TA_45719.pep
MRAPAMLRLAAAGIALVALLAAAPPAAAFYLPGVAPTDFAKGDELLVKVNKLTSIKTQLPYTYYSLPFCKPNTIVDSSENLGEVLRGDRIENSPYVVQMREPKMCQNILKITVTEKEAKE

SEQ ID NO: 151302 - protein, 50 aa, Triticum aestivum
  Clone ID: PAT_TA_45720.pep
MNRRPELCRNYQRGSCKYGAQCRFVHANSNQQQQQQAKPNPFGFGAGSRQ

SEQ ID NO: 151303 - protein, 144 aa, Triticum aestivum
  Clone ID: PAT_TA_45721.pep
ASADAWVEAAVALFRSPLPHSGCVSSKTRAPKIPRAAKAAVGVPAFASPAGPGHGSPAVALQIPEDPQPRRRACRIGGLPGVERVGPFVEGALQGHRCLYLRGHLFFLLDPPIDLDPKEKVIQVRFTKGIFRGYQEFLNRLDLY

SEQ ID NO: 151304 - protein, 86 aa, Triticum aestivum
  unsure (1)..(86): unsure at all Xaa locations
  Clone ID: PAT_TA_45722.pep
VRSHTTGFSNFDLQLLGMGPDGTMECALEVHTPAEENKKRVTHILDSHKASAKIITFTLAVLNXLVYVDMVVSGSMKANACQERNF

SEQ ID NO: 151305 - protein, 108 aa, Triticum aestivum
  Clone ID: PAT_TA_45723.pep
MATQISKKKNFVSDGAFYAELNEMLTRELAEDSYSCVEVRVTPMRTEIIIRATRTHNVLGEKGRRIRELTFVVQKRSNFPENGVELYAEKVCNRGLCAIAHAESLRYK

SEQ ID NO: 151306 - protein, 97 aa, Triticum aestivum
  unsure (1)..(97): unsure at all Xaa locations
  Clone ID: PAT_TA_45724.pep
MNSGRARMVRTDDTDLKCNEEDARAKQLATKARIGSQRGRSSCVNESHRYWPGTVAFPGIXRNRKRLXLLIWTLPFQRLIREIAQEFKTGLRLQSHA

SEQ ID NO: 151307 - protein, 93 aa, Triticum aestivum
  Clone ID: PAT_TA_45725.pep
MRGGRGGRGGAQPAWSGGRGRRRQTRRESGGRGRRRRWSTTAAEKEGPGGRQGGSPAVKGDSRRGKAGRGGGEGCRRRTSCSAPTPMDLEFIG

SEQ ID NO: 151308 - protein, 67 aa, Triticum aestivum
  Clone ID: PAT_TA_45726.pep
SEKGEKRNARRRQGDLSADSTRCSLERPDPNPNPSPHALSWIISSTLCSTSATSVSTRKRRARRRMR

SEQ ID NO: 151309 - protein, 67 aa, Triticum aestivum
  Clone ID: PAT_TA_45727.pep
CNSGDNKHGECFLCVKDFIYYHQHQRKLLFQKACVEIFANNVSMQIKFHKWLAVGTNLWIRAHASAD

SEQ ID NO: 151310 - protein, 29 aa, Triticum aestivum
  Clone ID: PAT_TA_45728.pep
AIMFRATQGNVTHLFTLIILSQVQLVSVH

SEQ ID NO: 151311 - protein, 38 aa, Triticum aestivum
  Clone ID: PAT_TA_45729.pep
VRAYSIFIPGCMLWCFPHYLCESGRFNLNQILFAFRDD

SEQ ID NO: 151312 - protein, 73 aa, Triticum aestivum
  Clone ID: PAT_TA_45730.pep
MATGNPDACEVERLYQLGDRLFLTKDKSQHAAGYEAIIAVVKGPNVKAKQLAAQLIPRYFRSFPALGTFAMEA

SEQ ID NO: 151313 - protein, 82 aa, Triticum aestivum
  Clone ID: PAT_TA_45731.pep
VVPVAAGKYGPKSAAGGGGSRHQVLSLEGSERRRRKGSGLVVGGADTERVEAVVYPVCFGRGIWVARLGGLALGFIYRGVTA

SEQ ID NO: 151314 - protein, 68 aa, Triticum aestivum
  Clone ID: PAT_TA_45732.pep
MARAKGRKRAAGDSQAEAVEANGGRSKRAKAPSKPKPEPEYVHEPRNLEDLWLTAFTIGTEWEIMDKI

SEQ ID NO: 151315 - protein, 97 aa, Triticum aestivum
  Clone ID: PAT_TA_45733.pep
MSPQTETIAGVGFQAGVKDYKLTYYTPEFETKDTVIMAAFRVSTHPGVPPEEAGAEGADESSTGTWTTVWTDRLTSLDRDKGLCFYIIACCLGKTSK

SEQ ID NO: 151316 - protein, 70 aa, Triticum aestivum
  unsure (1)..(70): unsure at all Xaa locations
  Clone ID: PAT_TA_45734.pep
LDAEQYTTKFHEYALRYAAAPIPLHHQMYLPSKQMMSERLCAPTRTASMVLELAMYYDIRVGYAMXECNG

SEQ ID NO: 151317 - protein, 47 aa, Triticum aestivum
  Clone ID: PAT_TA_45735.pep
SMLAWKNLEKRMGKRLAVGRVVAPLPLTASLCTISAEHHQQCPRIWA

SEQ ID NO: 151318 - protein, 68 aa, Triticum aestivum
  Clone ID: PAT_TA_45736.pep
AMNQPQARPDTGSRQMEPAPHPCTLRTRDRTAAITPDPSPPPTGTGAPQASLAGALMGGRQLARARTK

SEQ ID NO: 151319 - protein, 49 aa, Triticum aestivum
  Clone ID: PAT_TA_45737.pep
SHPSFVNICKPSLLNVLLLQRCCACVDVDCLCCYLSSDVSHTCLLHCSS

SEQ ID NO: 151320 - protein, 80 aa, Triticum aestivum
  unsure (1)..(80): unsure at all Xaa locations
  Clone ID: PAT_TA_45738.pep
SLPLERLSEDYGRKSKLVFTEDPSTHVSTSVVEPYNTXLPTHSLLEHTDASILLRQXRLIYYSCMRFLDIERPTYTNLVP

SEQ ID NO: 151321 - protein, 81 aa, Triticum aestivum
  Clone ID: PAT_TA_45739.pep
FSGCPPPRGSALITGAIAQSRLLALLLSSRRPLTLSPQSGRPKNPSSETWRCPSRWRSARYCPSDEMWRGRAAAASKSTSK

SEQ ID NO: 151322 - protein, 45 aa, Triticum aestivum
  Clone ID: PAT_TA_45740.pep
RDVSGRNHISVASVLHASTLPTPLIHRKFILKIVGFRSLICFSYV

SEQ ID NO: 151323 - protein, 91 aa, Triticum aestivum
  unsure (1)..(91): unsure at all Xaa locations
  Clone ID: PAT_TA_45741.pep
MGKVKTHIIIVVIGLVDSGWSTTTGHLIYMLGGFXLVCIXRFAMEAVDINYPSFMYACVLDMVWACRERDITIAIALLKLETILCYCTAID

SEQ ID NO: 151324 - protein, 107 aa, Triticum aestivum
  Clone ID: PAT_TA_45742.pep
VCYTLFYHAVRQLFSLSMACIKLPASKRHLMLDLLTYVPAHGIPMWSSTAARSDVGAARSVRLRLAPRASMVQTVFSSAGAELSRRRPMPWLPPFRTTCRWPFSLAS

SEQ ID NO: 151325 - protein, 56 aa, Triticum aestivum
  unsure (1)..(56): unsure at all Xaa locations
  Clone ID: PAT_TA_45743.pep
ATTTTAVSSSTLCVALFSHRLSIGPHDSGRWLRDATRRNHGGHHLRRDGSLRXXRK

SEQ ID NO: 151326 - protein, 88 aa, Triticum aestivum
  Clone ID: PAT_TA_45744.pep
FLFTTFHSVLPSLPLRLLPCHGAPRRLPCGGGLPTLRPLLCPTAPAPRLWLTLKPFIPDKFDHILYEISVRSSGCICCAFGSSTLGQD

SEQ ID NO: 151327 - protein, 77 aa, Triticum aestivum
  Clone ID: PAT_TA_45745.pep
NSVPDKKGAHSRSVSAPYLKKKQGGGSYNAQSTSGSGSSRFGWVLQKTVVLVSKSSNQAKLGEENCFYYDENLKRWV

SEQ ID NO: 151328 - protein, 66 aa, Triticum aestivum
  Clone ID: PAT_TA_45746.pep
VVRQRRSRRVTSAYGGGGAGAGTLQVQGRDGSLRVQVQAKVTAWGRPALSRPRRRSNHATANAWAD

SEQ ID NO: 151329 - protein, 71 aa, Triticum aestivum
  Clone ID: PAT_TA_45747.pep
VRSLIGRTLVIRATSELVFVRVILHDTALVVRAVLAGNPVQCHAGSAYGRAVHGVVRCGRRLLGGCERAGA

SEQ ID NO: 151330 - protein, 45 aa, Triticum aestivum
  Clone ID: PAT_TA_45748.pep
PSPPPPAPGTSSWRTQSLPLVRDRRHHRSLSLDSNPQRMGKASGR

SEQ ID NO: 151331 - protein, 82 aa, Triticum aestivum
  Clone ID: PAT_TA_45749.pep
MAFPKLFLQLVTLLPSCGLLLADFDLMTLIVVNNCAYPICPELQVSAGKEVLEGGGFFLPSLFHRFFLAPTHAWSGRIWART

SEQ ID NO: 151332 - protein, 67 aa, Triticum aestivum
  Clone ID: PAT_TA_45750.pep
KSLDKSRPWAPSPGEKKDVPTLPEPRARPTVVVRHNNPNHGASSYQHLYNLSTGQTRSLRRTKPLRL

SEQ ID NO: 151333 - protein, 43 aa, Triticum aestivum
  Clone ID: PAT_TA_45751.pep
PSSTRRTRDTASSAHGTVLGAIIRRRSTVDLSNAGVGSLSLRT

SEQ ID NO: 151334 - protein, 56 aa, Triticum aestivum
  unsure (1)..(56): unsure at all Xaa locations
  Clone ID: PAT_TA_45752.pep
SFSGXWCLHQCSDLPSHKLFRSQLPNAFGKPLTFIIRMRLDLLIKSNAFLKPSFIT

SEQ ID NO: 151335 - protein, 72 aa, Triticum aestivum
  unsure (1)..(72): unsure at all Xaa locations
  Clone ID: PAT_TA_45753.pep
WRTSSSRLIDLAPNPGMVTILALGHAIPQQIVXMQDYVVXGFMRNTNCNDPELKEKLARLCKTTTVKTRTLV

SEQ ID NO: 151336 - protein, 143 aa, Triticum aestivum
  Clone ID: PAT_TA_45754.pep
SAHASAQTELQALTGYAEPGTITALMGPSGSGKSTLLDALAGRLAANAFLSGTILLNGRKANLSFGAAAYVTQDDNLIGTLTVRETISYSARLRLPDNMPMEEKRALVEGTIVEMGLQDCADTVIGNWHLRGVSGGEKRRVSI

SEQ ID NO: 151337 - protein, 146 aa, Triticum aestivum
  unsure (1)..(146): unsure at all Xaa locations
  Clone ID: PAT_TA_45755.pep
YSRTRGAVWRCDSGVSDGRRVGAGVDLEGGYYDAGDNVXFGFPMAFTTTMLSWSVLEFGDYMPREXADTAADAVRGGTDYLLKTLAHPGVIFMQVRDPWKDHECWERPXDMDTERTVYNVSAXRPGSEVVGETAAVLVAAFMVFRD

SEQ ID NO: 151338 - protein, 71 aa, Triticum aestivum
  Clone ID: PAT_TA_45756.pep
KLCLEYNKKSSMVVTRQSQFQYIQFDTIAETHRCINWVFTKLNIIALIVPRIYLKQNFNLISEIRRFFYGM

SEQ ID NO: 151339 - protein, 65 aa, Triticum aestivum
  unsure (1)..(65): unsure at all Xaa locations
  Clone ID: PAT_TA_45757.pep
XFLSVLFFSFTSLFNATSDPIRSGLKLQQTVLFHLICGHTIYKQYLKGKSKSCGRSKSLIRVTLP

SEQ ID NO: 151340 - protein, 137 aa, Triticum aestivum
  Clone ID: PAT_TA_45758.pep
RPATLSNMSSSYHTHPFAQILGRNQPIHGAMPSLRREDQGGVRSAAVSTPVGRCAVTVRGWACTTGSRGGLGYRSVYRRPRQRHPRCRQRERPEEGAEHHRLPDLRVDVPNQVPHQQPLSVGHLLPALQGRQLQRLV

SEQ ID NO: 151341 - protein, 65 aa, Triticum aestivum
  unsure (1)..(65): unsure at all Xaa locations
  Clone ID: PAT_TA_45759.pep
SPAVLPPPPSRPSVPRSAASSSPVVARPTWPGLVATGWSRLSSLSSSYKLVVVLITRTTGSGXSW

SEQ ID NO: 151342 - protein, 130 aa, Triticum aestivum
  unsure (1)..(130): unsure at all Xaa locations
  Clone ID: PAT_TA_45760.pep
MDKEKTHINIEVIGHVDSGKSTTTGHLIYKLGGIDMRVIERFVKEAAREXNKRSVKYAWVLDKLKARAVSRGXITINVLPLWEVVRQTIGLAARVYLMPRERPVYFIKNMITGTIQAGXADLIIVLTTGG

SEQ ID NO: 151343 - protein, 95 aa, Triticum aestivum
  unsure (1)..(95): unsure at all Xaa locations
  Clone ID: PAT_TA_45761.pep
MARGSMAAVLAVLAVSQLRCAPAAVELPLVEHPAKNDGSFNLLSCXDWGRNXSYNLSGVLEQMVMVEERLNIDFCVFTVDFFYEKGLTCFHDQQF

SEQ ID NO: 151344 - protein, 127 aa, Triticum aestivum
  unsure (1)..(127): unsure at all Xaa locations
  Clone ID: PAT_TA_45762.pep
DALLLPYPPDSYPAMGRTMLAAWMSTGGXVPRKQLATKAARKTAPSTGGVKKPHRFRPGTVALREIRFVHMSTELVIRKLSFQRLVREIAHDLKTDLRFSPPSFKPCRSRRAYLDGLFXDTNLCAFH

SEQ ID NO: 151345 - protein, 89 aa, Triticum aestivum
  Clone ID: PAT_TA_45763.pep
PYKQDLIRLFAKVRGLRLEFTPLLYNQPTSAARVDQLSRRSGGCPAIYFFLHAYRMRSQSQYTACKKILGSFRTKSVTVAGKSELIQQH

SEQ ID NO: 151346 - protein, 65 aa, Triticum aestivum
  Clone ID: PAT_TA_45764.pep
LAAYKSKSKLSMRRLRPPCSAEVFIRVMCPQGECAFGLTRVRLYVRSGPHQRELPSALWFPFGRV

SEQ ID NO: 151347 - protein, 99 aa, Triticum aestivum
  Clone ID: PAT_TA_45765.pep
MANDMAQDEVSQSSAASAGVNARVHDVTPEFTARYDAHHHGHAHHHDHHHHQQQHQQQHHQYQHQYHHQGQDEGEAEGDADNAQDNPHLELAQELAKQV

SEQ ID NO: 151348 - protein, 81 aa, Triticum aestivum
  Clone ID: PAT_TA_45766.pep
TRINDECGMTNGVATELPNGLPYRLVHTGQKNIAQGGLNRPQVLYRCTWVFSSSARSCRPHYGSDKERVDLVCYTMVLYKT

SEQ ID NO: 151349 - protein, 86 aa, Triticum aestivum
  Clone ID: PAT_TA_45767.pep
MDFLQGQSVETMVAVAVAVVAVAVGGALLLRRSKRPKGCLDPENFKKFKLVEKTQISHNVAKFRFALPTPNSVLGLPIGQHITCRG

SEQ ID NO: 151350 - protein, 144 aa, Triticum aestivum
  unsure (1)..(144): unsure at all Xaa locations
  Clone ID: PAT_TA_45768.pep
RTSTRSPTRFAHASVPPYTSSPRGAFRSEPQGSPPRPPAKRAPKRGGRRRAAKKRXDKGVNPLFERRPKQFGIGXALPPRRTSTGFVKWPQGSCRIPAPSARIPQGSGLKVXPPALHQFTRTLDKNLATNLFKMLFKYRPEDKV

SEQ ID NO: 151351 - protein, 100 aa, Triticum aestivum
  Clone ID: PAT_TA_45769.pep
ICGRVKSCQSLGRLSSGGRSCVARRPSLRRWSGPRLPRRVSVPRTEVLELPERRQGQQEERIVPSTCCCHSIDQELGRLLSGVTIAHGGVILNMNPGAAF

SEQ ID NO: 151352 - protein, 75 aa, Triticum aestivum
  Clone ID: PAT_TA_45770.pep
MAAVMLLRRLPAARSPLMAATRAISDSTAPFTIETSMPFTVHIVDPPSRDVSTTPVELVPFFHDMFLMLRREIVA

SEQ ID NO: 151353 - protein, 69 aa, Triticum aestivum
  Clone ID: PAT_TA_45771.pep
SEAKPRLSPPPPKMQIFVKTLTGKTITLEVESSDTIDNVKAKIQDKEGIPPDQQRLIFAGKQLEDGRTL

SEQ ID NO: 151354 - protein, 93 aa, Triticum aestivum
  Clone ID: PAT_TA_45772.pep
IAVSTLDLPGRQRRLYIFFSSIPPTLPFAGPPHYGPEPTGPDYSPPRRPADLFHPPPLPFTPAWPVAVRQQQLLRQGGRNRASSPPASVPPTF

SEQ ID NO: 151355 - protein, 69 aa, Triticum aestivum
  Clone ID: PAT_TA_45773.pep
VRRERVLLCSTFVPCALLLTWASTPAFTEAEQRVRDREMKGVRGMAVVMALLLALVVMVGTYLVVFYQV

SEQ ID NO: 151356 - protein, 85 aa, Triticum aestivum
  Clone ID: PAT_TA_45774.pep
SGYIHEFDRRRDWRHTVGRTGEQNSASINRHGVRKWKGVPAATVHWFKSDTELTMDVELLDTRDINPMKLQKARFRYGFYSFLSK

SEQ ID NO: 151357 - protein, 88 aa, Triticum aestivum
  Clone ID: PAT_TA_45775.pep
PRGVWCPRSPSTRRPPPFLSFSSRRGGLLEPGMFPKHPRSTLSPFTKPQGQSRTSTPRRAVRPGYTTHSSRSRPQPERRAKVLLVLPN

SEQ ID NO: 151358 - protein, 87 aa, Triticum aestivum
  unsure (1)..(87): unsure at all Xaa locations
  Clone ID: PAT_TA_45776.pep
MAGTKHTARESTGGLAPRKHLATKAVRKSVPATGGVKKPHRFRPGTVSLRXIRKYQKSIELFIRKLPFHRLVRDIAQDFKTDLCLQS

SEQ ID NO: 151359 - protein, 92 aa, Triticum aestivum
  Clone ID: PAT_TA_45777.pep
MGSGSTTVRLMAFASALVLLTHCIHAAAAPSFQQKQAAAKTWCVAKPSTGEAALRANLEFACSESDCSAIQGTGGCSAHNGGVLLSRASVAM

SEQ ID NO: 151360 - protein, 72 aa, Triticum aestivum
  Clone ID: PAT_TA_45778.pep
SQLPWCRRLCPGLVIICLSLATRHQAWDHCLTLTTMSEAQYHLFARGDHAPSLLSVSCPRRPCAKLVILPLP

SEQ ID NO: 151361 - protein, 139 aa, Triticum aestivum
  unsure (1)..(139): unsure at all Xaa locations
  Clone ID: PAT_TA_45779.pep
VRLTLPPPPARILPGEAEIPRQAGRQAAPWTRSPSTRRPSPPPPSPPLPAASSASRNPSRPPPPXSPPKSPPPAEEETLAPHLGSPPPPPPNHSPPSPPSAEEAVAPRLGSPLPNPSPPPSEQQSVAPRLGAPLLPPPP

SEQ ID NO: 151362 - protein, 81 aa, Triticum aestivum
  Clone ID: PAT_TA_45780.pep
QRGQGAIQVQSWQSAALYNESVVSTLKTQLMKVVGDHANLTMEGLRRQRIERAVLFPVRITSTLSPEAFSRRASSLEVRAG

SEQ ID NO: 151363 - protein, 122 aa, Triticum aestivum
  Clone ID: PAT_TA_45781.pep
SSSTPHRGPRHGAGNRLISCRALPSLPYTRDHNKPAACLLLLVSPRQRTKCWRRTTHRPIGTGQLLLTAYATVVFLVMSNEKVTSARDEGLGREPHAAPRMDCAVHGYHETHLLQRVQARDE

SEQ ID NO: 151364 - protein, 53 aa, Triticum aestivum
  Clone ID: PAT_TA_45782.pep
SASQRAYGSFYSFFPLMLARSIIFYIETKSCLPFLHLVLIHFFLFSFMSIFFF

SEQ ID NO: 151365 - protein, 111 aa, Triticum aestivum
  unsure (1)..(111): unsure at all Xaa locations
  Clone ID: PAT_TA_45783.pep
RPRTRGGRMGYVHIDDVSFRGVLFYETGEASVIYFCSSVVLDNNELVGLLTKHFLVFPISRWFRDPYXKRAYQLNTFKLQGLGLKFKGVQEIFNXCVESLKSQGHFFECPL

SEQ ID NO: 151366 - protein, 104 aa, Triticum aestivum
  Clone ID: PAT_TA_45784.pep
ATTAVFSYIIVERRDLEGGNYLPLFDSTLSRDNNIPSRQIYHVHNDNAYKRSYYFKTLLILPHVTHQIKHSIHLLFSDHGHGEKFLLDFSGIPSGPHSCDILNT

SEQ ID NO: 151367 - protein, 112 aa, Triticum aestivum
  unsure (1)..(112): unsure at all Xaa locations
  Clone ID: PAT_TA_45785.pep
VRGRVGGRVGFHVSELKRCWGXPIREVDHETLDLQDNLTYRECPIRILDQAERTTRRHNIKFLKVQWSHHSEDEATLEREDRLRLEYPAFFSEEPKSRDEILLSGGELSHPS

SEQ ID NO: 151368 - protein, 111 aa, Triticum aestivum
  Clone ID: PAT_TA_45786.pep
TSGFMRSTDRDLPKLSCYDLPHVHGLQQPLLSVHPSSSLQHRSRREQPFPDETQINHQAAHVRPQPQILQSAPHSGSSGCCSFDSYRVFGASGRQQPGACVSVGGSDFRAA

SEQ ID NO: 151369 - protein, 108 aa, Triticum aestivum
  Clone ID: PAT_TA_45787.pep
MPAGHGLRSRTRDLFARPFRKKGYIPLTTYLRTYKGGEHVDVKVNGAVHKGMPHKFYHGRTGRVWNVTKRAIGVEINKRGGNRIIKKRIHVRVEHVQSFMGNEELIQR

SEQ ID NO: 151370 - protein, 120 aa, Triticum aestivum
  unsure (1)..(120): unsure at all Xaa locations
  Clone ID: PAT_TA_45788.pep
MGADKFVSEVWRRKXSDVMRFVQRVRCWEYRQQPAIVRITRPTRPDRARRLGFKAKQGYVVYRIRVRRGGRKRPVPKGIVYGKPKHQGITQLKFQRNKRSVAEERAGRKLGGLRVLNSYW

SEQ ID NO: 151371 - protein, 110 aa, Triticum aestivum
  Clone ID: PAT_TA_45789.pep
MSNRGRGGSAGNKFRMGVGLPVAATVNCADNTGAKNLYIISVKGIKGRLNRLPSACVGDMVMATVKKGKPDLRKKVMPAVIIRQRKPWRRKDGVFMYFEDNAGVIVYLKG

SEQ ID NO: 151372 - protein, 95 aa, Triticum aestivum
  Clone ID: PAT_TA_45790.pep
QKWHECESQEVLIDLTDGISSPHLEIVLECLLVKVYCAGSPSVCRACNCMPGPNDYVISCSLLLLDYPKDGRTYPVEMIPPMVLIMFNTVKVVCR

SEQ ID NO: 151373 - protein, 104 aa, Triticum aestivum
  Clone ID: PAT_TA_45791.pep
MGSGSTTVGLMALASALVLLTHCTHAAAAPSFQQKQAAVAKTWCVAKPSTGEAALRANLEFACSQSDCSAIQGTGGCSALNGGVLLSRAFVAMNAYYQARGRNS

SEQ ID NO: 151374 - protein, 59 aa, Triticum aestivum
  Clone ID: PAT_TA_45792.pep
RPRTRGHRRTYLTKHLQALYTDDSSIGEAMLFLFSHLHAALVFLPNNGCPAWAGPGIRL

SEQ ID NO: 151375 - protein, 72 aa, Triticum aestivum
  Clone ID: PAT_TA_45793.pep
ASVPVSQFGAGGTPPSAPVGGRRSRNREALPTALVRGRRGNDTRRVGGRGAPPVLPLMSDRRGREHKERVAT

SEQ ID NO: 151376 - protein, 86 aa, Triticum aestivum
  unsure (1)..(86): unsure at all Xaa locations
  Clone ID: PAT_TA_45794.pep
RPALPAAAAGSLVSSATSAVKGRIRSRGKGTSFSALPCTRTPSIWVKTGFINVDXLITKAVNNVHMPTQIDVLLRDQQGMLLEKSV

SEQ ID NO: 151377 - protein, 82 aa, Triticum aestivum
  Clone ID: PAT_TA_45795.pep
VETAPWPRSTQGEPACGGEHPPPRNARTHRSRTPSLPDGFTLPLFLRLRWWSPPKHTGSHLVHATLRYGSGPPRVHERVGGR

SEQ ID NO: 151378 - protein, 56 aa, Triticum aestivum
  Clone ID: PAT_TA_45796.pep
RPPTRPGQDRKDLEASVGVLGAPLPAPGTMAVLARSAVAVAALTLLALVVAGEVFF

SEQ ID NO: 151379 - protein, 47 aa, Triticum aestivum
  Clone ID: PAT_TA_45797.pep
KNNAFVVYLKNCNIKNLIEGWIVCIKVYYMRKLPSFRYRLCYCLNQL

SEQ ID NO: 151380 - protein, 129 aa, Triticum aestivum
  unsure (1)..(129): unsure at all Xaa locations
  Clone ID: PAT_TA_45798.pep
RPSDYRSVCKMIRTYFLRPPWRTGSTSAVSHKPFRRDLYCGXDSSSHLGGLFKEYQLYRIDHYLGKELAQNXLVLRVANRLFLPLWNRGNVXDDIQIVFREDFXTDTRGGYFDQYRIIRDIIHNHLMQV

SEQ ID NO: 151381 - protein, 71 aa, Triticum aestivum
  Clone ID: PAT_TA_45799.pep
MAAKGDGPAIGIDLGTTYSCVGVWQHDRVEIIANDQGNRTTPLYVAFTDSERLIGDAAKNQVAMNPINTRL

SEQ ID NO: 151382 - protein, 30 aa, Triticum aestivum
  Clone ID: PAT_TA_45800.pep
SDNYPPPPKMPPWQRCRLAKASHTVSLWLI

SEQ ID NO: 151383 - protein, 34 aa, Triticum aestivum
  Clone ID: PAT_TA_45801.pep
KKVFCVRGVPSVGRCLFYHLSMLKVWLLLVKSLF

SEQ ID NO: 151384 - protein, 122 aa, Triticum aestivum
  Clone ID: PAT_TA_45802.pep
SAHASGAAQSPTRRRSLTLAPGRRSPNTQLRRLSSQPSHLRSQRARTPTDGSPARRSFLRPPDEAGGEPDAATRGFGQMTRTSGANGGGQQGSGKLPRKRFYRARAHSNPLSNPEPATRTAT

SEQ ID NO: 151385 - protein, 64 aa, Triticum aestivum
  Clone ID: PAT_TA_45803.pep
VREPFHSIRLGSQIKHTIGGSMLEPPVVWGVWKHIFFIPLSGYSLHTRDMLNLFEHPAVRCSYR

SEQ ID NO: 151386 - protein, 119 aa, Triticum aestivum
  Clone ID: PAT_TA_45804.pep
RPPTRPRTRGRRRNPNPHPTDRARDAPPLPDDPSIHRVSPPTAAMEEEIRAEFEGSGFTIGGDSAQILSTLLTYCVNYKMSPADLVSNWEVYYLNRQLDGLKVESSYLDGFLSHLQNEV

SEQ ID NO: 151387 - protein, 69 aa, Triticum aestivum
  Clone ID: PAT_TA_45805.pep
MGPRNGGGRSFRPAPRAVPVRNPPAPARADSSPATTQSSGGGIMSGIGATIAQGMAFGTGSAMAHKAVD

SEQ ID NO: 151388 - protein, 56 aa, Triticum aestivum
  Clone ID: PAT_TA_45806.pep
TGCSASKCAWRCTASYSRRWGRVLEGIWRLTARCLSLLPLAVALVTLYLNPRVRGR

SEQ ID NO: 151389 - protein, 78 aa, Triticum aestivum
  Clone ID: PAT_TA_45807.pep
SAERHRPMTMGAEREAGEEEEARRPLLPPSPSPAAEHQQQYQHLGRSSSSALRGGGCSEVNTANEKPHERLLILLLLR

SEQ ID NO: 151390 - protein, 78 aa, Triticum aestivum
  Clone ID: PAT_TA_45808.pep
SGRQRASSGHRVCVCVNLLPACPQGKIVDLVQTNVLGGGTVQEPIVPQKEKIHPNPTLKHTCVPLDMGVPYTPRVNHQ

SEQ ID NO: 151391 - protein, 144 aa, Triticum aestivum
  unsure (1)..(144): unsure at all Xaa locations
  Clone ID: PAT_TA_45809.pep
VRPRVRIPPRPPGYAFVEFEDPREADDAIYGRDGYDFDGYRLRVELAHGGRAQSYSYDRPSSFSNGRRGGVSRRSEFRVMVDGLPSSASWQDLKDHMRRAGDVCFSEVYREGGATVGVVDYTNYDDMEYXAITKLDDTEFKNAF

SEQ ID NO: 151392 - protein, 86 aa, Triticum aestivum
  Clone ID: PAT_TA_45810.pep
SADAWAKRQASRSTATVAAAGDSALYLLLLVGRFESSPGPTLTGACPREKPATARHDTNPPAPLSPRLLLSPFKPLHSAAALHFSR

SEQ ID NO: 151393 - protein, 119 aa, Triticum aestivum
  Clone ID: PAT_TA_45811.pep
VRPRVRPRVRGLPVARSVLPSTTRQVALLFILVLLKQSSGIMLANRTLQSNKRNLFDPHALFYCSVPCVHFAFDASHLCLILISIHYFLRKQTKSYFSPNGTASEDRGGSGRCPFVHRP

SEQ ID NO: 151394 - protein, 69 aa, Triticum aestivum
  Clone ID: PAT_TA_45812.pep
HGPIITNVSIVHSHGYHSFMCNLLFLKELLQNRNRWHGPLPTMLVQSPVLDTVSFSSSVFTKNPTRPRT

SEQ ID NO: 151395 - protein, 128 aa, Triticum aestivum
  Clone ID: PAT_TA_45813.pep
VRPRVRPRVRFAPPLPPRRRSAKKPRTRSPSPPRRSHLLSSAAVQLKRPMELFQHGQHVRLRSRALGTYLHADDDGQGASLHHRRASMNAAWAVHVHHPPRAQVPYLLLHSARYGLYLAATDGPAPVG

SEQ ID NO: 151396 - protein, 96 aa, Triticum aestivum
  Clone ID: PAT_TA_45814.pep
GRGNAAETSRVSVVARPAPGADRAPAPVRPAAPGQGGLAREGAALCQGWWWLECSEGCDAGVGRGTRHECRHRDGVTAASGEGWWRNGWGWTWRRT

SEQ ID NO: 151397 - protein, 50 aa, Triticum aestivum
  Clone ID: PAT_TA_45815.pep
SRTRPRNIYWQYGDAGKSYMRWAGGMAVALDTGVPCVMCQQADAPVTPGS

SEQ ID NO: 151398 - protein, 85 aa, Triticum aestivum
  Clone ID: PAT_TA_45816.pep
VREPNTGVTFDDVAGVDEAKQDFMEVVEFLKKPERFTAVGARIPKGVLLVGPPGTGKTLLAKAIAGEAGVPFFSISGSEFVEMFV

SEQ ID NO: 151399 - protein, 87 aa, Triticum aestivum
  Clone ID: PAT_TA_45817.pep
MQVVRKMQAEGRPSAGRGGSRDGRWEDGVAAATAVDLRMVWRRRRWTEEWCGAGAGGPEGGVAAPPVDRRMVWRRLRLWTGPRVRGR

SEQ ID NO: 151400 - protein, 134 aa, Triticum aestivum
  unsure (1)..(134): unsure at all Xaa locations
  Clone ID: PAT_TA_45818.pep
YSIHHSRIDPRIHPYASYMLTDQQLHHVRLQLRSGXLDWEPTQGLTPSCPDGKCGDLFLENTLTAATLACESTTCSYAGYTNGTWFTILDNLTTNSVCNAGGISSAAQSAHYCENRLGSPARWYGAGRGAPCGS

SEQ ID NO: 151401 - protein, 103 aa, Triticum aestivum
  Clone ID: PAT_TA_45819.pep
ERESLFNNAQGNRPAQSHQKEAKRERKSREGGGPRRAPGTRGTPPAGSDADRPPRRDVPPPPARARRPPGERGTRQGAREERCSAPPHLGGLFLFSQTLACAR

SEQ ID NO: 151402 - protein, 94 aa, Triticum aestivum
  unsure (1)..(94): unsure at all Xaa locations
  Clone ID: PAT_TA_45820.pep
VPPLVSPHFRPRLRPNVLVPKAEGRHSVYGKPNSSTFDLLPTKHPXMQRILILRRLFRNYLEAKKINKYMDHFYFLKVTGNMFKNIRVLMVTFH

SEQ ID NO: 151403 - protein, 114 aa, Triticum aestivum
  Clone ID: PAT_TA_45821.pep
RREFLCSCSPPTNRIHPAIHPSMMGEANENDVYEEELLHYEEDDDKALDAFYTANAKPAGDADQAKMGYRWHTQLRDSATSSSSPSLLRAIQDCGFKPPSEGILSDDISRLGEK

SEQ ID NO: 151404 - protein, 63 aa, Triticum aestivum
  Clone ID: PAT_TA_45822.pep
MAWGAGSLRKASTLLYHYPCPDGAFADLVVHLYFSAERLPVRFFPNTDYYPIKSDGLTIDEIE

SEQ ID NO: 151405 - protein, 117 aa, Triticum aestivum
  Clone ID: PAT_TA_45823.pep
LSWTHGLELGLKEDDKATRGMGEARDMHITNTATIDLLGQHIMQAMKLLKLHILVRECLPATIIRGITGCGVERTGKGNIFRSVINLGERERIYRFEGNFGTIFIRLGGPREHQSTG

SEQ ID NO: 151406 - protein, 89 aa, Triticum aestivum
  unsure (1)..(89): unsure at all Xaa locations
  Clone ID: PAT_TA_45824.pep
SAHASGGSAPHRTEQSPTPDPAPPXSAPPPPPSSGIASSPPGFALAPPLGIASPPPGVASAPPPGIASPPLGVASTPLLGVTQTCVGKR

SEQ ID NO: 151407 - protein, 144 aa, Triticum aestivum
  Clone ID: PAT_TA_45825.pep
SADAWALTYEIYCSTDLKDAREDGLCTVRCGIAAQEPQPPGEECVSQASSNAATSEKHEQEAKSVTSSSDEDSWVEVKIPESPLGNYTPESQAERNAIGICQKNTLAHYEATAEITDANPCVSLTVRLLSLQSKTSGHIEKIYI

SEQ ID NO: 151408 - protein, 49 aa, Triticum aestivum
  Clone ID: PAT_TA_45826.pep
AGPLPFAAIFWGQGRLRLFTPGGFFLLRGRKKWRRVKERLSPYVLVGTG

SEQ ID NO: 151409 - protein, 99 aa, Triticum aestivum
  Clone ID: PAT_TA_45827.pep
RVVPCASGTTQYLTGRWSWGTRTILLLQRNVTDHRTDDDYVVCPSYEAPCRASRLQRGACQYPILLLTLLHDYTYVMAQIVKFLPKLGTLPGGNYYLSN

SEQ ID NO: 151410 - protein, 58 aa, Triticum aestivum
  unsure (1)..(58): unsure at all Xaa locations
  Clone ID: PAT_TA_45828.pep
SVHFRVLSKALRMSXGGDHMHGGTVIRNLKSQHQMTLGFVDLFDNDFIEKKARLGCLF

SEQ ID NO: 151411 - protein, 138 aa, Triticum aestivum
  Clone ID: PAT_TA_45829.pep
VRKTSENQWFTRLCPSIVCTKEQRELAAEAVRHGTVLLKNDNSFLPLKRSEVSHIAIIGAAANDAYIMGGDYTGVPCDPITFLKGMQAFVPQTTVAGGCKNVSCDSTDGFGEAIEVAKRADIVVVNAGLNLTQETEDL

SEQ ID NO: 151412 - protein, 103 aa, Triticum aestivum
  Clone ID: PAT_TA_45830.pep
SAVHPGARHARIYRRIWWKRIWTRRSPCSWHIDLSLSETASTSRARHRTSLPNEWIRRRALLIDLVNHHVGQQGSRQRTGQRGKAKGKRKSAGYGGSSGSKTR

SEQ ID NO: 151413 - protein, 101 aa, Triticum aestivum
  Clone ID: PAT_TA_45831.pep
MAALGVLLVMVAAMVAAAAAAATPSAPRPFFVFGDSLVDSGNNNYLATTARADSPPYGLDYPTHRATGRFFNGLNVPDIISEHLGAEPVLPYLSPHLDGHK

SEQ ID NO: 151414 - protein, 52 aa, Triticum aestivum
  Clone ID: PAT_TA_45832.pep
MLQCIAEWDPWGVPDDYECEVIEDDTPIPKHVPQHRPVALPEEFFKTLDAIK

SEQ ID NO: 151415 - protein, 110 aa, Triticum aestivum
  Clone ID: PAT_TA_45833.pep
SHRPLSEGCRRGSAGRCRGGGPRAAARRWRWRGARRRGRAGGAPPSPAAGRRGAGGRGASGSPSPVGGKGRRAADDTGDAAGRSPERRRRHRSRDMASASGIWGSRHFCP

SEQ ID NO: 151416 - protein, 140 aa, Triticum aestivum
  Clone ID: PAT_TA_45834.pep
REAPPPRFWSPTGVEPPPRVSSTSSRGPLPPAGGAARPPPRPRFLPPPPPLLSPESLPPSRPPPPPPPRRLAISTPRWGGRSSGRLVELGWVLGGFPKLVEGGGGGDGTARPLRVGPATYSGASQRADAWADAWADAWAD

SEQ ID NO: 151417 - protein, 73 aa, Triticum aestivum
  Clone ID: PAT_TA_45835.pep
NQSIVTRCTYKAVSNKNNPGHASKKCDFLAHGPTKIPFLQHLMECSIRTTLCSKKIISTDGSTEAQGNERHVT

SEQ ID NO: 151418 - protein, 48 aa, Triticum aestivum
  Clone ID: PAT_TA_45836.pep
SCIIIIRYYCDTFIIHPKDMVAPMRKQKTDSVTCTFSLLEINKKYRNM

SEQ ID NO: 151419 - protein, 107 aa, Triticum aestivum
  unsure (1)..(107): unsure at all Xaa locations
  Clone ID: PAT_TA_45837.pep
FFFLSNXVFSRFLNRNFSPPTKKIIIGRKGLMGNKGCSRGKITLWGATWAWLLKKKKGWWWKTILKKKWDKVSTMVGKKRYVIFFKGYSTRETGIYKGGGDFNFFNF

SEQ ID NO: 151420 - protein, 86 aa, Triticum aestivum
  Clone ID: PAT_TA_45838.pep
VTGIFCLEVTILNIFILCSDYSMPFLQIAKTVVLDYYFLNLGRWFILTTSYYCITRKRTKILVCGFHSWPFFLRCIVGHLKNPKGS

SEQ ID NO: 151421 - protein, 103 aa, Triticum aestivum
  Clone ID: PAT_TA_45839.pep
PRSADPASTHASGELLVSHKEDRRWLRWHCSCVIAWQPSGRTAAAMDDHDDYPPARSLPAADDDPSTRSMPAPSDEQDDNPPLRSMPPAPPSDEQEDNPSWAG

SEQ ID NO: 151422 - protein, 107 aa, Triticum aestivum
  Clone ID: PAT_TA_45840.pep
STHASGELLVFGRKAESQNTLFMEEASSDERILQANIQLKLLQPDQVQIGAQHAALLGLQSVVSHRPPHEPLLRRQRPGLLELLLWRLVHHRQVRPQGGGQPLAWLP

SEQ ID NO: 151423 - protein, 115 aa, Triticum aestivum
  Clone ID: PAT_TA_45841.pep
SADAWAGSTVRLAEAQKTWCMAKPSSDEKVLQANINYACSNVSCAVIQPGGPCYNPNNLLSHTSVAMNLYFAANGRHSWNCYFADSGIIVKSDPSEWPATSLPTCRDRRHYSLQL

SEQ ID NO: 151424 - protein, 117 aa, Triticum aestivum
  Clone ID: PAT_TA_45842.pep
MAGAPRNQEPTVGTSPSPPRASALLRHRLPTEQFQDGHHVRLRSRERGTYLHADDDGLGVSLRRRRASMNAAWAVHIYEGDGDALYVLLHSAAYGRYLAPRTRRRREATAGAASSSA

SEQ ID NO: 151425 - protein, 122 aa, Triticum aestivum
  Clone ID: PAT_TA_45843.pep
MDISTVCIRPSTIIGPRAADSTSLRPGYPDWVLLNKTARISDQRNATTALCRTREGQAVAVSFWLVDPPAVSYFSVHCPGLEDDDFSDTPPFLLCAEGAFVVFCVTLDDSVHHFVYSGRGIP

SEQ ID NO: 151426 - protein, 145 aa, Triticum aestivum
  Clone ID: PAT_TA_45844.pep
RPHGPRFPSITACCECCSPHPQRRHHLTSSKLFPCAPSSAVRISSMKMLLFPIAGLSSTPSGVRCPVFGLAERVVVDAVTVGIKGNGARVWATAGTELRGGRGPMTRRRRGGGQGEREKRGGDPGQDGGRGWRSDGAGAATAGGR

SEQ ID NO: 151427 - protein, 67 aa, Triticum aestivum
  Clone ID: PAT_TA_45845.pep
MDAARIASLLLLLGVVWSRAQPGAEAAGTTGFTLRNNCTFTIWPGTLSGNSAAVVCGGGFKLAPGAN

SEQ ID NO: 151428 - protein, 144 aa, Triticum aestivum
  unsure (1)..(144): unsure at all Xaa locations
  Clone ID: PAT_TA_45846.pep
VRGLVGGRVGYLSSSEAIPACPTATPLRLSPMSSPPPPPPPAVPXPAPPRPMRLSRTLRAPSRASPASTTCSSSSSTSGASSTSTPTPSAAPCPRSPTTMPTPTPSPAPWDSSGPSLGSGTPCFPPAAYSPFADRGSGRNPTLD

SEQ ID NO: 151429 - protein, 127 aa, Triticum aestivum
  unsure (1)..(127): unsure at all Xaa locations
  Clone ID: PAT_TA_45847.pep
MAPAAHGRTTPTRRMRECISINRQAGXQVGNACWELYCLEHGIQPDGQMPGDKTGGGGDDAFNTFFNETGAGKHVPRAGFVDLEPTGIDEVRTGRLHGRFFPHLRQGYQWAREDAWQQTSGRGHYTI

SEQ ID NO: 151430 - protein, 64 aa, Triticum aestivum
  Clone ID: PAT_TA_45848.pep
FAFSCADSWSVIGIGEQGLMSVAVSWDEVLSAGNRTGPAVVSGGTGAAFLPVRAGLLGLYNRGV

SEQ ID NO: 151431 - protein, 38 aa, Triticum aestivum
  unsure (1)..(38): unsure at all Xaa locations
  Clone ID: PAT_TA_45849.pep
XLDPLVLNHPIPIHVLSLLLLHIYILGEGTYCKGSPTL

SEQ ID NO: 151432 - protein, 155 aa, Triticum aestivum
  Clone ID: PAT_TA_45850.pep
YACRTGPHSGWRTRPPTRPQPRIGPSRDKPSPDEGDKNHRESEKYSGNVQRTSQAPQRVPTARPGRVVGPVLPYENGGMKDTYDPRRVAAMNSGYPPQQQIPQIYGYYQTPAKSACSEPSQAEVYTLHQQAYACANSSTVPDVALDMRAPPFHQS

SEQ ID NO: 151433 - protein, 130 aa, Triticum aestivum
  Clone ID: PAT_TA_45851.pep
SACRCLAKARRRRCLAQASRRGVYIPLGWSAAVVCIPLGTGAQQGLHPLGHRRARAQRRKQCSPPSRDHPLTLELADRGPAHLLNVGSTVRIPISETGSGCRAHSRGWPPLSPVGYVAGEPVCDGMHPGG

SEQ ID NO: 151434 - protein, 122 aa, Triticum aestivum
  Clone ID: PAT_TA_45852.pep
VPVRIAGGGTRPLTFLLPASFLDPLHRPSWGGGFRGGVGGITHLTAVIFIQLRPPPCLQPPWVQPLIHASRSPPGSPGLLHSLNQGRPRGPHGPGRLHAFSIYHQMGFHVGPANSHGYFLSP

SEQ ID NO: 151435 - protein, 43 aa, Triticum aestivum
  Clone ID: PAT_TA_45853.pep
SLLVLPIHLYGPFRWAKSIQQNKDYLSTLTMLHFYHRVLRRMY

SEQ ID NO: 151436 - protein, 146 aa, Triticum aestivum
  unsure (1)..(146): unsure at all Xaa locations
  Clone ID: PAT_TA_45854.pep
FPPAVPLLNSXGRGRAPRPTTSTTTQEPNNSGAPTGGRVISLGGLAPPGHPTTPTGGTLSGGLTFMDSPQNPTAGPTANGGFMFSASPEQPLTPASSSAGGGLWSLATEPSLSPREYHGGRAVASFPSPNHALTGYTDSGGLAFFP

SEQ ID NO: 151437 - protein, 92 aa, Triticum aestivum
  unsure (1)..(92): unsure at all Xaa locations
  Clone ID: PAT_TA_45855.pep
PSLIPXSTHSSSTPFPSLSLTHPHTLFHTSNQGAIFSTAKFLHPILSIHLYFFSQNTFIPLLSNLLFLIYSNKNFFHSLTIPFPLTLLIQLY

SEQ ID NO: 151438 - protein, 112 aa, Triticum aestivum
  Clone ID: PAT_TA_45856.pep
MDVSGGGSGAKGNNGAAGLKAGGPRKKSVTRSVKGGLQFPVGRIGRYLKKGRYAQGVGTGAPVYLAGVLEYLAAELVELGGNAAKDNKKRRIIPRHLVVGVRNDEELGKVVA

SEQ ID NO: 151439 - protein, 71 aa, Triticum aestivum
  Clone ID: PAT_TA_45857.pep
QNSVIVNQHLQLVSKAHAQLVWMHLITMITLTYGLMYATIEFTTTHALMFYRKEIYHQVSASRQEEPRIHT

SEQ ID NO: 151440 - protein, 132 aa, Triticum aestivum
  unsure (1)..(132): unsure at all Xaa locations
  Clone ID: PAT_TA_45858.pep
RRQRAAYFFTCRDNSSTGCGHGYFGGRIFRPSEILSLKGISCKYVPTXAKFTDILTRKGLRYTHAIHTHGQVRHRDTTYMACAKMVEXIKIVHSIXQRSCHSNYTFAATGSGTHNSFPSCTNLSLADRDNHN

SEQ ID NO: 151441 - protein, 78 aa, Triticum aestivum
  Clone ID: PAT_TA_45859.pep
ATLPCTLVREAPPLCSNGEGNAGGEPAHLGGRPAHVVCLLVAYTSSTSPSIPSRPNLKPAGGITPAIFCSPIERALCR

SEQ ID NO: 151442 - protein, 146 aa, Triticum aestivum
  unsure (1)..(146): unsure at all Xaa locations
  Clone ID: PAT_TA_45860.pep
GTRPSISKPHQPTSLPVYPASTPVGGTKQAGGMSTGGKAPRKQLLTKAGRKSGPATGGVKNPHRFRPGTVALREIRKYQKSTELLIRKLPFQRLVREIAQDFKTDLRLQASAVSALQEAGEAYLVGLFXDTNLCCIHAKRVTIMPK

SEQ ID NO: 151443 - protein, 62 aa, Triticum aestivum
  unsure (1)..(62): unsure at all Xaa locations
  Clone ID: PAT_TA_45861.pep
WKLYICKGRLVTDKDTNKPKGYAFIKAFPSSDXKNANNHPVGRKGDNKRVLVVGERGKTGPN

SEQ ID NO: 151444 - protein, 56 aa, Triticum aestivum
  Clone ID: PAT_TA_45862.pep
VNLDHINRKAILFLFYIFNNKFIFYNLLIFFRDNRHISPLRPLPCVEHYINGGTHC

SEQ ID NO: 151445 - protein, 70 aa, Triticum aestivum
  unsure (1)..(70): unsure at all Xaa locations
  Clone ID: PAT_TA_45863.pep
MASGXAFRGAVLAAGLVVPFLGPAAVEAQLGQVREYWGSQVALGRQACAILPATSPEHRHQDDEGDDDDY

SEQ ID NO: 151446 - protein, 125 aa, Triticum aestivum
  unsure (1)..(125): unsure at all Xaa locations
  Clone ID: PAT_TA_45864.pep
MTHILKEFRVLYIQMRGAVPEAGILFNIDSETAAHIILSQAITDEAVGSTRTMERVMGTNNIIENNYRLRMKNIPERIKRHLILEQQLACFXVPMEDHIKLIKDFQRKETGYIRLKRDRIWGDDF

SEQ ID NO: 151447 - protein, 102 aa, Triticum aestivum
  Clone ID: PAT_TA_45865.pep
MAVATSRGIALVGGGGVSVTAHPHPAAGGPPATPPPAGGATPPPAVGPAKAPPLPAGPAKFPAILAFGDSVGDTGNNNHLRTFIRSNFPPYGKDFPGHKHTG

SEQ ID NO: 151448 - protein, 93 aa, Triticum aestivum
  unsure (1)..(93): unsure at all Xaa locations
  Clone ID: PAT_TA_45866.pep
XPIDYCCHVRAPLYRHPSFRAGCFWTGGRHHSYPSQPVPVPRVACGDPQQGLPLHLRQQHPPLGQRPRARFLYLPSNLFVPEAVGAHPLRFPS

SEQ ID NO: 151449 - protein, 127 aa, Triticum aestivum
  Clone ID: PAT_TA_45867.pep
RPPTRPRTRGCKCISCVLIWGGRNRGWDGKGMPYVLAKYYPLELCYANRCFPLGLWSKQQFGMVSSTEWSNKPIVPYMVTRKCKGDIFARVRDTLAKASQLCGEDDRTKALCLNHEQNNPGLLQHRS

SEQ ID NO: 151450 - protein, 73 aa, Triticum aestivum
  unsure (1)..(73): unsure at all Xaa locations
  Clone ID: PAT_TA_45868.pep
MHPGYGSRNTVSSSRLPMYVRTLEAGANGFWLHQVAGLHHHVALAAAYRICSTAMRNGXPTPQEEEEEHAECY

SEQ ID NO: 151451 - protein, 52 aa, Triticum aestivum
  unsure (1)..(52): unsure at all Xaa locations
  Clone ID: PAT_TA_45869.pep
MEHNEAGCQXPVGPILWVNNWGFFCSAATMNICSKCHNGMVMKEEHANLAGS

SEQ ID NO: 151452 - protein, 55 aa, Triticum aestivum
  unsure (1)..(55): unsure at all Xaa locations
  Clone ID: PAT_TA_45870.pep
LPSALDLMLRAXRAGDHIWWVWENFNFTQYKCFQIFLVQCSLQIHCNPSLLALLL

SEQ ID NO: 151453 - protein, 134 aa, Triticum aestivum
  Clone ID: PAT_TA_45871.pep
VRLPPPYSYPSPTRHGPSPPPRVGLMLGGPLFSSTSATGDQAHLSAVIGDTGLAFCKDVLICEAVRSLTPLRLPGAGKAFRVPFLGGIRTGVSNITLFHLDVGDDSVVRLCDSALFVVTSGITANISIAWSYFY

SEQ ID NO: 151454 - protein, 84 aa, Triticum aestivum
  Clone ID: PAT_TA_45872.pep
MGVVSAVADAVVVLFSLTITVAVPLIYAQTVLPPDLYPAPLRDLKRWYAAEFDDYLMGHPAAFLHGLFCLELAFLWPVFGGTIL

SEQ ID NO: 151455 - protein, 117 aa, Triticum aestivum
  Clone ID: PAT_TA_45873.pep
PKKAPGAVAGVAVGPVVNAHGDEKAGAPGYGVGRYEPGRPSAVVGARLEACRVGVHGRAMRALDADLDGASARTGARAPGIHHGVGEARPPDTPPPGWRSKRGRAQRRKEWGTGERT

SEQ ID NO: 151456 - protein, 35 aa, Triticum aestivum
  Clone ID: PAT_TA_45874.pep
YNIYFFIVLKHLHPDICIFYKAMYFMNFFINDIFD

SEQ ID NO: 151457 - protein, 57 aa, Triticum aestivum
  Clone ID: PAT_TA_45875.pep
VRISRLSKCCSYYISNPLIYSWARGTLGGWEPVLYYIINACMGKNLFFITYVEKHFS

SEQ ID NO: 151458 - protein, 55 aa, Triticum aestivum
  Clone ID: PAT_TA_45876.pep
KKKKKKGEGAYRFKRLLAHPFILSKLSYSFMLNYILFIVPPIFISLTFNIHPFTF

SEQ ID NO: 151459 - protein, 107 aa, Triticum aestivum
  Clone ID: PAT_TA_45877.pep
AVPNLPFRPTRPPMRPRHVSSPETHRLRLPPLIVFPPCVRFPFPTRRAAVHRKSPPPPAKPSPPRRRRLLTQPALRRAGAPAPAGAHQVISCGMARIPIGIGFPFHE

SEQ ID NO: 151460 - protein, 122 aa, Triticum aestivum
  unsure (1)..(122): unsure at all Xaa locations
  Clone ID: PAT_TA_45878.pep
RPRRAWPRLAATYGLSCAAGGGCLATLVALLGTVCSTLMSMLYPPDIVVXCAGLLTGLAFSIVYAHTIIVCSLGGVIAVLEDAAGVNALLRLVHLMRGHTQXGRVDFLCDPTIGLAFHCGAV

SEQ ID NO: 151461 - protein, 139 aa, Triticum aestivum
  Clone ID: PAT_TA_45879.pep
VNGPVVSPEFTRRVRPPRSHRVQESRPRGGPARGPSGARRRGRSRVASDMPELEGMPPSKPYQWGGVVGELSGTREADLAGGKGRPPPRELGSVLRAGEGRRSKQESTAVGGAPPRLVVGGEGETSERERCAVADACPP

SEQ ID NO: 151462 - protein, 68 aa, Triticum aestivum
  Clone ID: PAT_TA_45880.pep
VRKHIAFHVRIITHLAISEIARVPHTRGARSTCSLISVLTCVRAEPKKNHPICHGGNWTSGVLETKQL

SEQ ID NO: 151463 - protein, 69 aa, Triticum aestivum
  Clone ID: PAT_TA_45881.pep
KKWGRFLYWGGTTSRRDHSNPPLIPSMTPLPYIFQLPLKSYRPPYKLIKHLHRTSEPTFVYSHFQGLLW

SEQ ID NO: 151464 - protein, 56 aa, Triticum aestivum
  Clone ID: PAT_TA_45882.pep
GHIKGEAALIISVKERIDSRVEDDEADPHPRIWTPPQMMAWVGEGGKGKETDMGGR

SEQ ID NO: 151465 - protein, 44 aa, Triticum aestivum
  Clone ID: PAT_TA_45883.pep
GQVWRLPWEQHQDRLGNHAALDVGLLRGYAGGSSVRLGLPGRVR

SEQ ID NO: 151466 - protein, 70 aa, Triticum aestivum
  Clone ID: PAT_TA_45884.pep
ARVRNSVAARPVSPAPSSRTKSVGRRRRLAHIGADPELNFSLEEFTAPWPCSMTAAAPSLLGSGHGSQCA

SEQ ID NO: 151467 - protein, 120 aa, Triticum aestivum
  unsure (1)..(120): unsure at all Xaa locations
  Clone ID: PAT_TA_45885.pep
ARHILPASSSSGAIIPGGPPPPRILAYYESSTTPAPPRAPPPETXTPEEPAGPQPPPRCGGTSRRSPTTSGRTTPSSPSGPSSAPTGAPSRPRGXPXPSIRFATTPRRPPPSAPATAAAV

SEQ ID NO: 151468 - protein, 110 aa, Triticum aestivum
  Clone ID: PAT_TA_45886.pep
APRVRSNPPPAKHTNPRLLPPPGGRARTKRTARMSTGGKAPRKQLATKAARKSAPATGGVKNPHRFRPGTVALREIRKYHKSTELVIRKLPFQRLVREIAHDFKTDLRVQ

SEQ ID NO: 151469 - protein, 110 aa, Triticum aestivum
  Clone ID: PAT_TA_45887.pep
LPERRKARAVHGGVRADPRRPAPAVGRSPCPRRSRIDAGGAGAGDVGDPDGVLAEARHQVLHAQSGVVTYVQARHGRSTRRNRFGVWRLTTLVASARMAFCRRRRATGTE

SEQ ID NO: 151470 - protein, 57 aa, Triticum aestivum
  Clone ID: PAT_TA_45888.pep
KHGEAPNATQSREPATPQGEEKASPSPSSPWRWRPGWHGGPPRAHIMPTPTWCNLAR

SEQ ID NO: 151471 - protein, 42 aa, Triticum aestivum
  Clone ID: PAT_TA_45889.pep
RPPNLTSHFSIHWSINYHFGGKVICTGDSNNHTSIHVYVQPL

SEQ ID NO: 151472 - protein, 91 aa, Triticum aestivum
  Clone ID: PAT_TA_45890.pep
VRSSKFSDALKKKLGFLGKGGGSGRQRFQDKIASEVIKFLTGHHWTRLCIIRPRLSSLNFLVPSTSTAMIFLYDRLMMNSGQQLELKFWVG

SEQ ID NO: 151473 - protein, 137 aa, Triticum aestivum
  unsure (1)..(137): unsure at all Xaa locations
  Clone ID: PAT_TA_45891.pep
VRPRVRPRVRGRVGAAALLPVAKARIALERRKFLENANIAVQRQATWSNLAHEMTAEFRSLCAEEACLQQELEKLQVMRNKAKLEGEPWDERISSSSGQNSHLVSKATRLWESILARMXQHEVLASGPIEDLIAHRE

SEQ ID NO: 151474 - protein, 136 aa, Triticum aestivum
  unsure (1)..(136): unsure at all Xaa locations
  Clone ID: PAT_TA_45892.pep
DATRPASPCREAIELPEIGYSTRGRKPHNRVESYKRRPTPSLPIIDLALLAGEERPVDMDLLNDTCKNWTYFQVLYHHISTDLLDEVLKITKEHYNMTLEQLFLXCESTTLKDCRRPDDILDRESTLFGRHLMEPN

SEQ ID NO: 151475 - protein, 66 aa, Triticum aestivum
  Clone ID: PAT_TA_45893.pep
IFAGNLLGLPAISVPVGHDKQGLPIGLQLIGRPWGEASLLRVASAVEELCLKRRNRPSTFYDILKT

SEQ ID NO: 151476 - protein, 140 aa, Triticum aestivum
  Clone ID: PAT_TA_45894.pep
RPRTRGRNPRSLPTPSEGDASGGAASPGEGGLNPLRRRTGSPPLRSGRCRRRRSRRDVAAVRGETSLPHLLFSRPISSAGRPLPPSPPARQQLAASGWCSRERGTRVRCSQRPGAMRAAVGGGRGQRSTTVLCKRLRKLG

SEQ ID NO: 151477 - protein, 136 aa, Triticum aestivum
  unsure (1)..(136): unsure at all Xaa locations
  Clone ID: PAT_TA_45895.pep
MAEKSAATDRSEGHFILLLKMQTFVKTMPXKTMILAAVPLDTSYNVRVQXMDREGIXPDQQGVMFDAKQXRDGRTLADYNIQKESTLHLVLRLRGGMQIFVKTLTGKTITLEVESSDTIDNVKAKIQDKEGIPPDQ

SEQ ID NO: 151478 - protein, 112 aa, Triticum aestivum
  Clone ID: PAT_TA_45896.pep
GAVTGKTITLEVESSDTIDNVKAKIQDMEGIPADQQRLIFAGKQLEDGRTLADYNIQKESTLHLVLRLRGGAKKRKKKTYTKPKKQKHKHKKVKLAVLQFYKGDDATGKVTR

SEQ ID NO: 151479 - protein, 69 aa, Triticum aestivum
  unsure (1)..(69): unsure at all Xaa locations
  Clone ID: PAT_TA_45897.pep
HYSQFHFXTRWGPSREVGDFSHLRANNLIISHALDSNGHYSSNCSNHTERDNAYYIQPRHHGFFFIKDL

SEQ ID NO: 151480 - protein, 83 aa, Triticum aestivum
  unsure (1)..(83): unsure at all Xaa locations
  Clone ID: PAT_TA_45898.pep
RPVPPREERGSGIXYAPXPGVGGSPCWGASSSPSLSWASNEDRAVLEQRRPNKQPPFGSRSPQSKQQQLHFRLTGGSLGDGED

SEQ ID NO: 151481 - protein, 73 aa, Triticum aestivum
  Clone ID: PAT_TA_45899.pep
TTPTHFPPADRAPKGPSPEPFLLLRSGDLGPPENWTAPRSPQPVDAPPACSPPRLLTCQTHASADEWADAMRA

SEQ ID NO: 151482 - protein, 85 aa, Triticum aestivum
  Clone ID: PAT_TA_45900.pep
TPICTDYWLFLIRGDDCVSIHREYLPPDRAVGGEEGTRESSLDPNCRSRGGEGRGAGSVLYAAAARGRGGGMVGGLDLTRGEGGR

SEQ ID NO: 151483 - protein, 114 aa, Triticum aestivum
  Clone ID: PAT_TA_45901.pep
AHSSSRRKGRSWSSRELQEEGGVSTVIRPVNSSPTKKLVAQRKKTAFADMGLARGALFSDCGCLLLRAIIAMQEGRRSPHWRASVKDSQVLKARKAASVSRDETDASVDKGITE

SEQ ID NO: 151484 - protein, 92 aa, Triticum aestivum
  unsure (1)..(92): unsure at all Xaa locations
  Clone ID: PAT_TA_45902.pep
RPPAASFTISSLVSIPRTISRVEIFVGTLTYKTIXTLEVDYSDTIDNCNANIQDKVGIPPDQHRLIFSVKQLYDRLTLSYYYIHMVFTLHLV

SEQ ID NO: 151485 - protein, 87 aa, Triticum aestivum
  Clone ID: PAT_TA_45903.pep
DSGGTEMVRADIFSLLSRISKNVTELKAEQKLRIIDYSSGQGHIHMGNMCREGANLLEIWGRGRTPRFPGKASLGEHSGGRGSYYGW

SEQ ID NO: 151486 - protein, 128 aa, Triticum aestivum
  Clone ID: PAT_TA_45904.pep
MAQSWAFFLLVVLCLCCVSDLICGSNGERVFLYPQSQKVSSIVSQRYRTAYHFQPPKNWINDPNGPMYYNGIYHEFYQYNPNGSVWGNIVWGHSVSTDLINWIPLETAIARDTPSDINGCWTGSSTIL

SEQ ID NO: 151487 - protein, 127 aa, Triticum aestivum
  unsure (1)..(127): unsure at all Xaa locations
  Clone ID: PAT_TA_45905.pep
GHASARARTILAVLMDKKILPPTAEVSYKRTRDGPPAKQGTVTVQGTIRCACGCGGKAFTVAEFAAHAGGCGAXRPSASVYLNDGRSLSQCLVQLMRAHGGNMLATGSPFSRARVKRIFPAELGDGY

SEQ ID NO: 151488 - protein, 68 aa, Triticum aestivum
  Clone ID: PAT_TA_45906.pep
VLNCSTPRIRSVQPWLPGVPGGRVAFPSAWGFKPSTPPPLSSYLSILTATLCLCYPTFQQLNTFLSVS

SEQ ID NO: 151489 - protein, 104 aa, Triticum aestivum
  Clone ID: PAT_TA_45907.pep
HLLHMVIPPSCQQLLALDFVGLAFVTMHPICVSSQHPWLPKFQAMLDCHHHQQSSKQQEWVVKLSCSSPPIAKTSHTRPVFSATLPGGVSFNLFACHYEDEWED

SEQ ID NO: 151490 - protein, 47 aa, Triticum aestivum
  Clone ID: PAT_TA_45908.pep
KVLCPLARMARLANHKCCKADSWHPFVMQIRRISILERFVKVMLGGH

SEQ ID NO: 151491 - protein, 136 aa, Triticum aestivum
  Clone ID: PAT_TA_45909.pep
SGRLSIRTSPNSSSVDRRRGGGALGRAKHTALKSTGGMAPRMHLATKAARKSAPTTGGVKKPHRYRPGTVALREIRMYQKSTELLIRKLPFQRLGREIAQDFKTDLRFQSHSWLGPQDAAVAYLVGLFEDTNLCAI

SEQ ID NO: 151492 - protein, 47 aa, Triticum aestivum
  Clone ID: PAT_TA_45910.pep
TRSFSLKRTRGGLMEIISAAGERKKAKHAGMFDIAKTANRPMIHIGG

SEQ ID NO: 151493 - protein, 77 aa, Triticum aestivum
  Clone ID: PAT_TA_45911.pep
RPVGFSRQRIHTRVNNNQIRWADGELEDGGWRWSSPSPCGSSTGTPSRTEFQILALGVANNSKGTRNLLAFFNTSNQ

SEQ ID NO: 151494 - protein, 117 aa, Triticum aestivum
  unsure (1)..(117): unsure at all Xaa locations
  Clone ID: PAT_TA_45912.pep
MVLAELGGSISRALARMSSATVVDENVLRECLNEIARALMQADVRFKMVCDLQANIKKSVNLEALAAGTNKRRVIETAVXKELCKMLDPGKPAFVPKKGKPNVVMFVGLHGSGKTTT

SEQ ID NO: 151495 - protein, 117 aa, Triticum aestivum
  Clone ID: PAT_TA_45913.pep
MCSNPGNGRTMKGWNWLKLPTPPGYADNCIGNSHALLEIEGDSILGGSSGEERLGTYWVNTASRKWFKGGSWTLAFLSRAGHGPELDNLLFGIGRDAPNHFCAMGISRLLSKRCAPL

SEQ ID NO: 151496 - protein, 117 aa, Triticum aestivum
  unsure (1)..(117): unsure at all Xaa locations
  Clone ID: PAT_TA_45914.pep
MEAMPLLLGLTLLGGPAYCLQSPRQSYHLELXAVDSVDTGSLNITDHELLRLAIQRSRERLASITPRLYPTRNRKVVAVDAPVLEAGGEYLVNLGLSTPHCWLTADIDTGRGLIWTH

SEQ ID NO: 151497 - protein, 67 aa, Triticum aestivum
  Clone ID: PAT_TA_45915.pep
PVGSVHDPLYLNLLPPHLRMADPPPPTPQLRAPPRASEPPAELATPPQATMCVEKRVWGKGKEIGRT

SEQ ID NO: 151498 - protein, 106 aa, Triticum aestivum
  Clone ID: PAT_TA_45916.pep
VRRHLRHLKEVTVDSGVPDQTRQDWEHATKNHPNRPRLVLHKSGVRMESEGPGNEEASAVREKRKICVLQPSLDDGLDSSLKKMKLSSESSSRLQVIVHSTSSSGH

SEQ ID NO: 151499 - protein, 98 aa, Triticum aestivum
  Clone ID: PAT_TA_45917.pep
HLLVAPPASISHGVRHNAAAVASATATPATIATAIAITATDRQGSDANRWRRLSQRHSSFSTLSCLAQLSWGSSLLLSTHTHTHVGTLHTHAKAKSSR

SEQ ID NO: 151500 - protein, 141 aa, Triticum aestivum
  Clone ID: PAT_TA_45918.pep
VRPRVRALQVAGPPLSERYHTEAAQLREKFQAMAISRAEPMFPGRPGFGSKGQVCVVRANHFFVGLVDKGLHQYDVAMSPEPTMTGVFRAVMSTLVKEHQDTTLGGRLPAYDGRMSLYTAGELPFTTKEFEVTLPDKNSGP

SEQ ID NO: 151501 - protein, 113 aa, Triticum aestivum
  Clone ID: PAT_TA_45919.pep
SAQFPTPRPEDRGRGVTTRSIGSCMHAWMDHRSRSSVTSRLNHPKRIKMNSGSTCGTVSELLSGFAHTYLNQCAAANASQQKVATQTKALLLPHTASIENQLPEGDATSPRHA

SEQ ID NO: 151502 - protein, 120 aa, Triticum aestivum
  Clone ID: PAT_TA_45920.pep
MLDINLFRKEKGGDPELVRESQRRRSADAKPETLEENVALVDEVIVLDEAWRQRQFELDKIRQELNKTSKEIGKLKAKKQDATELIQSTEEIKRRLAAKEKDVEEAKTTLDAKLVTIGNL

SEQ ID NO: 151503 - protein, 91 aa, Triticum aestivum
  Clone ID: PAT_TA_45921.pep
RPRTRGRKSHTHTNAFSFISQASSSARTEPATTMMAVTTAQLTQPRALAALLVLVLITLGGAAEAQTPMGTLRAHMTQLSPLDSSMATVMP

SEQ ID NO: 151504 - protein, 60 aa, Triticum aestivum
  Clone ID: PAT_TA_45922.pep
RPIRSSSISGSSLSYHLADPLWAGAVNKACDSFFLSIHRCSFAYYGCHPFLDCCFSLCGF

SEQ ID NO: 151505 - protein, 42 aa, Triticum aestivum
  Clone ID: PAT_TA_45923.pep
NSTRGTLMSVRSRPTVLVPACDRPAYRWRGPTSRPCRRAREG

SEQ ID NO: 151506 - protein, 77 aa, Triticum aestivum
  Clone ID: PAT_TA_45924.pep
LALAVLLGHRFLLREWLLLLSNVRGGVGGEGALGAGGGEERGGSWSHRLPCGQSSACRVRPGRLKTSCGRARVVITS

SEQ ID NO: 151507 - protein, 110 aa, Triticum aestivum
  Clone ID: PAT_TA_45925.pep
VRPRVRGRVGGGGGSSTVQAPLQFMSTRVNYPSSGGAMGGMPDTSIGMLAGLNAYDRGVGGTEEEQQQEQDQQQEMEQQRDGSGGGNEGEEDGDDDSGGEEEGHGNNSSQ

SEQ ID NO: 151508 - protein, 111 aa, Triticum aestivum
  Clone ID: PAT_TA_45926.pep
MATGVGEARGETVLVTGASGFIGSWTVRLLLARGYAVHAAVLNPDDKAETEHLLALAGGDEARVRFFPCDLLDGAAMLVAARGCSGVFHLDSPCTVDRVLDPQKELVVPAV

SEQ ID NO: 151509 - protein, 73 aa, Triticum aestivum
  unsure (1)..(73): unsure at all Xaa locations
  Clone ID: PAT_TA_45927.pep
MARWCQLAAVLLAVSMAASTSVAQDALQTKCQGDLQKLSDCMDYATXHEDTPSAKCCEDTVDTQKARPECLCS

SEQ ID NO: 151510 - protein, 55 aa, Triticum aestivum
  Clone ID: PAT_TA_45928.pep
KFPADSTQLVLSISSQKFCQDQATLLRIRNIASYSTHEATWLDTDRQEILCHALT

SEQ ID NO: 151511 - protein, 141 aa, Triticum aestivum
  Clone ID: PAT_TA_45929.pep
RPGNHYCTKDCHVLEIPSDQRKADTILSLSRKNTLAEPCERCNLPCQRARDPPCSHPCPSRCHLSDCLPCKALVKRSCHCGAMTHAFECVYYNNLNAKQQLKVRSCGGPCHRKLPNCPHLCSEICHPGQCPSVDQCMKKVN

SEQ ID NO: 151512 - protein, 126 aa, Triticum aestivum
  Clone ID: PAT_TA_45930.pep
RPPTRPPGYPAQLAGAFRDNVRTLLGLRLLHGVAYGDTWFGRWGFRYGRPSYGVALQSYQQSLHALQSIPLCVLEPHLSCFSQELPMVVTKYQAISGHKLLNLGDLLRFMLELRTRLSDTFGTGMD

SEQ ID NO: 151513 - protein, 96 aa, Triticum aestivum
  Clone ID: PAT_TA_45931.pep
VRGRVGAGLYVRRLTRFRKLRSSTWYHKCGSRRRESSSSWPFLVFQIHLRPCNDGWAVDALLFFGFRFWKPSGTLFFLVKWYNLMWGIWKKNELFR

SEQ ID NO: 151514 - protein, 43 aa, Triticum aestivum
  Clone ID: PAT_TA_45932.pep
RPRTRGRMPIRTEADTLQKRTKFHMGSHNALLSRGSLLAAGHF

SEQ ID NO: 151515 - protein, 48 aa, Triticum aestivum
  Clone ID: PAT_TA_45933.pep
VRGRVGTPPRLPPSSKQPLLVNIKEESYNSLVGEAKNSSSLFLLPQVR

SEQ ID NO: 151516 - protein, 90 aa, Triticum aestivum
  Clone ID: PAT_TA_45934.pep
LAASENPWRLAGGASCPCTGVSSFQMTDAVAEKTRSCLQFVPVTTTRKSNFLVHGSDGETDSDSRLTTEETDGRPLCPAVMAHHPSVLPD

SEQ ID NO: 151517 - protein, 79 aa, Triticum aestivum
  unsure (1)..(79): unsure at all Xaa locations
  Clone ID: PAT_TA_45935.pep
RPVXDNHQNIKGYAHIPCTWGGGKQELIFRTRGRSMSSPISCNRSHLSPSRPTGVPLQGGASERQFKPLILHLGFGLCR

SEQ ID NO: 151518 - protein, 62 aa, Triticum aestivum
  Clone ID: PAT_TA_45936.pep
ASPHSSVQLVLLDSNNPRGFISNWGWAEPWGIPHIATEVDLLFYSPNIYYVGLSMNNCCYLP

SEQ ID NO: 151519 - protein, 69 aa, Triticum aestivum
  Clone ID: PAT_TA_45937.pep
IKIVYSNLQPTENVSSILYFILVHIRLQFNRTDQSYHFVLYSLFHNCDCEMARFFLRKIPRVRPRVRGR

SEQ ID NO: 151520 - protein, 49 aa, Triticum aestivum
  Clone ID: PAT_TA_45938.pep
KVLLAPFSIESVVSFHYHTKSVTKSSFFISVCIENLEKNPGAWGEWGSG

SEQ ID NO: 151521 - protein, 57 aa, Triticum aestivum
  Clone ID: PAT_TA_45939.pep
IAPPSVMKSTRTRRAARARGCGSGSRGHLHRRSQSTDLGAARCIDLRRYVCDVCAER

SEQ ID NO: 151522 - protein, 59 aa, Triticum aestivum
  Clone ID: PAT_TA_45940.pep
IPPTLIQFKQSKSQHRHLAQCPWPWSQLVQLANKPPGGLARQPCSNEYARIFLGAHTLY

SEQ ID NO: 151523 - protein, 88 aa, Triticum aestivum
  Clone ID: PAT_TA_45941.pep
MAMAASRSLWASRAASYLKISAFPRAFSTVLKDLKYAETHEWVKVDGDSAIVGITDHAQDHLGDVVYVELPEVVAFVSQGTHFGAVVS

SEQ ID NO: 151524 - protein, 38 aa, Triticum aestivum
  Clone ID: PAT_TA_45942.pep
TPGATSSLLGSRPCLFLFRARARLGGGQLRSLDRALPS

SEQ ID NO: 151525 - protein, 135 aa, Triticum aestivum
  Clone ID: PAT_TA_45943.pep
MAIALAAFLLLPLFSLGALFVLAAWRVVDKKAAAQRQSAPGLLRPYPLLGHLPQFLANRHRILDWLTEVLARQPTCTLVFRRPGGIRGVITANPANLEHIMRASFDNYPKGPRFASLLHDFLGRGIFNAHREAWR

SEQ ID NO: 151526 - protein, 87 aa, Triticum aestivum
  Clone ID: PAT_TA_45944.pep
SVQISVRLTDEFMELAKENTSNNLETCGILGASFVNTNRDGTYYVTTLIIPKQEGTAHSCQASNEEEIHAVLSEQSLYPAGWIHVDI

SEQ ID NO: 151527 - protein, 107 aa, Triticum aestivum
  Clone ID: PAT_TA_45945.pep
SADAWVALHDLTSRDDEDPLIPNPLALNSENIQDNGIYLLENGEDGFIHVGNAVNPATLEQIFGFSSLAGAPNLLVLEQFDNVLSRKVNEVVNEIRRQRCSYLRYYL

SEQ ID NO: 151528 - protein, 61 aa, Triticum aestivum
  Clone ID: PAT_TA_45946.pep
IELSSVGAPLFSQSLRTTFWCSKIKYVFLFSFSPTRPRTRGRTRGRTRGRNGWTYAWVESG

SEQ ID NO: 151529 - protein, 85 aa, Triticum aestivum
  Clone ID: PAT_TA_45947.pep
VRESAKKARLYLSVGHSVKQELVAHDAAAGGGAVVAVAPEHSPRAVLAVKIDMCVLHCPLCSLPFKPSVFQCMGGHLVCCGCSVQ

SEQ ID NO: 151530 - protein, 56 aa, Triticum aestivum
  Clone ID: PAT_TA_45948.pep
VRCYSQGVAPWAIQCWLLGLSHRGGGALVCGVHNGLVTCRTMLSIWWTRRSPTCGC

SEQ ID NO: 151531 - protein, 140 aa, Triticum aestivum
  Clone ID: PAT_TA_45949.pep
VRRLRRLLRSPISRCACFIVALTVLLVVLSLRQIARVDLPRPDLPHQVPNEQLWGSNGYGYHACVTPIHRYIAPIESDRYMTVRRNGGLNQMRTGICDMIAVARLVNATLVIPQLDKRSFWQDTSTFKDIFNEPGFIKAL

SEQ ID NO: 151532 - protein, 75 aa, Triticum aestivum
  Clone ID: PAT_TA_45950.pep
RSLDAGGAAHPCCNTPRRNRRVGPWPSVLLRRSHGAGERVRCHRASSPVERAADRGGWGGRLLILPMVICSVLIR

SEQ ID NO: 151533 - protein, 88 aa, Triticum aestivum
  unsure (1)..(88): unsure at all Xaa locations
  Clone ID: PAT_TA_45951.pep
LYFGFLILLYIIHFFYYFNFKYLISYYIXLFFSFFFFIXFFIILFLFCVIYIYYYLYINIILFFFLLFFFYYFYSLIYLYNLFFFFFL

SEQ ID NO: 151534 - protein, 140 aa, Triticum aestivum
  Clone ID: PAT_TA_45952.pep
ALNAQQQQPPILSLIKELNLGFPLAVVFVSHTPSNPSKQSKTRGLKPYRRSKPSENTDAPPASSSFSSGAGGGEGPGIRADRRKAKEGPAAAGELLWWGGVSPSAGAERASERAPWLSCAPLLSSPVWRDPRVRERVGGR

SEQ ID NO: 151535 - protein, 29 aa, Triticum aestivum
  Clone ID: PAT_TA_45953.pep
LTHDKALPSSSPQPSRCDVSMFLLKKKRT

SEQ ID NO: 151536 - protein, 86 aa, Triticum aestivum
  Clone ID: PAT_TA_45954.pep
TLSFTGSIKTPTSVALSPPSGLFIPCCITHAMKIFWLKPNTETVCFPSKCQLYSDGSGLGLASTKSMFELTLVLTFSFGVGQMIKS

SEQ ID NO: 151537 - protein, 61 aa, Triticum aestivum
  Clone ID: PAT_TA_45955.pep
LKSIPLPGPAPSPDKIRRKSPPELKICVGVNPPQQDGQEAISFLFRLINESRRRCTRSHRT

SEQ ID NO: 151538 - protein, 127 aa, Triticum aestivum
  Clone ID: PAT_TA_45956.pep
RSGDGQALLVDKVHRQVEPQVEVGAYPRRLGSGSDAEERHDPDGRGVDGRRQERDKSAGEGEAGRVGPLLRGGGVVHGEGELVRPLATGVARRGACLGRDDHGKAAVGLVSGRHGGRSIDGSWIFAD

SEQ ID NO: 151539 - protein, 118 aa, Triticum aestivum
  unsure (1)..(118): unsure at all Xaa locations
  Clone ID: PAT_TA_45957.pep
MARTKHTVRKSTGGKAPWKQLATKAVRKSAPATGGVKKPHRFRPGTVALRXIRKYQKSTELLIRKLPFQRLVREIAQDFKTDLWFQSFAVSGLHEAREAYLVGLFEDTNLCSIHAKRV

SEQ ID NO: 151540 - protein, 76 aa, Triticum aestivum
  Clone ID: PAT_TA_45958.pep
YCGLPPLISFGIGARCRGFSRPPAASSAFAPEEDPPTAAPVGPLSTSIGLRLLLRLRLRRGWNGAGWNRLIGFYGR

SEQ ID NO: 151541 - protein, 44 aa, Triticum aestivum
  Clone ID: PAT_TA_45959.pep
TVGHWAKLNNMPILGEDVNVCDVIHSNGGVVFPHKKIKSKVINP

SEQ ID NO: 151542 - protein, 141 aa, Triticum aestivum
  Clone ID: PAT_TA_45960.pep
NWAPMAAIAKRDQGTPTTVVGHRSAPNRRCGHQPQSELLSLWNGVGSARRSACGHRKGRGVRKHWKDVGSGAPKRPSGDIRWLGGGISPEQVKRWRDLLQGKWGVKGRWRRCRVGRRHGVGLDGRRSGGTVAMMCLQTAER

SEQ ID NO: 151543 - protein, 68 aa, Triticum aestivum
  Clone ID: PAT_TA_45961.pep
SYHASETDCIAPSIVDRNCWRCHDRSSPWHTAFATLPTELIPFTFITLPPFLRPDRTELSSSAEEVSF

SEQ ID NO: 151544 - protein, 59 aa, Triticum aestivum
  Clone ID: PAT_TA_45962.pep
SRLITCAVYFFAYPSTSRRLLMMLVRLRASGDQNLSLPSFLMIREVASLLPDCLDFCLT

SEQ ID NO: 151545 - protein, 38 aa, Triticum aestivum
  Clone ID: PAT_TA_45963.pep
LIRCFLHTMMPWILWAMKLQISKPARSTVSYLDRHRFD

SEQ ID NO: 151546 - protein, 89 aa, Triticum aestivum
  Clone ID: PAT_TA_45964.pep
HNSEEDNDVSPLCAWANALPNPTFEKLDRVLVSVEWEQKFPLVTDQALSRRVSDHTPLVVDLGEPNHMGNKNNFYFEMAWFERERVLDL

SEQ ID NO: 151547 - protein, 95 aa, Triticum aestivum
  Clone ID: PAT_TA_45965.pep
GVALAPTRIPRQRIGGAPPRRLGGVGLDELGEVGHPKNKVQRAEVVHHVGRQVVGQLAVGLALAPMVLAHRARPAVAASSSAVAVHPPVHVGLRG

SEQ ID NO: 151548 - protein, 137 aa, Triticum aestivum
  Clone ID: PAT_TA_45966.pep
RPRTRGPRRGPPPQSRPRRTSLLRAKSASHAPFRLGLNRGGRAGLLPARSAHTRAPRVDRDQLHARESMLLLSMPSVAQVSYVAVAGHRVPKLTHSVSSMSRPRGRQDTKYHDVDDSQVQLHRLRTVLTLNIYSERR

SEQ ID NO: 151549 - protein, 147 aa, Triticum aestivum
  unsure (1)..(147): unsure at all Xaa locations
  Clone ID: PAT_TA_45967.pep
RPRTRGRTRGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGSSLAAFXLNQEKLVRM

SEQ ID NO: 151550 - protein, 108 aa, Triticum aestivum
  Clone ID: PAT_TA_45968.pep
SAHASADAWVTPVAATVTPTEVTPVAAKQTDGEENRKWFNSEEPGKTPQEPSAAEQAQPGNEVGDTSAAEQTAQSNSPALTVQDLVNRIKTNPGDPNILETQEPLEDL

SEQ ID NO: 151551 - protein, 58 aa, Triticum aestivum
  Clone ID: PAT_TA_45969.pep
RPPTRTRTRGRTHGRTRGRVLAIDCYLNWHSKKLKATLELTNFLMTTRVERMFYLHAS

SEQ ID NO: 151552 - protein, 100 aa, Triticum aestivum
  Clone ID: PAT_TA_45970.pep
MAPTKGEGPAIGIDLGTTYSCVGVWQHDRVEIIANDQGNRTTPSYVAFTDSERLIGDAGKNQVGMDPINTGFDAKRLIGRRVADASGQKDIKKGPDQGIS

SEQ ID NO: 151553 - protein, 89 aa, Triticum aestivum
  Clone ID: PAT_TA_45971.pep
MCATQPSHHQNEQSKCLGSPNKTQAIVGLPNLHQLENIPNLSELVHLWEICSYLVVRLFLYRSKANRIDDHLIVFCIWNPRVRVRVGGR

SEQ ID NO: 151554 - protein, 119 aa, Triticum aestivum
  Clone ID: PAT_TA_45972.pep
RPATTSSNHGRPQSIPAPTPASSLFLLLLHPPVSAFPQRQHHLRSALKNRPAPSSSQDRLPRRRQEDPSCRRRATPLLAHKARGRRGRRCGGGTIPREGGRVGSAADGADRRGDEAGGA

SEQ ID NO: 151555 - protein, 61 aa, Triticum aestivum
  Clone ID: PAT_TA_45973.pep
GPSIPVAFSRLAHSSSLFHPPSAAAGWFRPKSSMRSHYTVWAPRFSMATPLAQHVARLGCH

SEQ ID NO: 151556 - protein, 113 aa, Triticum aestivum
  Clone ID: PAT_TA_45974.pep
MANDDDDRRPMKRTNSDGYSGLCFSPGSPLGSDLNDCSHQSLPSEYPHVYRPVARAGGVDVLPTVTHQLPEPSPPSPPTTATSAATSLSLSLSLAGLDAPEPSPGAQAQPMSM

SEQ ID NO: 151557 - protein, 46 aa, Triticum aestivum
  Clone ID: PAT_TA_45975.pep
LEQGVLVLELADPHASSSLVLGDRSPSGTFLLPPKMILLPVARVYV

SEQ ID NO: 151558 - protein, 145 aa, Triticum aestivum
  Clone ID: PAT_TA_45976.pep
VRGRVGEARVMGEISLLPANVRVAAGRRPVAMAVGAVDRSYKHADVRKQVLVVVTSGWAVMCFDHNLKKLWETSLGDDFPHAAHHREVAVSVTNYTLKHGDAGLVIVGGRMEMQHHSADLFDDFMTVEHGREEHRKSASEKHALE

SEQ ID NO: 151559 - protein, 77 aa, Triticum aestivum
  unsure (1)..(77): unsure at all Xaa locations
  Clone ID: PAT_TA_45977.pep
RPVPPNPTCYYXVDLVFLDKERDSWELKDIAEKIEAVVKKKDEGTVWFKMAKYARAFKRYGTALNFIEYESSLIEKK

SEQ ID NO: 151560 - protein, 129 aa, Triticum aestivum
  Clone ID: PAT_TA_45978.pep
HIGIYYSTKRGQMCGGIRPGLSFLMDPGGNPPKDLVPGIILACAFWTLAWSLFRVDHPPRQDPRFSSTLFARVRHSHTRRHRIRTSIPLQRRPPCPPAASGSEAGCASWRCSSQEYDRTPVQKVGRSGR

SEQ ID NO: 151561 - protein, 137 aa, Triticum aestivum
  Clone ID: PAT_TA_45979.pep
HGTSSSLRVGSSILDPSLGFRRWVPASSDEESEELRTNTQPCGVSKNALLLDTNGVTSSSFWSGKLKTLYDERSESGGGSSTSSGKAADTLDSSAKSIADNRGVDKSKSAMAWVVRLDRFVYWLTTTSGTRPDAWAD

SEQ ID NO: 151562 - protein, 124 aa, Triticum aestivum
  Clone ID: PAT_TA_45980.pep
PRWSPRKCLGQSYCVFFLGVWRVCVESSHTVCVERRERPQKSCARQLGVEEEAALRGGGANIWYSEPCRSESVVARRTSCEMEADGARRRMVAMRCRYVKMAVRSCHKKSRRDADDGGVMPSSS

SEQ ID NO: 151563 - protein, 138 aa, Triticum aestivum
  Clone ID: PAT_TA_45981.pep
RAPGSCTAPCSACTQSPSWRTRGERRRAPCPLAGLLFLSGLDGGGGGDGFGSGFSSAFVACCRACSLARRRVRRVFYTVAAVYCAYSGLVVVGCVAENGKKRGSSWGLGHRRREETGAVKGGSLRCSVQLFSLLNFPD

SEQ ID NO: 151564 - protein, 138 aa, Triticum aestivum
  Clone ID: PAT_TA_45982.pep
RPPTRPNGPKTDKGKILKVSWEGGADYYTAAKLDEIFKQFGTVEDIVIKTRKSKSKGSAIIVMASKEAAQTALKNHSVCNVFPVPLIVASVQESGGPPARSTQTPEPRTSNIDGTGFSDLEASVFRKLQEAQKRKKSG

SEQ ID NO: 151565 - protein, 140 aa, Triticum aestivum
  Clone ID: PAT_TA_45983.pep
RPPNPTLLLPAPALFSPPLLPISHIYTRFCILHTSKLTAASHPATLHQSHEGLPAGHPTAGAAARRRGTALRSNSTSATSKGNRSAVCTMLLVFGDSTVDPGNNNRLRTTAKANFPPYGVNFYGRRPTGRFTNGRLATDM

SEQ ID NO: 151566 - protein, 80 aa, Triticum aestivum
  unsure (1)..(80): unsure at all Xaa locations
  Clone ID: PAT_TA_45984.pep
MGQGVTDAAIKVEAYWPDLLRQDHEQHERRTTSRVSSXSGGGGAPADAAAAPDDGGAAAAEENKEEKKEEAQEESDDDMG

SEQ ID NO: 151567 - protein, 108 aa, Triticum aestivum
  Clone ID: PAT_TA_45985.pep
RPPASLLFRSSVPCPWGIDPSFGWVGSPIHACEAMAVSSPSSAPEKKRKWLLSNRKPVSSCHANGSSVQQLFAFSSVPDNAKNIWSFDYTSRVVWSCRPNSKSQDSFF

SEQ ID NO: 151568 - protein, 97 aa, Triticum aestivum
  Clone ID: PAT_TA_45986.pep
LHRGHRPRAVMITGDRSRRTGQLLGTATTTQDGCSDHRSLIHRRLLQFLLFLHGARQRAITGSRRAGGRTWRGGCGSWAVVTAIVVVVAGSVRALLA

SEQ ID NO: 151569 - protein, 142 aa, Triticum aestivum
  Clone ID: PAT_TA_45987.pep
SADAWADAWVTTREENIAKHCSKDERNIYPLHHLGPDDACTLFTKKVFKETVSLDERYPELVEPAKLILKKCRGLPLGLVIIGGFLANQPKTAFEWKKMNEHINAGLEVNPKLGTIKAILMKSYDGLPYYLKAWFLDLAIFS

SEQ ID NO: 151570 - protein, 66 aa, Triticum aestivum
  Clone ID: PAT_TA_45988.pep
VRGRVGTNPIATKLTVVHVVDGRVNSRTQYMQDECLMSACETVNDGHSYTVCEKGCDTDRDGLLSD

SEQ ID NO: 151571 - protein, 39 aa, Triticum aestivum
  Clone ID: PAT_TA_45989.pep
LDTNSSLVARMEVRAVPYSSPRGSGCAYPRGRPPRRPKA

SEQ ID NO: 151572 - protein, 82 aa, Triticum aestivum
  Clone ID: PAT_TA_45990.pep
LASQLPDLVAAMARNCRAPAASSFMAPLLLVAAAAVVAFLGGGAEAMKSGSNITGVGSVYWDACSNNNFFKHSFFLKGAWVL

SEQ ID NO: 151573 - protein, 53 aa, Triticum aestivum
  Clone ID: PAT_TA_45991.pep
AFFGGAGEHSDERALLSCPAMEGGAHGNNESDLTECCFMCWRNRYVLRLRLSA

SEQ ID NO: 151574 - protein, 133 aa, Triticum aestivum
  Clone ID: PAT_TA_45992.pep
SVLIDPLLLLQNLLQYSWTHQVDGRVGLAAMYGSGCWASSKGPFGTPFVIGCCATGAGEHLIRGFASRECCISASLSQSGPASSCTKVLRSVVQSSSEMSHDTGAGLLLVQSDLTKRGESPLLEAVELVGAYS

SEQ ID NO: 151575 - protein, 79 aa, Triticum aestivum
  Clone ID: PAT_TA_45993.pep
SDFCCYILSSCCCCSMYSFHSTVILIYFLGEEAAPLVTYNDTEKLFVYFYFHMLMENPIAHIDHMFASKYARRSSFVSK

SEQ ID NO: 151576 - protein, 69 aa, Triticum aestivum
  unsure (1)..(69): unsure at all Xaa locations
  Clone ID: PAT_TA_45994.pep
MVTANMGRVGLTGRSRFVACWLIIGLLECEYREIGTGTYLGQXTDAAHLWILAGAKERLHLERADLSDE

SEQ ID NO: 151577 - protein, 112 aa, Triticum aestivum
  Clone ID: PAT_TA_45995.pep
VRSSPHPLPYPPLPFRRNQQTNTNEARVGDGDAHRIQGRRRSSTTSARGSGTGTHTGFKAGDEHRRPAEVWGRTPVRQEAGDEYRRPAQVPLIFFCSHTGDQRGWSAERVWD

SEQ ID NO: 151578 - protein, 68 aa, Triticum aestivum
  Clone ID: PAT_TA_45996.pep
ALFDTVRRCLEQSPLSPLCVFRRLSLYSYVTYLQAWPLDGVLFPGPAAVDVRRSVHALRSFSVVIVGI

SEQ ID NO: 151579 - protein, 96 aa, Triticum aestivum
  Clone ID: PAT_TA_45997.pep
RPPTRSRTRGPSPNRNPPFRDWLSCILRPPSSPSTSLPPWPIRGSTRGDPTLTVTNPPSTASAGGYTTRTRTLTSLPVYKNLYDLLNVLEVPFPGG

SEQ ID NO: 151580 - protein, 84 aa, Triticum aestivum
  Clone ID: PAT_TA_45998.pep
MRTEVIKADTIDAAAERILDELKNTRSRENAIYFDGWDGLGASAVLRAVAQRLAPKEQTRPPGLEFEQVIHIDSSKWESRKAVH

SEQ ID NO: 151581 - protein, 40 aa, Triticum aestivum
  Clone ID: PAT_TA_45999.pep
LEIRCYSYIEGVGVSVLIHIPLNLTQQMKIECQSAQIRRD

SEQ ID NO: 151582 - protein, 47 aa, Triticum aestivum
  Clone ID: PAT_TA_46000.pep
GSRHDSRFDVDYGGGMRRRLFRSLSLSLCSSVSMWSALCSLECLCGR

SEQ ID NO: 151583 - protein, 95 aa, Triticum aestivum
  Clone ID: PAT_TA_46001.pep
HGWMSRAAAGRPQTARMSLSECDSVVVPRRVTRKVLHRPTVLSPGTYSRKTLFIEPEAGKGLAYRLIRVRSRYSGRLESSSLSSACTSLCVEGVS

SEQ ID NO: 151584 - protein, 52 aa, Triticum aestivum
  Clone ID: PAT_TA_46002.pep
TCNSLLAEDRNAVLVIQARRLYAVRSWHGSLGIYGDPLSTLWSWKSLLLLDG

SEQ ID NO: 151585 - protein, 95 aa, Triticum aestivum
  unsure (1)..(95): unsure at all Xaa locations
  Clone ID: PAT_TA_46003.pep
DLGFKTFLLTGRPGPPGRHRRHLRDXGFHDWDKLILRAAADREKTATAYKSEKRKEMEAEGYKILGNSGDQWSDLLGYSMSARSFKLPNPMYYVP

SEQ ID NO: 151586 - protein, 35 aa, Triticum aestivum
  Clone ID: PAT_TA_46004.pep
SKVRNLVARSHGTCMNSRFNRDKANCPNMLSTDMY

SEQ ID NO: 151587 - protein, 57 aa, Triticum aestivum
  Clone ID: PAT_TA_46005.pep
RHVHIAKRNSVHNPTGPFALAIQCPQSACSHLFGRIESINVPVFPSGPPTGPFHRRH

SEQ ID NO: 151588 - protein, 109 aa, Triticum aestivum
  Clone ID: PAT_TA_46006.pep
ISQKSRTLETIQEEMELTEVVNPPCSTLVLEWAHQRLPLPAHWILSSICCSDDADVSRAGLIFLLGLEAVSAAPSLDVPLVWKMHALSASVRTNMDLLQEDRSKDVFEA

SEQ ID NO: 151589 - protein, 85 aa, Triticum aestivum
  unsure (1)..(85): unsure at all Xaa locations
  Clone ID: PAT_TA_46007.pep
MSLVFVAPGLHKQRSVLATNRVTGTRAIWSCISTQSKPQQSAESPTASYYTLCTPALESGAVAWHSSTVASAXTXPVPVVRAEPR

SEQ ID NO: 151590 - protein, 178 aa, Triticum aestivum
  unsure (1)..(178): unsure at all Xaa locations
  Clone ID: PAT_TA_46008.pep
TPPSSCSSPARTVPTPRPSSAVPPARAVHPEVAPAPPDRPPQADPPRRWPAPSLXPPDRPPQADPPRRWPAPSLXPPACPVPAWTPATWCAARPASSDSWRGQRRHGSKAGERRRGCDDASGGAGEHDNYRVERDWRQSHSFVGQRADVADGDVQRERPSLSAQTLCCSILDQVCGGR

SEQ ID NO: 151591 - protein, 100 aa, Triticum aestivum
  unsure (1)..(100): unsure at all Xaa locations
  Clone ID: PAT_TA_46009.pep
HRLSTRDRLLMLFXDGLYQYLTNQEXVAQVEMFIATTXPEGEPGQHLFKEVLFRASXHKQAMXDFHELIEIXPGDRRRYHYDLSXIVISLEXGRIWRSCV

SEQ ID NO: 151592 - protein, 182 aa, Triticum aestivum
  unsure (1)..(182): unsure at all Xaa locations
  Clone ID: PAT_TA_46010.pep
SSHAIAIHQSRCCQVLXNPRQAAAQVMNFALILSTAFMMWKGLSVISDSPSPIVVVLSGSMEPAFQRGDLLFLWNRNLMAETDVGEVVVYNVKDKDIPIVHRVVRKFGKGDKAQLLTKGDNNLSDDTELYAKNQDYLVRKDIIGSVVGYIPFVGYVTIVLSEYPWLKTVMLGIMGLLVRLQR

SEQ ID NO: 151593 - protein, 118 aa, Triticum aestivum
  Clone ID: PAT_TA_46011.pep
MQALLASPALRPSPSPSPAARSPPPSRGRVALADFPARARALRCGPRDTMEALERDEMLNAEQLEQWQIGISEQRHRLPARAIRVRRHGRSRRLLGRISGRDGPPSLRSLAGPLGRGI

SEQ ID NO: 151594 - protein, 74 aa, Triticum aestivum
  Clone ID: PAT_TA_46012.pep
GHDHRIFLRPFSVGVTTSQAILSRHPILLFIFVSTFFSFRFAFACASLFQVFRSDLCWGNSSQSGRLREWEGPA

SEQ ID NO: 151595 - protein, 167 aa, Triticum aestivum
  unsure (1)..(167): unsure at all Xaa locations
  Clone ID: PAT_TA_46013.pep
KRQILSAIAPDLQXVNRYRYTSPLRCLEEFVEALSFAHYLRHQTIITPTQAQAAMPADMSLTPHDYMYGIFDLXGELMRFATVTTAQTGELAGNGERNIMGDIQELGCEFEILPDVPTKDWRGKMGAMRQSVKKVEKLGYGLVVRGSERPKGWVPDMKDDAPEPTSP

SEQ ID NO: 151596 - protein, 185 aa, Triticum aestivum
  unsure (1)..(185): unsure at all Xaa locations
  Clone ID: PAT_TA_46014.pep
AWASTQNPGHSPAVVTGXKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAPDVKAKFIIEAANHPTDPEADEILTKKGVVVLPDIYAN

SEQ ID NO: 151597 - protein, 164 aa, Triticum aestivum
  unsure (1)..(164): unsure at all Xaa locations
  Clone ID: PAT_TA_46015.pep
MVSIEEDGTHDGIKTIRIQKACEFTTSSVLCVCIITWNMNGKDLRKLVSSTRKFDLLVVGLQEVPKCGVEQVLQEAMADTHILLCQKAMQSIQMFLFGAKSSESYIKEMKVDKHAVGGCGGVIGRKKGAVAMYVNFSGIRMVFVSCHLAAHEXXVEKRNSECRH

SEQ ID NO: 151598 - protein, 92 aa, Triticum aestivum
  unsure (1)..(92): unsure at all Xaa locations
  Clone ID: PAT_TA_46016.pep
ATXCRARDTAAPDQPLGXRKAGGAVRQTPLPRFTVSRGAPGHILRWCLGVCTGYCTHMSLWLVVVTVRGSHAWLYIGILGLCPFVETRIMKS

SEQ ID NO: 151599 - protein, 157 aa, Triticum aestivum
  Clone ID: PAT_TA_46017.pep
MAMLPFLANECCSQYGYCGTTDAYCGQGCQSGPCSGSGGGGGSGVSVESVVTEAFFNGIKSRAGNGCAGKSFYTRPSFLSAARANPNFGKGRTTDDGKREIAAFFAHVTHETGHMCYIEEIGGARQNYCDRKYTQWPCASGKGYYGRGPLQLTLDYN

SEQ ID NO: 151600 - protein, 60 aa, Triticum aestivum
  unsure (1)..(60): unsure at all Xaa locations
  Clone ID: PAT_TA_46018.pep
YWYKPPKVLLLIITSAIINFFSSSSSSSSSSSSSSRRGVPRYYVRTVLDGWLSSXXPTRP

SEQ ID NO: 151601 - protein, 183 aa, Triticum aestivum
  Clone ID: PAT_TA_46019.pep
PNTARAQGSDDDIASSEREQHIVFNDDRSTDPTHSMLSKDHFSNILNEIAGRNAASMVQWVVPQLMDAIDDDGTDVDRLLDDIVDGVLHHPAQRDLGSRKAQEGRNRFFKGIEEWWQEMGDGQREEYRGKLTRDGVQNGENHKEGVQDTGHGHGCAGKLKMRKLYGGGPETLEDKIAGAAADA

SEQ ID NO: 151602 - protein, 157 aa, Triticum aestivum
  unsure (1)..(157): unsure at all Xaa locations
  Clone ID: PAT_TA_46020.pep
LRCKXXGARVVIANRTFARAQELGNLIGGPALTLTELENYHPEEGMILANTTAIGMHPNVNETPLSKQALKSYAVVFDAVYTPKETRLLKEAAECGATVVSGLEMFIRQAMGQFEHFTGMPGKKNYAYIFVCLPMSSCVVVSLTSFLLWLVIQLQIA

SEQ ID NO: 151603 - protein, 192 aa, Triticum aestivum
  Clone ID: PAT_TA_46021.pep
APATAPPPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGILAFCFAIGLYYVTGKESFLVTPLSGFHGCLAGFLVALKQLLPNLELPMCFFWKIKAKWMPFFVVCFSSIMAFIVP

SEQ ID NO: 151604 - protein, 154 aa, Triticum aestivum
  Clone ID: PAT_TA_46022.pep
PPCRLPRRLPSFPRRPTPGGLPPICRLPIDECQRPTPRLRRLPPRPSSPITGSIPRSKVPLVSGSGRSRRHRRELWRRKQSNMKSFCSGRLVRRLGFGVKQSEVYEPGGDDCRIPVIECVYEWIQVLEILGVILVPENNSLRSVGWTSGAGCKH

SEQ ID NO: 151605 - protein, 185 aa, Triticum aestivum
  unsure (1)..(185): unsure at all Xaa locations
  Clone ID: PAT_TA_46023.pep
STQRPALAEAPAARPILYSYWRSSCSHRVRIALNLXGIDYEYKAVNLLXGEQSDPEFMKLNPMKFVPALVDGDAVIGDSYAVALYLEDKYPQRPLLPQDLKKKALNIQVASIVCSGIQPLHNLTLVRFIEQKVGTGESIPWVQQQIDRGFTGCLHRHVPSFLVITAIFAALLPSRKFALEILLTK

SEQ ID NO: 151606 - protein, 51 aa, Triticum aestivum
  unsure (1)..(51): unsure at all Xaa locations
  Clone ID: PAT_TA_46024.pep
NHRLAAPLTVRTTARFTSRQPRIRSVSAESCRLARLHVLLLLLSLXPVCVG

SEQ ID NO: 151607 - protein, 104 aa, Triticum aestivum
  Clone ID: PAT_TA_46025.pep
ISLVLVQKVTLLTIARVALRTISRLHWTWNCALVQMVAAVQSAMAFGLDTDAPPRAMAVAPPAHSHGPSTLGPPLFSSLTRLPAEDPRLQRTVGGGPADATRLF

SEQ ID NO: 151608 - protein, 197 aa, Triticum aestivum
  Clone ID: PAT_TA_46026.pep
DDCPSPPSSDGNRHLVTPLVVTAFVLVFLSLVSLSIYCFIRRRRRQRRQQSLLAAGAANPAAQGDGPAPEMAGAATATDVEGGAAPDPEDEEVVHHAWHIRTVGLDEAAIESIALTRYRVGAGTLGGAADCSVCLGEFLDGELLRLLPKCGHAFHVPCIGTWLRAHVNCPLCRADVVVLDSAATGRSEPPADAQQFL

SEQ ID NO: 151609 - protein, 186 aa, Triticum aestivum
  Clone ID: PAT_TA_46027.pep
MASPPSPRLLCALLGDRLGALSARPLLRTAAPGRGNARVTCQATRTLSSLVDALFNRRSRDDSLENNPRRLRPGKVSPRLTVPSHIQRPPYVNSRQRPQMNDGPEIHDEKGIECMRASGKLAAQVLKFAGTLVNPGITTDEIDKAVHQMIIDNGAYPSPLGYCGFPKSVCTSVNECICHGIPDSRP

SEQ ID NO: 151610 - protein, 192 aa, Triticum aestivum
  Clone ID: PAT_TA_46028.pep
QWRTNLSNTNQPNKFLILALIVVAATTTAAEPFNALHGASEPQRPSSPEQQPTPQPQEHPVPHQKLNPCRDALLQQCSPVGVMPLVQPQVVQQTSCLVMWEQCCQQLKAIPKQSRCEAIHNVLHAIILQQQQLVQGTSTQPQQQQQQGQQQQGQGFSQPQQQQLDQGWIAAIGTWVIQTIPAMCDVHVPPYC

SEQ ID NO: 151611 - protein, 133 aa, Triticum aestivum
  unsure (1)..(133): unsure at all Xaa locations
  Clone ID: PAT_TA_46029.pep
CLLVDLFSAGSETSATTLIWAMSELMRNPTTMAKAQAEVRNNLQGKPSVTEDDLADLKYMRLVIKETLRLHPSVPLLLPREPIEACKVLGYDVPTGTTXXXNTWAICRDPKHWDAPEEXRXERXEGXKXDXKG

SEQ ID NO: 151612 - protein, 139 aa, Triticum aestivum
  Clone ID: PAT_TA_46030.pep
RQLIKKLLDRTVGFTINYEREDPYDTRELSEFPDVRLWFVRLDASCPWFPVVLDWRAGELARYAAMLVPHQMSMRHGVVFNPEALELFGMKKVFLVYSWLKQQNHAKPRLKTGDMAKMLGFGIGDELFDLIEKYPVDEL

SEQ ID NO: 151613 - protein, 160 aa, Triticum aestivum
  Clone ID: PAT_TA_46031.pep
MQRQRFGSDEGPGRNPAEERRLKRPATESEETGDDDELPPGTRRKMKDTQQKTRPSGSTAAGAGAASSASSVRAVLQDFLEQQQRLDAQRQEAAARHAQERLAFEQQWRQEMQRLERERLMLEQAWREREEQRRMREEARAERRDALLTNLLNKLLRDDF

SEQ ID NO: 151614 - protein, 146 aa, Triticum aestivum
  Clone ID: PAT_TA_46032.pep
MDAMERGERTPLLPESHGPKVQEDDSLQLQVPLLKHKKRGGSKAPAVILLFECLESTAFNGISTNLVVYLETVLHGTNLASASNVATWFGTSYLTPVFGAIIADSFWGNYNTILVSLVVYLLGMMLVTFSAFVPTTTAALCAAGAS

SEQ ID NO: 151615 - protein, 145 aa, Triticum aestivum
  Clone ID: PAT_TA_46033.pep
MAIVPHSAGGSTVSMPMPMLTPDNYTVWAIKAEAILDAQNLWEAVSPASGAAVDTGKNKTARAVLFGALSEDLLMQVSTKKTAAEVWASLKTRFIGADRVQAARLSTLRGEFDNLRMEEGEALDTYAGKIGGMAARYAGLGSTLG

SEQ ID NO: 151616 - protein, 108 aa, Triticum aestivum
  unsure (1)..(108): unsure at all Xaa locations
  Clone ID: PAT_TA_46034.pep
MGKEKIHISIVVIGHVDSGKSTTTGHLIYKLGGIDKRVIERFEKEAAEMNKRSFKYAWVLDKLKAERERGMTIGIALWKFETTKCSCTDIXAAGHRYLVENMITSYLP

SEQ ID NO: 151617 - protein, 58 aa, Triticum aestivum
  unsure (1)..(58): unsure at all Xaa locations
  Clone ID: PAT_TA_46035.pep
KELIFHRDFPYVEHFREXLGGYSIDRFEKVKPKMIQAVDDMLGYDIPELLKNFRNPYE

SEQ ID NO: 151618 - protein, 171 aa, Triticum aestivum
  unsure (1)..(171): unsure at all Xaa locations
  Clone ID: PAT_TA_46036.pep
RINVLVTGFGPFREQYPINPSWEIASSLPSHLPPLRAKDPNSRHAAILLPNVRISVHPEPIRVNYQVVRGLVPSFYDATRPFDVVIHIGMAGPRPFYSIERRGYRDGYKHPDVDGEXVDSEEDRQKDDWPWRGLPEEIETELDLDQXLSLWQGHSSEYDDVRIFEDARHLL

SEQ ID NO: 151619 - protein, 150 aa, Triticum aestivum
  unsure (1)..(150): unsure at all Xaa locations
  Clone ID: PAT_TA_46037.pep
AAGGEARTCLRGQGQNQGALAEGEERADVLGQLRDLTGAFDLLRVVXGTVGALNWLSKIQVVHSXIARVLKVIXLKQHAALREGYNNKRXPIDLRSKKTRTIQRRMTHHLLCFITGGRRSATVLANDEVCYELLRYDDIFYRSFFAKKVR

SEQ ID NO: 151620 - protein, 100 aa, Triticum aestivum
  Clone ID: PAT_TA_46038.pep
KDMLALKYAELVYAGRWFDPLRLSMDAFMETITATTTGSVTLKLYKGSVTVASRKSPYSLYREDISSFENGEIYDQADAEGFIRLYGLPTRVRAMLEKGI

SEQ ID NO: 151621 - protein, 56 aa, Triticum aestivum
  Clone ID: PAT_TA_46039.pep
TGITRGFSERKSHEDSENRRHQPHSTSELHTSIMVDQQYINQQFHSKHLFASPQTT

SEQ ID NO: 151622 - protein, 143 aa, Triticum aestivum
  Clone ID: PAT_TA_46040.pep
MAKGPLVERWRQWMRRQDTSATDDKETSTEAKSETRETTTEDKATTTEDKQTTTEDKPTTTEDKPTTTDEPVSTTEESTTEATSTEQSSSSSIISSTETSSDPTSTSTSTSASTSTRSTLTSLAQGASCYSTTVSTSVVCHIT

SEQ ID NO: 151623 - protein, 94 aa, Triticum aestivum
  unsure (1)..(94): unsure at all Xaa locations
  Clone ID: PAT_TA_46041.pep
CWEIRSATLPILRLITVHPEKRRGRGWMSKDQKDQKKKGKGDGAMCMSMEGKILISLPAVFEKNGIXPWXWMIEGHFXLKHSRRSNXYCDANTC

SEQ ID NO: 151624 - protein, 161 aa, Triticum aestivum
  unsure (1)..(161): unsure at all Xaa locations
  Clone ID: PAT_TA_46042.pep
RRRRSPRRRSSRSHGGACTGRGQGHPPRAELTDNRTPPSWVETGVAHVDEXLTHAAKKGLMPAQXSAILLRDHHGLPLAKSDTVSKSPRSLKAQGLPPEIPEDLYCLIKTAAAIRKHLERNRKDXDSTLRLILVXSRIHRLARDYGRTXKLASTWMYEPTT

SEQ ID NO: 151625 - protein, 85 aa, Triticum aestivum
  Clone ID: PAT_TA_46043.pep
PIYCGDRVSEKGKEGSDWQLLVLKRKEIDFFHDGVRLRKMVAVSNDRGRMLNNCTSTYYLPTLQHQQALNFTHLPHLPSLLKDES

SEQ ID NO: 151626 - protein, 118 aa, Triticum aestivum
  Clone ID: PAT_TA_46044.pep
RLGKEFMDRINKEGYIDAKDKSGNVLYRVTKESLMERLSHDLHATSLSISKECRFFTIHGSADEIIPVEDAYEFARLIPNHKLRVIEGANHCYTAHRRELSDAVVEAITTSEAGETTP

SEQ ID NO: 151627 - protein, 124 aa, Triticum aestivum
  unsure (1)..(124): unsure at all Xaa locations
  Clone ID: PAT_TA_46045.pep
SAPHRVRSPRPHHHERERETDGRRPVAAARRPGSTRARGGLVARAVVAAKGEVASSDTGGHEVLMFEALREAMIEEMTLDPTVCMIGEDVGDYGGSYKVSKGLSEMFGDXRVLDTPIAENSFTG

SEQ ID NO: 151628 - protein, 195 aa, Triticum aestivum
  unsure (1)..(195): unsure at all Xaa locations
  Clone ID: PAT_TA_46046.pep
LPPXDKVXPERLVRRWIAEGYSRELRGKSAEEIAESYFMELISRSMILPSQESIHSRRGIDSCQVHDLIREIGISKSAEDNLVFTLEEGCGLNNRGTIRHLAISSSWKGDQCDFKSIVDMSCIRSLTVFGKWRPFFMSEKMRLLRVLDLEGTSGLVDHHLTGIGKLLHLRYLSLRGCDDIYHLPDSLGNLRQLQT

SEQ ID NO: 151629 - protein, 108 aa, Triticum aestivum
  unsure (1)..(108): unsure at all Xaa locations
  Clone ID: PAT_TA_46047.pep
EKAGTRAAVMKLAVVLLAMSQLVHMATXQRRIRRLSRLYWSRAFPALPXGKSILNPATSGKRRCCSMRXQAQHPCPSTPSPPRPTVQGKSVLTSRPGTIKVKCSWSSK

SEQ ID NO: 151630 - protein, 135 aa, Triticum aestivum
  unsure (1)..(135): unsure at all Xaa locations
  Clone ID: PAT_TA_46048.pep
WGFRRCEDVCWVKTNXKASSGLRHDSRTLLQHSKEHCLMGIKGTVRRSTDGHVIHANIDTDIIIAEEPTDGIYLVAAIVNSHYYYSFYDICLLNCAEATFPFLSCSCMKLNSLFCLCCCHGMKFMVWPMKVEYDF

SEQ ID NO: 151631 - protein, 140 aa, Triticum aestivum
  unsure (1)..(140): unsure at all Xaa locations
  Clone ID: PAT_TA_46049.pep
QADAAVXEEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASQSTVDAVTEAFKGLAGNKKAGVC

SEQ ID NO: 151632 - protein, 172 aa, Triticum aestivum
  unsure (1)..(172): unsure at all Xaa locations
  Clone ID: PAT_TA_46050.pep
MDAEAVAQAAAAAAAGAPLDPHGAMVSAIVPPATGNQLTLSFQGEVYVFDSVSPDKSLIAVXVQAVLLLLGGRELNPGMGAGASSSTPYSKRLNFPHRVASLMRFREKRKERNFDKKIRYTVRKEVALRMQRNRGQFTSSKPKPDDGTSELATADGSPNLGSVEGRPPSAAS

SEQ ID NO: 151633 - protein, 165 aa, Triticum aestivum
  unsure (1)..(165): unsure at all Xaa locations
  Clone ID: PAT_TA_46051.pep
MAATVGKEREEAVVHPNARQGGKLLSRLLTRDSSAAAPSFRVYYGVASAGAVPFLWESQPGTPKNAVSDAAMPPLTPPPSYYAAGGTAAAKKHAARKAAAGGKRFRPSRILGSILMATRRRGRTAPSSVSPTSSFSSXSSSSSSTSSFRRAGGSSSRLHSSSSSS

SEQ ID NO: 151634 - protein, 182 aa, Triticum aestivum
  unsure (1)..(182): unsure at all Xaa locations
  Clone ID: PAT_TA_46052.pep
MHRQPGXGLLTSCKWDPRLGATFIYNTAISVPLRNAAAFVADVKRLRDLNPRTFCSLDARGGLLARYIRASSAYLGKPEDAVDFDITYYRSYTAGAPRAHADVIDELEQMALHKYGGFPHWGKNRNFAFDGAVGRYPKAGEFLEVKGRYDPDGLFSSEWSDQVLGINGTSPSVDKXGCAMEG

SEQ ID NO: 151635 - protein, 55 aa, Triticum aestivum
  unsure (1)..(55): unsure at all Xaa locations
  Clone ID: PAT_TA_46053.pep
GXAESWVGPXGQYYRELPCPNCRGRGYTPCKKCGIDRSSLDCPMCNGKVTLPNLL

SEQ ID NO: 151636 - protein, 93 aa, Triticum aestivum
  unsure (1)..(93): unsure at all Xaa locations
  Clone ID: PAT_TA_46054.pep
MESKGGKKSSSSSSLMYEAPLGYSIEDVRPAGGAKKFSAAYSNCAKKPSXISFSLCSSLLCSLTRTATMAAPTSAIGFEGYEKRLEITFSEAS

SEQ ID NO: 151637 - protein, 190 aa, Triticum aestivum
  Clone ID: PAT_TA_46055.pep
SPPPPPSPLKCKRKTPHQGKGKENLPPRPPAVGGGVGGDRAAGGCGVCAICLDRIPLQETALVKGCDHAYCVTCILRWASYKQTPVCPQCKHPFEFLSVHRSLDSCLHDYMFDESVCLLLRATWFKPLAVEAHEEAQEEEDIYRSYQYDYGDEDDLYEEYISRSPSIRIGNRRWGDNGYVRGGRREARPV

SEQ ID NO: 151638 - protein, 191 aa, Triticum aestivum
  Clone ID: PAT_TA_46056.pep
LPTNNMPSFTTFVAAIAGCSAIVNGAAIPTESTGLQTTTLHRRAVTKEHQLSKREPVTVAILTAAGTAAVTAIVNEAVQAAVGFIGDISNFDAGREAFTVQTTEAMMANNPDPERFQAAACYNKAFSVADPANIDGQSSVKFSLGILNTDYECMYIAAPNQFFTEGDGGLINLSFTHTDRCTFDSETADLT

SEQ ID NO: 151639 - protein, 175 aa, Triticum aestivum
  unsure (1)..(175): unsure at all Xaa locations
  Clone ID: PAT_TA_46057.pep
PPRPXIAAVENRPPAIPIPPSILISLSPAAASRPAAAPRPQNPSPARRYPATALCPASRHSRPPPQSIPPPTHPPTTPRQSPRRAPPWTGPRARATGTRRRTRGTVTRTGRPAGRKQAPAPPMPFSPPGRSGSPPATAGRPGRRRGPSPRWSTTIPASRARRTCTSSGSTTATRP

SEQ ID NO: 151640 - protein, 161 aa, Triticum aestivum
  unsure (1)..(161): unsure at all Xaa locations
  Clone ID: PAT_TA_46058.pep
PQVSKGVXLQNXXIXXXXPXPTLSQTXNIXKQXEXDXXRKTNLDVRHKTNATILPDXNQAQPPSLLRTVDSSRDDLHNSASVHDGSCGAHGDIHTRQGSVFMTANAVRTDYLSLEEERRKSPRNSQQMRSNGPSSEPEAAQTTEGTQVAPGTSMVRKWVLC

SEQ ID NO: 151641 - protein, 158 aa, Triticum aestivum
  Clone ID: PAT_TA_46059.pep
MGSCVSRSTASVEGSGRAVATAKVVGPDGSLAQFAAPVMAGEALGDAARASSFLCSADELRFDAPARALAAEEALQPGWLYFALPMSMLRRPLSGQEMAALAVKASSALAVASGKGRKAARVAPLVLADDEGTGTEDGGWSRHAYGKSDALKTVHGGG

SEQ ID NO: 151642 - protein, 175 aa, Triticum aestivum
  Clone ID: PAT_TA_46060.pep
MSPPAAISPTSRSVELATSTTKLPVHAVKNINTKTVEEMLGNWDDFKFAPIRESQVSRAMTRRYFQDLDNYAESDIVIIGAGSCGLSAAYILGKKRPDLKIAIIEASVSPGGGAWLGGQLFSAMIMRKPADAFLREVGVPYEDEGNYVVVKHAALFTSTIMSKVLQMPNIKLFNA

SEQ ID NO: 151643 - protein, 123 aa, Triticum aestivum
  unsure (1)..(123): unsure at all Xaa locations
  Clone ID: PAT_TA_46061.pep
GVSRVTVKKAXLLFVISKPDVFKSPNSDTYVIFGEAKIEDLSSQLQTQAAEQFKAPDLSQMILNPETSGPGQEDNDEEVDETGVEAKDIELVMTQASVSRPKAVKALKASNGDIVTAIMDLTT

SEQ ID NO: 151644 - protein, 193 aa, Triticum aestivum
  unsure (1)..(193): unsure at all Xaa locations
  Clone ID: PAT_TA_46062.pep
FVNPNXNKFQIVGMAYQPGGSAGYDPAXXKDPLSNKDKCMRDAALMQILGINAIRVYNLDPNVNHDECASIFNAAGMYMMIDVNSPLPHESLHSLAPWESYHADYLNRTFAIVEAFGNYPNTLLFFAANEVINDEKTAEDAPQYIRALTRDLKNYVKNNLKRKIPIGYSAADVREVLWDTWNYLQCSDPETRV

SEQ ID NO: 151645 - protein, 161 aa, Triticum aestivum
  unsure (1)..(161): unsure at all Xaa locations
  Clone ID: PAT_TA_46063.pep
MARWAIAIHGGAGVDPNLPEHRQEEAKRVLARCLQVGVDLLRAGATALDVVEAVVRELETDPCFNSGRGSALTRAGTVEMEASIMDGNGRRCGAVSGVSTVRNPVSLARRVMDKSPHSYLAFDGAEDFAREQGXLEVVDNSYFITEENIGMLKLAKEANSI

SEQ ID NO: 151646 - protein, 77 aa, Triticum aestivum
  Clone ID: PAT_TA_46064.pep
SDQKLSSLITKRWIIATMLKLFSSPEWVEMILVISKVCDFTHLDSLSTFHDEAALGSEIYPMSTKSHFAAGLENLAH

SEQ ID NO: 151647 - protein, 57 aa, Triticum aestivum
  Clone ID: PAT_TA_46065.pep
MADASSRTDTSIVVDTDDKNQRIMENGQNGAIVPSNSSEPSDRSDRPMDQKVLRRLA

SEQ ID NO: 151648 - protein, 74 aa, Triticum aestivum
  Clone ID: PAT_TA_46066.pep
TPKEGDDELNPWNYETPDDVSKPVLQNKGALRMMAFMFAWMMLVPWWPLICQTMCSSIDDNKLGLSFHRVLLSN

SEQ ID NO: 151649 - protein, 121 aa, Triticum aestivum
  unsure (1)..(121): unsure at all Xaa locations
  Clone ID: PAT_TA_46067.pep
YRWPRLASQVKGRKDWRLFFNTLFWNLDXWDRPFPRALTVAVVLIAVNYLLLLMAATGATDAPPGTWVIGYLADAAGIIGGPWXKYRKGGGATISSIGMFKAQMSSGSFQLLGMAELSPLP

SEQ ID NO: 151650 - protein, 91 aa, Triticum aestivum
  Clone ID: PAT_TA_46068.pep
PVRQGQGRARSVIQSGVLHAHHVGHKISDSLCHWWWHKLPVPAACLCSSSLGVCPRPWPVGAYAATQGMDPALASYLWPASSCSWLGCLVS

SEQ ID NO: 151651 - protein, 121 aa, Triticum aestivum
  unsure (1)..(121): unsure at all Xaa locations
  Clone ID: PAT_TA_46069.pep
TMRKTSRNIQGIDTVVSAVGXKRHRDANQPLQDRGRIRLCERFFPSEYGTDVEYGPQSADEKPHQLKLKVRKYIREKRMASNILLWLRDHTLTCTLLSHPGSLKQGVLIILEKRLSLVDNG

SEQ ID NO: 151652 - protein, 71 aa, Triticum aestivum; identical to SEQ ID NO: 107874
  Clone ID: PAT_TA_46070.pep

SEQ ID NO: 151653 - protein, 48 aa, Triticum aestivum
  Clone ID: PAT_TA_46071.pep
CGEPGAYACDDPSNHWNWDGVHLTEAAYGHIAKGWLYGPFADPPILEA

SEQ ID NO: 151654 - protein, 146 aa, Triticum aestivum
  unsure (1)..(146): unsure at all Xaa locations
  Clone ID: PAT_TA_46072.pep
IAXAGAAHEAIELELSSWPSSPSGKSRRVTELVMALLARLCACAEGRAAVVAHPAGIALVAKRALRVSAVTDTSAVRVLAAVCGRAASPEVVREMARVGAVGKLCCVLQADCDRDVKEAARAVLRVHSGVWCGSPCVSAYLLSRYL

SEQ ID NO: 151655 - protein, 115 aa, Triticum aestivum
  Clone ID: PAT_TA_46073.pep
MAPKKKRKSAPPETVSTTVHDLPDNLLQHVLSFLPAQESVRTCVLARRWRHLWKSTTGLRILDLVLDDDEDISFQDLRKFVEHLLMLRERTDLESVEMKFHCYYEGESYVSLWTR

SEQ ID NO: 151656 - protein, 202 aa, Triticum aestivum
  Clone ID: PAT_TA_46074.pep
IHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKEL

SEQ ID NO: 151657 - protein, 152 aa, Triticum aestivum
  Clone ID: PAT_TA_46075.pep
PASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 151658 - protein, 58 aa, Triticum aestivum
  Clone ID: PAT_TA_46076.pep
QIKRGVYIDTGHTEHRGPDACVLLQGHCATRTYVCVRAYICTFLLLTMQGPCLSGVIY

SEQ ID NO: 151659 - protein, 191 aa, Triticum aestivum
  Clone ID: PAT_TA_46077.pep
METWQIFFGVILFALPLTLLLLRTGKTGGGARRPIPPGPPSFPVLGSMVWLTNSPADGELLLRRLFARYGPIVSLRVGSRLSIFVADRRLAHAALVERGAALADRPTLASVRIMGENDNTITRASYGPVWRLLRRNLVSETLHPSRVRLFAPARSWVRRVLVDKLRDESSSGGAAVVETFQYAMFCLLVLM

SEQ ID NO: 151660 - protein, 39 aa, Triticum aestivum
  Clone ID: PAT_TA_46078.pep
SHVSWISYNERVFVDQFYLMYLDLHVLAISINRTNVYLF

SEQ ID NO: 151661 - protein, 146 aa, Triticum aestivum
  Clone ID: PAT_TA_46079.pep
MAASAAPLPLDGRVALVTGGSRGIGREVSSHLAALGARVLINYASDSASASALAAELNSRGLGGLRAAAAQADVSDPAAVRALFDRAEEAFGSPPHIVVACAGLLNPKYPALADTTVEDFDAMFAVNVRGTFLVCREAANRVPAGG

SEQ ID NO: 151662 - protein, 184 aa, Triticum aestivum
  Clone ID: PAT_TA_46080.pep
MLGVTKCIEMAMSCVEDERDKRPFITEIIDKLKELDSKIEEMLKNDPKPLIRQLRNSVNDSEAVKQNISPNASEKNILVDPSRELCLPFEPKKEIRCCLQLMNTVASSHIAFNIKTDVNKYRAQPNKGILAPCSKCYITLTLRAQEEPPLNMQCGDVLIVQSKSVSKHFTSDKITQDFLAHASA

SEQ ID NO: 151663 - protein, 90 aa, Triticum aestivum
  Clone ID: PAT_TA_46081.pep
DHNHDQLDNQCDICLSDSASRILIRFKTWSNPAATVIRRLRDRALATAVVVVVVSATDTPPRARRNEPEHPPQGHQIDSLEHRIPAHDVG

SEQ ID NO: 151664 - protein, 194 aa, Triticum aestivum
  Clone ID: PAT_TA_46082.pep
ADIEAALRELVGLKWRHAGQACVTVNRFLVQSAVYDKFLQRFAEETAKYVVGHGASEGTTLGPVTKPESLDRAERLIKDAVSKGARIVTGGNRLSPKDGEGGYFFEPTILADMTHDTLISCEECFAPIAAFYKFETEEEAVRVANDTPMGLASYAFTKDADRIWRLFENLEAGMIALNTGNSSAAESPFGGIKM

SEQ ID NO: 151665 - protein, 114 aa, Triticum aestivum
  Clone ID: PAT_TA_46083.pep
FFSGPWSKSTSPARLRRYLWRHSAAQPAHGHHPTTSPYLIDEHGPAFLGLQRGLHSRRDYTEWHLNLRLPASSFPPMLQQQPMSVGGATHERNTTTALLPSSGGARPRRYNDAT

SEQ ID NO: 151666 - protein, 202 aa, Triticum aestivum
  Clone ID: PAT_TA_46084.pep
DSSSCVIEKFPPGFSDVLSLEKINSKSFSYSKDHSGKLCLKWCRLLRSPEAVKIMENQMEMLPHWNFQHLQVKDYGGESCPSWLQPNLMPRLRSLEFTHCFNLKSIPFFLQLDGSLGNTSRSDNINRLEELVITGCGQISWQGSVVLPTSLRKLDLQSPGHPMDHFVSCFLDLISLTYLKLHHCHSLTAIPLHVWRSNLPSL

SEQ ID NO: 151667 - protein, 75 aa, Triticum aestivum
  Clone ID: PAT_TA_46085.pep
SIIAMCQGHGRGAHDQKTFVGGLPCSVSILNIMPMVYLGSVVPSIVIHASCASASAVVLGSMSAPAPIFVPAEAQ

SEQ ID NO: 151668 - protein, 133 aa, Triticum aestivum
  unsure (1)..(133): unsure at all Xaa locations
  Clone ID: PAT_TA_46086.pep
MDKLVQFGRKAWFVVRVMSGYEERRIRSYRLQLQQRLQQAQAKKKEIEKQPEQVILSEVRQVVQQMQALNQHLEEAETAIDEYFKPIDKNAQILTDMQMEKEEKQMKEMLQVMRGQIEMQREIEARKAXASAV

SEQ ID NO: 151669 - protein, 112 aa, Triticum aestivum
  Clone ID: PAT_TA_46087.pep
TFPRNTTQSGGYGPQHHNPQGHGPASQWGPRSQPQQYGYPPRGPPQNAPYSQPPYGGYPQQPPPRGGMGWDQRQGPPPHQGGGYDYYKQGSQPYESQPPNYPPGPGNFNSYG

SEQ ID NO: 151670 - protein, 120 aa, Triticum aestivum
  Clone ID: PAT_TA_46088.pep
DAWGCKIKRKVFPDWIYDHFAQDDGLQACEVTGETEEIARKMNLIGLWCVQILPAYRPTITKVLEMFERSSDDMDMPPKQNFSGLLESSAHNMDVQSSSSNRSEEISLVNSKILQQSPTL

SEQ ID NO: 151671 - protein, 44 aa, Triticum aestivum
  Clone ID: PAT_TA_46089.pep
HQKVIEEAPAPGMDADTRAAVCQAAVNAAKAVDYVGAGTIEKRK

SEQ ID NO: 151672 - protein, 56 aa, Triticum aestivum
  Clone ID: PAT_TA_46090.pep
LAKAREVHLFLILPTSHIERHSIDPPLSFNRSPTFIPNLSLMLCLQRENRCVTASE

SEQ ID NO: 151673 - protein, 187 aa, Triticum aestivum
  Clone ID: PAT_TA_46091.pep
MDMVTAPLLLLLLLAPLATAQWPDCGKKGNFTQNSTYQANLRLLSSTLPKKAVSNTNLFATATVGDVPDIVHALTLCRGDTNASACQSCVATAFEDAQQLCPYNKEAAVYHDLCMLKFSNKNFLATTTALILMSDRNFTTNSDITQRLLFTLINSTAQSAANSSRRFTTSRLDVGSSPTLFCLMQCT

SEQ ID NO: 151674 - protein, 88 aa, Triticum aestivum
  Clone ID: PAT_TA_46092.pep
VPAAPGRPGGGVPAGGGGWGRGGEGQGRQFTLARAAEGSRLRLLDFELGSGEFTFPEPLVRWTEHFADFACVYHFFSSAPFHCSLVHQ

SEQ ID NO: 151675 - protein, 198 aa, Triticum aestivum
  Clone ID: PAT_TA_46093.pep
LSLLHLDGNRLTGQLPPEIGRLPLVMLNVSRNNLSGPIPSEIGDILCIERMDLSFNNLSGELPASLFKLTELSMFNVSYNPLLSGNVSTTGQFGTFDEQSFLGNPLISLHQGGAAGKQQPPPEAADAPAVRTRSIPRTIGIWLLFSLVIAFIAAAGHGRRRGLCILHELRTQRRRANKFSDIGVEGLQNQFIFLTKML

SEQ ID NO: 151676 - protein, 186 aa, Triticum aestivum
  Clone ID: PAT_TA_46094.pep
LSLGRANERIAGIQDSYVDSANATWLDNLERSLAMMREYQNARKKLENRRLAYDASTNKLQKARRDDFRVEEEVRMNKAKFEETSEDVLRRMQDIKETEVDNISSLTQFLEAELDYHERCAEELRRVRQSWAGGASSPTSAPKIGRSRSNTARSWQEPRHQAVYEEPEPEQESARIPHRSPASRLA

SEQ ID NO: 151677 - protein, 161 aa, Triticum aestivum
  Clone ID: PAT_TA_46095.pep
MVLVKPSSGKQACTKFQRICTDGNHSIVLCKPVTGRTHQIRVHLKHLGYPIANDELYVSGDFCPRSSKGTSIHRETSLACSLPSSEPDNSAEADLKFGIDPMCTNCPNLAPVGYDGDEEGLWLHCVRYTGPDWCYECPYPEWASLDNVSGKKMKPDVPPEN

SEQ ID NO: 151678 - protein, 99 aa, Triticum aestivum
  unsure (1)..(99): unsure at all Xaa locations
  Clone ID: PAT_TA_46096.pep
SFHLXAASLAQRNATLGIGDSSAVSATRARALAEDAFFHPSIMSISYASVEHYFAIYMPFFAPVCLHVLLAAIKELKRYKVERAKYSAFLASQSQATTS

SEQ ID NO: 151679 - protein, 196 aa, Triticum aestivum
  Clone ID: PAT_TA_46097.pep
GRVGLHRAFDGCVGVFHTSSLVDPGGISGYTKHMATLEAKAAEQVVEACVRTESVRKCVFTSSLLACVWRQSYPHRHRFPATVDESCWSDEAFCRDKKLWFALGKTMAEKAAWRAARGRDLKLVTVCPALVTGPGFRRRNSTPSIAYLKGAHTMLAEGLLATADVERVAEAHVRVYEAMGGATAAGGRYICYDHVV

SEQ ID NO: 151680 - protein, 80 aa, Triticum aestivum
  Clone ID: PAT_TA_46098.pep
SDGSWNITLTSRDGIAVAIYMSANSRCAKLRNYQLLARLMVPRAKPRPCFSGLITDAAAASLGFASCSSARGVAWRGTLH

SEQ ID NO: 151681 - protein, 43 aa, Triticum aestivum
  Clone ID: PAT_TA_46099.pep
TYQKTMFLVRQSWSARPCQWRHGVSCDCSFPKPVIAGCTNNCR

SEQ ID NO: 151682 - protein, 128 aa, Triticum aestivum
  unsure (1)..(128): unsure at all Xaa locations
  Clone ID: PAT_TA_46100.pep
SRLPDSTPGXSDHLRSVXFALTRVQSDRAIAAFSGGHTLTKSHTERSVLEGACTANPLRFDNSXLTALLTGEEERLLHLPTDKTLLTDPAFHPLVDKYAGDEDAIXADYSDAHLKLYELGYGEATKGS

SEQ ID NO: 151683 - protein, 189 aa, Triticum aestivum
  unsure (1)..(189): unsure at all Xaa locations
  Clone ID: PAT_TA_46101.pep
LIDSWTFWYRPPISKAHGYIEYEXTLHEIATVRTAEEFWEMYAYLKRPSVLPVVSDFHLFKKGVRPIWEDDINKKGGKWVVRMKKGVSDRYWEDLLLNLIGDQFGEAGEDVCGAVLSVRNGEDILSIWTRTDGGRVIKIRETMKHVLNFPPNTRVEFKSHDSSIQQRTAIEESRREKAGQLHHHDKRHA

SEQ ID NO: 151684 - protein, 141 aa, Triticum aestivum
  Clone ID: PAT_TA_46102.pep
MDMEGKVRKTIPMPYGRRFGAIGSSQGCLLYGVASVDDNNKTLDSETELWCLKDCDSEEFVLKHTASIDELISMTGEKYRVAGIHPDCDTIYLVSRGGDTMVPYDMQHQKVGCILNLEKNTQRFLPYVPLFSESLADGDGQ

SEQ ID NO: 151685 - protein, 178 aa, Triticum aestivum
  unsure (1)..(178): unsure at all Xaa locations
  Clone ID: PAT_TA_46103.pep
EMRRRRMRSXEAQERLLEEEAMAXXKAKEEEAAALEFEKWKGXFSVDAEGTTESETQDGGQGLLHNFVEYIKKQKCVPLEDLAGEFGMRTQDCINRIITLEGMDRLSGVMDDRGKFIYISIEEMQAVADYIRKHGRVSISHLANNSNEFIDLEPKPLYDEKEESHQDESAPAGVVAEP

SEQ ID NO: 151686 - protein, 77 aa, Triticum aestivum
  unsure (1)..(77): unsure at all Xaa locations
  Clone ID: PAT_TA_46104.pep
ESNRPVVQLLLLLLLLLLLLLLLLRNALPNNKKTRISRLMSSSKHEPDTSLEIEHHHKFTTLINLDNPTGLLLAXLX

SEQ ID NO: 151687 - protein, 176 aa, Triticum aestivum
  Clone ID: PAT_TA_46105.pep
GGGSGASGIVLYGLAEIPGLLDDVPAVWSEARRVVLPANSHKEWVYFLNRGSQIEVNYSVEPGTGPTNPLRVTIAQAAGKVGFTQWSEEPSVHGTGAVKQSINSSEDYYITVGNLRDQDTTAMLDFRISAVLYNTSGAEYACSPSPGGSGCTYRLPILGENVGRPVVRPETGREGG

SEQ ID NO: 151688 - protein, 146 aa, Triticum aestivum
  unsure (1)..(146): unsure at all Xaa locations
  Clone ID: PAT_TA_46106.pep
LAACPILLSYGHCIAPGSSPETHHNGEAVGVLTGREGVKGTIFFTQEGXDGPNTETESVTGLKEGXHGFHVHALGDTTXGCMLTGXPHCQPCRSCAWEHQEDEIRHAGDLGKCVQAGSGMVVAXNINVTDCHIPLTGPNXIVGRAV

SEQ ID NO: 151689 - protein, 105 aa, Triticum aestivum
  unsure (1)..(105): unsure at all Xaa locations
  Clone ID: PAT_TA_46107.pep
MELSTAHCTLATTDLNNKHPRLCTEGPDARGHSFYTDNNGLYLKAGISRLAEGGAPAALLIIDHPIPSYLDSEQXHHPTVRSQVWAQMARALTALNANTLFHTTT

SEQ ID NO: 151690 - protein, 54 aa, Triticum aestivum
  unsure (1)..(54): unsure at all Xaa locations
  Clone ID: PAT_TA_46108.pep
MENSGKIVMGRYEVXEIVXXKGAFGKVHYAKNLESNRGVAIKMLDKEKVLKVGL

SEQ ID NO: 151691 - protein, 103 aa, Triticum aestivum
  Clone ID: PAT_TA_46109.pep
RSPSTPRPHNRSGGRGRRRGRRELDEHGRGVRARPSGAAAGAADGGGGGGVRGGRQGGGVHPGVQGGPQAAAPQIHLQLHPDAQAPRCRRPAGCRSVIGSRDR

SEQ ID NO: 151692 - protein, 192 aa, Triticum aestivum
  unsure (1)..(192): unsure at all Xaa locations
  Clone ID: PAT_TA_46110.pep
TLTQPALRLSLCAPHTLTLATAAAGSSATAAGASSAAAGASSATAGXSGSAAGVSSSFTSSTTAGSAFATASMVSVSTTAGAYGSLGAXASGSATADGSVSLASSVLVATGASSLVASTLMGADASTLASVGAGTSSVFGASSAATERLLRGSLLRQGGGGLSSSSGPPPCETTDVAAAKAAIWSRLRTVWS

SEQ ID NO: 151693 - protein, 89 aa, Triticum aestivum
  unsure (1)..(89): unsure at all Xaa locations
  Clone ID: PAT_TA_46111.pep
PRVRQLQXRYHLENSPCPPGIVHCCFPWCANCQEHRERKGRLAESSAVPMTIVNPPPPLQEMSMVENNAPTSENEASKAEHDDVEVIPL

SEQ ID NO: 151694 - protein, 175 aa, Triticum aestivum
  unsure (1)..(175): unsure at all Xaa locations
  Clone ID: PAT_TA_46112.pep
MPGMASSKGLLVFALLLAAAAILVASTDEHTEAKKEENGAGVENFFHFGGGHHGHGGGGGGYGGGGGGYGGGGGYGGGGGYPGGGGGYGGGGGYPGHGGKGGGGYGGGGGYPGHGGKGGGGYGGGGGGYPGGGGGYGGGGGYPGHGGKGGGGYGGGGCHWGCCGHGLXHHHGCRC

SEQ ID NO: 151695 - protein, 122 aa, Triticum aestivum
  unsure (1)..(122): unsure at all Xaa locations
  Clone ID: PAT_TA_46113.pep
GTHASAGTTAPCTCDPPKRPQVSVEGEKPATGGAAAAEKAVSWAGXASSRARARXGRVPFDRQDGDHQSRTMLLNGVPLELGDGGGVPALNPVPAAVDSPVHLAPTSIAFVVLPRFEAKACS

SEQ ID NO: 151696 - protein, 161 aa, Triticum aestivum
  Clone ID: PAT_TA_46114.pep
MGPSAPGERAHAVCLPAPFQGHIIPMLDLAKMLHARGFHVTFVNTEYNHARLVRARGEAAVAGVLGFRFDTIPDGLPPSDDDVTQDVVSLCKSLTETCLGPFRRLLAELNDTATPMGHPPVTCIVSDNVMDFSMEAARELGLPYVQLYTSSAISYVGVRHY

SEQ ID NO: 151697 - protein, 143 aa, Triticum aestivum
  unsure (1)..(143): unsure at all Xaa locations
  Clone ID: PAT_TA_46115.pep
NIVATGASSXIGLXAIKQLLDXSQPYKVILGARNIQXAQKSYDELNYDRSASGVTILPLELNDLKXVKSFADQTLXXTXAKXKIDYLLLNAGLGGVSADEPGPNGSKWCEPYVVNHLSQYYLVHLLREKLVESKSRIGFVSSG

SEQ ID NO: 151698 - protein, 105 aa, Triticum aestivum
  Clone ID: PAT_TA_46116.pep
TRTRVQTRNTQQRRQTHDHPTDCRDSESDHIGLHVSWSYIVGADGKKTRGVERVLTRARYTAGKDYMRYERTPYCRSSTSGRSQTPSLTSGAMVHTRKQEQKLTG

SEQ ID NO: 151699 - protein, 169 aa, Triticum aestivum
  unsure (1)..(169): unsure at all Xaa locations
  Clone ID: PAT_TA_46117.pep
PTVLCPNCIRRLLWKIXGHWGHYEENMFTFRGSXTKFGLKPMNCPGHCKIFAHSNVTYNDLPWRMADFRTLHLNEFFGALXGLTRVRPFQHDDAHIFCTVDQIPEEIEYAFNFLSTVYXIFGFSFKLKLFTRPEKDVGDIATXDAAEKKLEEGLEKTGANWEFNPGEGA

SEQ ID NO: 151700 - protein, 187 aa, Triticum aestivum
  Clone ID: PAT_TA_46118.pep
MDDAAVHVLVFPWPRQGHINPMLHFATALVDAGVQVTFLHTERNLRRLAQAPPPGLRLLSIPDGQPDGHPPGFLELLESMSTTGSAAYRALLSAADAPVTCVVADSTIPFAFDIAEELGIPSLAFVTHSACSYLAILSMPKLVELGETAFPADDLVRGVPGMEGFLRRRDLPRGLCCAERAAKTPWC

SEQ ID NO: 151701 - protein, 187 aa, Triticum aestivum
  unsure (1)..(187): unsure at all Xaa locations
  Clone ID: PAT_TA_46119.pep
ASAYXRSGTWFRTXLGPILTRXFNWPMTITYTFNLPVCIPXGEYLLRIQSMGIHNPYPAGLPQFYISCAQINLXGGGSTVPGSQVKIPGAFKETDPGYTANIYSNFNSYTIPGPSVFSCNGAGGGDNSGTPPVTTLQTTTQPSAQPTQPGQCASLWAQCGGQGWTGPKCCAXGTCKATNDFYAQCVQ

SEQ ID NO: 151702 - protein, 39 aa, Triticum aestivum
  Clone ID: PAT_TA_46120.pep
AYQCLVWFMCSKLAYSASSDNLRGLVTRCRTEEPAIFNG

SEQ ID NO: 151703 - protein, 107 aa, Triticum aestivum
  Clone ID: PAT_TA_46121.pep
RKHWHEPAMLQPSTWELQATLASGSCDHGIDLLGTGGRVWWRSCNGGWWWERDRAPCFIHRAVRSCNGNLGSRGDLARDDGDLVQRACTSQTTRPRARRQQLGAARL

SEQ ID NO: 151704 - protein, 146 aa, Triticum aestivum
  unsure (1)..(146): unsure at all Xaa locations
  Clone ID: PAT_TA_46122.pep
MYFAGPVGGQLCGGLPTCRRAGRPVGPRAVLERRSWVRRAAVADFXAVWGDASKEMDDXLAHSIELPGGLFVSFKGGKTSRNFQGLSQYRSGYFVLCSVSKRGDTLGGPNCYSLGNKVRMLGXAANVAQAAAPASLGVAAGPAVLE

SEQ ID NO: 151705 - protein, 61 aa, Triticum aestivum
  unsure (1)..(61): unsure at all Xaa locations
  Clone ID: PAT_TA_46123.pep
NLNTAKQEERACNVEETLSGLQHLEGVLAECSKXEAQAVAPIFGGDTIGFLDIALRCYLPW

SEQ ID NO: 151706 - protein, 109 aa, Triticum aestivum
  Clone ID: PAT_TA_46124.pep
KFRIEVCLCEQIVQLLPSDQKPPTLQLLFPASSPASTLRWVWHKHRDGEWHEAELQGCLLGRPLGVVARLSLPAFPLPLMNFSPTTAAKPSILENGISMSTMRERIRNK

SEQ ID NO: 151707 - protein, 193 aa, Triticum aestivum
  unsure (1)..(193): unsure at all Xaa locations
  Clone ID: PAT_TA_46125.pep
ATTNLRTHRQTQRTGGRACSPEPLTVQRIVPLRRRGSAVDGGNQQGPSATELIFLYFRNMEATPTGTHRSVVSSCDARRRGGDVRPNTYGEETTGPTPHRSAAPRRRARDLPRSREACDVRPTPPCSGAKFPRPVQDTPGGGANLLRWGWSAGVQRPRLPGGGGFGRFDEGIWNVGCASFGHRAVKSWRWELX

SEQ ID NO: 151708 - protein, 160 aa, Triticum aestivum
  Clone ID: PAT_TA_46126.pep
QCSRRCGSTTVPYPFGFSPGCPIPLSCDASISTPILGRSGTTIHSFNSTTLTIVVSLPPSCTRSVPDAKKALSGANYGVSSHTGLFLRGGCREINASGAECSVPASVMRLLRTEQCVGNDTSVTCFASSPMNSTAAGPAPPAPALKFAYPNELRWEKVEA

SEQ ID NO: 151709 - protein, 190 aa, Triticum aestivum
  Clone ID: PAT_TA_46127.pep
GCRPKYEMAAGALPLGAFVVLLCVGVVRAADADIVAAGRPLSGDQKLVSPGGKFALGLFHPDGAADGSWYVGIWYHKISVHTPVWVANRETPVSNTSRLAIAPDGNLALFDGAGSIVWSTNASTSGVANASDTVAVLLDSGNLVLAPASNASAVLWQSFDHITDTWLPGGKLRRDKRTGAIQAMALWRAR

SEQ ID NO: 151710 - protein, 145 aa, Triticum aestivum
  Clone ID: PAT_TA_46128.pep
LRQEVLCVSRDCPLVIVTPSSGYMYCSRNWEILSAEFRGVHCIVKDRAKSVARRGCAFISWYSDQRLFTGGLILLYSYTLERYKAYHQRRDHAQEAIDVKVLNDQDKAGMDIQHAEFLASTVSADAYAEKDRLTPRRVSFQGGRG

SEQ ID NO: 151711 - protein, 118 aa, Triticum aestivum
  unsure (1)..(118): unsure at all Xaa locations
  Clone ID: PAT_TA_46129.pep
XRAVRSNASXNVYCTLLAHSALHGAMAGYSGFTVAPVNGRHAYIPFYRITEKQNKVVITDRMWARVLCSTNQPCFLSHEDVENMKHDDDERHHLHNTQLLDGSPAKCSPNCNGSAGAE

SEQ ID NO: 151712 - protein, 120 aa, Triticum aestivum
  unsure (1)..(120): unsure at all Xaa locations
  Clone ID: PAT_TA_46130.pep
LDVLLWLLCYVQWVVVAAACSIVWLMCFVFDAIQILAAIVLKTREKTWGDVVVCGAGGASGKATATPALQSITMASDRTILSKCKGIDKVQNCSKKYDLGRRSXVWGGRSAGKGHNNTYV

SEQ ID NO: 151713 - protein, 201 aa, Triticum aestivum
  Clone ID: PAT_TA_46131.pep
EFFGLKRYNQFSDINSDPEIANILEKLYTDPDMVELYPGLMVEDIKPQRNPGSGIMPTYSVGRAVLSDAITLVRSDRFNTIDYTVSNLTSWGYNEVQQDYKTLGGSMLYKLIQRGVPNWFPYNSVAVMQPMYTKSANEKIAKEIGTFDQFTTDDPKPPAKVAVTMSNETIKKVLSNTKQYVVPWLKPLNDLFPGKKEYGWF

SEQ ID NO: 151714 - protein, 140 aa, Triticum aestivum
  unsure (1)..(140): unsure at all Xaa locations
  Clone ID: PAT_TA_46132.pep
KQKTGLDLLLRAGDSAPAPPGASLRFSPCSDTSPARLPRPSPSSLCGSTRVRCSAPSKLDAIPGLRRSIPPPRPGQRAAAIILHMLLGGLCSLTIIISLRFVSLXRIQFGSIRCWAILFVSWFLVFGVWASRTRTSRRAS

SEQ ID NO: 151715 - protein, 86 aa, Triticum aestivum
  Clone ID: PAT_TA_46133.pep
LGNPLNGMTNASTRQFMERSATKHALRPCVTQYEGAHYVQIDLVAISSQEGRFKSLGTLRWLALVANLRLLTATALALSREPTRRR

SEQ ID NO: 151716 - protein, 71 aa, Triticum aestivum
  unsure (1)..(71): unsure at all Xaa locations
  Clone ID: PAT_TA_46134.pep
RAVLPASCGKCLLHTNTATGAQITVRIGDQCNNXGWTLDFDTVFMKTTPTGHGVTXGHLTVMYQLFDCCDN

SEQ ID NO: 151717 - protein, 75 aa, Triticum aestivum; identical to SEQ ID NO: 106874
  Clone ID: PAT_TA_46135.pep

SEQ ID NO: 151718 - protein, 50 aa, Triticum aestivum
  Clone ID: PAT_TA_46136.pep
LTAAQLTLDHLLLLHFYVLFTLVRSNKLTQERTAQNWSRTGREMFTCRVN

SEQ ID NO: 151719 - protein, 71 aa, Triticum aestivum
  Clone ID: PAT_TA_46137.pep
MAPVKLYGATLSWNVTRCVAALEEAGVEYELVPINFGTGEHKGPDHLARNPFGQVPALQDGDLYVFGMMFS

SEQ ID NO: 151720 - protein, 153 aa, Triticum aestivum
  Clone ID: PAT_TA_46138.pep
MELVSSSRSTLSSCSRLVAPSRSSSTTASAAARRHGKRLLCVLGGDRNGKLKIGKRAALALLLATPTLSLPFSAHAKTKTINPYDERRLLQQNKKIQEANRAPDDFPNFIREGFQVKVVTPDNYITRDSGLIYEDVKVGTGDCPKDGQQVIFH

SEQ ID NO: 151721 - protein, 85 aa, Triticum aestivum
  Clone ID: PAT_TA_46139.pep
DQDKPTFKSTHHATDLALVLDEHDLPGPCVPLNTPCLLWRPYQGDLTRCTDVAITSDLIRLRFPDPLYCRRDWHLLVLLPPWSLI

SEQ ID NO: 151722 - protein, 75 aa, Triticum aestivum
  Clone ID: PAT_TA_46140.pep
PASAAWADAWVRENFSDGTVMTIAHRITWVLDSDMVLLLDNGVAVERDTPAKLLENKSSLFSKLVAEYTMRATHT

SEQ ID NO: 151723 - protein, 114 aa, Triticum aestivum
  unsure (1)..(114): unsure at all Xaa locations
  Clone ID: PAT_TA_46141.pep
MSMPSTREDTIKMKCRVLQENVGFAHRYGKRGHSKSHFGDIDIFDGKXLVDMVPXYKKGDRPHGDRLTYQLIEITEDGYVRLITRXGNTEDDLKLCKEDVLLGQIKTGFDDGKD

SEQ ID NO: 151724 - protein, 176 aa, Triticum aestivum
  unsure (1)..(176): unsure at all Xaa locations
  Clone ID: PAT_TA_46142.pep
MFNYLYVNYGSVFTVSCFGVIKVTLLIGPEATTHFFQGLESEISHGNLLEFTVPMFGKAVGYGRDTATRMEQMRFHSEALRASRLRSHVSPMLQEVEDFFAKWGEEGVVDLKLEFEQLLMLISGRCLLGKEXRENMFDEVYTLFREIEKGVTLISFLFPYLPTPANRQRDRARIRL

SEQ ID NO: 151725 - protein, 143 aa, Triticum aestivum
  unsure (1)..(143): unsure at all Xaa locations
  Clone ID: PAT_TA_46143.pep
SEITSSYKVSSITSTNSSKSPRSPPPPPRRPSNLVHHGSSSDQRLGHLIAYGTLPPDRSAELLDIQHVEPSPEPPEPSKPTSPSSRALPPDLLRGLLMLLMAMDHMGLALNXWSHGTGRKTEMDGLPIKEWNTDFAYFIRTLT

SEQ ID NO: 151726 - protein, 173 aa, Triticum aestivum
  unsure (1)..(173): unsure at all Xaa locations
  Clone ID: PAT_TA_46144.pep
CVCVTIQKLLGQLLKREVQSSSKQSAVLQDLCRAARWEEAGEMISKMARKDCPPNEVTXNILINSLCQKGXIDRAILVVEQMPKYGSTPDIFTYNALINGFSEQGRLYDADKLLSTMPCKPDTVSYNSTLXSCRAERWKEAEEVVAEMLRKKCPLKEVTFNYANQLFIPNRVT

SEQ ID NO: 151727 - protein, 65 aa, Triticum aestivum
  Clone ID: PAT_TA_46145.pep
VYIIHIVDISTIFIKLAQNPLVDEPICVRRRMKVMHSEVATCKCFTFSKWQACTNTWTYNMNYNS

SEQ ID NO: 151728 - protein, 76 aa, Triticum aestivum
  Clone ID: PAT_TA_46146.pep
HMDAILSKYTFKSKLLNIADSGITVEVAFVQPPLSLEGPRRGDRGALARRPNRASLEECNFNRNAILSKYTSNPNY

SEQ ID NO: 151729 - protein, 173 aa, Triticum aestivum
  unsure (1)..(173): unsure at all Xaa locations
  Clone ID: PAT_TA_46147.pep
PCQKESTLHMCXRLACQKKGEHIFVKTLMAKTCFELRRRILQVKQRFXDETGIPPGRQRLIFAXEAAXDGRTLADYNVHNECTIHLVVFHGLTCQRMGXMHIIIRGLTDKIMTAVAEGEDXIYSVKVKVSAETGVPPDRQTLIFAGNVLEDGRTLADYDVQHASTLHVVLRGV

SEQ ID NO: 151730 - protein, 75 aa, Triticum aestivum
  Clone ID: PAT_TA_46148.pep
RLLVTRLPTGEPGRTPNGYGSNQAASTEDNQDECRGTTRSPRQNKSATYTATCANSELTESAPVNIMLNIVTVLS

SEQ ID NO: 151731 - protein, 50 aa, Triticum aestivum
  Clone ID: PAT_TA_46149.pep
PQEWDRQALWNNVVLTPTSCLPAVSVGLLLNILDALSYGMFLKIMALQSN

SEQ ID NO: 151732 - protein, 129 aa, Triticum aestivum
  Clone ID: PAT_TA_46150.pep
MATMSLAAASPLTASTPRGLAVPAPRAPPFLVPRAFGAPATRFAGLAAAPRPSGRGDAAVVRMAKREQELEEIRAMETENLEQEVVDLKGELFLLRLKRFARQEFKSSEFGRMPKKVGRLVTGRRKRKL

SEQ ID NO: 151733 - protein, 147 aa, Triticum aestivum
  Clone ID: PAT_TA_46151.pep
VPQERVDEAHRAGVKVLHQVGNLEEAAKAKEAGVDGIIVQGREAGGHVIGQEGLLPLLPRVVDLVSDSTVSVIAAGGIVDGRGYAAALALGAHGVCLGTRGLFGWCPGSPCQSWADQKIGDQIARPGFANNLAWNQKEGVRASWACQ

SEQ ID NO: 151734 - protein, 136 aa, Triticum aestivum
  Clone ID: PAT_TA_46152.pep
MAASVWLFFSLASLGALHVSALSVRLLASLAPCLRGPKDLRRRYGAWAVVTGPTSGIGRSMSLELARRGLNLVLVGRDPAKLRDVSETISRAHAVQTKTVLFDFSLVSTAQGDEAMRRLREAVAGLDVGLLVNNAG

SEQ ID NO: 151735 - protein, 141 aa, Triticum aestivum
  Clone ID: PAT_TA_46153.pep
MAQAIEAQREGAEVYHGAALCAEKAVELLAETNMPLGLLPLADIQEVGYNRATGFVWLRQKKALTHTFKQIGRQVSYATEVTAFVEDRKMKRMTGVKSKELLIWITLCDMYIEKDDPSKITFKTPTGLGRTFPVFVFGEAG

SEQ ID NO: 151736 - protein, 145 aa, Triticum aestivum
  Clone ID: PAT_TA_46154.pep
NITVAICRQTLHKNVIEEWASLLSDTISECLDSWYTKQTVVPKNIDESLRPNKEYAYYRKRKLRNSCEAVSSKKAVRTPTDEQLSKPLRELVERKVHLKNVQEPRKAGKSKKSSKSRTKTLDNVGDTLNIEQGLKRLCNDGPKPS

SEQ ID NO: 151737 - protein, 114 aa, Triticum aestivum
  Clone ID: PAT_TA_46155.pep
QRGIFRLVRSSDLLKKIDRQPLMMMTALVFFLFTWQINRKVSPPFSPFILGPCLAPSICVSLSILFPSCCSLRSGQGLAHPDGSPPKKAFSCLRLSPPCLILVLSFRSCLSACY

SEQ ID NO: 151738 - protein, 74 aa, Triticum aestivum
  Clone ID: PAT_TA_46156.pep
PRPWRRPAPASASGSGPPPAPRPGRPASPSSPRTSPLPAGAAPRPATQKTTGRAGSAPFLRRQPWVCRVQEMES

SEQ ID NO: 151739 - protein, 170 aa, Triticum aestivum
  Clone ID: PAT_TA_46157.pep
HHGPHVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVNRFDNLRQVQCVSFIAFKPPGC

SEQ ID NO: 151740 - protein, 79 aa, Triticum aestivum
  Clone ID: PAT_TA_46158.pep
AGARAVQQDPPSSCPSSASTAFVFPMLLLPVIFRMCCRRKMTWFISSSRSIASRSIPSPCSSSSPPLSSSPRSRCALSN

SEQ ID NO: 151741 - protein, 94 aa, Triticum aestivum
  unsure (1)..(94): unsure at all Xaa locations
  Clone ID: PAT_TA_46159.pep
EGTYPQDVDKLLQEAXIHYHPDITFDRXECPKHLGLCLIRQMTECPFLEVSYNPEQGAHPRXIADPSMTKFSRKVLPFKYDHRRYGYEESLKKY

SEQ ID NO: 151742 - protein, 67 aa, Triticum aestivum
  Clone ID: PAT_TA_46160.pep
CQVGVSFYRSSNKAGSARHDLVLLPPCSCTMWHRSTLWPSASPQVPFFSCGIISHYVSLHVGDEPHI

SEQ ID NO: 151743 - protein, 65 aa, Triticum aestivum
  Clone ID: PAT_TA_46161.pep
SDFLFSIIILWNMVLFFLQFRTWMAMLRSWLASSTTLSVHQLYNWQLKLNNIFMNMNRCLSKNSQ

SEQ ID NO: 151744 - protein, 149 aa, Triticum aestivum
  unsure (1)..(149): unsure at all Xaa locations
  Clone ID: PAT_TA_46162.pep
MAPAVMASSATTVAPFQGXKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGGTDATQVLNEGGEGKKEYPDTYDRGMG

SEQ ID NO: 151745 - protein, 116 aa, Triticum aestivum
  unsure (1)..(116): unsure at all Xaa locations
  Clone ID: PAT_TA_46163.pep
VSPAAKAPRKLLATKAERKSAPTTGGVKKPHRYMPDTVAXLLEIRKCQESTXLLISKLTFQRLVRXESMQDFKTDLMLQSHAVLALRDAVRSXYLVGLFVDTNLCSIHAKRVTFMP

SEQ ID NO: 151746 - protein, 84 aa, Triticum aestivum
  Clone ID: PAT_TA_46164.pep
TLIIHTWQHGLQGRANLPDDPENNAPYGLILLRGLHLMLMASHTDTVVSSLKLAPESNGLHRLIHHYFSPRMLLQMLASWTQSD

SEQ ID NO: 151747 - protein, 97 aa, Triticum aestivum
  Clone ID: PAT_TA_46165.pep
QSYPGLRYQFQHPKSPVLAVDVAGRSSQRHRLQQFNVTTLSCSICCRRTQHLSQPVAAPTTTAVAPLHTLHRSTPARPGHYPAKTAFYRSRRGQDGS

SEQ ID NO: 151748 - protein, 154 aa, Triticum aestivum
  unsure (1)..(154): unsure at all Xaa locations
  Clone ID: PAT_TA_46166.pep
TLVYLLIPGLFSNHSPLYFLNTKRXFSKMGLTCHIAKIHSEASVEKXARELKLYIEELYWGSGKQVLLLGHSKGGVDAAAALSLYWSELKGKVAGLALVQSPYGGTPVASDILREGQIADRETRRIMELIVCKLIKGDMRALEDLTYDKKKGLH

SEQ ID NO: 151749 - protein, 114 aa, Triticum aestivum
  unsure (1)..(114): unsure at all Xaa locations
  Clone ID: PAT_TA_46167.pep
MXGVFSXKSXIYSFGVLVIEXITGXXNSSFYDDELDLNLLGYAWXLWXRSRGVELLDEXMGGTFEYDVVLKCIQVALLCVQVHPRXKPLMSSVVMLLSRXNATMPEPNEPGSKH

SEQ ID NO: 151750 - protein, 94 aa, Triticum aestivum
  Clone ID: PAT_TA_46168.pep
ADANDSSQVGAPMSGVLVELRVHEGSEVKKGDPIAILSAMKMEMSVSASHSGKVTSLHVREGDSVDGSDLILRITRIPKENDGIFVWRVKMTYE

SEQ ID NO: 151751 - protein, 68 aa, Triticum aestivum
  unsure (1)..(68): unsure at all Xaa locations
  Clone ID: PAT_TA_46169.pep
PYDISVLIHLSILEQHNPTTLQFHCLCHNSLCSLLSRLAVRQSQLDHPHRPPXPLSLPSPSSFFLGGG

SEQ ID NO: 151752 - protein, 69 aa, Triticum aestivum
  Clone ID: PAT_TA_46170.pep
IPFMSTPRKASINVSSVPIIYFTQQICCCQQCSLNRHCNYHIRTSLLLHQTIKNYLKSSLASSLSSTEG

SEQ ID NO: 151753 - protein, 124 aa, Triticum aestivum
  Clone ID: PAT_TA_46171.pep
MHDWDAQKYPPPSDSKPEALNFPLTHYEMSRDTTPFIPPQRYPSPPQNMWYEVPKDRSSPQSKHAPEIFPWERNQPRPTRTFAGEPQPEPQPSPEETSAQLSVKTEGITESGSESKNQSSWSTP

SEQ ID NO: 151754 - protein, 70 aa, Triticum aestivum
  Clone ID: PAT_TA_46172.pep
FVKKKACKITILVNVSSASITMCIRNKYQKQNILTHDPTHFTSVQFSEQKESATLVNSTYVVQTIHCSRH

SEQ ID NO: 151755 - protein, 135 aa, Triticum aestivum
  Clone ID: PAT_TA_46173.pep
ALFFFFFFFFFGPQQHTTTKPKSPVGVYTQLEGGHNTNRGYSVDTVQASSVSRGREPGVPPRESVGPVPRTRPPEPPTPRYTAYKLQRYIHTAPHHVRGHMEGAKLLLLRLLLLYLGLQASICCSSCIMVWNLLR

SEQ ID NO: 151756 - protein, 127 aa, Triticum aestivum
  Clone ID: PAT_TA_46174.pep
MAPRALLCLSLLCLAVLASGGAAAESHTQCTDNPPDLTAGGDEAGAVVDDLAGFKAYVTGGAAHSHRAVVLASDFYGFEAPLLRKIADKVGEAGYYVVGPDFFNGQPYTGGTNRTEWFLAHSPVKAG

SEQ ID NO: 151757 - protein, 155 aa, Triticum aestivum
  unsure (1)..(155): unsure at all Xaa locations
  Clone ID: PAT_TA_46175.pep
SWQPGFMPXGGRGVPFPXGGMGMPQGRPGQFPYPQQGGRGGVPQQMPPNMYGMPGQFPPGYGQPGTPQFMAAMQAQQAALGGRGAPQGGRGGPQGMPGMPPMAGNMPGFPPNNNRQGGRGGPGRNGNGPQGGRGADAAGLSSLQQQLASAPPPQQ

SEQ ID NO: 151758 - protein, 143 aa, Triticum aestivum
  Clone ID: PAT_TA_46176.pep
KPLAPGALLAVRLRTFFPKTSSARRPPCLFWFGRGAPDRASRWREPTGSSRLPSPANLADEETNGARPCCHGHRRPEPPCVSFPSLPSLPPDRAGSARLLSPRLPVLASRRGASSLLRSDERSWRRPLRQFQDASAARIGRPL

SEQ ID NO: 151759 - protein, 108 aa, Triticum aestivum
  unsure (1)..(108): unsure at all Xaa locations
  Clone ID: PAT_TA_46177.pep
LLTQHSRHTGTALFTLQAQLSSGTTPRRLFILLRSLLLWATVPRTRTPQHHEVDEEENPSYNARDREYDLLTRLSEIVTTQGADCTDIAQFDQHAQGQHIDPSSXVCY

SEQ ID NO: 151760 - protein, 121 aa, Triticum aestivum
  Clone ID: PAT_TA_46178.pep
MSFSSVSAASQTRVGVVQMTSVGDLDANYATCSRLTKEAAAAGVKFLCFPEVFSFIGSKDGESVKLAEPLDGPIMQRYCSLANESSIWLSLGGFQERGPDDSHQYNTHVLIDESGKVRSLY

SEQ ID NO: 151761 - protein, 151 aa, Triticum aestivum
  Clone ID: PAT_TA_46179.pep
ARPSRHTTLSRRDTWARVAGASYLALRSFMVSYFGCLSEEQATRYLHWARGDLVRAVLLVEHDLYDAELQIPNPASQRTQAALKCAAIYVSHPAPDVLVRLQASPLPQQWLDAAAPFLKPQGRKLTLDDVELIVRMLRHQDGAPLDLQGKL

SEQ ID NO: 151762 - protein, 100 aa, Triticum aestivum
  Clone ID: PAT_TA_46180.pep
MARKMLKDGEAPVVADDGGSYDYDLFVIGAGSGGVRGSRTAAGFGAKVAICELPFHPISSEWLGGHGGTCVIRGCVPKKILGYGAYFRGECEDARQFGGG

SEQ ID NO: 151763 - protein, 134 aa, Triticum aestivum
  unsure (1)..(134): unsure at all Xaa locations
  Clone ID: PAT_TA_46181.pep
PRVRXNNKVIQIAWKDSTIVLFLSTVHSRASHERTPKKRKMPAKRAQRQSNIAFKSTSTGESFKIISIPTIAAQYNNEMNHVDRGDQIRSYTTYEHRFRRGPWQALLWSFLLEVALANSFILQRETTQAHWKPT

SEQ ID NO: 151764 - protein, 114 aa, Triticum aestivum
  Clone ID: PAT_TA_46182.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLVEDTILCAIH

SEQ ID NO: 151765 - protein, 128 aa, Triticum aestivum
  Clone ID: PAT_TA_46183.pep
MVATAKIPQRQLFIDGDWRAPALGRRLPVINPTTEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 151766 - protein, 124 aa, Triticum aestivum
  Clone ID: PAT_TA_46184.pep
MAQQPLSSSAQPTDIYGGDEVSALVLDPGYCSTRAGFAGEDVPKSILPSFYGHVTGDNSRDLFGDECLIPRENYEVRNYMNKDSVVEDWDVAARIWENMLVNRLQPERQTPSSKNGLNDDPGPE

SEQ ID NO: 151767 - protein, 153 aa, Triticum aestivum
  unsure (1)..(153): unsure at all Xaa locations
  Clone ID: PAT_TA_46185.pep
TXFWYNTTYHSSLGCTPFKAVYGHEPNLGQLPQPLQATHPDLQTWLQERNQYSDFLHQHLNRAQTKMKADADKKRSSREFVVGDKVFLKLQPYAQTSVVNRPYPKLAMKFFGPFEVLEKIGPAAYKLLLPGGSQVHPVFHTSQLKPHVADHTP

SEQ ID NO: 151768 - protein, 73 aa, Triticum aestivum
  Clone ID: PAT_TA_46186.pep
LLNYPCFQQQPSSSRFCSGLLVSFAVVTMPINLSSEISNLAYCLSIFLHASRVSLFDGILCYMLSCEHSMALV

SEQ ID NO: 151769 - protein, 161 aa, Triticum aestivum
  Clone ID: PAT_TA_46187.pep
NNPLSQVLYGLALRHGWGCAPDPEGAVKYLSAAASNSASIEQMALQAGMTKGGAAKGELVLAIFELANCFRHGWGINKDAYAAKQYYETAANLGDTDAMNEIAWCYVEGFGCKKDKFAAARYYRLAEKSGNKTLGNSWIWKEKSTLRARAVTSSGGEAGML

SEQ ID NO: 151770 - protein, 129 aa, Triticum aestivum
  Clone ID: PAT_TA_46188.pep
MSSHNIPSYKLNDGNEIPVLAFGLGTAQFKKDSQSGLDQHVVDITTKAIKAGYRHLDGAEVYGNEEELGEAIKAGGVPREQLYVTTKIPAEKKGSAIDAFDVSLKKLGLEYVDLYLIHGPWFGETEGGL

SEQ ID NO: 151771 - protein, 157 aa, Triticum aestivum
  Clone ID: PAT_TA_46189.pep
QGNIATSEFPTQCASHILSAHPSPFEATVVRQLRKRGATVVGKTNMDEFGMGSHSTNSVHGAVRNPLAKNDNVSAGGSSGGSAVAVRLGDADVALGTDTGGSIRLPAAYTGTVGYKPSYGMISRFGVVPYANSLDTVGFMAKDVKPIHDLVFKTKMH

SEQ ID NO: 151772 - protein, 96 aa, Triticum aestivum
  unsure (1)..(96): unsure at all Xaa locations
  Clone ID: PAT_TA_46190.pep
PPLPLTQGSLASVIIDPPFFSNDCQTNXALTGRWLIKXKSPRVIVCTGERMAPIIDKLYSSVGVYPTTFEPAHAGLSNHYYCYANFGELDLGLATG

SEQ ID NO: 151773 - protein, 99 aa, Triticum aestivum
  Clone ID: PAT_TA_46191.pep
RYQCSGKSGSSPGSYTVFHLVWPQAWSRASTGAGTMGGTMSKVLRTALSLPLMLPVKLAVSCDGSCNSSCKCSKECEHAMRGFGSSLLSAGQSAERKLV

SEQ ID NO: 151774 - protein, 139 aa, Triticum aestivum
  Clone ID: PAT_TA_46192.pep
SLTQNYPLNTHTHTHAHVYHTVTPWNNTSYKEQSSTITLLERMRTITLRKLQESNNRTHKVALRRRHLQLRLYAAQTKINWGETFREGEPAEKNIAENNTKRTKLLSNPPLIALRRRRLQLQLYTAQTRASSLSLPSFR

SEQ ID NO: 151775 - protein, 123 aa, Triticum aestivum
  Clone ID: PAT_TA_46193.pep
GRRRALRRGGGANNPEELASRGSFFNWWCFATSGGNTITISALNYVQESVSWQFGFGIPCAAMALALSVFLLGTRTYRFYPPEKNGVLLTQLGELLVARAKSWHSSWCSSSIFPDDDSLPLAG

SEQ ID NO: 151776 - protein, 86 aa, Triticum aestivum
  Clone ID: PAT_TA_46194.pep
AFFADSYPLNQLSSEVVANRLPVPPSTIVISERHIISVVPVTHVTMSHRKRSFIFYVVGYGRDVFVQNYPSRFCWGLCRCFEWFGN

SEQ ID NO: 151777 - protein, 151 aa, Triticum aestivum
  Clone ID: PAT_TA_46195.pep
SELSAGGWRRTDAAGVNRADTVQRQGRYPPPPGASPYPGLECSGTILALGANVPPRWAVGDQVCALLTGGGYAERVVVPAGQLLPVPEGVSLTDAAGLPEVACTVWSTVFMTSHLSPGESFLIHGGSSGIGTFAIQIAKHLGGKGFVTGGS

SEQ ID NO: 151778 - protein, 182 aa, Triticum aestivum
  Clone ID: PAT_TA_46196.pep
GSLGIVTKVSILTPAKLPSTNVAFLSCNDYMSCQKLLLAARRSLGEILSAFEFMDRQCIDLAMTHLEGVHNPLPVSPYKFYVLIETTGSDESYDKAKLEAFLLSSMEDGLVADGVIAQDISQASNFWRIREGISEASVKVGAVYKYDLSIPVEKLYDIVEEMRSRVGDTAEVLGYGHPGDGN

SEQ ID NO: 151779 - protein, 105 aa, Triticum aestivum
  Clone ID: PAT_TA_46197.pep
MSGLINKVKEAIHSDKDKKHDSTTHGTHDTHNTHSTHSSGLPEGTAGPHSSRAANAADPRVDSDLDSSRRTGAGHTTGGLGSTTGTAGHTTGHTTGGIGSYFENM

SEQ ID NO: 151780 - protein, 80 aa, Triticum aestivum
  Clone ID: PAT_TA_46198.pep
MSDVTAVMDLEVEEPRLSLPPGFRFHPTDEEVVTHYLTPKAVNNAFCCLVIAGVDLKKRETWDMRGKGKMGEKEGNFLVD

SEQ ID NO: 151781 - protein, 108 aa, Triticum aestivum
  unsure (1)..(108): unsure at all Xaa locations
  Clone ID: PAT_TA_46199.pep
TNRCFYLLQIYDIFQLLPSKIQVGVFSATMPPEALEITRKFMNKPVRILVKRDELTLEGIKQFYVNVEKEEWKLDTLCDLYETLAITQSVIFVNTPRRXDWLTDQKRG

SEQ ID NO: 151782 - protein, 72 aa, Triticum aestivum
  Clone ID: PAT_TA_46200.pep
GWTTRTPTIRRGHHHPTLLCYAMALEDDTDLISSAAKIYAIIYITIYHVWVARRLYNGPVIILPTDMGLKTF

SEQ ID NO: 151783 - protein, 143 aa, Triticum aestivum
  Clone ID: PAT_TA_46201.pep
TKTTAGLWNGGSTYELALLQISSHSFHLKLNVEAGTSADRPKTFSKKKQEVSNRREESIEEESDEEVEKTKHKGTAGLIEIDNPNLVKPKSIKAKDVDVDRTTDLSRREREELEKQRARAHYMRLQEEGKTEQARKDLDRLTL

SEQ ID NO: 151784 - protein, 108 aa, Triticum aestivum
  Clone ID: PAT_TA_46202.pep
SRAESLESIFFFHSNPLHPLPRCTTLRRGRRCPTRSTCRSATRRRAASMHACSRRCAASAATRPASAASTASAAAATKTAMAAMDGRRLQGGADIHRPPPPFIISICV

SEQ ID NO: 151785 - protein, 86 aa, Triticum aestivum
  unsure (1)..(86): unsure at all Xaa locations
  Clone ID: PAT_TA_46203.pep
TSRLEFEKNMMAKFAEWSQQMGTQQVPTKRVDNKENSNPNLQNILLQRSSPNKTSGSRPTAISSNALIQAGARXNPGCFKAMDPNN

SEQ ID NO: 151786 - protein, 51 aa, Triticum aestivum
  Clone ID: PAT_TA_46204.pep
QEAIQRCAAAAAAAGGRRRASQAFEWLPYNARFRYAFARSMVDKQAAAVLA

SEQ ID NO: 151787 - protein, 142 aa, Triticum aestivum
  Clone ID: PAT_TA_46205.pep
MSSEPLPASTEALEADLSAATISKKQLNKEARKAAKAAKAENAGKAEKSQAEEEDDPFAVNYGDVPLEEIQSKVISGRSWTDIGDLDEAAVGRSVLIRGYAEKFRPVCKKIAFVVLCQSMTTVPGVLVASADTGVSTPMGAL

SEQ ID NO: 151788 - protein, 121 aa, Triticum aestivum
  Clone ID: PAT_TA_46206.pep
GSGVPVPANMAAVTLGTETDGSILCPSSFNSVVGIKPTLGLTSRAGVVPITPLQDTVGPMCRTVSDAVHVLDAIVGYDAQDAAATGAASKYIPHGGYTQFLKKNGLKGKRIGVPNASSKDM

SEQ ID NO: 151789 - protein, 88 aa, Triticum aestivum
  Clone ID: PAT_TA_46207.pep
LFICYSIGRIRADTDSDKINLPNGLCADLPKHRCTNPDACVCCTVDGICYVTMDECKKECKKTSSSEDILLAMTSPPLSAPYFSSLEA

SEQ ID NO: 151790 - protein, 167 aa, Triticum aestivum
  unsure (1)..(167): unsure at all Xaa locations
  Clone ID: PAT_TA_46208.pep
GWTQXLEDEMRGILRVIKAKDEQEFLKVGRLVLSLNRGLAVAGPALAGTAALATVFIGSGEAGAWASGAAVFGGALAAAVNTVEHGGQMGMLFELLRNCAGFYRKIQEDIEANLGEPDVERRERGEVFATKVALKLGRSMSDLKQFRKMALPSVRDEDIKEFAGKLF

SEQ ID NO: 151791 - protein, 75 aa, Triticum aestivum
  Clone ID: PAT_TA_46209.pep
ACSQMTTATWRGSPWIGIWSPGRQVEPPSLMRKASSAARPRAHQPPAPSGSPLPLQPPYAPIWATLSVLVSAHAP

SEQ ID NO: 151792 - protein, 177 aa, Triticum aestivum
  unsure (1)..(177): unsure at all Xaa locations
  Clone ID: PAT_TA_46210.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGXPLLGCTIKPK

SEQ ID NO: 151793 - protein, 180 aa, Triticum aestivum
  unsure (1)..(180): unsure at all Xaa locations
  Clone ID: PAT_TA_46211.pep
MSPQTETKAGVGFKAGVKDYKLTYYTPEYETKDTDILAAFRVSPQPGVPPEEXGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKXNKYGRPLLGCTIKPKLGL

SEQ ID NO: 151794 - protein, 195 aa, Triticum aestivum
  Clone ID: PAT_TA_46212.pep
QQRPPQPARSSSPVCGPRPPWQPEPAPSVAAEPPTAVDVHPGSTSALQSPSSPCCPVVDWIKEPARSSSPACGSRPAWQPEPAPSVVAETPTAVVVHPSSTGVLQSCSSPPPLLTGQGAGALVLAGVRVEASLAAGTGAVRRRRDTHRCRRAPFLHRRTPVVLVAAPVVDWTRSRRARASRRAGRGQLGSRNRRR

SEQ ID NO: 151795 - protein, 85 aa, Triticum aestivum
  Clone ID: PAT_TA_46213.pep
MLRAKLSVTRAMLSCDSIKGNNSDQPLQQQVQRFRQPHQQVPDEITRMVLETLASVCSANIPQYCATTPCSTIFQTPYNIPMADT

SEQ ID NO: 151796 - protein, 139 aa, Triticum aestivum
  Clone ID: PAT_TA_46214.pep
MGSVGTGLLKGLRRVLEKQRKPVDLCRTSRAWSSTVSFSDIDEKDDMGDDSDLKDSRRELEPQSVDPKKGWGFRGVHRAIICGKVGQAPVQKILRNGRTITIFTIGTGGMFDQRVIGSADTPKPAQWHRIAGHSEHLGA

SEQ ID NO: 151797 - protein, 198 aa, Triticum aestivum
  unsure (1)..(198): unsure at all Xaa locations
  Clone ID: PAT_TA_46215.pep
STAGSRRCXTXKNETQTVEVDLSLIGVGKANARDVWAHEDLTISGTQKFELKPHELRLLVLSDITQTPKPKQWGYYAAPKAALEGTASLVDCGANECMPVNKKIKSIGKDAKVTFKFVSAPKDGPLYVGVDYINHEYHHTIGDWETNTRNMSISVNGEDAKRWAFPNAGGDWFESDRMTILLDGFKKGKDNTVTFTAS

SEQ ID NO: 151798 - protein, 88 aa, Triticum aestivum
  Clone ID: PAT_TA_46216.pep
DNRIKPYSTHPITRHKLCTYEGVCTGQKIQRHLPTLTYSIGTITRCYNNHIICVVMEGTFFWNGITSEGRTQTCIQYDHLLCSKGILP

SEQ ID NO: 151799 - protein, 145 aa, Triticum aestivum
  unsure (1)..(145): unsure at all Xaa locations
  Clone ID: PAT_TA_46217.pep
MSQHILALAALAIDMDRGAVPLMATQQADSVIPAQSCPRQEDEPGSHGCDDKHPEHLCAGTWLRQIADHCRMHYSTRAEEKNILTHFGHKLTALHTTKXWRNDXANYHTDRNTCDPANVCCHYTHVSIIKSTGLRLSRIGLTTNR

SEQ ID NO: 151800 - protein, 171 aa, Triticum aestivum
  Clone ID: PAT_TA_46218.pep
MGLLLLFEASLVPAGPRLGQWQPPSPRRALPRNAPADFVSLHNSLRALVEVGPVTWDTTVANYALNYANQRKADCNLVHSGGTYGENIFWGSAGGTWTASSAVTMWTDEKQFYDYATNTCATNKVCGHYTQVVWRSSTSIGCARVVCDSNRGVFIICNYSPRGNIAGQKPY

SEQ ID NO: 151801 - protein, 180 aa, Triticum aestivum
  unsure (1)..(180): unsure at all Xaa locations
  Clone ID: PAT_TA_46219.pep
PQPFPQPQQPQQPFPQPQQQFPQPQQPQQSIPQQQQPLIQSSLQQQMNPCKNFLLQQCNPVSLVSSLVSLILPRSDCQVMQQQCCQQLAQIPHHLQCAAIHSVAHSIIMQQQQQQGIQILRPLFQIVQGQSIIQQQPAQLEVIRSLVLKTLXTMCNVYVRPDCSNIRTPFASTNAGIGGP

SEQ ID NO: 151802 - protein, 104 aa, Triticum aestivum
  unsure (1)..(104): unsure at all Xaa locations
  Clone ID: PAT_TA_46220.pep
LPAIWHDASXEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 151803 - protein, 186 aa, Triticum aestivum
  Clone ID: PAT_TA_46221.pep
DEAANVRADQLCHRGRLTQPSPQRHGSLHTRSRLEWMAPCCPETCATETEEISTVHSKHARRQHARTHTAPLPPHATASHQILATAAPPKSGPSFAPPNPRNSRAPRNPPDRRDPKFAEPPAPQIRRAAAPLVAAAWRILPGPPRHGRFERKERGEGRGEERGSEADLCRRRCTRSPVAAASRPRE

SEQ ID NO: 151804 - protein, 161 aa, Triticum aestivum
  unsure (1)..(161): unsure at all Xaa locations
  Clone ID: PAT_TA_46222.pep
SDXCMIKXTTXSDVYSFGVVLLEIITGRRPVEHAFGEGQSVVQWVREHLHRKCDPAEVIDARLQGRPDTQVQEMLQALGIALLCASTRPEDRPTMKDVAALLRGLRHDDGAESRKMSGGGGGSFGKWSEQSRPVPLPRAGQTQAQTQTHSSSLAYSTTGSV

SEQ ID NO: 151805 - protein, 122 aa, Triticum aestivum
  Clone ID: PAT_TA_46223.pep
MAARLAQLRTKAAQAAEFASKHGGAYYKEAMEKNKQYVVQPPSVEKCQELSKQLFYTRLASLPGRYEALWKEVDGVKQLWKNRKELKVEDLGIATLFGVELYAWFCVGEIAGRGFTLTGYKV

SEQ ID NO: 151806 - protein, 141 aa, Triticum aestivum
  unsure (1)..(141): unsure at all Xaa locations
  Clone ID: PAT_TA_46224.pep
VXYITAXKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSWAGKASL

SEQ ID NO: 151807 - protein, 190 aa, Triticum aestivum
  unsure (1)..(190): unsure at all Xaa locations
  Clone ID: PAT_TA_46225.pep
QMDRLXTXKDQLSEQLNAATLRYFKAEKKLDRAKSSQVQKMEQQAFANATRPSASGDVNTDSGETNGNSGELLLKYEEATAAATKQKEQLDVFLAEIKALQDENSTLKAKRDTLTDEDFIRTDVFKQFKNQNEDLIKRINTLEATNKQLREEAERLQAERTAFRTMLEADANQVTQELESEIILRDQDLA

SEQ ID NO: 151808 - protein, 121 aa, Triticum aestivum
  Clone ID: PAT_TA_46226.pep
QQAAVVRVQAVPHLPRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 151809 - protein, 172 aa, Triticum aestivum
  unsure (1)..(172): unsure at all Xaa locations
  Clone ID: PAT_TA_46227.pep
RTAAYGDEDASPXTVSVARAEXDGVKASRSSKPTASDAKKLVFVGGEPEVAYELESLLHASAEVLGKGWLGTTYRATLEGGVAVVTVKRLREVPIPEKEFRGTVAALGALRHESLVPLRSYFYSKEEKLIVYDFVSAKGLSSLLHXAGSERLDFTTRAPIALASARGLSTGR

SEQ ID NO: 151810 - protein, 188 aa, Triticum aestivum
  Clone ID: PAT_TA_46228.pep
PPHPKPYLIAAREGRRRRRGGRRHRGGHRGTEGAPYAGTTESPELRWALIRKIYVVLCLQLLLTAAVAAVFVTVTAIPHFFVSSYAGLGLYIFILVFPFIVLCPLHIYRQKHPINLLLLGVFTVAISFSVGLTCAFTSGKVILQAGILTIVVVLSLTAYTFWAARRGKDFSFLGPFLFASLMILLVFA

SEQ ID NO: 151811 - protein, 64 aa, Triticum aestivum
  Clone ID: PAT_TA_46229.pep
IKSLCEHRTDMCLAKLFNKCSKKNPENVRTLHFRLYNIGNTIVLDKIIFHNYTTNKGHTESKSA

SEQ ID NO: 151812 - protein, 178 aa, Triticum aestivum
  unsure (1)..(178): unsure at all Xaa locations
  Clone ID: PAT_TA_46230.pep
VXIYHCVLESKSFLEKRXVTEHTLPFFLPIREVETDHLSSNAIRFIDHLEEILQSYIDRREQVRLIKELYGNQIGELFYSLPYTLIEFTLEDFECKVTVSIRYSDLILTLPSQARVLAWPLRSAKRISAADRRAQPVPSRLSYAENALKTLSLPEAYAEIVLELPRALKQMFYSQESD

SEQ ID NO: 151813 - protein, 62 aa, Triticum aestivum
  Clone ID: PAT_TA_46231.pep
VWRQQSSEVPGGSDTFVKQFLEDNLGIKHDFLGYVVLAHFAFIIAFFFVFGYSIKVLNFQKR

SEQ ID NO: 151814 - protein, 66 aa, Triticum aestivum
  Clone ID: PAT_TA_46232.pep
QTDQHTTGTVFWELLELGMRCTADAPHERPDMPVILAALLDMAGDAGCAYCMSSGHSDGEQTSSLT

SEQ ID NO: 151815 - protein, 101 aa, Triticum aestivum
  unsure (1)..(101): unsure at all Xaa locations
  Clone ID: PAT_TA_46233.pep
XELLEXITWSQLGIHDKPVGLLNVDGYYDPLLALFDKGAAEGFIKADCRQIIVSAPTAHELLTKMEQYTRSHREVASRTSWEMTELGYGKAAPEPEEEASC

SEQ ID NO: 151816 - protein, 165 aa, Triticum aestivum
  Clone ID: PAT_TA_46234.pep
LRRPKKRRLQPTPPPISSSPAPRRRPPPPLHSPIPPPPPLCLLSRTRVRLRRPPIPPRQSSRSAAPQPLPPPPAAVVAAPGHQRRRAGVARPDAPPSRGGAASSGRRGGWRRAALARAAWSGAFFSRAARGLAVRLEALRGHEGVCRILAPSATGRSLVERQQRR

SEQ ID NO: 151817 - protein, 76 aa, Triticum aestivum
  Clone ID: PAT_TA_46235.pep
GIRGASCRGSAPGSKYPGRRQGPVGGSTGTRARYGCRTGQPPRLPAAWSTRAQYRRSPSGAIGISARPWRTVGGGV

SEQ ID NO: 151818 - protein, 182 aa, Triticum aestivum
  Clone ID: PAT_TA_46236.pep
KPVALIVGASRGIGRQVAVDLASNGYAVVVAAKTISDTSNLPSPFPPNPNSSASTITTVAHEITLAGGDATAIQVDVRYPESVDSLIAQTISTYGRLDVLIYNSGAIFWAPVSSTPLKRFQLMQRVNPEGLYATIQAALPHLPSTGRIVVVSPPIYSRFFRGKTAYAMGKVGMSVLTKGLAM

SEQ ID NO: 151819 - protein, 142 aa, Triticum aestivum
  Clone ID: PAT_TA_46237.pep
YILIKVLLERGDSMQGLTFKKDVVTGCLVLTGFQRVWTTIWLNKMPFLTVIVLSVLLLFSWQGRISWQFSKAAWQENDCTSQLTSYTTREKASSTAGFRCISSAERGATNKALQLTHSSSAWSLALLLHKCSSSGLLEARYC

SEQ ID NO: 151820 - protein, 177 aa, Triticum aestivum
  Clone ID: PAT_TA_46238.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPK

SEQ ID NO: 151821 - protein, 55 aa, Triticum aestivum
  Clone ID: PAT_TA_46239.pep
SFPQFCTSPLRFFGYCSLNKLPTIEFKICYLHKKELNKDDLTQLILILAMRVFCI

SEQ ID NO: 151822 - protein, 137 aa, Triticum aestivum
  Clone ID: PAT_TA_46240.pep
MGSRMECSSDESSELSDTDIDDYAEKAYTDLKSGKLVARFGADRFRCPFCPGKKKQDYRYNELLQHAIGVGASNRAAKVKANHQALASHLKTDHADAAGSLPPRQAVALINPPKPVQDQELFVWPWMGILANVPVEQ

SEQ ID NO: 151823 - protein, 62 aa, Triticum aestivum
  Clone ID: PAT_TA_46241.pep
QFFSIFHILLNPYFFMFSSLKQQVLPHFWTTCLEVSCSCTSMAADSRINSGLCRRMLSGRPN

SEQ ID NO: 151824 - protein, 189 aa, Triticum aestivum
  Clone ID: PAT_TA_46242.pep
SSPPGTRPAPWRGAASCAPSGRRPRRCRASRRRPGRRRWRRARRSPSGRSPRCRWARTTRPPAPPRRCPPAPPPPPRRRPRPSPRTTAPGSRRTPASTPPNACSRTATGSRGWAPWAGARAAWPAPATNRTPTRAHPWRRRRHRDPSSPRPPSPPPGRPRPRPRAPEPAPGRRPPWPPPSSAPAPCLPA

SEQ ID NO: 151825 - protein, 192 aa, Triticum aestivum
  unsure (1)..(192): unsure at all Xaa locations
  Clone ID: PAT_TA_46243.pep
SREQDGNMLLNISPMANGVLPEEQXQVLNDIGDFLSRYGEAVYDTRAWDIYGEGPNQVEGGSFTAPLQGNSSDIRFTRNKEDDVLYVTVLGWPEDNLVSVKNLGSNALVDLESLKSVELLGDKAGDYVKVSEWEQSKDALDITLPSQPAESLAYVLKLTFDGGIPVPQPERGAAVFSKADATGKGVALALGT

SEQ ID NO: 151826 - protein, 93 aa, Triticum aestivum
  Clone ID: PAT_TA_46244.pep
AVTLQSVVSSHHKPANRDVHMYSTAAKHVVEAFHQTSDPVVGQREVVEPEGGVPGGVPPLDHPRLAVRLRRLVVDPREGVLPQQLGERRPTRP

SEQ ID NO: 151827 - protein, 194 aa, Triticum aestivum
  Clone ID: PAT_TA_46245.pep
MYGRLPLYHICNVLFVIFNVACALAPNLGGLIAFRLLAGLAGSCPLTIGAGSLADVISRERRGAAMSSWALGPLFGPVIGPVAGGYLSQAKSWRWSFWVVSILAGAITIMAFVFMRETYAYTILDNKTKKLRKETGNPKLRSALAKEITTKELFSMAMVRPTKMLLFAPIVTLLSLYMALVYGYLYLLFTSLPT

SEQ ID NO: 151828 - protein, 129 aa, Triticum aestivum
  Clone ID: PAT_TA_46246.pep
PRRGRQLGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 151829 - protein, 63 aa, Triticum aestivum
  Clone ID: PAT_TA_46247.pep
DNVGFYSILSYTLSWSLYYNIIYAHDAQTMHQQFHHLPLYPSTNHAHAYNCNLLRHRRNACMP

SEQ ID NO: 151830 - protein, 69 aa, Triticum aestivum
  unsure (1)..(69): unsure at all Xaa locations
  Clone ID: PAT_TA_46248.pep
LFNPWDKXAKAMQDFGDSEYKHMLCVEPAAVEKPITLKPGEEWKGRLGLSAVPSSYCSGQLDPLKVLHG

SEQ ID NO: 151831 - protein, 187 aa, Triticum aestivum
  unsure (1)..(187): unsure at all Xaa locations
  Clone ID: PAT_TA_46249.pep
XASCPAKGQRPPPDYACASSNSYCVNATVGLSGYALSYVCKCSEHYEGNPYIANGCRDIDECKFPDLYYCSSKGICKNRPGGYDCPCKPGMRGDGKLGQCVEKFPLVAKAVVGIIGGISVIVVISFLVLLHKERRKTRXFYEKNGGPTLERAXNIKIFKKEEPVPILKESNLIGRGGFGVVYKGTLG

SEQ ID NO: 151832 - protein, 78 aa, Triticum aestivum
  Clone ID: PAT_TA_46250.pep
FIIRRQPWLKISPYESNHNPAFRDVVYCRNRGPGPGISSMIRLYPIHDRSSKHRSRIPTTRKCFIAEAPLPVDRIDFR

SEQ ID NO: 151833 - protein, 158 aa, Triticum aestivum
  Clone ID: PAT_TA_46251.pep
MSPSAITNSPPQQAVQPTTVPIASSLDKVDNTFAVQPPPNFTGYDHITWWVGNAKQAASYYTNLFGFKPIAYKGLETGSRYFASYVIENNGVRFVFTSPLRSEAHFPDDEPISKSDRKLLKEMYAHLERHGDAVKDVAFEVENVEGVYHKAVQEGAVA

SEQ ID NO: 151834 - protein, 199 aa, Triticum aestivum
  unsure (1)..(199): unsure at all Xaa locations
  Clone ID: PAT_TA_46252.pep
RLVLDRSRSRTAXMLESNMRETDDKGQPILGMTIEEVIEECKLFYFAGSETTSVLLTWTMIVLAMHPEWQGRAREEVLGLFAKNKPENDGFSKLKTVTMILYEVLRLYPPAVAFMRKTYKEIEIGSITYPAGVIIELPVLLIHHDPDIWGSDVHEFKPERFADGIAKASKDPGAFLPFGWGPRICIGQNFALLEAKMAL

SEQ ID NO: 151835 - protein, 93 aa, Triticum aestivum
  Clone ID: PAT_TA_46253.pep
MPLGLILSSIGRSMRRKRTSSLNILSSKRAPRDYYKGKNCKPTGFHTRKGGYVMVDAKLPRFVVPDLTDFKLKPYVSQCARDELGASSAENKN

SEQ ID NO: 151836 - protein, 68 aa, Triticum aestivum
  unsure (1)..(68): unsure at all Xaa locations
  Clone ID: PAT_TA_46254.pep
QMNVNNFNKETMNNNVHICASVVSXPQGLVCGSDGSYRLCTTRYHKTGKAAKRLAFAKVIXEQSINCX

SEQ ID NO: 151837 - protein, 160 aa, Triticum aestivum
  unsure (1)..(160): unsure at all Xaa locations
  Clone ID: PAT_TA_46255.pep
PIKRVELXYGPNSXSRGVANVTFHKSDGASKAFQKLNGLLVDNRPIKIEIVVGAAQADKVIPTAKSLAERTSQPKAQAKAQPKSAAADKHNAGAAKGAAKGAANKKRRGRSSRPAKKTQEELDSEMADYFVAPAAEAAGNTAAPATAPAPTADADMDEIA

SEQ ID NO: 151838 - protein, 149 aa, Triticum aestivum
  Clone ID: PAT_TA_46256.pep
MSTIEISESDIARSWVRSLCCTDESRYTVEQIKQKFSTLAGGDQEKINSLLKEAIDTLTQQRIICKSKRLPLSGRPFRLNEAFGHVLGKLAQRTKYKDAADFKTQLDAIFRRGEAYRIPFTLNDGSVMALINLNASERIKLVPVNVPHI

SEQ ID NO: 151839 - protein, 57 aa, Triticum aestivum
  unsure (1)..(57): unsure at all Xaa locations
  Clone ID: PAT_TA_46257.pep
TLPNNGLVHCTHSVTYIYEFFCLHALFFFIFFSFISFLLLFFFFFFFFLFFFFIXPR

SEQ ID NO: 151840 - protein, 97 aa, Triticum aestivum
  unsure (1)..(97): unsure at all Xaa locations
  Clone ID: PAT_TA_46258.pep
CQGGRLIFYDFGMMGSISPNXREGLLEVFYGVYEKDPDKVLQAMVQMGVLVPTGDMTAVRRTAQFFLDSFEERLAAQRKEREMATVEPGFKKQLSKE

SEQ ID NO: 151841 - protein, 122 aa, Triticum aestivum
  unsure (1)..(122): unsure at all Xaa locations
  Clone ID: PAT_TA_46259.pep
PSVGMRLPPWTSPRGAAEXWSPGTPAGFAGSGSHVTPPLSAGFCSYRATPPTSGGGCSRPPRAPPAADSPYVRAKQAQVTRSTTTATVRRDPFPFRFRNPAPCYLVVRAILPSAGEGFGVAN

SEQ ID NO: 151842 - protein, 90 aa, Triticum aestivum
  Clone ID: PAT_TA_46260.pep
MKVRASVKRLCGFCKVVKRRGIVFIHCTSNQKHKQRQGFSTIAACLPAPPPPTSASAAAFAEASKVARQEMSTKFNWPLGLAAMFKNGDK

SEQ ID NO: 151843 - protein, 69 aa, Triticum aestivum
  Clone ID: PAT_TA_46261.pep
HSIWTCRGSVHSKRLLVHTKQPSSSRLAWNGLTRVVIPHFGIPFGGYKTSGIASRVVTVCFGCLHTIQG

SEQ ID NO: 151844 - protein, 48 aa, Triticum aestivum
  unsure (1)..(48): unsure at all Xaa locations
  Clone ID: PAT_TA_46262.pep
DQKNLLYNIMHHQLVANCLQEYSLTSSIKQYNHSTIAXLSTVXYSPKQ

SEQ ID NO: 151845 - protein, 37 aa, Triticum aestivum
  unsure (1)..(37): unsure at all Xaa locations
  Clone ID: PAT_TA_46263.pep
HLIHSLDVSVFVPLIKGWFSXYAYTMVTRRELYKYYM

SEQ ID NO: 151846 - protein, 103 aa, Triticum aestivum
  unsure (1)..(103): unsure at all Xaa locations
  Clone ID: PAT_TA_46264.pep
XXDKKIKAARKELLDLLMAPSTAESLYQDITTNWTKWGYLFGMVPVFYGFKKADFAKIFKGDFSGIDPRVEVVESRACPCGIPWPQKCSRCGRGLPNFVGDSG

SEQ ID NO: 151847 - protein, 146 aa, Triticum aestivum
  unsure (1)..(146): unsure at all Xaa locations
  Clone ID: PAT_TA_46265.pep
DKYPAQEQQPXGIRRRKGWWYFCKLCLSNGRADPVRDRRDQEEPPEGQLPLRLVGRQLPRRQRQQAAPHRLPGAAGRRGRRRRQPPPRPMVGVYPGADRRASLGGAGRRRGRRVGLSLEMNTTQALVPFKSQGTLFYWIGFLHCLP

SEQ ID NO: 151848 - protein, 192 aa, Triticum aestivum
  unsure (1)..(192): unsure at all Xaa locations
  Clone ID: PAT_TA_46266.pep
AFSAXSPRWXFRRRETKAIAVLEQIYDSGRLEEEVELLASASMHEFQSNCTGSYLDIFRLKELRLAFFAGAGLQAFQQFTGINTVMYYSPTIVQMAGFTSNRLALLLSLVVAAMNASGTIVGIYLIDRCGRRRLALTSLAGVVLSLVILATAFILQSSSSLCGSLFSXSCQGVLGWFAVGGLALYIAFFSPG

SEQ ID NO: 151849 - protein, 98 aa, Triticum aestivum
  unsure (1)..(98): unsure at all Xaa locations
  Clone ID: PAT_TA_46267.pep
RQRPRRHGRCTTKPWERAGAEGTSGPSPFKPPSGGSTSDVVEAFLXTAKPGETIAATEGNMSANVNNPISRPMPQRPWQQTGYXKFLMEGTGYGSNMY

SEQ ID NO: 151850 - protein, 86 aa, Triticum aestivum
  Clone ID: PAT_TA_46268.pep
MVTMAGLVAAAAEAVEAALARLVAAEAAQRREHACVEAALLLVAPLHMVCVGHLLPGRSVVHLARLCRGWVGLLGRRSVSKGGALS

SEQ ID NO: 151851 - protein, 167 aa, Triticum aestivum
  Clone ID: PAT_TA_46269.pep
LGLDPTARARVLLVAAVVWFLATTACQAAQPDYATALTKSLLYFEAQRSGRLPPTQRVQWRGDSALKDGADHGVDLTGGYYDSGDNVKFGFPMAFMVTMLSWSVVEHRDRLAAAGELGHTLQAVRWGADYLAKTHAHPDVLYVNVGDGNSDHACWERPEDMDTPPEA

SEQ ID NO: 151852 - protein, 182 aa, Triticum aestivum
  unsure (1)..(182): unsure at all Xaa locations
  Clone ID: PAT_TA_46270.pep
MSPQTETKAGVGFKAGVKDYKLTYYTPEYETKDTDILAAFRVSPQPGVPPEEXGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSA

SEQ ID NO: 151853 - protein, 151 aa, Triticum aestivum
  Clone ID: PAT_TA_46271.pep
MGANGALEGEEERPRADGEEEEEGGATVFRGTNYSLPRTIAALALWLGGIHFNVILILASLFLFPLRLAALVVALQLVFMFTPLNDEDKLGRKIGRFICKYAMGYFPISLHVEDYNAFDSSRAYVFGYEPHSVLPIGVAALANHVGFMPLP

SEQ ID NO: 151854 - protein, 114 aa, Triticum aestivum
  unsure (1)..(114): unsure at all Xaa locations
  Clone ID: PAT_TA_46272.pep
PIVRCTTWEYGWRFNYRKTHFDKCSSPDLYARVGIAGSGCKHXWKDTNVIMDNWIPTWDHQFEFPVFVLELALVHDEEHQXNNHQKDHFCGQTCLPVWELRSGILYVRLYDRHG

SEQ ID NO: 151855 - protein, 136 aa, Triticum aestivum; identical to SEQ ID NO: 117882
  Clone ID: PAT_TA_46273.pep

SEQ ID NO: 151856 - protein, 102 aa, Triticum aestivum
  Clone ID: PAT_TA_46274.pep
THVPTFFKNSNERCAPQQPPPPPPPPPPPMPAPPSPPPPPPPQPPPPPPSPPPPPPPQPPPPSPPPPQPPPPHPPPSPPAHPPPSPSAQPVPSPLQVPPASD

SEQ ID NO: 151857 - protein, 116 aa, Triticum aestivum
  Clone ID: PAT_TA_46275.pep
PGHRSYRCIVRYGYRDVHQDVDSFETELVESLASFIRLDALFRCSDARSDADYERENAFTVIGSNPLRRRISYDDTHDSASSVEIRVDSPTGSSRTNTIQLDAVSRPRACDRVTLL

SEQ ID NO: 151858 - protein, 144 aa, Triticum aestivum
  unsure (1)..(144): unsure at all Xaa locations
  Clone ID: PAT_TA_46276.pep
MAGGKPRGLNAARKLRTNRRXEWADLAYKKRALGTAYKSSPFGGSSHAKGIVLEKVGVEAKQPNSAIRKCVRVQLIKNGKKVTAFVPNDGCLNFVDENDEVLLAGFGRKGKAKGDIPGVRFKVVKVSGVGLLALWKEKKEKPRS

SEQ ID NO: 151859 - protein, 82 aa, Triticum aestivum
  unsure (1)..(82): unsure at all Xaa locations
  Clone ID: PAT_TA_46277.pep
XIVNSSIMDGYFDFLDVNSFSNLPTNLTITCLITTFGPAPSHQGAQPAHRKYTYAAASPGGCKVKWTAEEKPHGAGLXKWEA

SEQ ID NO: 151860 - protein, 197 aa, Triticum aestivum
  Clone ID: PAT_TA_46278.pep
LAVELDTIMDVEFRDINSNHVGIDVNSLISRQAKQAGYYSDENGAFQELRLNSRQPMQVWVDYDAQVRRLNVTLAPVQLPKPKIPLLSELIDLSLIMADKMYVGFSASGGWGVGTHHYVLGWSFSLDGPAPPLDFSKLPVLPRLGPKPQSKILDVVLPLAATLLVIAMLAAIFFFLWHRRRFAEVREDWEDEFGPTV

SEQ ID NO: 151861 - protein, 128 aa, Triticum aestivum
  Clone ID: PAT_TA_46279.pep
PSVRVVVAVAFSLARRSSLYFSLSQRLKKKEEEEAAVDTVVVFSALERPPHERQIFLLQHELHPQLNQYTGGSLIRVRAHTTPRSTLQRPRSASSAHDAHEHVLRGRLQPHRYATSRYSSQQTHARTH

SEQ ID NO: 151862 - protein, 75 aa, Triticum aestivum
  unsure (1)..(75): unsure at all Xaa locations
  Clone ID: PAT_TA_46280.pep
IVCYDEKKKKKKKKKKKKKKPKKKKKKKKKKKKKKKKKKKKKKKKKKKKKKKKXGGXXLKKNKFGGFGKKNFFFW

SEQ ID NO: 151863 - protein, 70 aa, Triticum aestivum
  Clone ID: PAT_TA_46281.pep
REHGTLRERSRTHDSSIESMRGVSNVLLPLDMPNANMYILGGCNIIRLTYWITPDLFCTCPQQTIPKYKK

SEQ ID NO: 151864 - protein, 163 aa, Triticum aestivum
  Clone ID: PAT_TA_46282.pep
HQRQSFFMAPCNNQPRASGAHQLPLKLSTFLLRRAMIASLKEGGAVSSRRGVCHYLPRPHLFHALGWIASTRILLLRSQESTEWNSIPSLNPSSVDGTSRTGCSSPPVAGIDRQSRFPKPRSGLGGQMDRPEVSFPSAPIGIRRVDAGGLDREWMDLTRWLVS

SEQ ID NO: 151865 - protein, 56 aa, Triticum aestivum
  Clone ID: PAT_TA_46283.pep
THHSYDHMKLLLYTSGISYIGSKTRTKETPRAYVNDSAQPRLQTLKHLILASCPAL

SEQ ID NO: 151866 - protein, 154 aa, Triticum aestivum
  unsure (1)..(154): unsure at all Xaa locations
  Clone ID: PAT_TA_46284.pep
NGWPSQNLIGQGRKDMVKLQSSEEYVALGTVESAVATSNYXEHTYWIYADPLNNYCVAMVVPNHHALENWAQNSGINYEGFAKLCQNAXAIREAHHSLSKALQASRLEKFDVPTNIPLLPQPWTQHSALVTEALKLSREHIKAKCKDHLDILYH

SEQ ID NO: 151867 - protein, 63 aa, Triticum aestivum
  Clone ID: PAT_TA_46285.pep
RPPPARGPPPSWRPPRRPLASPAAGGLPSGTRSTYGCLDVSGGHCLWLMQEHGRRGTGWLAEV

SEQ ID NO: 151868 - protein, 98 aa, Triticum aestivum
  Clone ID: PAT_TA_46286.pep
MAGAAAQQQKGGSGGGGGAVRVGGGGPAPFLTKTHQMVEERGTDEVISWSEHGRSFVVWKPVELARDLLPLHFKHCNFSSFVRQLNTYGFRKVVPDRW

SEQ ID NO: 151869 - protein, 89 aa, Triticum aestivum
  Clone ID: PAT_TA_46287.pep
DLPTFRFPARDLEFTKICIQGATELRNVQEQPFVGKVDLQEQKISNVEELMELCAHIEATCMGFLKFNSFRSWMVQEFLQKKKKRAGSD

SEQ ID NO: 151870 - protein, 112 aa, Triticum aestivum
  Clone ID: PAT_TA_46288.pep
TKIPKGYQAIQLFSTLTVPLQSSLVHCKAGQRKITLLLEESTKLNRARRHSFCSRSRILEAKERTGFLCLISVQHTHIQKLLYRFFFSLASSAFGWPNFQQRLSSKSKLVLS

SEQ ID NO: 151871 - protein, 60 aa, Triticum aestivum
  Clone ID: PAT_TA_46289.pep
CTFTCNEWNFTRITVQLVGGNSVRERYSGHYARYLLENIDQFCLLIVLLNIRMKYETCVL

SEQ ID NO: 151872 - protein, 116 aa, Triticum aestivum
  unsure (1)..(116): unsure at all Xaa locations
  Clone ID: PAT_TA_46290.pep
GLDGVXSTHFCHDELRSTHATDVAKEVVGSTVPVLDGEDFSVRVLVDHSIVQSFVMGGRMTATSRAYPTEAIYAAAGVYLFNNATSATITAEKLIVHDMDSSYNRIFTDADLVVLD

SEQ ID NO: 151873 - protein, 105 aa, Triticum aestivum
  Clone ID: PAT_TA_46291.pep
NTSPERFEVAGAGGEIDLKDPDYKLLPFGGGRRGCPGYTFALATVQVSLASLLYHFEWALPAGVRAEDVSVEETFGLATRKKEPLFVAVRKSDVYQFKGEELNEV

SEQ ID NO: 151874 - protein, 127 aa, Triticum aestivum
  Clone ID: PAT_TA_46292.pep
MSDPQAQLQALSEDFQKLQGEMQSAIESRQKLEGQKQENVGVQQEFERLQEGETIYKLSGPVLLKQDKFEAENTVKGRLDYIGSEINRLEDTIKETQGKLERKRTEIIQLQQSAQAAAQGKGKEASK

SEQ ID NO: 151875 - protein, 82 aa, Triticum aestivum
  Clone ID: PAT_TA_46293.pep
VRRQIVLIISALQPSFMHLVDELNGNHVIHKCLSNFGAEENKNPRYDIDFQYKMYVHKDVLVGPYHKRKLVKLVTKFTLDLD

SEQ ID NO: 151876 - protein, 75 aa, Triticum aestivum
  unsure (1)..(75): unsure at all Xaa locations
  Clone ID: PAT_TA_46294.pep
AAHWIPRSIPSMMHSVHSPDVSSASLKQAQPPDPLPGPAYPRRTFPPLVPGSFFRFLFSFFETSTTRDLXPDQPX

SEQ ID NO: 151877 - protein, 98 aa, Triticum aestivum
  Clone ID: PAT_TA_46295.pep
KHIMCAKSLLEAKRIHLQLLHSSHPYVWQHGLVGRANLPDDPENNAPYEFILSGLHLMLMASHTDVSSLKLAPQSNGLHCLVHHYFSRRMLLQMLDTE

SEQ ID NO: 151878 - protein, 174 aa, Triticum aestivum
  unsure (1)..(174): unsure at all Xaa locations
  Clone ID: PAT_TA_46296.pep
MAVGKNKRISKGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVN

SEQ ID NO: 151879 - protein, 193 aa, Triticum aestivum
  unsure (1)..(193): unsure at all Xaa locations
  Clone ID: PAT_TA_46297.pep
LFLFLIRATASVVFPKEALPTKSGYLPIPPANDSSSLYFAFYEATHPLTAPESTPLLVWLEGGPGCSSMLSNFLQLGPYLLDGGNASLTPNPFAWNRRFGLLFLDAPLGTGYSVVPTPAAIPTDQSTIAVHTVAAIQAFLDAQPGFFRARPLFITGESYAGKSVPTAGALILATNPALPQRERINLRGXAXGN

SEQ ID NO: 151880 - protein, 117 aa, Triticum aestivum
  unsure (1)..(117): unsure at all Xaa locations
  Clone ID: PAT_TA_46298.pep
TLLFMYKXNTYSRQISDMLDAALREAISERVRAVETCSTYDLRINNTIKERDEAKASVTRLDADLKEISQRRMNLQRSGEQTFQCSIRMSINARDEDGHLFGDLTIPLEAIAREQDG

SEQ ID NO: 151881 - protein, 195 aa, Triticum aestivum
  unsure (1)..(195): unsure at all Xaa locations
  Clone ID: PAT_TA_46299.pep
GRVGIVEGRSLAYLEEVGYNPXKVPFPPISGFQGDNMIERSTNLXWYKGPTLLEALDQINEPKRPXYKPLRLPLQDVYKIGGIXGTEPVGRVETGVIKPAVVVTFGPTGLTTEVKSVEMHHESLLKALAGDNVGFNVKNVAEKDLKRGCGAYNSIDDPANEACNFTSTVIIMNHPDQIGNGYTPVLDCHTLHIAG

SEQ ID NO: 151882 - protein, 117 aa, Triticum aestivum
  unsure (1)..(117): unsure at all Xaa locations
  Clone ID: PAT_TA_46300.pep
VRPSVRLEETPSPAATQTNPLKAXKHRAGYHGRRPRPGHRVLRLGLGVPHRAGDMIRLRLLLETSPPCSFHTYSKIISPTWSPSDLLCEKPGEDGRPGGKTPDRWKKKQPRTPPGGR

SEQ ID NO: 151883 - protein, 75 aa, Triticum aestivum
  Clone ID: PAT_TA_46301.pep
CSHDRPWCGRSFTRGGFFPPRSPREQNHWLVWCKTQTIFFLDRKPRSFSFVLNLQNALPGKCKLKEVNSAYEDLF

SEQ ID NO: 151884 - protein, 104 aa, Triticum aestivum
  unsure (1)..(104): unsure at all Xaa locations
  Clone ID: PAT_TA_46302.pep
ISLENCWNLAAAGLAVLSTVFGKKILPTFLPFDSAKLARPDDESWXVYWEAAVLSIGAIVIGSITGLYPHLLQMVRPPSPHFFLKRKLFLGAFLVQNPPPPPPY

SEQ ID NO: 151885 - protein, 156 aa, Triticum aestivum
  Clone ID: PAT_TA_46303.pep
MGASAAFFYLLLPLWVQDAAAAGLGFTRSDFPRRFVFGTGTSAYQYEGAVAEDGRSSSSWDTFTHAGKMPDKSTADVAADGYHKYMDDVKLMSETGLEAYRFSISWSRLIPNGRGAINPKGLEYYNNLIDELVNHGIQIHITLHHLDLPQILEDEY

SEQ ID NO: 151886 - protein, 90 aa, Triticum aestivum
  unsure (1)..(90): unsure at all Xaa locations
  Clone ID: PAT_TA_46304.pep
PYGPRRRRWPRRRRSNAARCTGCSRGPSLACRRWGPTTVTDLVTRLSRRCGDACTRSAASQRSPTSTARRSCALEKSARDXGERHSPAPC

SEQ ID NO: 151887 - protein, 123 aa, Triticum aestivum
  unsure (1)..(123): unsure at all Xaa locations
  Clone ID: PAT_TA_46305.pep
STVSIVAFPFQAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARXIRGERA

SEQ ID NO: 151888 - protein, 132 aa, Triticum aestivum
  unsure (1)..(132): unsure at all Xaa locations
  Clone ID: PAT_TA_46306.pep
SFLTTRLXGGCFVLSANQFCRRQDYPPPSEYAFAGLGEEPSPDTVVCPGGSVIISPSGEVLAGPNYDGEALITADLDMGEIVRAKFDFDVVGHYSRPEVLSLVVDDQPHRPVSFTSAAEKAPAAKSDGTAKP

SEQ ID NO: 151889 - protein, 79 aa, Triticum aestivum
  Clone ID: PAT_TA_46307.pep
YITIKMASYAGDGSGGRRHPLHAQHGPRAPPQALGRDGAPRRGASSRNPARSSDSSPAVPSRPAITGSRSSYAPAPSAA

SEQ ID NO: 151890 - protein, 169 aa, Triticum aestivum
  Clone ID: PAT_TA_46308.pep
MCGGASLADVKVPTVTWKVTKAALCPKKKKPRHGSNGGRCFTGLGGCMGPDVDDNEEDFEAELEVFEVNFGDSDVELGRTRVDEKDDDNEVVEINSFAAAKSSLSQGFDGPSAKRKRKSQFRGIRQRPWGKWAAEIRDPSKGARVWLGTFNSAEEAARAYDVEARRIRG

SEQ ID NO: 151891 - protein, 74 aa, Triticum aestivum
  Clone ID: PAT_TA_46309.pep
FQVKTQAHVDAHSGVLLNHFGLTEARYYTVLFGVSRSIGIGSQLIWDRALGLPLERPKSVTMEWLENHCKKVAA

SEQ ID NO: 151892 - protein, 180 aa, Triticum aestivum
  Clone ID: PAT_TA_46310.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTL

SEQ ID NO: 151893 - protein, 102 aa, Triticum aestivum
  unsure (1)..(102): unsure at all Xaa locations
  Clone ID: PAT_TA_46311.pep
XAWVALVLFCFTWCNCXVDIVRPSMMYRSPLSRLRLKQQPAARKGNQCELPPWTVSRGSYITRKPSMPDAALRSSSILFVMDACMHHELPYYYLYVPSMQCL

SEQ ID NO: 151894 - protein, 84 aa, Triticum aestivum
  Clone ID: PAT_TA_46312.pep
MLGGRNNGPSTTSKARADGAGLAGASTVVADGGQAEVAASQFVVQLDEAARERLERMNRRLSLLEQQMEMLEAEVGRASSTADD

SEQ ID NO: 151895 - protein, 182 aa, Triticum aestivum
  unsure (1)..(182): unsure at all Xaa locations
  Clone ID: PAT_TA_46313.pep
MPVFQXLIKPINEALMAVTELKDSNRPSPLITQLSTVSEGIMVLAWVTVDARPFKHVDECLGAAQFFGNRVLKEYKEKDPKQIEWVQSFYQVFRDLSDYVKQYFSTGIPWNPQGQSVQEVLQSLSGAPAPSAAPAPSAGGAPPPPPPPGPPPVLDIKTQEAPAAAPSGGLGAVFSELNRVTL

SEQ ID NO: 151896 - protein, 124 aa, Triticum aestivum
  Clone ID: PAT_TA_46314.pep
TIKFKLITAAAQLLLTCGVSSSLRHRDSYSERELLLPNGVPFDIIQDRATHHEIKLSKASRLATLLIVLHDLDSRSPIPGYSLVDIYQHFKNPGNQWISHLQDKVQPYNNKPDSADTQGNDSRW

SEQ ID NO: 151897 - protein, 109 aa, Triticum aestivum
  Clone ID: PAT_TA_46315.pep
MAQRDKKVEEPTEVHLHAAASPAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 151898 - protein, 102 aa, Triticum aestivum
  Clone ID: PAT_TA_46316.pep
LQTLEAHIKCMLRNLHRGRKPNRDGDPSARQPLLKQLLHDEQDKHGVLDMEHQLPSPTRPFSPDISLSLPLSETDTRTHTQHKNRTAGHQAAPHVPLPSPTG

SEQ ID NO: 151899 - protein, 129 aa, Triticum aestivum
  unsure (1)..(129): unsure at all Xaa locations
  Clone ID: PAT_TA_46317.pep
MEVEAARCECCGLHGMSARRXYIAAVRAEYMGRWVCGLCAAAAGRPDPPRGRPEPARHHHGRGAQPARRVRAGRRRARPGRRRSESSRTTSLACSGSASTRRPCPPPLRMGSRWPMSPPARTPKMIDQG

SEQ ID NO: 151900 - protein, 64 aa, Triticum aestivum
  unsure (1)..(64): unsure at all Xaa locations
  Clone ID: PAT_TA_46318.pep
LLYNSMFPRXHNERMDRTXVDVAREVAKMEVPLSRHHLDDAAALSRYDDNNDDDFPLKSAYFRM

SEQ ID NO: 151901 - protein, 109 aa, Triticum aestivum
  unsure (1)..(109): unsure at all Xaa locations
  Clone ID: PAT_TA_46319.pep
ARXLANKASEFCRRSSRLAASYRVHGDREVPDDARLLRGAPRRLRHHRGDQAAGLRRGDEACAKQGRCTGAGVVRQVNGGAACWVRARLRRPPLLRHRRHALIKHALVD

SEQ ID NO: 151902 - protein, 166 aa, Triticum aestivum
  Clone ID: PAT_TA_46320.pep
VFVPRRLQRRRKNGTCERPPRNQTLGLGAKLAIGASVGILVALVGFLGVEVIRHKRSIKRQALNRQSDEYFKQHGGEILAEMTRDGHGRSIPFAVYTREEIEAATGSFNKANIVGEGGQGTVYKAVLRGAAVAVKRCKEVDESRTKDFVQELVILCRVDHPNIVKL

SEQ ID NO: 151903 - protein, 197 aa, Triticum aestivum
  Clone ID: PAT_TA_46321.pep
LSRPPVSAHLLRLRRRRTHRGSSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHFLRQRHWY

SEQ ID NO: 151904 - protein, 173 aa, Triticum aestivum
  Clone ID: PAT_TA_46322.pep
MAENGGREPQMMHHLHQRQSSRGLFSPEVVDLVLPPLKFGGYAGTAGVLAGVGGSIFKEANPIIWGAVSGFQWFTLGTSFWFTRGIVLKAWGGEERLKNSEKTMASAISGTAAGAVGGLIRGPKNILPAMFVWTTVGAVGQIIANRMAVRKPKVDDEKEGFLTRWDSAQEAHR

SEQ ID NO: 151905 - protein, 202 aa, Triticum aestivum
  Clone ID: PAT_TA_46323.pep
WYVYIWHPLVPFIMLLMVGSKMEHIITELAYEVAQKHTAIRGDLVVSPSDNFFWFHRPKLVLLLIHIVLFQNAFEIAFFFWLLVTYGFKSCIMGKPAYVITRVVIRYNRYHSSSNIILRHLENILITFTYFSVICQVLCGYSTLPLYAVVSHMGNSFKKTIFDENVTEGLVNWAEKARRGTRTPNKITTDASSSPIDEANGG

SEQ ID NO: 151906 - protein, 136 aa, Triticum aestivum
  unsure (1)..(136): unsure at all Xaa locations
  Clone ID: PAT_TA_46324.pep
MAATADPTAKTPATQPHRLKPWGPPQPPRGHCVPSLSSVSGGAGAIRDRRRSSTSHRRGGADAVDEGPYDDGLEDLRAKLMGHVHEAADRLRLPPATPQRSPEPEPPAAPLPPPPQDAAAVVAASMPXTLRERKRR

SEQ ID NO: 151907 - protein, 71 aa, Triticum aestivum
  unsure (1)..(71): unsure at all Xaa locations
  Clone ID: PAT_TA_46325.pep
HHYFPLPPPXHPPTTSHQAADLPSPPPLPPTPQLRQPFVSRYGRASPPLPFPSPGDPPSQIPPARGPRTPL

SEQ ID NO: 151908 - protein, 119 aa, Triticum aestivum
  unsure (1)..(119): unsure at all Xaa locations
  Clone ID: PAT_TA_46326.pep
MVHAATAECFSSVFASFDRDPNDRISAAELRLCMKAALGEDVSAEDAKALVASADANGDRLLDEQEFLRLVVRSEMEEEEEERCXGLKEAFAMYEXPACLMRMLARLGSEQGMEECCAM

SEQ ID NO: 151909 - protein, 193 aa, Triticum aestivum
  Clone ID: PAT_TA_46327.pep
GLGSERTSITDIDKDFHSNQPRVIDTKEPERRNLVARQELTLPVLGGPRPKQVDASAFLFAVSTTYDRVVRDDYAVAKDWARWMTGGNKNGNGASFLLVLDQGHHQQADKLNQVLASYGIDAHVTYSEGQMSTAKRYFNMIETVKKHSATLAQKGQMKQWYGILDEDIFLPNLSHLQQRLFAFNSERNSTSAY

SEQ ID NO: 151910 - protein, 97 aa, Triticum aestivum
  unsure (1)..(97): unsure at all Xaa locations
  Clone ID: PAT_TA_46328.pep
FRANNAPVPRRLASIYSEVQTSRIAHTLPLPSVLRSHFTLADEPASTAARSPDEIAKLFSSLHGRXSTAVLPSAEPVATKPLKIGIVLPGGQVPGGQ

SEQ ID NO: 151911 - protein, 57 aa, Triticum aestivum
  Clone ID: PAT_TA_46329.pep
EVVSTDYPKYTQNTLTAAKVSTKTNICRFNLVIATQQRDRTETAATIHGGQKETRLR

SEQ ID NO: 151912 - protein, 83 aa, Triticum aestivum
  unsure (1)..(83): unsure at all Xaa locations
  Clone ID: PAT_TA_46330.pep
IILVVVGMXXIGKLDGHDLEIGTFRASCSQLYTALVCVAVPLGLIASPFSTLLWLIGASGVTILGHAAFLDKPIDEAFSGEAV

SEQ ID NO: 151913 - protein, 196 aa, Triticum aestivum
  unsure (1)..(196): unsure at all Xaa locations
  Clone ID: PAT_TA_46331.pep
FYSCHLPVTXYDQALDSESLNPGEXGEIVRRVLLKLSLQSGIFGEIDHTKLKTHFHLRTPHISAMHHDDTPNLKIVEEKLEEILEIASTSLETRKMVVEICDIVARRAARLAAAGLAGILKKLGRDGCVDKHRSVIAIDGGLFEHYAKFSKCLEATLYELLGEQSSKSVVIKHADDGSGIGAALIAASQSQCRNVE

SEQ ID NO: 151914 - protein, 143 aa, Triticum aestivum
  Clone ID: PAT_TA_46332.pep
MARFQETKPDLLNSGSDTRMMAEARLPKARKPYMITKQREKWTEEEHKLFLEAMQLHGRAWRRIQEHIGTKTAVQIRSHAQKFFSKVTRDSSGDSGGSSSGAGPPIQIPPPRPKRKSVHPYPCNLRSAQPGKHAHAALLRVDK

SEQ ID NO: 151915 - protein, 148 aa, Triticum aestivum
  unsure (1)..(148): unsure at all Xaa locations
  Clone ID: PAT_TA_46333.pep
MAAIMAARGQRQVQDFDFFVVVDFEATCVKDARIFPQEIIEFPAVLVDGATGRIESAFXQEDVDGGVELGEALWMHDSWLKAATAGAGSLAVVTWGDWDCRTMLESECRFKGIEKPSYFDRWINLRVPFQAALGGGGRVTLQEAVRAA

SEQ ID NO: 151916 - protein, 144 aa, Triticum aestivum
  Clone ID: PAT_TA_46334.pep
MNQQLPANLVQIMEQRMKSIEQKSAYLQEKINQPAASPEEYSRANKEFHKLESTMELIKELRSKQKEIEGLTALVTNSVEEKDMREMAAEELLEAVEEEKQLQHELFRTLLPKDEADERDCILEVRAGTGGERTSLFAMDIFKM

SEQ ID NO: 151917 - protein, 73 aa, Triticum aestivum
  Clone ID: PAT_TA_46335.pep
HIYYNHLNLPGDTNRICNDVQLMKCHYSEHLYCRKDKKINGVDRIKSTGYYRTSNYNITNDSAGLMWLLPPEF

SEQ ID NO: 151918 - protein, 138 aa, Triticum aestivum
  unsure (1)..(138): unsure at all Xaa locations
  Clone ID: PAT_TA_46336.pep
AVQVCQSLXCPAGYDVFDKLEKXQKMAQWSRADRKLTFDMVNSILSEILAPCLDMHPWATTARNMAPAWGSEGLLEKLLQVLTRRREELAPRVHKKEKQVLNQKWPDLADYIDRAGRDVERMIKDDLLEELVLELMSS

SEQ ID NO: 151919 - protein, 127 aa, Triticum aestivum
  Clone ID: PAT_TA_46337.pep
MGERVKGTVKWFNVTKGFGFISPEDGSEDLFVHQSAIKSDGYRSLNENDTVEFEVITGDDGRTKASDVTAPGGGALSGGSRPGDGGGDRGGRGGYGGGGYGGGGGGGGCFSCGESGHFSRECPNKAH

SEQ ID NO: 151920 - protein, 122 aa, Triticum aestivum
  Clone ID: PAT_TA_46338.pep
SFLWLINLQRKWPIAYLLAGDRYLKPFLIPKPEVSIVARAKDDDCLILASDGLWDVMSNEDACKVARRQILLWYKNNNDGANSDGGSEPTMNPAAKAAADCLVRLALSKGSGDNISVIVIDL

SEQ ID NO: 151921 - protein, 175 aa, Triticum aestivum
  Clone ID: PAT_TA_46339.pep
SKKRNITPTVSPLSPSPPDPSRQEAPHPVRRSIRCRAVHRPVPGSTSAHLRMGMRLEELAARLATKDPGVVGGPGGGGGRGVGELLYLRLGIVSGPSGRWPSPANKENWVSVVRRRARFCTTVPRSCHENQQATLEIKTSREREQKESPKREGAKKMEQSPPSEHHHHRCPSFYG

SEQ ID NO: 151922 - protein, 108 aa, Triticum aestivum
  Clone ID: PAT_TA_46340.pep
MLPQISRIGRRILGQGKGGCREVWAGPLSGNRLAVALWNRCSETVNITMSLPAVGLDGSSAYSVRDLWKHETLSANVVGTFGAQVAVHDCKMYFFNHQLAEKPTVGVK

SEQ ID NO: 151923 - protein, 107 aa, Triticum aestivum
  Clone ID: PAT_TA_46341.pep
QSDRLPDPASMEFLMQNSARGQREQHPHESSSVPCEDASGRCVADAQICAAEAAPVAGSGDKRQGSENSIEHVDPKTPGWIKGTHSWIEPTYVLVRCAKTGSEARKM

SEQ ID NO: 151924 - protein, 51 aa, Triticum aestivum
  Clone ID: PAT_TA_46342.pep
MQKRHPRIYDFYMRAHAGMMGTTMTTHYHMLDDEIHFDAYDLYDLGHYLSY

SEQ ID NO: 151925 - protein, 58 aa, Triticum aestivum
  Clone ID: PAT_TA_46343.pep
EVRSVVFVLMARQLNTLFQCKFACSTWPAIQIASNLYPPTSVANIFGLGGQFSKGTKR

SEQ ID NO: 151926 - protein, 66 aa, Triticum aestivum
  Clone ID: PAT_TA_46344.pep
DLLFENTSFIGDGVQSRNTIYNAFVFYESIVSSFHCLLHDPQFIPAMSSSWLSDFVGYKEVNSLVL

SEQ ID NO: 151927 - protein, 130 aa, Triticum aestivum
  Clone ID: PAT_TA_46345.pep
QFYKLQNRTTYPDFVSSTNRAGPHRAYPHLVYIPINAEPTESEGGTLASPVQNSILHFQQGLRDQLKKNTGCATRWSATNAARSPGRGAASMSLPSTKTSRKESTAPARRGRVLTQKGRPRTPKKVTAFA

SEQ ID NO: 151928 - protein, 136 aa, Triticum aestivum
  Clone ID: PAT_TA_46346.pep
PSSTCQCRPLLGNDKLYSSKQPPPPPWAPSSRGEGTVKTLSGEVRRARAPSASVESGRRSSSWHACRAVTQRDMPAEVAGDHQLQVYSAEPCGGGGERGTRRPSSGWAACSPMENNRTTLAENGPVRLGPGPYLVG

SEQ ID NO: 151929 - protein, 77 aa, Triticum aestivum
  Clone ID: PAT_TA_46347.pep
PSVRGSVGGRVGRPVDKGLVLDVVIAFDMEMSFRARNSDGLRRSYARSTLGKGSRGCAHSDCRSDSPDCQILKTLQG

SEQ ID NO: 151930 - protein, 195 aa, Triticum aestivum
  unsure (1)..(195): unsure at all Xaa locations
  Clone ID: PAT_TA_46348.pep
PASGLXTLVLAYRQLEEIEYAKFERKFTAAKNSVSADRDELIDEAADLIERDLILLGATAVEDKLQKGVPDCIDKLAKAGIKIWVLTGDKMETAINIGYACSLLRQGMKQITITLDTPDIIALEKGGDKGAINKASKVSVVQQISEGKKLINASGNESFALIIDGKSLTYALKDDAQAAFLDLTIACGSVICCRS

SEQ ID NO: 151931 - protein, 123 aa, Triticum aestivum
  Clone ID: PAT_TA_46349.pep
TVRFVSHLKKKRGQSPTQPLVLIRLRSSSSTLAVLPHGRATCALRPPHDPCLPSVCLCRRARGRCRRARPPHGCRGHTLHHQCAVAALPPPPSPVPANRLHGHRFPISPSLLVAPAIEGCSIR

SEQ ID NO: 151932 - protein, 179 aa, Triticum aestivum
  unsure (1)..(179): unsure at all Xaa locations
  Clone ID: PAT_TA_46350.pep
RGEEAMRRLRQAVDGLEVGVLVNNAGVATPHATYLHEADAEAWVRMIRVNLWAVTEVTAAVLPGMVERXRGAVVNIGSGAAEALPSYPLYSVYAATKRYVAQLSRSLHVEYRVKGIDVQCQAPLYVDTKMVTNMVTRGGLLSWLIFPTSDAYAGAAARWIGHRRPVCMPXLGHRLQWCL

SEQ ID NO: 151933 - protein, 177 aa, Triticum aestivum
  Clone ID: PAT_TA_46351.pep
MITNTRPTPNGYAKPQWRPCRYRIGRRSPQKAFPGDQQPPLRLKDRVVRVTWQWFPCTMSTGGLANLLGEQPYTFTGLQTIGKVVFILNLVLFVTFTCLMIARFCIKPRAFATSLHHPSESFFFGSFWVSIALILNGAQSYGGPATGEWFVTAMRVVFWIYYACEMIVAVTQYHIIF

SEQ ID NO: 151934 - protein, 45 aa, Triticum aestivum
  unsure (1)..(45): unsure at all Xaa locations
  Clone ID: PAT_TA_46352.pep
XTAEVWNSRACMMGLIGTFIVELILNKGVLEIIGFEVGKGLDIPL

SEQ ID NO: 151935 - protein, 157 aa, Triticum aestivum
  unsure (1)..(157): unsure at all Xaa locations
  Clone ID: PAT_TA_46353.pep
MTDRGDGPIGSLPEHLLVEILARLPTHEWVQISCVSKHWASMFRGEYLWQTAIARKWPSAGFRKRWPGPIXEALLGDQFIACGRTGEKAHELASNIWIAVIDNLEENQQTFMLLKHLAQEGDFFLPFPYSRSYKVLWRVFDKLFTDFRDCFNGADYH

SEQ ID NO: 151936 - protein, 182 aa, Triticum aestivum
  Clone ID: PAT_TA_46354.pep
MKSVLDWPTRLGIIKGVARGLLYLHQDSRLTVIHRDLKASNVLLDAEMRPKIADFGMAKIFGDNQVKADTKRVVGTYGYIAPEYLTAGVFSVKSDVYSFGVLLLEIVSGVRISSSDGIMEFPSLIAFAWSLWREGKARDLVDPSMAGSCSTDEALLCIHVGLLCVEDEPSRRPLMSSVVSIF

SEQ ID NO: 151937 - protein, 84 aa, Triticum aestivum
  Clone ID: PAT_TA_46355.pep
AGPGCVGAADERSRDVHRALRVCALPEREGLHRCVHAPAALRGQMPLHLFRHGLLGRLRPWRLRLHATAPSVRQHGSASAEASS

SEQ ID NO: 151938 - protein, 190 aa, Triticum aestivum
  Clone ID: PAT_TA_46356.pep
PASATTTGEESGGEEVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIAR

SEQ ID NO: 151939 - protein, 43 aa, Triticum aestivum
  Clone ID: PAT_TA_46357.pep
FFTKEAEPSMDSFPLPKIKSSLKCHALQKIKIFSHEEENSTCH

SEQ ID NO: 151940 - protein, 166 aa, Triticum aestivum
  Clone ID: PAT_TA_46358.pep
PSLAPPFAVAVAAVSSSSPLFSSSSSRPILRRHPLLRSISVRPRHRSAVASAAATESAGKLLLEVHGLTASVKENGQQILKGVDLTIREGEVHAIMGKNGSGKSTLTKVLVGHPHYEVTGGTILFKGENLIDMEPEERSLAGLFMSFQAPIEIPGVSNYDFLLMAI

SEQ ID NO: 151941 - protein, 127 aa, Triticum aestivum
  Clone ID: PAT_TA_46359.pep
MSEQGAGQGTKEQSPAELELELETDHPALPPPLARGGSASEVLAILPSYTGKTVLELGAGVGLFTGELAKEASHVIALEFIDNMIKKNEEINGHIHKNITFMCADVTSPELKIDDNFIYLVFSKWLL

SEQ ID NO: 151942 - protein, 49 aa, Triticum aestivum
  Clone ID: PAT_TA_46360.pep
CIMMFLKINDKPSSKTTLSPFLQHSPNDNPIDTKKINYCSVSSITRHYQ

SEQ ID NO: 151943 - protein, 132 aa, Triticum aestivum
  Clone ID: PAT_TA_46361.pep
IGPNLGAIFFYFWYMLMHPHHMRSSRGYQPRSLNLAWGGGEGGPSEVLMVPEAWGGGEAGLSEVFLVARAWGGGEGGLSEVLLVARAWGGREGSLSEVFLLGRSLGRQRRQSLQSFSGGLSLGRQRSRPRGR

SEQ ID NO: 151944 - protein, 88 aa, Triticum aestivum
  Clone ID: PAT_TA_46362.pep
RKLTTLHHETTDVFRMVPHLFFYFFGFSLLGIFFARSMLTLEPPICQKNVRVVVINKGDRCTEPIYDQIRFSTWESIGSSPCISTDYS

SEQ ID NO: 151945 - protein, 202 aa, Triticum aestivum
  Clone ID: PAT_TA_46363.pep
QTLSTLLSFLTQMPCVRLIVVVGGDNANTPSTTAAAGVEIITYSRLHSQGKMSSQTYRPPKPEDVATICYTSGTTGTPKGAVLSHENLIANVAGSSLGVKFYPSDVYISYLPLAHIYERANQIALLHYGVAIGFYQGDNLKLMDDLAALRPTVFASVPRLYNRIYSAITNAVKDSGGLKERLFRTAYNAKRQALMNGRNPSP

SEQ ID NO: 151946 - protein, 97 aa, Triticum aestivum
  Clone ID: PAT_TA_46364.pep
PGGFEVYFPRECEFLLAKQWLVRYDARIAGAVTAGRLAALEGVHVKVLFLWLPVAEVDRAGDRLSFYVGPVSTSFPLSSFASSPHCRGYDAVAAAVS

SEQ ID NO: 151947 - protein, 151 aa, Triticum aestivum
  Clone ID: PAT_TA_46365.pep
ASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 151948 - protein, 74 aa, Triticum aestivum
  unsure (1)..(74): unsure at all Xaa locations
  Clone ID: PAT_TA_46366.pep
SGRDSLEVHYGKNXRRWRLSDQSVGEVSRKPSRAGIPRGRGRKWHTSLTTRLKRTTVCFKKEAHCKKRGGTWHV

SEQ ID NO: 151949 - protein, 62 aa, Triticum aestivum
  unsure (1)..(62): unsure at all Xaa locations
  Clone ID: PAT_TA_46367.pep
LYIFITSSARLEAFLSVLPKAPYHTPVSVQTRKQKQNQSTLIXMALXXXNXIVVSPTITITP

SEQ ID NO: 151950 - protein, 71 aa, Triticum aestivum
  Clone ID: PAT_TA_46368.pep
QPLFIYFVRINIIDFLSPFESPPRHIHPSVCYVPSSPIGRVWRPLAVLMLRRQPYRGRQRISFPGGLGGCY

SEQ ID NO: 151951 - protein, 174 aa, Triticum aestivum
  unsure (1)..(174): unsure at all Xaa locations
  Clone ID: PAT_TA_46369.pep
GRVGFAISLQFIINQTSLVKDLRSAGLTVYAQVFRNEFLSQPWDFFXGXQXEINSYAQSLKVDGLITDFPKTVRRYKRNSCTGKDKPAYMETVDVGGLVQLLQRNAAPEAQPPAVAPMPELNETEVQQPPFPPVAPKNAPPGAAAPPGSSPSDAHTTAVSTCILLVAACAALLL

SEQ ID NO: 151952 - protein, 178 aa, Triticum aestivum
  unsure (1)..(178): unsure at all Xaa locations
  Clone ID: PAT_TA_46370.pep
SLQGVVTYAAIQRSVLFRLLVYGSAGQLKAMNQVXGSLNLFLAQYREVAAFTQFGSDLDASTNQTLNRGERASXKQARKKFEIQHTDYFTXLPELLKPKQHMPMGATEMVPLIFAGANGFLNTIXVNKILXWECDLLAHLKTNHTELLATIDKDGALSKDTDAKLNDVVHSFVKSFLC

SEQ ID NO: 151953 - protein, 96 aa, Triticum aestivum
  Clone ID: PAT_TA_46371.pep
CEYTKKKQAFSQEGSLYKPQCDEELKPKVGMLFDDIGSVMEFYKTYAHHVGFGVRLGQQKIVDNVLLWKRFLCAKEGFRPEKGLTSPSTRLISKRH

SEQ ID NO: 151954 - protein, 106 aa, Triticum aestivum
  unsure (1)..(106): unsure at all Xaa locations
  Clone ID: PAT_TA_46372.pep
AVESPKERSQATVAGFCPGXRHVSRCAHVYTSTIDASTTQHQVPHRRRQGFRQPSWNSRSTSHHVQIGLTTKLVREFNRAGQFAQIICTASPLKIHNLDLRCFCQI

SEQ ID NO: 151955 - protein, 122 aa, Triticum aestivum
  Clone ID: PAT_TA_46373.pep
RKTRLLAVVYNSSNNELVRTQTLVKNAIVQVDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 151956 - protein, 67 aa, Triticum aestivum
  Clone ID: PAT_TA_46374.pep
DAMRLFGSGPHLSSLALEAANPALERLMWHTMNIMVDGIMTIRWSGTRRCWIDHYQMLTNTKHHNNI

SEQ ID NO: 151957 - protein, 197 aa, Triticum aestivum
  unsure (1)..(197): unsure at all Xaa locations
  Clone ID: PAT_TA_46375.pep
GRVGGRVGHGVFNECNWRNKXKILGVMMNWLEWVLSQSLLRIAECNPYGMDDFWLQQGTSMLLSLVKSSQEDVQERAATTIATFVVIDDETANVDAARSEAVMRDGGIPLLLDLARCSRVSAQSEAAKAIANLSVNAKVAKVVADEGGIAIFTNLAKSTNRLVAEEAAGGLWNLSVGEEHKAAIAAAGGIKALVDLI

SEQ ID NO: 151958 - protein, 199 aa, Triticum aestivum
  Clone ID: PAT_TA_46376.pep
LCGGRRGDHANGGHSGPTPENSSVTFGDDEADNGLQLSDGAEPVTKRRKEHADNEGSSGGTGGCGKPVREPRLVVQTLSDIDILDDGFRWRKYGQKVVKGNPNPRSYYKCTTVGCPVRKHVERASHDNRAVITTYEGKHSHDVPVGRGRALPATSSSDSSGVIWPAAVPAPYTLEMLTNPAAGHRGYAAGGAFQRTKDE

SEQ ID NO: 151959 - protein, 85 aa, Triticum aestivum
  Clone ID: PAT_TA_46377.pep
NLASQKGSIIFFPPPGGGHYTYYFPMVGKPHPQAKRLGLRGKNGPPWGEVPTFYEKEPFGYWPRANFLGALYFFSFFGTSKVWKK

SEQ ID NO: 151960 - protein, 41 aa, Triticum aestivum
  Clone ID: PAT_TA_46378.pep
NDQPDGYAFNIILQNIANRTQILAIHINRRRNPRTSFNTGG

SEQ ID NO: 151961 - protein, 67 aa, Triticum aestivum
  Clone ID: PAT_TA_46379.pep
QKGLGGGGGTRPTDRLKDNKGGFFLGGPGLINPGRGDPGAGGQKHHGAGGHTRLRTGWPGDGGGATL

SEQ ID NO: 151962 - protein, 178 aa, Triticum aestivum
  Clone ID: PAT_TA_46380.pep
DDFKGLVYAGSCDTESSLTLSNVTGKIVLCYQPAAANSMPPPQALPIAINLTIMAGAKGLIFAQYTTNLLDFLPLCKGVMPCVVVDFEIAHRIVSYWRSDKGNAVVKVSPAMTVVGKGVLSPRVASFSSRGPSMLFPSILKPDIAAPGVSILAAERNSYVFKSGTSMACPHVSAVTAL

SEQ ID NO: 151963 - protein, 55 aa, Triticum aestivum
  Clone ID: PAT_TA_46381.pep
ARAKESLNVETAFFTLFSEIKNKMGSPPSAERKLTVHVSIKGQPLQHQSSSFCSL

SEQ ID NO: 151964 - protein, 80 aa, Triticum aestivum
  unsure (1)..(80): unsure at all Xaa locations
  Clone ID: PAT_TA_46382.pep
TPPCFKGPAWFPPRKKGPKGGGFSQVVSNPVDIKPRDSLXGLKKTRTPRGLGPHWGGGVRGYPPKTPGRKEKPFGFSKKK

SEQ ID NO: 151965 - protein, 76 aa, Triticum aestivum
  Clone ID: PAT_TA_46383.pep
RCKKRKEIDGPQYSCPGTMNKGYLFMKCMVLPSWRCRLAPADLSSCLEVRADNHGEVISVVAIDRGRGEDDWNFLG

SEQ ID NO: 151966 - protein, 115 aa, Triticum aestivum
  Clone ID: PAT_TA_46384.pep
TSTTNYRSSLPMIIKISDNDYPLGGYEGALKGGSNATEVSQNIHAYHRIRVASAHNAFGYLLETRRLIFATNEFLPATTPTTTRRPHHLDVLYELKRQQRTLIPICRLGHHHHSD

SEQ ID NO: 151967 - protein, 206 aa, Triticum aestivum
  unsure (1)..(206): unsure at all Xaa locations
  Clone ID: PAT_TA_46385.pep
DGGCSNLGFLNLSSSSLNVLWLSDLCSLSESVISCPNMSELSLCFTQQSTECTDLXGANLRGLCMLSLILGSKMTDAAVASIVRSCASLALLDLSGSSISDSGVGMICKAFPHTLSRLLLALCPNITTCGIQAATAQLPLLQLMDCGMSLRSNLQNEKQGAYFGEINGRIRLCPKLPTLKKQPMRQKLIIKHDNLKKLSLXWGCSA

SEQ ID NO: 151968 - protein, 57 aa, Triticum aestivum
  Clone ID: PAT_TA_46386.pep
MLHIIGTFKLTLQFTEDYPNKPPTVRFVSRMFHPNIYADGSICLDILQNQWSPIYDV

SEQ ID NO: 151969 - protein, 162 aa, Triticum aestivum
  unsure (1)..(162): unsure at all Xaa locations
  Clone ID: PAT_TA_46387.pep
MVASLWFFFWLASLGALQVFALSIRLLANLVLFLRRPKDLRCTYGAWAVVTGPTSGIGHAMSLELARSGLNLVLVGRDPTRLREISETISRTYAMQTKTVLFDFSLVSTAQGDEAMSRLREAVAGLNVGVLVNNAGVAKPGAVYLHEVDVXAWVRMIRVNVL

SEQ ID NO: 151970 - protein, 188 aa, Triticum aestivum
  unsure (1)..(188): unsure at all Xaa locations
  Clone ID: PAT_TA_46388.pep
MRHPSPPPELPAAGGEIQAMAPASAAGSSSTGGSFTALLGLPTSQAIELLLPGAAPAPAPAPAFPSDPHLVDRAARFSAFASPSPSPTPPPAASSAKRKADPASKGKVAKKGKTTAGGGEEKDSGEDEKPAYVHVRARRGQATDSHSLAERARREKINARMELLKELVPGCSKVSGTALVLXEIINHV

SEQ ID NO: 151971 - protein, 136 aa, Triticum aestivum
  unsure (1)..(136): unsure at all Xaa locations
  Clone ID: PAT_TA_46389.pep
FPFPHGQGKRKTGLKTANPRFLRSNCSPDHHQFAGLPTTSPRRPIQASRPPRPRRFPQHATSELGHVAHLRIRVHGSLVGLGLGLMRNGAQAPRGTGGGGGGGLFSARSLSSYMRIVSSGASTAAXTLRSXGASLV

SEQ ID NO: 151972 - protein, 188 aa, Triticum aestivum
  unsure (1)..(188): unsure at all Xaa locations
  Clone ID: PAT_TA_46390.pep
RTRGLFFPHLPIPPHRRRDEARARLGEILHEIVRSRRRISPARVMDSNDDDEGDVLQSFIDSKYSDGRSMTESEIVGLLIAILFAGQHTSSSTSTWTGACLLSNQKYMTAAMKEQKKIIEQNGEPIDYTILSKMDALRCCIKEALRLYSPTPLLLRHAHKSFTVQTXDGMEYEIPEGHALACSIVVSN

SEQ ID NO: 151973 - protein, 205 aa, Triticum aestivum
  unsure (1)..(205): unsure at all Xaa locations
  Clone ID: PAT_TA_46391.pep
MRKSQXISSYLKKXGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSG

SEQ ID NO: 151974 - protein, 78 aa, Triticum aestivum
  Clone ID: PAT_TA_46392.pep
MPPSENKRRDWAGLGDGLAGTIADRVLAHDVADYLRFRAVCGPWRRCCADPRAHGGLDRRFHPRRWLMLREPRERIDA

SEQ ID NO: 151975 - protein, 105 aa, Triticum aestivum
  unsure (1)..(105): unsure at all Xaa locations
  Clone ID: PAT_TA_46393.pep
MAALPLATAEACDANSHMITSGELRALQPVFRIYGGRRLFAGPVVTVKVFEDNVLVRGILEEKDEGRVLXVVDRGGSLRRALLGGNIAMLAQNNGWAGIMINGCV

SEQ ID NO: 151976 - protein, 136 aa, Triticum aestivum
  Clone ID: PAT_TA_46394.pep
PKKSGGNTKKKRGATAKKKRGRGKKKGPPGGDRQKPHPFRKTGPLGPPGKKGPGPAGGPMKKGEPGGKKGAPHHSQKESSPKPKAQSGGGPRQGENQIKRLAQKARLPKGKPGGPAGQQRGPTPPEGRYPHSPPGG

SEQ ID NO: 151977 - protein, 72 aa, Triticum aestivum
  unsure (1)..(72): unsure at all Xaa locations
  Clone ID: PAT_TA_46395.pep
VLQQIALFXVVAAVIMNSSVCLEAAGHDATVVGTGSNDPNHPVXPSPPGKPYTGRPCSKIYGCNVPPAGGQP

SEQ ID NO: 151978 - protein, 56 aa, Triticum aestivum
  Clone ID: PAT_TA_46396.pep
VGIPPGAAAAAPIKVAQRPENAGKLFVVVFPSFGERYLSSVLFHSIKKEAESMVVE

SEQ ID NO: 151979 - protein, 76 aa, Triticum aestivum
  Clone ID: PAT_TA_46397.pep
MATANHQLQKAAKFLDSGAVRATRFLWRHPVARVSLLFYLVFVHLFLMYLMQRLQDFAAEETVKSSMGDLANVKLP

SEQ ID NO: 151980 - protein, 156 aa, Triticum aestivum
  Clone ID: PAT_TA_46398.pep
PRAPPPPQAQGPKKGCPVSPPGPGPRGVAPPQKTSQSFVPPGKPHAQFPVRVGAPKNRFKPLGGPPQGNARGVAHFKGIWPPLLSQGLFFEGPSFNPGKTFGDFFFLFLGGRGKPIPFPAGPPPPPRPGPPGFWWTPGPFFCGICPPQKKTNSPFF

SEQ ID NO: 151981 - protein, 63 aa, Triticum aestivum
  unsure (1)..(63): unsure at all Xaa locations
  Clone ID: PAT_TA_46399.pep
LKKGYTYSITPDTFCMGKXCRKHTQHKVTQYKGWKASLFAQGKRRCDRKQSGYGGQTKPVFHK

SEQ ID NO: 151982 - protein, 141 aa, Triticum aestivum
  Clone ID: PAT_TA_46400.pep
PDLQSWTRDEDMELPLPLLWQSEAYKRERLPQAMPQCPVLKADEDGVLYLLLGDYYIDWEGGARLCREIECVISINMRTKSLLSCSHRPIKDGLPAPPPWRVEPSKDFHPDIPTLLAVKFCASHTGLSDGLLHKEKKNRLI

SEQ ID NO: 151983 - protein, 106 aa, Triticum aestivum
  unsure (1)..(106): unsure at all Xaa locations
  Clone ID: PAT_TA_46401.pep
FLASGMTPRTXLFFISLGAIKTVDDHCGLWLPGNVIHAVFANNSAFHNIHHQLYGQKHNFSQPFFVVWDKILGTYMPFTLQSREGGGVKARPVKHALAAHEQHKSD

SEQ ID NO: 151984 - protein, 94 aa, Triticum aestivum
  Clone ID: PAT_TA_46402.pep
AKGDKFLGQQRYKVPSYQCLWALDYFLNKGGEPKTKQRLRFQRFTKFILPFLDIYKHKWPPNASKMGAPSGGRRSLLNSTLGLFALGAGLSLVG

SEQ ID NO: 151985 - protein, 60 aa, Triticum aestivum
  Clone ID: PAT_TA_46403.pep
AVHLLFIWADFYEPLLLIWGATYKGFMDKRGSGNYYCQLKRVWEPYWGVNRVAGGGKWGP

SEQ ID NO: 151986 - protein, 55 aa, Triticum aestivum
  Clone ID: PAT_TA_46404.pep
EMGQPGILTSASIKYPTLKKTFNCNNVAQQLGSKPKVSLKEGVKMPPDFHRRLRA

SEQ ID NO: 151987 - protein, 175 aa, Triticum aestivum
  Clone ID: PAT_TA_46405.pep
RHLQPLRDLDYLTYWNGTARIMRPLTIVVSGNAPFESVTAMNSTHRDIFWDAKLERLVSMEDNFDTKPPTFRFNRSNSYFASTRFQNAKLFRTEYDNALDVLPGRERDMTSTQIEQAESRGLLARYWDTPAEPPNLRDIAWRVLIDNEIGLLNMDDLGIVRQRAKGWGSLRYEDL

SEQ ID NO: 151988 - protein, 61 aa, Triticum aestivum
  Clone ID: PAT_TA_46406.pep
WGTVQEKVQGGPQLLIGGGGPPSPNSLIFLVVIGLAGFTRTPPSIKNKDYLDPEIPDLTNS

SEQ ID NO: 151989 - protein, 63 aa, Triticum aestivum
  Clone ID: PAT_TA_46407.pep
TLEGQVQFYVTGSTHDLSTVIHFFSSIHMMQLLYDSFSQSFMDCRNSFYFHVVLIDQFCIAFF

SEQ ID NO: 151990 - protein, 81 aa, Triticum aestivum
  Clone ID: PAT_TA_46408.pep
KKGFAHFFLFIYIFIYIYIFPISITLSKNEKIPRKNVSPDNFFSNLAYYFGLYYFASTKKSPPEPFRNINQTLSPWFFPGH

SEQ ID NO: 151991 - protein, 76 aa, Triticum aestivum
  Clone ID: PAT_TA_46409.pep
ILEQTGTKHPHRGFVDTFQQRARGIPDAENYCTGGKTTGTHFTAFSAEGKKLAPPTLKTNLAFWAGALLHLTHHCI

SEQ ID NO: 151992 - protein, 89 aa, Triticum aestivum
  Clone ID: PAT_TA_46410.pep
QPNSLLFTPVHVWYFELYKGLQRQVFRNGTNLWHGIDNTTGGRGTMATETPHTKVGRTHNPNLSNYHARSSQAHQVVLDDWITRYQFVI

SEQ ID NO: 151993 - protein, 146 aa, Triticum aestivum
  unsure (1)..(146): unsure at all Xaa locations
  Clone ID: PAT_TA_46411.pep
VTIGKSRNTYXKRKQCSKHTQRKVSXSKAGKASLFPQGKIQYDRNQSGSGGXTKTVFPKKAKPXRKVVISLECAEGKAKLQLEMNPCKPFVLGGTVSSNGAAARFVGALCVGSQGLHFHPSLVGFAASWMCTVTRRLVVLGFRLVL

SEQ ID NO: 151994 - protein, 83 aa, Triticum aestivum
  Clone ID: PAT_TA_46412.pep
SNSGSSHRRRAPSRITSPSRCRLPTPPSSPSLPPTPAPTLLLLLPDRPYLRRLLRLPAGGVACLHGRSVRVLTVAARWLLRPT

SEQ ID NO: 151995 - protein, 150 aa, Triticum aestivum
  Clone ID: PAT_TA_46413.pep
LRFARRGGEVKEPEVVQRTKGSVHLPGDGARTFLTSAQSDATEPKRTHRDSRSSPRHVAPSLDSPTRGGALSRSACDGGGDRGGRALRGGLRVRGGGGYERGGGYGGGGGGYGGGGGGRGSQVRQEGHISRTAPRRGGAAVRRGGYGGAA

SEQ ID NO: 151996 - protein, 192 aa, Triticum aestivum
  Clone ID: PAT_TA_46414.pep
PARGKGREETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSG

SEQ ID NO: 151997 - protein, 127 aa, Triticum aestivum; identical to SEQ ID NO: 124219
  Clone ID: PAT_TA_46415.pep

SEQ ID NO: 151998 - protein, 167 aa, Triticum aestivum
  unsure (1)..(167): unsure at all Xaa locations
  Clone ID: PAT_TA_46416.pep
MAFAVSDELLGTFVPIAVYWLYSALYNVLDALGTVDCYRLHPKEDEETRNIPSKRTVLRGVLLQQAVQVAVSLIVFKITGDGRRDAREQPPAPVIALQFIVAMFAMDTWQYFVHRYLHTNKFLYKHXHAQHHTILVPYAFGALYSHPLEGLLMDTASGAVGFLASGM

SEQ ID NO: 151999 - protein, 100 aa, Triticum aestivum
  Clone ID: PAT_TA_46417.pep
RGSPEIKPSLRRRPLEGGGTKARSFGSGTRPEKGRSSVIVGHFLWWNVDVHVDGCTLVLIGGRGSPFPNSLIFLVVIGLDWFYRTTPSIKNKDLFRSLYL

SEQ ID NO: 152000 - protein, 81 aa, Triticum aestivum
  Clone ID: PAT_TA_46418.pep
AKLSFASVLAQFSYTSWEVEVMMEYEPQSFSWPAALASWLASFCCGSEGGSHGEPVAGDGPARRMAAAARHLNGAHKIKFS

SEQ ID NO: 152001 - protein, 182 aa, Triticum aestivum
  Clone ID: PAT_TA_46419.pep
MLLRYHIRRHWLRYITGLLLCLSVGELIYIHYLSKNLVRISNDPYDIRFSDLTYKSPELWDDAHQAFLRNADPVPIHSHNDYERHIPLFDALGSGCISVEADVHLRKSNLYVGHSSLGLSSKKTLKSLYLEPIQRMITAQNVNLTGHWRGLFDKAPNQTLTLLIDFKSSGTKTFAELDRHLQ

SEQ ID NO: 152002 - protein, 84 aa, Triticum aestivum
  unsure (1)..(84): unsure at all Xaa locations
  Clone ID: PAT_TA_46420.pep
VREEGVKPHLPPPPPPPPXAPADQSEQEAPPPRAPPXPPPPSPPPRPPPTTTAPPSLPRRRRPPTTPDTLPLTTVRALRGRTPP

SEQ ID NO: 152003 - protein, 124 aa, Triticum aestivum
  Clone ID: PAT_TA_46421.pep
GARRAQFGLPLTDHQLNKLHLGLFHGGGFNRLDALTPSSRISKGFVLSSAPAHDSVSCLLTIGTPQSTEKSVDRKTPHIMLFGKAILTEQQMTSSGSRETLSFGATGNSSPISTALKAGNASDG

SEQ ID NO: 152004 - protein, 111 aa, Triticum aestivum
  Clone ID: PAT_TA_46422.pep
MHLSVICNNFVNRTPNTVTLCRSRNVVPGDSVSGRAYKGRHCKKFYTEEGCPYGDACTFLHDEQSKARESVAISLSPSVGGGSYNSAAAAAASPNGPTILKPSNWKTRICN

SEQ ID NO: 152005 - protein, 136 aa, Triticum aestivum
  Clone ID: PAT_TA_46423.pep
RPPTRPGVSKAVLAQWSNQGIRFSSDPETAMGLVQHEGGPCGVLATVQAYVLKYLLFFSDNLGNPEVSDPSFALGQRRFYQSSFAARDDFSSLTEDGKTRALVHAMVEILFLCGTGKRAVVAFIGGVTREKVDAAL

SEQ ID NO: 152006 - protein, 119 aa, Triticum aestivum
  Clone ID: PAT_TA_46424.pep
PWPPPTPRAWACPPPRTRTTTHPWPAPSASSTPPRIRSPCRSAASSRLPSCRRPSGCPSAASPPSAAAPKPRGRRRSRPFHGRTRPRRLRRRAAPSRRSTSPGRWSRKDNLSLAPSSRP

SEQ ID NO: 152007 - protein, 78 aa, Triticum aestivum
  Clone ID: PAT_TA_46425.pep
LGVHFSSQSNTLCSVFWLGTIHVVPNSWIALCIISWLVVDSAFFHELQRGKHRLYFNHLCSIRIQLNWITAMSDSSHR

SEQ ID NO: 152008 - protein, 28 aa, Triticum aestivum
  Clone ID: PAT_TA_46426.pep
PAQFSILTKERCIHSNYLHMSHLFVIKK

SEQ ID NO: 152009 - protein, 114 aa, Triticum aestivum
  unsure (1)..(114): unsure at all Xaa locations
  Clone ID: PAT_TA_46427.pep
PPPPPPPPRWGSSTCSTWPTAPRGTRPSPASSTRSSRPTTPTSPPRPPRRPPPRTPPPTPXPAPRPAVPPRWWKLLPKGGQLWWRPGQRPGLLWWWWRQRRPWKGTWRRIQSCL

SEQ ID NO: 152010 - protein, 139 aa, Triticum aestivum
  Clone ID: PAT_TA_46428.pep
RPPTRPPTRPPTRPRTRGPAASALQWLAPPQTASGLPFVFSQCQSIHARSVFPCHDTPAARITYSLLLNVPAQLSAVAAARHVARRDPVPSDHSGACDDALWCAPGRIVEEFEMAQCVPPYLFVFAAGGIGSRDLGPRT

SEQ ID NO: 152011 - protein, 94 aa, Triticum aestivum
  unsure (1)..(94): unsure at all Xaa locations
  Clone ID: PAT_TA_46429.pep
ADKKPGAKKPGEDEPTTEKAEKVTAAKKPKACKRVPVGMTDSXEGGEIRSRMKGKKSGETYTIYMFKVLMQVHPDMGISSKDMSIMNCFMNDIF

SEQ ID NO: 152012 - protein, 103 aa, Triticum aestivum
  unsure (1)..(103): unsure at all Xaa locations
  Clone ID: PAT_TA_46430.pep
GDARRLPRVRDGPGWVDRAKHPFDGICEFGSEKRAHGPLILFLRDGEKECGNTYSYHGLKSKVEIFSAGGFVIGSXTQADSREDKLNGAPLLSKFPYGRAEIL

SEQ ID NO: 152013 - protein, 135 aa, Triticum aestivum
  Clone ID: PAT_TA_46431.pep
SPRFIARYVGKFGSPPPTGRTKKGAGFSPRPTDLGLAPVAFTVSPVVDGRFFQSPVVTSHPEAPPILGGAPPLFFPSDSRVRWVTFWTPAMVNWPCGIGWCVFVKKKKKKKKKTKKKKKKKKKKKKKKNPRVRGR

SEQ ID NO: 152014 - protein, 60 aa, Triticum aestivum
  Clone ID: PAT_TA_46432.pep
IFSLYRLLKLSNNCTGLQGILVFNAVSGGTRSGLVSLLLERLDEDYGKKFKLGFTGNQFL

SEQ ID NO: 152015 - protein, 105 aa, Triticum aestivum
  Clone ID: PAT_TA_46433.pep
RHGCAPAGSGWTAHCCRARPIGRPMSRWVHGECDACYFISHSSSVHDDSEAGIGPKAQNPVLDRPYGRLQEPWIATARLTAKSGAPAVRDTRTCYDRVPRTRGRT

SEQ ID NO: 152016 - protein, 25 aa, Triticum aestivum
  Clone ID: PAT_TA_46434.pep
VRHSFFYTCTDALVVLLIKDRFLLA

SEQ ID NO: 152017 - protein, 111 aa, Triticum aestivum
  unsure (1)..(111): unsure at all Xaa locations
  Clone ID: PAT_TA_46435.pep
VRSGFGRVYKGRLDGSQGVAIKQLNTDGNQXTKIFLVEGLKLSLLHHQNLVNLFGYCADGKQRLLVYEYMPLGSLDVHLHDLSLVXDPMYWHTMSKIAYGAAKGLEYLHDN

SEQ ID NO: 152018 - protein, 105 aa, Triticum aestivum
  Clone ID: PAT_TA_46436.pep
MEPAEAEAGGGIAAARSSPAAVQATNDDAAASKLSCVTKGYMKDDYVHHFVRRTTKRAPIINRGYYARWSVLRKLMLQFLNAGSGSDDQKRKQILSLGAGFDTTF

SEQ ID NO: 152019 - protein, 81 aa, Triticum aestivum
  Clone ID: PAT_TA_46437.pep
KSEEQFVSPPRIGNEQQRKIRQNFPDFDQIRQRRTEDGHLGENGTRIGGGGMGRGASIGSRRAASNKPRETRSEIGNRAAE

SEQ ID NO: 152020 - protein, 81 aa, Triticum aestivum
  Clone ID: PAT_TA_46438.pep
TRKFRPTRPINSTPAVTSLYYGALSDAPGYIRTYKRKQPEPAMCPGAPVAAVAVDNSVCVMDASGPLGQALVHRLIRRGYT

SEQ ID NO: 152021 - protein, 119 aa, Triticum aestivum
  unsure (1)..(119): unsure at all Xaa locations
  Clone ID: PAT_TA_46439.pep
MLTNSFPNPTRATAPRGSPATMFGRVMGGKGLGKGGAKRHRKVLRDNIQGITKPAIRRLXARRGGVKRISGLIYEETRGVLKIFLENVIRDAVTYTEHARRKTVTAMDVGYALKRQGRT

SEQ ID NO: 152022 - protein, 129 aa, Triticum aestivum
  Clone ID: PAT_TA_46440.pep
RPALCMLTSLPWNRSSAVCPLLAGVPCSASPPNHASRPGCPNKLAGVLAPSATSRTRAHASRPPIHRPSSPGVRWLLAPCPAPAPLFLCRGPRHSRRAWPPLAPQPSSFMCSSPRARTLLRSCPRTSRS

SEQ ID NO: 152023 - protein, 69 aa, Triticum aestivum
  Clone ID: PAT_TA_46441.pep
RRCRCGDPRFGGHGSAEQLQRRCWQLHRLTSLVFSSFWPDKTTQPASYERQTDMDGETIYVSCVNSVCL

SEQ ID NO: 152024 - protein, 50 aa, Triticum aestivum
  Clone ID: PAT_TA_46442.pep
VHGRVGSSAHCHRRVANGGGEPHIHRGAAHLPGRVPTYPHGGARQALSRA

SEQ ID NO: 152025 - protein, 54 aa, Triticum aestivum
  Clone ID: PAT_TA_46443.pep
RPLYFSLLSSSPHSTSGLGVRGCFPPPSSPSPRLNGNAIASPSAFTYTTESKFK

SEQ ID NO: 152026 - protein, 54 aa, Triticum aestivum
  Clone ID: PAT_TA_46444.pep
YSLPKLGKPPSSEYECTMVGARRNRLRSEGPHHPGALRTGGKHYVRNLSRHANN

SEQ ID NO: 152027 - protein, 59 aa, Triticum aestivum
  Clone ID: PAT_TA_46445.pep
STGERAEKAAAAVRMNSMLVSSTESSKARSGWVAHHSRLRACVNGSDHMSMSECGGACA

SEQ ID NO: 152028 - protein, 94 aa, Triticum aestivum
  Clone ID: PAT_TA_46446.pep
MEGGGACEVRHWNADVNGVSLHVAKQGPAAGPAVLLLHGLPELWLSWRHQMAALADRGFRALAPDLRGYGDSDAPVDPAGYTMLHVDGDVVALF

SEQ ID NO: 152029 - protein, 127 aa, Triticum aestivum
  Clone ID: PAT_TA_46447.pep
RRRSRFRSSRRRRIRCRRRRAGAEGEGRQHPHAHLPAPGHEAAAGSRVVASSSSSTTREEQLLLHARARHGYESYLAGSTLVRWDWIRFWIGASLPNPIERGEEERRRREAREIRTRGRTRRSDREV

SEQ ID NO: 152030 - protein, 78 aa, Triticum aestivum
  Clone ID: PAT_TA_46448.pep
SVRTNVVNASFFYSDGGKAVQRCVLGPVLRLKAPSVPMRHASGLTSPPMWFTSSPAACLAGVHGGLHVLPGRLFLLAQ

SEQ ID NO: 152031 - protein, 80 aa, Triticum aestivum
  Clone ID: PAT_TA_46449.pep
RPARLAKSHTPTGAREFHIYHPCGTSRGAQVRHGRLLSGPRRHRGAGPPPGGLGADGDRGARHLCLWRPPLTTTGTTTTL

SEQ ID NO: 152032 - protein, 58 aa, Triticum aestivum
  Clone ID: PAT_TA_46450.pep
QKKKSHPKATTWYQISTPTSEEDFLDHEVGQLTHVTSHGNSPMLPLIEITSYAIDLLR

SEQ ID NO: 152033 - protein, 32 aa, Triticum aestivum
  Clone ID: PAT_TA_46451.pep
HTDPVPVNQHPKTLLISLPPRHREAPLTNNKS

SEQ ID NO: 152034 - protein, 82 aa, Triticum aestivum
  Clone ID: PAT_TA_46452.pep
QRQITVISGRSKCQKHKDLKPFTWTILHIYVTTTNTFQAKSWDARFIYYHTTQDMIQTRFSWLGTHTTLTLPKPSWKRFPST

SEQ ID NO: 152035 - protein, 73 aa, Triticum aestivum
  Clone ID: PAT_TA_46453.pep
PRRRNRSSSQRSPPPPSLPRLPTRASFPCPRPSLRRRGLPSSRKSRPFLGRPARAGRADDSGGVHVSADAWAD

SEQ ID NO: 152036 - protein, 61 aa, Triticum aestivum
  Clone ID: PAT_TA_46454.pep
KISNFIICESNKHFGGVNASLGLTSNQLLMVYWDFSHTFSTSLLTKKHVVSHHKAIQVFFF

SEQ ID NO: 152037 - protein, 71 aa, Triticum aestivum
  unsure (1)..(71): unsure at all Xaa locations
  Clone ID: PAT_TA_46455.pep
MNLWTDDNASMMEAFMASADMPAFPWGAAATPPAAAFIQDTLXXRLQAIIEGSRETWTYAIFWQSFSYSGA

SEQ ID NO: 152038 - protein, 122 aa, Triticum aestivum
  Clone ID: PAT_TA_46456.pep
RSRTRGRLLQIAPEKPTIFAEPTPFYSGGPTQQRGGQGQRRRQFAGKPPYYSASPRASFLAAVAACLLVLLPLVVSPRPRDGDAIPRAVGRAHPIYSPLLPAGRVCAVVRHCRVIPSGALIG

SEQ ID NO: 152039 - protein, 54 aa, Triticum aestivum
  Clone ID: PAT_TA_46457.pep
RPPTRAYCNSDPYRTRPIAPHPVWTFLSGGGPFLFPTIRPALPRLPLQSSEFYC

SEQ ID NO: 152040 - protein, 62 aa, Triticum aestivum
  Clone ID: PAT_TA_46458.pep
VRPLVRPLVRPLVRENKILSIRDRGVGMTKEHLIKNLGTIAKSRTSGVVENMQTGGDLNLFG

SEQ ID NO: 152041 - protein, 57 aa, Triticum aestivum
  Clone ID: PAT_TA_46459.pep
MATLDLLFNLRNLFYLGAYQSAINNSYVPGLDADSSAERDVIDFRFYIALGSYQLGD

SEQ ID NO: 152042 - protein, 60 aa, Triticum aestivum
  unsure (1)..(60): unsure at all Xaa locations
  Clone ID: PAT_TA_46460.pep
MLMACTKLTARKYTGGKALRKQLATKAARMSAPTTGGVKNPHRYXRPGTVVLREIREYQK

SEQ ID NO: 152043 - protein, 40 aa, Triticum aestivum
  Clone ID: PAT_TA_46461.pep
SYEINAWYRYGYGPLSITPKFMEDATSSCETSVLIIMKQN

SEQ ID NO: 152044 - protein, 123 aa, Triticum aestivum
  Clone ID: PAT_TA_46462.pep
SPACRRVLSQRPTSISTGGVPDLRGATSFSLFVPCSPALALLCFALGFSRVSQRPRSWRVRVLGAGGADSYLEEGRCANIRLSPFLHRRSKTVVSDYPNENWGWRLHHMVNHFGPTVRKRSIG

SEQ ID NO: 152045 - protein, 106 aa, Triticum aestivum
  unsure (1)..(106): unsure at all Xaa locations
  Clone ID: PAT_TA_46463.pep
PFAMASLGLTYPQERGSLAEESGVLFEAIKLVFEKREKEIWNLXFDMDDQIANYFGTGAAYIRAXSFGIPLXCLFDAKRVVGYIVYSYASTNAFLAIVIVIEANQC

SEQ ID NO: 152046 - protein, 92 aa, Triticum aestivum
  unsure (1)..(92): unsure at all Xaa locations
  Clone ID: PAT_TA_46464.pep
FADAWADSWGNGVTLNRLTVGAPEDSAGTPYGIHIHMFRHVSVYDANIRTGDDCVFVGPGNCYLWIERVSCGXPGHGISIGSLGHEEGLDMV

SEQ ID NO: 152047 - protein, 50 aa, Triticum aestivum
  Clone ID: PAT_TA_46465.pep
RRPLVRSVFPNQDSPTVYAFSQLDRNGVGRRRSSGRREGPGRQLHLRPQA

SEQ ID NO: 152048 - protein, 51 aa, Triticum aestivum
  Clone ID: PAT_TA_46466.pep
IKNVNSFIQPTKIVSSNLYFILAHLRLQFTTTDQSYRFLLKKKKKPTRPRT

SEQ ID NO: 152049 - protein, 60 aa, Triticum aestivum
  Clone ID: PAT_TA_46467.pep
RPRQSEEGSTPFVTYHVLMRGWCLSGLTFWKKGTFTLPLRSGRAFCKPHILLFLTFIFRG

SEQ ID NO: 152050 - protein, 114 aa, Triticum aestivum
  unsure (1)..(114): unsure at all Xaa locations
  Clone ID: PAT_TA_46468.pep
RSEISNGPSRPLTLDFPYLVHAQSIHTIYAVQVVLMGLIEVYRVGGGPLGEGLDIIYPGGAFNPLVLADYPDTVIELKVKELKIGLLAMFSMYEVFVHAIVTGXGPVENLFDHI

SEQ ID NO: 152051 - protein, 76 aa, Triticum aestivum
  Clone ID: PAT_TA_46469.pep
VGLLPMRNKFPPHPYIVSCPPISIVHLSIITPPFVVIRAHLTPPSEHVDNYLPLDTIRYVLAMVGILPPHQMRLDR

SEQ ID NO: 152052 - protein, 67 aa, Triticum aestivum
  Clone ID: PAT_TA_46470.pep
MTVVSLAIPITPQQQRATFRNMVLGIRFFVSPSDSVAIMQANAVQTNHTYASALKGVSTSMSTTAAT

SEQ ID NO: 152053 - protein, 86 aa, Triticum aestivum
  unsure (1)..(86): unsure at all Xaa locations
  Clone ID: PAT_TA_46471.pep
RTVKTMRRFLLSQKHIVYTEPREIRAGTTVDVLYNPSNTVLKGKPEVWFRCFLNLWRHPRGALPPQKMVKXSGYGPVFKATVNGPT

SEQ ID NO: 152054 - protein, 74 aa, Triticum aestivum
  Clone ID: PAT_TA_46472.pep
SAVAWAPVGRGYLHMYRGVSVTDEGGGVKFVHVDRIDGELGGPSDCGYTINLPYFVDNRGLRHGVSPGMILCTQ

SEQ ID NO: 152055 - protein, 92 aa, Triticum aestivum
  Clone ID: PAT_TA_46473.pep
RSHEGKAPRRGDGSPRRLRAPGSRAAYVNASCPGPLPSRSHTTTTLASLFSRIVFIAQSTHAHAVPSPSQPTNFITPSAVGAAGEALRRPVC

SEQ ID NO: 152056 - protein, 86 aa, Triticum aestivum
  Clone ID: PAT_TA_46474.pep
THRPTSDGDHGARMRVLPTAVLHHGCVPARPLNFWASDSQRELRPRSCRLLRLRGVHTIEPFTASRARRTTHRRAPCSRRSRTTLH

SEQ ID NO: 152057 - protein, 39 aa, Triticum aestivum
  Clone ID: PAT_TA_46475.pep
RPRTRGVQVLRDALEEIFVLCFSPAGCSKPSWDIIFCDL

SEQ ID NO: 152058 - protein, 69 aa, Triticum aestivum
  Clone ID: PAT_TA_46476.pep
MAQDEVPPSSSASSLVNARVNAFTPESTARYDAHHHAHAHHHEHHHHHHQHQQPHHQHRHQHHHQHQHQ

SEQ ID NO: 152059 - protein, 66 aa, Triticum aestivum
  unsure (1)..(66): unsure at all Xaa locations
  Clone ID: PAT_TA_46477.pep
MKVYVVVGINTAFKDRVRHDYVQDTXVPCDNMMGGLDPDTPHLVRFVIGHSATPGGALDRAINVDE

SEQ ID NO: 152060 - protein, 77 aa, Triticum aestivum
  Clone ID: PAT_TA_46478.pep
VTPVLCFPAQCEPTCIVIHWAVQLDSLVSHPHRFSCLRLICIQFYAVNIHMLSFCSRFMPWLWQRVQYSAVVCYFLR

SEQ ID NO: 152061 - protein, 88 aa, Triticum aestivum
  unsure (1)..(88): unsure at all Xaa locations
  Clone ID: PAT_TA_46479.pep
MGRGMLLRRLPSARCLLMVATLAISDSTVPLTIETIDXPCTVDIVDPGSRDLSTTSAEVVVLFHDMFLMRRMEIAVNLFYKAKFIRGK

SEQ ID NO: 152062 - protein, 48 aa, Triticum aestivum
  Clone ID: PAT_TA_46480.pep
MSDLDVQIPTAFDPFAEANAGDAGAAAGSKDYVHVRIQQRNGRKSLTT

SEQ ID NO: 152063 - protein, 98 aa, Triticum aestivum
  Clone ID: PAT_TA_46481.pep
ACSTRLEFPGKTTHIRRPTKPKKKKKTIKKKKKNKRQKPTTKQKKNKKLNKSRGGRFWGSCFTPPFSNSMVFLWATLTAVLGPPFTRGDRAKPWLFPN

SEQ ID NO: 152064 - protein, 106 aa, Triticum aestivum
  Clone ID: PAT_TA_46482.pep
AQPAATPNTAFAFDRRRAPPQITPPSKPLVPASLPYQLLLPPGHRPRWREWQGGRMEQTGRAAGWEVVRSGRVRTVVGWRSVGQRRREAREENIKSALRPRGRVEI

SEQ ID NO: 152065 - protein, 154 aa, Triticum aestivum
  unsure (1)..(154): unsure at all Xaa locations
  Clone ID: PAT_TA_46483.pep
VRSEACEEALRLRRRDLIGGWGGATVGLEIAEASTRSTGVAAAADLIERRQRSEFQSSIKSTLTAAIEAKPELVPSLLTLALNDAITYDKATKTGGPNGSIRXEISRPENSGLSAALDLLVEAKKEIDSYSKGGPLSFADLIQIAASQALKKTF

SEQ ID NO: 152066 - protein, 60 aa, Triticum aestivum
  Clone ID: PAT_TA_46484.pep
LSDLQRSNIIVKQDQPCDDGQNHAQVKSNGGELVAAGSLGDVDDEDPDAPPGFDAPPGFG

SEQ ID NO: 152067 - protein, 150 aa, Triticum aestivum
  Clone ID: PAT_TA_46485.pep
MLKHEIRKLEQLQQQLEVEANRAIDVLHKEVECHKHGNQDAAETIAKLQAEIREMQSFRSENRDVEMVTDEGNGSDLKDEITRLHLQDSDIAKLEAKLENVQRSIDKLVMSLPNVETTPKSNRSKKKKRMLLPLGVSKRPNLIRAPCTPH

SEQ ID NO: 152068 - protein, 116 aa, Triticum aestivum
  Clone ID: PAT_TA_46486.pep
LQPPCRAAPPCRRPLEAPRPRNRRPAPDWRRRRSPRRPRPRRGRTRAIRPRRRRGPIPAMRRRGRRRGTCRRRPRPLSAGSWAATSLGRHSPTRPRGRGPSAPPATPSSAFSTGLA

SEQ ID NO: 152069 - protein, 86 aa, Triticum aestivum
  Clone ID: PAT_TA_46487.pep
MDPSGAFARSSSNVSLATLVRSGSSGSSGSSRGRGGSRRMVRRVLRGVITFIFAIAGLFLGAVTGGLIGLATESGLFRGTGIGAIT

SEQ ID NO: 152070 - protein, 108 aa, Triticum aestivum
  Clone ID: PAT_TA_46488.pep
MGFLPLLQVVLLVAAAAARGPAAHAWGEEGHFMTCKIAEGFLTSEASAAVKGLLPEWANGELAAACSWPDAVRRQMPWSISLHFADTPGDCKFSYARDCHGTKGEKDM

SEQ ID NO: 152071 - protein, 64 aa, Triticum aestivum
  unsure (1)..(64): unsure at all Xaa locations
  Clone ID: PAT_TA_46489.pep
MNQPVQKNTRYIGGLADEXGEKILHAVFAPSWFKEIKGVKRPLDQATQKHCSFGFFTFLEREEH

SEQ ID NO: 152072 - protein, 128 aa, Triticum aestivum
  Clone ID: PAT_TA_46490.pep
TGCASWRKAPPGRPTLGAPPPSLEMSTDAVLLPLVPSPSDAATVAGAGNGGAGGPAVSRDGVLVTGGSDGGSCRVRGRCWCDDRRGYHKCGSGIDRPPCWPPLAVASVLVSCLLSHLIQSMILFQQAK

SEQ ID NO: 152073 - protein, 140 aa, Triticum aestivum
  unsure (1)..(140): unsure at all Xaa locations
  Clone ID: PAT_TA_46491.pep
QQQVDAYSWLGSIQKIHNLRSKQCYLNQRAKRRRGRTPTPGRYLGAKSSRGRRYSRSRSPVRRDRYSSRYSPERERSYSPYRRGRSYSRRDRRRSYFPXESYTPSDRSESPYDRRRSYSPYDRRISYSPHHGHXHRFRSP

SEQ ID NO: 152074 - protein, 147 aa, Triticum aestivum
  Clone ID: PAT_TA_46492.pep
RTRPPTRPPTRPGAPLRPRPPRAGGPPVALGPGVLPRPARRPRLRCPRCACLPLLLGAQREKHEALKLLLLSGRSSSRKSMTPTPSSTAAPSSPTTPSSSPLPAVLSMSRLKCALPRFDLWALLFLLIGVPIIIIYVHGQKVLREDT

SEQ ID NO: 152075 - protein, 153 aa, Triticum aestivum
  Clone ID: PAT_TA_46493.pep
CCRSSHRAHCRIGGGTLDSCSASPAECTRGRRRWQRRRGCGRRDPAGREKEPAAAWAEKEHLELKLVHGDAEERRGWWEEERGRGSRRRRRQMRSERGREAAAWEGGRCGGRRSECGERRRRRRGREGARPSPSISMPTPISRSRLSVVACGR

SEQ ID NO: 152076 - protein, 91 aa, Triticum aestivum
  Clone ID: PAT_TA_46494.pep
FGGPPHIPPSHASGCLGESLLIWLLGRNIPLPSLLLPPTTALLRIAMDKLVLLPIDYYTHGAPMACIWLPDRGVRIPCFTSHRRPPHVHSA

SEQ ID NO: 152077 - protein, 112 aa, Triticum aestivum
  unsure (1)..(112): unsure at all Xaa locations
  Clone ID: PAT_TA_46495.pep
ARVRAPLSPPFALLPHSPQPXPHERRCPCGGDPWPPDVLICSCREEAGGGGDLVARELREEELNPRGEDASQGVVLARRGPSRLEPSTVGGSFSGAADGGLSGWVTVAAAGA

SEQ ID NO: 152078 - protein, 74 aa, Triticum aestivum
  unsure (1)..(74): unsure at all Xaa locations
  Clone ID: PAT_TA_46496.pep
VXXPFSPLLNRIHNHKIFTPLRGASMRGVSHFLLLPYPTVLLACKFTVMASFVEAFAASTTSVLVIMGSGFFGS

SEQ ID NO: 152079 - protein, 108 aa, Triticum aestivum
  unsure (1)..(108): unsure at all Xaa locations
  Clone ID: PAT_TA_46497.pep
MGSARDVDTTTAANKQQQATCLAPNPGKATILALGHAFPQQLVMQDYVVEGFMRNTNCKDPELKEKLTRLCKTTTVKTRYVVMXDEILKSYPELAHDGLPTMKQRLDI

SEQ ID NO: 152080 - protein, 58 aa, Triticum aestivum
  Clone ID: PAT_TA_46498.pep
MEAEDDQPATGYRHGPPWVFNGNALYHLHMVNADTARAFMPKELRLVEAFCYTLGGMF

SEQ ID NO: 152081 - protein, 126 aa, Triticum aestivum
  Clone ID: PAT_TA_46499.pep
SQQCEIEGRPRGIRPGDGDDEAVLYPARWRPGRDLLLGLGARRLLACGAGILSAPQRTNQHNTDTEPEPEPRPRRQSRHASPGRACGRAPELNPGGRRRKVSRLVSHWGRKGEWRGWLGERLGWRT

SEQ ID NO: 152082 - protein, 115 aa, Triticum aestivum
  unsure (1)..(115): unsure at all Xaa locations
  Clone ID: PAT_TA_46500.pep
MYAVRACARMQSAMHEEGAPPRKRGGAVHGSAAREQHQQADETSSSAGPGAPCGACKFLRRRCVPGCVFAPHFXGSGRERGAAHFAAVHRVFGASNVANLLSRVPVALRXDTART

SEQ ID NO: 152083 - protein, 124 aa, Triticum aestivum
  Clone ID: PAT_TA_46501.pep
VRPRVHGLVGGRVGTVEHLTTGCDPDEGVCSTHAAASSPEEIAPPVPTPLPPPAASAEDRVERAWAHWKLLASPTLAVAPMVDNSELPFHMLFRRYGADADYTPILHYRMFCENENHRDMEFTT

SEQ ID NO: 152084 - protein, 90 aa, Triticum aestivum
  Clone ID: PAT_TA_46502.pep
LPRIDTPSVLRIIRRIIWMSVSWSSSRSFSSFRHSRSGASDMTRAYTWIIGTQLGRMKYRSSSQARPPTQRQRDLLVQVGTRLLVHLLGR

SEQ ID NO: 152085 - protein, 134 aa, Triticum aestivum
  unsure (1)..(134): unsure at all Xaa locations
  Clone ID: PAT_TA_46503.pep
RPPTRPPTRPLSDIDILDDGFRWRKYGQKVVKGNPNPRSYYKCTTVGCPVRKHVERASHDNRAVITTYEGKHSHDVPIGRGRALXRHLPPTARPSSGLPPPXQAPCTLEMLAGHPCYAAKDEPRDDMFVESLLC

SEQ ID NO: 152086 - protein, 139 aa, Triticum aestivum
  unsure (1)..(139): unsure at all Xaa locations
  Clone ID: PAT_TA_46504.pep
RAPTRPRTRGSGDRFPPDSCNGGRGGARGVARSGQXTGEVNATIHYASPYDPDGHGGHTAWTAAGNFHTPAISRGYNFGYASGMAPGARLALYKAAYPFGGYMSNVIAGGDQARXDGVDGISLSMAPSSVSPGPAGFLN

SEQ ID NO: 152087 - protein, 112 aa, Triticum aestivum
  Clone ID: PAT_TA_46505.pep
SWYAPQSVQKTNPVGKLPFVSAPPQRLPTAQPHPHAGEMTSSPRSRARAAARRIGPAALSPSRSEKEKAGVRRGAWAPESTQTQARTDRPSPKCLVRDCVCAPTRPRTRGRT

SEQ ID NO: 152088 - protein, 156 aa, Triticum aestivum
  Clone ID: PAT_TA_46506.pep
VLRVEHASAHASAHASADAWVIRALLGLRRAERIVNRATFIISAGTNDMLLNYIASNRSAGPIAMLRYENHLIARLGNYTQVMRMLGARRFVFVGLPPIGCLPIARTLLGRDPDGCDSDLNQLAASFNSRLVQLSKFVNYQPRMKSAYIDTYTIIR

SEQ ID NO: 152089 - protein, 67 aa, Triticum aestivum
  Clone ID: PAT_TA_46507.pep
RRPGGEASAVGQAWLGVTKSHEVVAVGLHATLDQLLQPPCAVAVGRLRLCCSGAGTCPCAVRANQPS

SEQ ID NO: 152090 - protein, 82 aa, Triticum aestivum
  Clone ID: PAT_TA_46508.pep
LGNCDQGGAGVLLFGSDPTKRLHVALTGTDALNSQWQSRIMDYWYKQMMVTAGSDMGSFTRILHSGKPDGLMDDITTLIVDP

SEQ ID NO: 152091 - protein, 48 aa, Triticum aestivum
  Clone ID: PAT_TA_46509.pep
FLFYFCMFVLCIVSYLFFFFFCTKMQLSHFLIKLKHLLFHYELSFLKY

SEQ ID NO: 152092 - protein, 149 aa, Triticum aestivum
  Clone ID: PAT_TA_46510.pep
SADAWADAWAGRAPLDWETRVKISLGAARAIAHLHTGAGGKFIHGNIKSNNIILSRELSACASDFGLAQLMATPHFHPRLVGYRAPEVLEAKKPTQKSDVYSFGVLLLEMLTGKAPLRSPGRDDSIEHLPRWVQSVVREEWTSEVFDVD

SEQ ID NO: 152093 - protein, 105 aa, Triticum aestivum
  Clone ID: PAT_TA_46511.pep
VRWITRRLSRRSGGEYGAHNHQFITMKQKEWYSFAMLDFGSRCSSAINRRYSRCHHSFAATQASDEEARNGGGHITIFQRGERHTYPLTIEMQVQGKHLYYYWAN

SEQ ID NO: 152094 - protein, 97 aa, Triticum aestivum
  unsure (1)..(97): unsure at all Xaa locations
  Clone ID: PAT_TA_46512.pep
KDEPCKEITXQPGLSIHGAKWINQQRHGPCRRIESRSSEIEGRLDPTTRNQPARGESAPQSRRPISAGLCTSTTAARFSXLAVGSCPAGRVGRARNP

SEQ ID NO: 152095 - protein, 49 aa, Triticum aestivum
  Clone ID: PAT_TA_46513.pep
AYDLRVRGRVFSKEYKKMNFLCVLWQPIQTTTALLCLWYILYIRLTGGM

SEQ ID NO: 152096 - protein, 111 aa, Triticum aestivum
  Clone ID: PAT_TA_46514.pep
RPRTRGRTRPQASRSRLGFLQRRRRRASAPRRPHLRRHSRRVGLHLPPQLPRALSLPPPVSSSSSWPGPARDPLRWTTPTLVDVPLRRRTPAPLPSSLAVSPSISYELLLF

SEQ ID NO: 152097 - protein, 60 aa, Triticum aestivum
  Clone ID: PAT_TA_46515.pep
ISLTIVLTSSFIALILCRILQHEFTMLMIIFGLTVIISLTSTYLSSKVVLPTKLTMMSRT

SEQ ID NO: 152098 - protein, 86 aa, Triticum aestivum
  Clone ID: PAT_TA_46516.pep
PRPTRTRGGPRESAPPAAPSPMATPPAPVPQATGNYVPTPTQTAGKAPPLSQPTYTAGTLKTEIPPACTCDDTDDGVAAEGASVED

SEQ ID NO: 152099 - protein, 98 aa, Triticum aestivum
  unsure (1)..(98): unsure at all Xaa locations
  Clone ID: PAT_TA_46517.pep
TVSLLLRTKMKYIGAYLLDYLCDYPRHCALDLTYILESLASKTDYDQIELMLCQAKGKDMTGIFGSLGEKPAPFNSLACGALXSTAAHTAGGAGGPAA

SEQ ID NO: 152100 - protein, 63 aa, Triticum aestivum
  Clone ID: PAT_TA_46518.pep
RSTRSTASHRTTSWCVPKPYKIMTLCEDLSSLMPKNKHHICEGLVPISFEITEGEEDMTTTVR

SEQ ID NO: 152101 - protein, 85 aa, Triticum aestivum
  Clone ID: PAT_TA_46519.pep
RPRTRGSPLATGTCGHHQIVSRSVLFAKFRRRRQRKSIDWSLGQASFTYGVCARHVRWKSIHLLASLLASRTYAYLQRAVRDQKL

SEQ ID NO: 152102 - protein, 65 aa, Triticum aestivum
  Clone ID: PAT_TA_46520.pep
MLPGVLVTRISVHSHREVFDAGTLNAVLVQLICTLIFDFTSHGFHMHFIKLTPYSAGTGDCLIFA

SEQ ID NO: 152103 - protein, 112 aa, Triticum aestivum
  Clone ID: PAT_TA_46521.pep
CNQSDAIRIHLIHLHLFRFSLSISTSTCYQHLPTRVEQKKTEKVRRKGGLAAGEMPGLVSFFLRLIREDGHGYRLTTRRRHGVGGLRRFRCRMQAIRRFDRMSLDAATMAGR

SEQ ID NO: 152104 - protein, 97 aa, Triticum aestivum
  unsure (1)..(97): unsure at all Xaa locations
  Clone ID: PAT_TA_46522.pep
CGDAWLFTYPPVSVARTRTLLLKVHTAFPGSMAXATYFSAVSPGMSILEKQSLVHWDHTSTLHRLLLGPWIKAFSLRLFTLKKQGDIVSLNLYPYLR

SEQ ID NO: 152105 - protein, 123 aa, Triticum aestivum
  Clone ID: PAT_TA_46523.pep
SADAWGQTPSRGGPDRCVRGSARTPAKVQPWRAAVLEQKNRGLLRRYTYPPKTWCATCDQTCSPTNTDLLGHELTLFIMLFFHMYDINNIYYTTVKDTRTKERMDSVKSYHILGTHNGLCCVD

SEQ ID NO: 152106 - protein, 54 aa, Triticum aestivum
  Clone ID: PAT_TA_46524.pep
DGVSRRRRSCQPIASSAPPALSQPPPSRSSAVVSPIKYDAIDRLLVQQGQMTGP

SEQ ID NO: 152107 - protein, 51 aa, Triticum aestivum
  Clone ID: PAT_TA_46525.pep
RPTGRTPTRAATRASGCSSPNLPPPSSHIQGRCLCRAATRIMVMWMLRPQL

SEQ ID NO: 152108 - protein, 103 aa, Triticum aestivum
  Clone ID: PAT_TA_46526.pep
AEQRQRPSETPRSTEVEWTTFWPRASETAVQCKYSIGNGREGGGVVSKEAGVVPGRAVVHGEPGAGAWPAGLILLFLLPCTLNADVALSSHSSLVESTDRIHM

SEQ ID NO: 152109 - protein, 140 aa, Triticum aestivum
  unsure (1)..(140): unsure at all Xaa locations
  Clone ID: PAT_TA_46527.pep
VRGRVGGISVGGQVLCIRSWDFGMDDAGSGGVILDCSTAVTRLQWAAYAALRXAFVQGTQCLHRASGISMFDTCYDLTKRDNVQVPSVALLLEGGSELKLPAKNYLIPVDGAGTYCLAFAVTSGAQSIIGKMHXQGVRVS

SEQ ID NO: 152110 - protein, 91 aa, Triticum aestivum
  Clone ID: PAT_TA_46528.pep
SARCHPFFLPYPSPSFVQPCTSAGPYCRGPHSPCGAGDDNVDTTRESASSQWRKGGMELQRLIKGMGLPGTKARLFGEIFSTKVGKKFPPT

SEQ ID NO: 152111 - protein, 60 aa, Triticum aestivum
  Clone ID: PAT_TA_46529.pep
RTHTYLNNCAIFLIQLNRSTECQLRQRLAPLPSVALGKLRPSDWVVEIMKSNTDIYFTHG

SEQ ID NO: 152112 - protein, 106 aa, Triticum aestivum
  Clone ID: PAT_TA_46530.pep
MPATMPLTISPPCLLHRHHGRATLQQQRPTARLALLPRRAARIRCAPDEVAATAAEPEQQGEEEEFVLLASNRSDFNEGMMVIDSPSNRYLVLDPSRNVHRILPKE

SEQ ID NO: 152113 - protein, 114 aa, Triticum aestivum
  unsure (1)..(114): unsure at all Xaa locations
  Clone ID: PAT_TA_46531.pep
MVLRGDITATNVDSDMNRPDNTLLKSDALYTYILDTNTLQRXHECMHNLXLIRDKHPWGYMQXTKTRRRMLGMLIKTVASKKTIYVGVFTDYSLLAIILALPQDGHVVNINSDR

SEQ ID NO: 152114 - protein, 70 aa, Triticum aestivum
  Clone ID: PAT_TA_46532.pep
SISGHSYTTDRSSPSTVLLRNMSSPLKYSICAVGVSGSLAVSNDSHVITSLSGVNQYDEHLDEPPDAWAD

SEQ ID NO: 152115 - protein, 81 aa, Triticum aestivum
  Clone ID: PAT_TA_46533.pep
RPPTRPPTRPPTRPRKPNAPFQIPKPPNRPAPLDPSPPPWPRPPPPPTPATTSPRRSPRAAPPAPIPTGISGPRRRRPLRR

SEQ ID NO: 152116 - protein, 63 aa, Triticum aestivum
  Clone ID: PAT_TA_46534.pep
KCHLRPSTCSSAGLPRQTVVARVYSPCRLASYPLPSISRAPCLYLIHGETIDLSHGWEQTIKP

SEQ ID NO: 152117 - protein, 77 aa, Triticum aestivum
  unsure (1)..(77): unsure at all Xaa locations
  Clone ID: PAT_TA_46535.pep
RPAGFVPIASPAPPPPPPPTXPPARPHAAPPPAPPTPSPRMHRASPSAAPLLLRRACPPPPPPPPRRPRSSRPGRSP

SEQ ID NO: 152118 - protein, 109 aa, Triticum aestivum
  Clone ID: PAT_TA_46536.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVSTWHR

SEQ ID NO: 152119 - protein, 141 aa, Triticum aestivum
  Clone ID: PAT_TA_46537.pep
SEPCLSRHFSTFENFDAYPVSNAIWHSREVDMKDLGDPVNFFGRNRMFDSILYNKLVGRPKSKDGREINPYLAKIIKMNPRMVSEIFAYALRSLAVITVENHRMGVPLGAAVKLSNLRISYSHGKFVLLNILPKSPGYKGL

SEQ ID NO: 152120 - protein, 94 aa, Triticum aestivum
  Clone ID: PAT_TA_46538.pep
KPPQAKDVEQFRVNGRSRKRISRTTVSIKEKRYAHVIYRDESIINECNCPSNWGGFCSAIDLQGYRQFTPNKISGACEEKSNASAHASANAWAD

SEQ ID NO: 152121 - protein, 140 aa, Triticum aestivum
  Clone ID: PAT_TA_46539.pep
RAKGRGGQRRAEGRGRRRARGRAQKAALRRRRGRRRARGRARTEATAGAVVLCSGVLHPRPRRHCPASPRDVSAAPAPPRRTTATAPPRRAVSAAPAPPRRGVPVALNPSPSPSPEKPVAVSIAIAIARELDKTTRIART

SEQ ID NO: 152122 - protein, 141 aa, Triticum aestivum
  Clone ID: PAT_TA_46540.pep
VRPRVRAYGVVFADPLGVQHRVYLRDGGKNEVILSAGTLGSPQLLMLSGVGPHVHLEAHSIQVLVDQPMVGQGVADNPMNSVFIPSPEPVGLSLVQVVGITKSGSFIEGVSGSEFGIPVSNGARRLAKLGLFSPQTGQLGT

SEQ ID NO: 152123 - protein, 69 aa, Triticum aestivum
  Clone ID: PAT_TA_46541.pep
VRDAAIQWLDANQLGEVDEFEDKMKELEGLCNPIIAKMYQGAGADMPGGMDEDPPAGNGGAGPKIEEGD

SEQ ID NO: 152124 - protein, 84 aa, Triticum aestivum
  Clone ID: PAT_TA_46542.pep
ALGVLPRRRAWNKHEHATCLTPNHKKDTILCLGHTLPQDIIMQDYLAEGFMMNTHYNDPELKEKLTKLCKTTTVKTMSVLMSNK

SEQ ID NO: 152125 - protein, 117 aa, Triticum aestivum
  unsure (1)..(117): unsure at all Xaa locations
  Clone ID: PAT_TA_46543.pep
FQDICRRFAARFLDHWQQRFSCSSSSPLGGIDGAAPSSRSCFACWSPTLQCDSGGVRSRQWXVVVVPGRGSEKRGRPRRRAGEGGDDGRXPRRRRGAGSRASTEKGEGSGLVDGAGR

SEQ ID NO: 152126 - protein, 84 aa, Triticum aestivum
  unsure (1)..(84): unsure at all Xaa locations
  Clone ID: PAT_TA_46544.pep
LLLYKVKEGPYRLLYSGLHIKACSSAHCSHILGVMMYIRIYSVFLNVKENTRSPQKKKKKKKKKKKKKKKKKKRKKMLKKKXIN

SEQ ID NO: 152127 - protein, 112 aa, Triticum aestivum
  Clone ID: PAT_TA_46545.pep
MVSSAKGKVCVTGASSFLASWLIKRLLECGYHVIGTVRDPGNRKKVGHLWKLPGANERLQLVRADLLEEGSFDDAVMACEGVFHIASPVLGKSDSNCKEATLGPAINGTLNV

SEQ ID NO: 152128 - protein, 94 aa, Triticum aestivum
  Clone ID: PAT_TA_46546.pep
SFLALSLSTYNCSFTPLSWQMSWKPSRIEIESGEERAKILSVAREFLGGADAGDGGRCGSRRAHTAAPRDLLRARVGMEEEGRAEDLLLGRGFM

SEQ ID NO: 152129 - protein, 95 aa, Triticum aestivum
  unsure (1)..(95): unsure at all Xaa locations
  Clone ID: PAT_TA_46547.pep
MAPSTVPRALLAVSLVLLVVGGLGPAAEAQRXGGCVPQLNRLLACRAYLVPGAADPSADCCSALSFISRDCACSTMGIINSIPSRCNIGQVNCSV

SEQ ID NO: 152130 - protein, 124 aa, Triticum aestivum
  unsure (1)..(124): unsure at all Xaa locations
  Clone ID: PAT_TA_46548.pep
VRPRVRGLVVGRVGRSIGLIVHLSHIWLHCQPPASPHACTIALSNQNSGDYPSFNLVIVGDGGXTGKTTFVKRHLTGQCEKKYXPTIGVEVHPLDVTTNCGKIRFYCWDTAGQEKFGGLRDGFY

SEQ ID NO: 152131 - protein, 47 aa, Triticum aestivum
  Clone ID: PAT_TA_46549.pep
SGHARNVVTESATGTNTATQLASKAMGSLPPGERPHAVMIPYPAQGH

SEQ ID NO: 152132 - protein, 65 aa, Triticum aestivum
  Clone ID: PAT_TA_46550.pep
RSRRRSSRWSGIVPPSTVRVVRAVDLASPACFASHPSSSCRLQIPCFPHTDRFTVEWSGVKWSGR

SEQ ID NO: 152133 - protein, 49 aa, Triticum aestivum
  Clone ID: PAT_TA_46551.pep
YFRRTYALPHERRFGCTNSSIFLLSTNSGSAHTAATPTRRTTGCGTRGS

SEQ ID NO: 152134 - protein, 104 aa, Triticum aestivum
  Clone ID: PAT_TA_46552.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVF

SEQ ID NO: 152135 - protein, 74 aa, Triticum aestivum
  Clone ID: PAT_TA_46553.pep
SAHASAHASDHASAPSTGRRDGRRRLAGLRRRGPPPRLPLADPAARLTRHRPRAGRNQRFITSTLHKIRCMHSL

SEQ ID NO: 152136 - protein, 83 aa, Triticum aestivum
  Clone ID: PAT_TA_46554.pep
RPQGFRDQMVASVRGFSGSKSNGLFINSCFAHCQSELPATWNGTPAIQNKRIAKSVGDWYFGRAEVKAIDCPYPCDNTCRNII

SEQ ID NO: 152137 - protein, 129 aa, Triticum aestivum
  Clone ID: PAT_TA_46555.pep
MEVETVMPPPAAGLDRVDSAAREPTHTESFLPSPAAGGGANGAATKVQKVYRSYRTRHKLADSAVVVEELWWEALDFARLNHSTVSFYDDPEPETAASRWNRVSLNASKVGQGLSKDAKALKLAFQHWI

SEQ ID NO: 152138 - protein, 88 aa, Triticum aestivum
  Clone ID: PAT_TA_46556.pep
MIGNGASIFTTSGVSARKFQTDIEAGQVGINVPIPVPLPFFSFTGSKASFAGDLNFYGKAGVQFFTQIKTITQQWKESSPQRVSLSMP

SEQ ID NO: 152139 - protein, 53 aa, Triticum aestivum
  Clone ID: PAT_TA_46557.pep
AIPDSCQIRHPSSKISSSAFLLNQLCLFKSAMTKLRVLNNIINHGESESRSLP

SEQ ID NO: 152140 - protein, 93 aa, Triticum aestivum
  unsure (1)..(93): unsure at all Xaa locations
  Clone ID: PAT_TA_46558.pep
MVSARGVDTTTAANKQQQATCLAPNPGKATILALGHAFPQQLVMQDYVVEGFMRNTNCNDPELKEKLARLCKTTTVKTKYVVMXDEILKSYPE

SEQ ID NO: 152141 - protein, 115 aa, Triticum aestivum
  Clone ID: PAT_TA_46559.pep
TRWAMRRSSSGSATLERHLVSSHFRRVLWQEWISAASPSMARNAERTSRSASARLAASKPPASSMETEGFIHWLLPLAAVSFGRQIRFGVCWVVPPLSSELMMVAALDEPYLHGR

SEQ ID NO: 152142 - protein, 71 aa, Triticum aestivum
  Clone ID: PAT_TA_46560.pep
MNDVEATAEEWLTINWLHGGFIFLLIVTRHVPNRMTDMSEHLYQTVSVTASPPLRKLCWVSKILTTLKSRV

SEQ ID NO: 152143 - protein, 98 aa, Triticum aestivum
  Clone ID: PAT_TA_46561.pep
GGRNRKGWASPPTGEGDVAEEARILHPPRRRQGLAVVRGKERKRGVGRAEAMAVLLGRREETGRRRAAIVLDGDAVIPSTIECGEAGERAFVVVAAST

SEQ ID NO: 152144 - protein, 122 aa, Triticum aestivum
  Clone ID: PAT_TA_46562.pep
IDFSDLALKLATDVIGQAAFGVDFALSAPREHGGREAEEFMAEHVHSTTSLKMDLSASLSIVLGLVAPALQGPARGLLRRLPGTADRRIARTNDRLRARVEEIVASRERDLDKRRGQRDFLG

SEQ ID NO: 152145 - protein, 74 aa, Triticum aestivum
  Clone ID: PAT_TA_46563.pep
RPPPHRLLRVRCAARASVACRRAHQRAATVLRPCLLPPFLLLSNSFGLPQGHRTRAPNKRHWITLACRSAMSTD

SEQ ID NO: 152146 - protein, 88 aa, Triticum aestivum
  Clone ID: PAT_TA_46564.pep
KNFFFSFTGKLTLVLLKGPPLFFFFGFFFFFFFFFFFFFFFFFFFFFFFFFFFNNKVQQCISFLPTEYMYGPQIKKILLHVLDQSCRT

SEQ ID NO: 152147 - protein, 33 aa, Triticum aestivum
  Clone ID: PAT_TA_46565.pep
GDGCSFSLDRGRYPIACWLYTCQSTRTCRVGGR

SEQ ID NO: 152148 - protein, 96 aa, Triticum aestivum
  Clone ID: PAT_TA_46566.pep
LRRGRPPLELLPPRSRAPPPRARLHPHTTEASIARAPPAPTRRPPRELLLAPPRHPPRELVPTPPRRPLRELLPLRSPVTLAGQPPHRSSSPPLVM

SEQ ID NO: 152149 - protein, 138 aa, Triticum aestivum
  unsure (1)..(138): unsure at all Xaa locations
  Clone ID: PAT_TA_46567.pep
SXARAANCRVRGACLIRRLKRPLFRFVEAFLLFFLLLTGGVGARGAGGGGDAVTWNASRVLSMETSRLAAAAAASVVIVAFADLEGDCGRRGQRRRLKVVCERSNTMDKSRRTTGKEKERRSNGNGFRGAGARTRGRT

SEQ ID NO: 152150 - protein, 27 aa, Triticum aestivum
  Clone ID: PAT_TA_46568.pep
PLGTRGFNKLKKGFRPRVIFEKRLIIP

SEQ ID NO: 152151 - protein, 107 aa, Triticum aestivum
  Clone ID: PAT_TA_46569.pep
MADVEYRCFVGGLAWATDDQSLQNAFCKYGDVIDSKIITDRETGRSRGFGFVTFASDEAMRQAIEAMNGQDLDGRNITVNEAQTRRYRGGVRRLSGRGGGRYSCQRP

SEQ ID NO: 152152 - protein, 157 aa, Triticum aestivum
  unsure (1)..(157): unsure at all Xaa locations
  Clone ID: PAT_TA_46570.pep
TRPILPTVGRRHGVELXXVGTPWVLCSSRALFLQHEDKQQQQHQGGQKGPRLRSMAVARRPTGRPCCQRSPASAGPPTTSYSASSCPPASSSATEEGGTKESGLCSSLSSTTKDAGPQPWFFCDYRTNLGAQPPRATDSPDSQEASALVHGVMTCAP

SEQ ID NO: 152153 - protein, 56 aa, Triticum aestivum
  unsure (1)..(56): unsure at all Xaa locations
  Clone ID: PAT_TA_46571.pep
FRYDKVGVEKRNMYECRQRCLSLTPPLLEESRPNEWGCTLFYXXXRSFIPVHLFPH

SEQ ID NO: 152154 - protein, 50 aa, Triticum aestivum
  Clone ID: PAT_TA_46572.pep
KVRLYGSILLRVFSQELQGNGHLISDVLPYGQIISREVVEDHRHLRRTPP

SEQ ID NO: 152155 - protein, 92 aa, Triticum aestivum
  unsure (1)..(92): unsure at all Xaa locations
  Clone ID: PAT_TA_46573.pep
PKGXRGTAXHRGVPWPRGGGTYPSEPPSTSGGPPHLHIHPVLAWCTRKGTGHLPEEDDTGYHVDSQPTIFDGGQGRWLRRSPNRGRWKGHLW

SEQ ID NO: 152156 - protein, 90 aa, Triticum aestivum
  Clone ID: PAT_TA_46574.pep
RVPLRTTTNTTVDYSSFWGLLLSSAGGIVPGVTGGRSHTQWLKAVAVLTFIEGVKGSICSTQEGDGSTTDSESVTGLKEGLHCFYVALSC

SEQ ID NO: 152157 - protein, 73 aa, Triticum aestivum
  Clone ID: PAT_TA_46575.pep
MREGISIHIGQAGIHGGNACWELYWLEHGIQPGGQMPGGKTCGGGEDSFNTFFSGTGAGDHGPRAGFGVLSPL

SEQ ID NO: 152158 - protein, 103 aa, Triticum aestivum
  unsure (1)..(103): unsure at all Xaa locations
  Clone ID: PAT_TA_46576.pep
PTPTQIHASSALSSRRNGRSAPPQLEPKVRKTLPPPNCTGLAWQSLPTAARGWIGSPRLTGGGRIRSLAAHATPLGSPHPTSCFXXPCASDAPVDKDRTRGRT

SEQ ID NO: 152159 - protein, 144 aa, Triticum aestivum
  unsure (1)..(144): unsure at all Xaa locations
  Clone ID: PAT_TA_46577.pep
VRGRVGGRVGDSKTLLFXEKEVAVXGCRNPEEIPWAAAGAEYVVESTGVFTDKDKAAAHIKGGAKKVIISAPSKDAPMFVCGVNEKEYKSDIDIVSNASXTTNCLAPLAKVINDRFGIVEGLMTTVHAMTATQKTVDGPSSKDW

SEQ ID NO: 152160 - protein, 109 aa, Triticum aestivum
  unsure (1)..(109): unsure at all Xaa locations
  Clone ID: PAT_TA_46578.pep
LGGINGGGDGLGGGAQGMALLMGLREDVLEQDILEETYVQNYIXDNTCNNAKIKGMLESLXMRTTVTAMYTELLDELLEEYTEWYTAWSPPLAIWIDMWLELGVDLGGA

SEQ ID NO: 152161 - protein, 89 aa, Triticum aestivum
  unsure (1)..(89): unsure at all Xaa locations
  Clone ID: PAT_TA_46579.pep
MASMGGSAVSFAKPGKAINTNSLSFSGPRGGNAFLRLQPGPMRFAGCWSAKHETVEKGWEIGKXQLAVPEGTEVCGTTKFSDLGADSLD

SEQ ID NO: 152162 - protein, 71 aa, Triticum aestivum
  Clone ID: PAT_TA_46580.pep
WVDLPNIHKAYSRHHGVWHEILKLGCPDHTTRLMTIISLTFFMGVFSIHMGGESLCLMDSSVGYRGGICQP

SEQ ID NO: 152163 - protein, 129 aa, Triticum aestivum
  unsure (1)..(129): unsure at all Xaa locations
  Clone ID: PAT_TA_46581.pep
MSPPTPTPASGGRLDLDGVLVALLTICVIWADGFISSHVCEKLMAETPHSVLAVDHLVDPPPPHLAGGIXFRCLNLMNNSRLEGLIKMSDLVWIVGEKLGEGIGSTRKEVQHQAAEISLRNLARDYGAL

SEQ ID NO: 152164 - protein, 57 aa, Triticum aestivum
  unsure (1)..(57): unsure at all Xaa locations
  Clone ID: PAT_TA_46582.pep
MAREVGDIYYLWFXGGLSWATDYQALHNGXXRDGYFIGSKIITDRETGRSLGFRFFT

SEQ ID NO: 152165 - protein, 113 aa, Triticum aestivum
  unsure (1)..(113): unsure at all Xaa locations
  Clone ID: PAT_TA_46583.pep
MXTSTKKXNNSWDNINNKLHLVMNSCKYTLWYKTFLRTLSNSKANLVILANNWPPLHKAEIEYYSMFAKITVHHYHGNNFYLGTSCGKYLRFCWLSIINPGDSYIINSTPSCQ

SEQ ID NO: 152166 - protein, 102 aa, Triticum aestivum
  Clone ID: PAT_TA_46584.pep
SAHAFVDAWGQKELFRQRSGSPRGGGSKSAGGRRHVPEHPPDSYSGTQLRFLPYSPRSERAIERSAMKKCASDLELEAFIRRAGARRRAEAWLRRRGREWSL

SEQ ID NO: 152167 - protein, 159 aa, Triticum aestivum
  unsure (1)..(159): unsure at all Xaa locations
  Clone ID: PAT_TA_46585.pep
PGVRGRVGGLVGAVWLSPSQSRPTVGCGTPWARAGTGAKGKKGAAGRKGCGPRKKSVTRSVKAGLQFPVGRIGRYLKKGRYAQRVGTGAPVYLAAVLEYLAAELVELAGNAGKDNKKSRIIPRHLVLAXRNDEELCKLLAGXTIAHGGVIPNINPVLLP

SEQ ID NO: 152168 - protein, 113 aa, Triticum aestivum
  unsure (1)..(113): unsure at all Xaa locations
  Clone ID: PAT_TA_46586.pep
MREGMSIHIGQARIQVWNACWELYWLEHGIQPDGQMPGDKTGGGGDDAFNTFFXETGAGKHVPRAGFGDLXPTGIDEGMTGAYRQVFHPERVIIGKGDSSNNLARGHYTIGEG

SEQ ID NO: 152169 - protein, 82 aa, Triticum aestivum
  unsure (1)..(82): unsure at all Xaa locations
  Clone ID: PAT_TA_46587.pep
RPHASAKSYSARREEPXXSPLSPPGGSRSREGAMPWRPLSPNGLGRSWSYTSTYCWARWCGRWHMSGRCKVARRSASRSCTF

SEQ ID NO: 152170 - protein, 138 aa, Triticum aestivum
  unsure (1)..(138): unsure at all Xaa locations
  Clone ID: PAT_TA_46588.pep
TRPLPSRASHPLLAYIXTSAPIRLGGGSSPWGGLVSCRRPSYRPTSQQRFPRSNSSEGSIRKERIEVLHAGSVXCFTPFWIRAVACDGSRSAQVIAVEYQGRRFLHVKGWLAGEGHDADKACKRATKLAFGGKATSEL

SEQ ID NO: 152171 - protein, 53 aa, Triticum aestivum
  unsure (1)..(53): unsure at all Xaa locations
  Clone ID: PAT_TA_46589.pep
AARASTSPPTSPPPRLLGAXRQGSXREGGYARAAADQGCASGGIRLEARRRLL

SEQ ID NO: 152172 - protein, 99 aa, Triticum aestivum
  unsure (1)..(99): unsure at all Xaa locations
  Clone ID: PAT_TA_46590.pep
GSRGGPGVRSSTTSGGATXATXTSRAPXIGGSGTAGGCAMAXPHXVATSVGASGGSHRSSSAGEAGVSVGGGRVAGSGVVDLGRAGGXCSRVGCGFWXL

SEQ ID NO: 152173 - protein, 122 aa, Triticum aestivum
  unsure (1)..(122): unsure at all Xaa locations
  Clone ID: PAT_TA_46591.pep
PGAGRACEKMCAATEXGKESFXLGEEXTAGFXXGXGSGTSNHGKTGGASHSXGKAQGGTRGYMVVGKLRATFSSGSPGGAGGFGKLEGTRGSTLAKEGYGIGKGELRSRSRXKKENHIREGY

SEQ ID NO: 152174 - protein, 118 aa, Triticum aestivum
  unsure (1)..(118): unsure at all Xaa locations
  Clone ID: PAT_TA_46592.pep
EDGLPHWRXEVAPPQSHIELLGVDGLCPVPEDPGTALAHASLPKIKALVPAADWPVPAGEQEFALDGATIIPENPTAXSPCHIVPPPPRXVHPPGXGNAXALTRXKAAMENPRVRGRP

SEQ ID NO: 152175 - protein, 114 aa, Triticum aestivum
  Clone ID: PAT_TA_46593.pep
MAASTAPVEGPVAAPVRTVKGTNVSLSATEQDIKEFFSFSGDIGHVDMKRGDEGSQVAYVTFKDAQGAETALLLSGATIVDLSGIIAPAPEDQPAPTGSAPLMRGTRGPAGGDN

SEQ ID NO: 152176 - protein, 96 aa, Triticum aestivum
  Clone ID: PAT_TA_46594.pep
MDAWATGAGAEANNGAAGRKGCGPRKKSVTRSVKGGLQFPVGRIGRYLKNGRYAKRVGTGAPVYLAGVLEYLAAELLELAGNAAKDNKKSRIVPRH

SEQ ID NO: 152177 - protein, 61 aa, Triticum aestivum
  unsure (1)..(61): unsure at all Xaa locations
  Clone ID: PAT_TA_46595.pep
MPHIPKKIKPQRPAGGSINSMAGDGQILHHKGDFNHKKKQKLQQSSYKKQGWGAXQQNGDG

SEQ ID NO: 152178 - protein, 149 aa, Triticum aestivum
  unsure (1)..(149): unsure at all Xaa locations
  Clone ID: PAT_TA_46596.pep
FPGRAGVHPRVRITLSLEWGEARGGGLHPVARVFTLEGGSNHSSKGDWWVGIGGKGDNGTKVLDDHPGGDDVLVASTGNGATGYFXDVGDSTTGRAXMDEYYVGEIYSTTIPTKGKYTRAKDADYNQDKTPEVRIKILQFLGPLWILGL

SEQ ID NO: 152179 - protein, 101 aa, Triticum aestivum
  Clone ID: PAT_TA_46597.pep
HHIPNEFFPLYPAGASYALFYTFSHTRMFIIDIPLFFIAHMHAQHPLLYICDITKWGVSTYISPLFIYPISACRSFDKRMISFDQLPAAISSQITTTILIS

SEQ ID NO: 152180 - protein, 109 aa, Triticum aestivum
  Clone ID: PAT_TA_46598.pep
MRGFPLAILLLALLLAAGELHCAATAPAPPAKASSPPPPTPPQHTPPSPPRRHRPSHGRAPPVPRKQDPPSSPPPQKQDPPPPSPPPQQDPPSPPPQQIMPPIQLVPPI

SEQ ID NO: 152181 - protein, 124 aa, Triticum aestivum
  Clone ID: PAT_TA_46599.pep
CRSGAHTTGSLVSHGGGDEVHERGVRRPRPDGGGGGPVEEGLAIAIWWLRRALRQVRSLEELIQNEMVPCPIDIVNNAIDDHLAKRLTKLCGSVNKLVVGSAEYKRIIEMNLGITCLYVDVPDC

SEQ ID NO: 152182 - protein, 69 aa, Triticum aestivum
  Clone ID: PAT_TA_46600.pep
SGNDMVCQNQLSQREAAVNKFRQKRKDRNFGKKVRYQSRKRLAEQRPRVRGQFVRQSGQEDEAGQAEDR

SEQ ID NO: 152183 - protein, 131 aa, Triticum aestivum
  Clone ID: PAT_TA_46601.pep
RPATSPLPPNPSDPIRPLAAPRRKRASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 152184 - protein, 118 aa, Triticum aestivum
  Clone ID: PAT_TA_46602.pep
CVSFKQRLFNQHRDNKPNMTLKKRFYHKLASVCPRTEVDNNISPLDFASPPKFDNSYYKLIVEGRGLLNSDQVLWTGKDPEIAHLQDKFHTTKHGSYCPISSIICPLCCWCGNRSVLP

SEQ ID NO: 152185 - protein, 148 aa, Triticum aestivum
  unsure (1)..(148): unsure at all Xaa locations
  Clone ID: PAT_TA_46603.pep
SAHASEKKLLYKSQIDLXIRKKKSGQKKITGFQFAPGSSLEVLITSADSRIRVVNGDXLVHKFKGFRNTSSQISASVAPNGKYVVCASEDSHVYVWRHDNSSHPSRSRSAVDVTNSYEHFHCRDVTVAITWPGAEARGSLVCRSSRHS

SEQ ID NO: 152186 - protein, 59 aa, Triticum aestivum
  Clone ID: PAT_TA_46604.pep
MAPTVMAWSDTSVAPFQGLKSTAGLPVSRRSNGASLGSVSNGGRIRCMQVWPIEGIKKF

SEQ ID NO: 152187 - protein, 82 aa, Triticum aestivum
  Clone ID: PAT_TA_46605.pep
VRGINFLCIFSSALSPSLGLLAQMAIKLRHFFLLGLAPNGAFLWIHVHLLFAHFQLVTHSCASPLCSFSIGDAYSRCGRQLS

SEQ ID NO: 152188 - protein, 160 aa, Triticum aestivum
  Clone ID: PAT_TA_46606.pep
VGRPARQLYMVLDTGSDVTWLQCQPCADCYAQSDPVYDPSVSASYAAVGCDSPRCRDLDAAACRNSTGSCLYEVAYGDGSYTVGDFATETLTLGDSAPVSNVAIGCGHDNEGLFVGAAGLLALGGGPLSFPSQISATSFSYCLVDRDSPSSSTLQFRDAE

SEQ ID NO: 152189 - protein, 58 aa, Triticum aestivum
  Clone ID: PAT_TA_46607.pep
MHLLHSITRYEVADWVKFRRTVTSPDFGWQGAGPKSIGFVQSIVDNDHLIVSFCSGEA

SEQ ID NO: 152190 - protein, 79 aa, Triticum aestivum
  Clone ID: PAT_TA_46608.pep
KTRKKITHMKASHSMGADGKKSLDFYTKHHTEEASRGPAELRRRRGAGRRPGEPAARRTANWGSREGGTAAGEGKSSAD

SEQ ID NO: 152191 - protein, 85 aa, Triticum aestivum
  Clone ID: PAT_TA_46609.pep
MGPQTPGYMSSMYSSVMYNANAYGPDYWYGSHLYGSGMYGGWNVLSDGKYKPRPKTYGSYRFGNENIDGLNELKRGPRSTAIKNE

SEQ ID NO: 152192 - protein, 150 aa, Triticum aestivum
  Clone ID: PAT_TA_46610.pep
VRAGRASHTCSPRPPYPSYSRTPRASAMSLAAAASPSCRFLSPSTAARRRFLHHLLAAPPRPPQLRRCSPYHWMAQFWTEGSLEKNNALVEYLKQYGVVRTDKVAEVMETIDRALFVPEGFTPYIDSPMPIGYNATISAPHMHATCLELL

SEQ ID NO: 152193 - protein, 32 aa, Triticum aestivum
  Clone ID: PAT_TA_46611.pep
TTLGQTSSSETVKTSRQAVNINRARGAMCRDH

SEQ ID NO: 152194 - protein, 116 aa, Triticum aestivum
  Clone ID: PAT_TA_46612.pep
MDGVLVAVKDEIDCLPYQTTGSVRMPAALCGVVGFKPTAGRLSNSGLLPLNWTVGVPGILAATVEDALIAYAAMVDQSRPAHSQPQLNLPMLTSTHCMPNIRLARYGKWFNDSDNI

SEQ ID NO: 152195 - protein, 39 aa, Triticum aestivum
  Clone ID: PAT_TA_46613.pep
WGGKGWCKKCVSGDGGAQQRGRGLTTRWTSRTSGSNREL

SEQ ID NO: 152196 - protein, 132 aa, Triticum aestivum
  Clone ID: PAT_TA_46614.pep
RPRTRGRTRGLIVPHIGWNALQITKDTQLLQGADGHHVYFVHSYHALPSDANRDWISSTCNYGESFISSISMGNIEAVQFHPEKSGATGLSIFEKFLSPNSSGAKAPAHRKASKLAKRVIACLDVRSNDNGD

SEQ ID NO: 152197 - protein, 49 aa, Triticum aestivum
  Clone ID: PAT_TA_46615.pep
FGWNQDVLVHTCPGLLFSLAREQVYYICNTMRIVASISQAEVLPRPLSD

SEQ ID NO: 152198 - protein, 130 aa, Triticum aestivum
  Clone ID: PAT_TA_46616.pep
VRVITYFFYKNLTFTLTQFWFTFQTGFSGQRFYDDWFQSLYNVIFTALPVIMVGLFDKDVSASLSKKYPQLYQEGIRNTFFKWKVIAVWGFFAFYQSIVFYYFTAAASQHGHGSSGKILGQWDVSTMAFT

SEQ ID NO: 152199 - protein, 140 aa, Triticum aestivum
  unsure (1)..(140): unsure at all Xaa locations
  Clone ID: PAT_TA_46617.pep
SKIPLSFKHQPIPRPPRLGPPASSPDSSRNSTSPSPAPQPPSPRSRWPSPPMSWSSQSRSPAPPSXLPWRPRCTSTPSSPQPLPASSSNQQAVLAVPALSVSPPLRFPHVALPLSSALALFFAGNRAPQRRHEPSATREP

SEQ ID NO: 152200 - protein, 109 aa, Triticum aestivum
  Clone ID: PAT_TA_46618.pep
RPPPHESAHTLHILRQFPKPTAAAPLSSNPTTPAVAPPPPSTGDLLVLQRRTPTFSFSPKRRERGKAPDRARPDPRRHRRAIVDLGCDHHGRRRRLLHGGPTRQDQAAA

SEQ ID NO: 152201 - protein, 48 aa, Triticum aestivum
  Clone ID: PAT_TA_46619.pep
SKLTYASIRRRSSFIEAPKFNPLAFSFHLSLCNTKWLNYCFINHQNLR

SEQ ID NO: 152202 - protein, 138 aa, Triticum aestivum
  Clone ID: PAT_TA_46620.pep
VRPRVRPRVRPRVRPRVRSRPPVEQLINNVPSTDAAVEVPVLKDTPNVQNEVPAMEKKVPAPQEKISAVVPNIPSPVRESPILQEVPVLLHEEPAILAESPPPLKDESPPSLKHESPPPIKDSSAITIEQLSPLKEET

SEQ ID NO: 152203 - protein, 115 aa, Triticum aestivum
  unsure (1)..(115): unsure at all Xaa locations
  Clone ID: PAT_TA_46621.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGFXGGGGGGGYGGQRLERGGGGS

SEQ ID NO: 152204 - protein, 66 aa, Triticum aestivum
  Clone ID: PAT_TA_46622.pep
SQAVSLSEKASERQRSVPALPCVRQRQGRTAGVITPMAVAGVPASWRRGETRESGGSRARGRVGGR

SEQ ID NO: 152205 - protein, 105 aa, Triticum aestivum
  unsure (1)..(105): unsure at all Xaa locations
  Clone ID: PAT_TA_46623.pep
DLSSNSFSRYCASSNCCIFCSSRSPLVQEPNGESMPPVALQRPNMKDVGVHVXPLDTEGFLLERAVSASRKSGIGLGNERIHAQLQNVYFTAASSSRSCQIPSPH

SEQ ID NO: 152206 - protein, 143 aa, Triticum aestivum
  Clone ID: PAT_TA_46624.pep
RPVAPDDGLSGEAGLLPLSRATALLASLLGDALKRRRETHEEGADASLDALVQNLTWDLSRLVLKMFDLGQEYRSCATRVLLQPMLTSLADVSCVTVEFGAVQLKLSRSGFLESIWNSCVSLFSLGRPERLDAYAILSLYFSV

SEQ ID NO: 152207 - protein, 150 aa, Triticum aestivum
  Clone ID: PAT_TA_46625.pep
RPQLSKNPFHPLHTHTHTHTQRERERERERERERKPGRTRKQEDGAGAAQALRLLLLHQGDEGKQPNHDPPSLPPSLPIHPFLHLRRSISRLLGAFSMRRSSWNQLTSRCSCLNRISHALEPRANPDRRSSQCANLDLCSGFYDGPWRGP

SEQ ID NO: 152208 - protein, 95 aa, Triticum aestivum
  Clone ID: PAT_TA_46626.pep
MGCLFDCFPRPGGEPRAGRARAQLVSSSVVPSPIVGERRAPSSRNALSAVFLGEDEGSHATSSVSTRTPEQQGYPELRHERHFLKMGCTAELNES

SEQ ID NO: 152209 - protein, 63 aa, Triticum aestivum
  Clone ID: PAT_TA_46627.pep
ATSTTTICTHCLGILWFDSMYSIQNRSNLQDILGYKWSAVDVVACAFAPKGPEEPHLPSTTSE

SEQ ID NO: 152210 - protein, 143 aa, Triticum aestivum
  unsure (1)..(143): unsure at all Xaa locations
  Clone ID: PAT_TA_46628.pep
FFIWLFSMQGERTFSWCPSSLRLFSXSNSQFIFSACCSTLSGYKFAFCDSDIAMVLLSSSRAPIFFKCLSPFRWTSKSDSRPQITWQSLQPHTEGGFSACCDTLLSSDFASRGAMPIWLLLPSLHGAAMRLLTSVISPSWSGR

SEQ ID NO: 152211 - protein, 126 aa, Triticum aestivum
  Clone ID: PAT_TA_46629.pep
VRAPATPDAAPPGPEKKRKRKSKANAKKNSKKKKKRADGAASASDVVEGFSVFKGAEAKEATEESVEVVVREDEDSAVVRRRKEAEREIERAAILRKRYDIHISGHNVPAPLESFEELVSRYDYDS

SEQ ID NO: 152212 - protein, 111 aa, Triticum aestivum
  unsure (1)..(111): unsure at all Xaa locations
  Clone ID: PAT_TA_46630.pep
CVHVVLCQLLFNITRYSEQRDDIKEVREHYKQHGDIDMALRNFPRHLVAEKAILQCLRKCPENYLQALKGIPRPLIMMYVHSYQSYLWNHAVSMRVEKXSQVVEGDLIYTK

SEQ ID NO: 152213 - protein, 74 aa, Triticum aestivum
  Clone ID: PAT_TA_46631.pep
VELVAEGLPRSVGMLATAEARPSQVVVLLLGWLARRRLAAGGGGFRLDLCAVVQCAFLTGVRPRRSTGIPDGLR

SEQ ID NO: 152214 - protein, 79 aa, Triticum aestivum
  Clone ID: PAT_TA_46632.pep
GSTHASADAWEKRDSPQPSPARDSPLCPYSPPVALPRRPLAVAGRPEGQDPPAASRPAQPRPANSGTIGPVSLAVQSAL

SEQ ID NO: 152215 - protein, 63 aa, Triticum aestivum
  unsure (1)..(63): unsure at all Xaa locations
  Clone ID: PAT_TA_46633.pep
EKTVTGKTMTLEAETSDTIDNVKAKIHDKEGIPPDQQRLIFAXKQLEDGRTLADYNIQKESTL

SEQ ID NO: 152216 - protein, 113 aa, Triticum aestivum
  Clone ID: PAT_TA_46634.pep
SRVLKSVIVILCTYSIVLAEFGASCSSLYLIWERVLKGHPISIVYSKGWFERRYGYGLTLLSSYAIRGLVIHKQCLRMLPTILPCRKSLYAKGPSLARARFIRIWLMGLWAPD

SEQ ID NO: 152217 - protein, 82 aa, Triticum aestivum
  Clone ID: PAT_TA_46635.pep
RTPGALQKQHSCTPGASQHLSGTTPDEETGDESTKGEKQVVEILKGANGHRDIKEDKETMELAGTNDETTTHRYEDHDKRCA

SEQ ID NO: 152218 - protein, 83 aa, Triticum aestivum
  Clone ID: PAT_TA_46636.pep
VRMICCCNKMDATTPKYSKARYEEIVKEVVSYLNKVGYNSNKVPFDPISGFEGDNMIERSTNSDWYKEPTLLEVLDQINESNK

SEQ ID NO: 152219 - protein, 55 aa, Triticum aestivum
  Clone ID: PAT_TA_46637.pep
MASETETFAFQAEINQLLSLINNTFYSNKEIFLRELIFNAFDALDKIKFGSLADK

SEQ ID NO: 152220 - protein, 59 aa, Triticum aestivum
  Clone ID: PAT_TA_46638.pep
RARTRGRTRGRDARVVPGVGGTRGKSLRAERRHSYDIDRSKGRTPGHLAWGYTERGACE

SEQ ID NO: 152221 - protein, 58 aa, Triticum aestivum
  Clone ID: PAT_TA_46639.pep
CGRAADFSRDVWSSRWTRLARNDKCEDVDDACRYRCLVPEHPCEAPWCHGPLGAFGEL

SEQ ID NO: 152222 - protein, 129 aa, Triticum aestivum
  unsure (1)..(129): unsure at all Xaa locations
  Clone ID: PAT_TA_46640.pep
SVAGRGGKEERGDTEPRAQGHSAETRQERRGATLRIFQAGFRKKEMRILRQTRSGXDHILYKLKLGEIXTTIPTIGFNGETGEYKNISFTARDVGGQDKIRPLWRHYFQNTQGLIFVEDKNNRERGGEA

SEQ ID NO: 152223 - protein, 56 aa, Triticum aestivum
  Clone ID: PAT_TA_46641.pep
PFFFFYTYRLNYYSRYNSNTILVACLIKISLPLIRLILQSRSMIYTISYIVWVQRS

SEQ ID NO: 152224 - protein, 45 aa, Triticum aestivum
  Clone ID: PAT_TA_46642.pep
AKTHCWLQYKFGFYVKYKFGNSEIIVQIWFLAKIQLDKQITSPGS

SEQ ID NO: 152225 - protein, 42 aa, Triticum aestivum
  Clone ID: PAT_TA_46643.pep
AEKRGVTLKQVALRVSNLLIARRRLFLARASMTSERVRYRYT

SEQ ID NO: 152226 - protein, 170 aa, Triticum aestivum
  Clone ID: PAT_TA_46644.pep
RPPTRPRTRGAVQAVKTTNSKGEVKYPIKSINILKAHGKSAKESYLLNGYALNTGRAAQGMPTRVTPARIACLDFNLQKMKMQMGVQVLVSDPRELEKIRERESDVTKERIEKVLKAGANVVFTTKGIDDMSLKYFVEAGAIAVRRVRKEDLRHVAKATGATMVTTFADM

SEQ ID NO: 152227 - protein, 154 aa, Triticum aestivum
  unsure (1)..(154): unsure at all Xaa locations
  Clone ID: PAT_TA_46645.pep
SGPSWNSRRGPRGNXVRPIRNNGGSACNAIKSRGVAGKNDDSMEDSIKKCLEMLXGPDGELPEKLRNWEPRLIEHVSNEIMDKDPNVRWDDIAGXDHAKKCVTEMVIWPLLRPDIFRXCRSPGRGLLLFGPSGTGKTMIGKAIAGEANATFFYI

SEQ ID NO: 152228 - protein, 181 aa, Triticum aestivum
  Clone ID: PAT_TA_46646.pep
SNDCLSVIPPLPSDDLRGAMGHQSAVIMCDPHGEGYLLAELIKKGGGLAGVWLWKSSAPEPKWVSVPGSHPLPPSRFTVDSCFSYRGSTLCWVDLLKGMLLCDLNQDCDNKFSIKLPQDCPALDWNLKEFSFVKLPQDCPALDRNLEESSYIIKFCTRPEEFRSMACVCDHIKLVSLDESG

SEQ ID NO: 152229 - protein, 92 aa, Triticum aestivum
  Clone ID: PAT_TA_46647.pep
ERNAAPFFYSGYKRNLQVTPLTKTYSAKRGEALPLGKTRGKLGLEPGSVKAEASESDTYKHSDHGRRGSKATYNSEDEHINSKKERLIALKE

SEQ ID NO: 152230 - protein, 61 aa, Triticum aestivum
  Clone ID: PAT_TA_46648.pep
RMYKRTTTSTITIMKSRERRLFSFDREYCTDHSSLKLKKLATVVSKAPGHKKLKLTIAKQY

SEQ ID NO: 152231 - protein, 75 aa, Triticum aestivum
  unsure (1)..(75): unsure at all Xaa locations
  Clone ID: PAT_TA_46649.pep
LLGARRSSVCKESGRVLTVAMQVAQSVVRSVNRVRAAGISLVRDERAEVVVRRSSSSDAGSITAPAGEXKTHLHQ

SEQ ID NO: 152232 - protein, 89 aa, Triticum aestivum
  Clone ID: PAT_TA_46650.pep
MQQMALSAFVTTPSSSYSNNLPGLTARRSQRWHARRLRSKGRAQAQQELQYKKLGDSDLLINEITLGTMTWGEQNTEKEAHDMLPYSSD

SEQ ID NO: 152233 - protein, 116 aa, Triticum aestivum
  unsure (1)..(116): unsure at all Xaa locations
  Clone ID: PAT_TA_46651.pep
SARAYAPIQRLARSLSCSVRPSPCRRGPSPRAQMCARLLPRFTSFRGAELLSCLFVWLAGTLFPFRAEPSTLHPVPLLTSRSVVSTGSRELRPRGAPPLEFPTGLVLSVGDGEARX

SEQ ID NO: 152234 - protein, 38 aa, Triticum aestivum
  Clone ID: PAT_TA_46652.pep
FQYVYILTAFRSSSCQCMIQNLHRPTMEHIHAYVLCVC

SEQ ID NO: 152235 - protein, 70 aa, Triticum aestivum
  Clone ID: PAT_TA_46653.pep
LITTMYFQGRGRTRKSYIHPSDMTCSFTSSRPSYICNESRKTSQYLTNTTRAQNVALSITKELHFRKYVC

SEQ ID NO: 152236 - protein, 55 aa, Triticum aestivum
  Clone ID: PAT_TA_46654.pep
VGGRVGGPAQAFVVEARVDRGRGPLATTIVKSGTLVSGQYIVVGAEWGRIRSLRD

SEQ ID NO: 152237 - protein, 51 aa, Triticum aestivum
  Clone ID: PAT_TA_46655.pep
HELKTTVGATFSQEKCLGRKMLKTVTDSDELVYLFLARTYPLPSYLYSLSP

SEQ ID NO: 152238 - protein, 57 aa, Triticum aestivum
  Clone ID: PAT_TA_46656.pep
VRPRVRGDVPNIRKKRQTSGNCTQLCNFALRKSGHWRDNLLLNNSHIHLLYGHRAGR

SEQ ID NO: 152239 - protein, 63 aa, Triticum aestivum
  Clone ID: PAT_TA_46657.pep
AHTALPRDTASPAQPLGGRALPQPHLLQPSCPPRRPVLLPLGAEVPSFLPMSERPCLLLPVAR

SEQ ID NO: 152240 - protein, 68 aa, Triticum aestivum
  unsure (1)..(68): unsure at all Xaa locations
  Clone ID: PAT_TA_46658.pep
MGFAQLVIGPAGSGKSTYCSGLDQHCETVGKRIHMXNLDPAXEHFSYPCXSLVLGELISLDGGREELG

SEQ ID NO: 152241 - protein, 110 aa, Triticum aestivum
  unsure (1)..(110): unsure at all Xaa locations
  Clone ID: PAT_TA_46659.pep
RHYAPIEPVLNTEKQSLLDTDVDGTHKGDMYITXAXLKDAGSKTLNDHIDALFKRARQVKQAITAEDXQAMECIDVTPNFATPIELIKTLSIDGCGKIYVEIERARSIKI

SEQ ID NO: 152242 - protein, 130 aa, Triticum aestivum
  Clone ID: PAT_TA_46660.pep
SGDNDDCPPDKISFSIVLPALLRAGEISAAWKTFKRMEHAGFEADSRALDTLARGLCRQCAADISVLKDAKEVFGKVVAAGHEPVSYTYCLMAHALARGGEVDSSRAILDDMVRKGFCLGKRAYTDVVRA

SEQ ID NO: 152243 - protein, 104 aa, Triticum aestivum
  Clone ID: PAT_TA_46661.pep
SDDPGATTVIESVFNFNLSIPLNFLFDSFGGNILVIQGIKDPLIKSESFVSMLREHCSKVQIRELNAGHAPHDEVPDEVNSLLSEWMKTNKTELKPALEKSKAI

SEQ ID NO: 152244 - protein, 82 aa, Triticum aestivum
  unsure (1)..(82): unsure at all Xaa locations
  Clone ID: PAT_TA_46662.pep
RLGAGSYMIIAVDSNSTRLEEYRKLXCTEIVNQDDHRQPVYEALAVMTNGXIYRITECTINCYAMIQDYERVHDGCRVDELE

SEQ ID NO: 152245 - protein, 136 aa, Triticum aestivum
  unsure (1)..(136): unsure at all Xaa locations
  Clone ID: PAT_TA_46663.pep
MFGCGHHGHHGQNRPVHSTDGVGGNQPTFKIFCKADEGYCLCVRDGGVVLAHSNPRDEHQHWVKDMRSSCQIKDEEGNPAFAIVNMDTGLAXKHSLGQSHPVELVPFNPQYLDESVMWTESSYVSKGFRCIAMVNN

SEQ ID NO: 152246 - protein, 91 aa, Triticum aestivum
  Clone ID: PAT_TA_46664.pep
MTNTVFYFNNKKSQLIISTIVHTSTKEFSKPCPLMSKQKFIDQTPSNMKALLITKSTAVNSAGVSAICSRSKLVLTQEGKHPFVLGSHELA

SEQ ID NO: 152247 - protein, 83 aa, Triticum aestivum
  Clone ID: PAT_TA_46665.pep
HPRLRRDGAKAASLFPHRSWKNIYARSISCSSGKVKAIHTYHSARWLQLSRDSQFDFDRKNSRINCAKRQITMVHVWCEQYAP

SEQ ID NO: 152248 - protein, 181 aa, Triticum aestivum
  unsure (1)..(181): unsure at all Xaa locations
  Clone ID: PAT_TA_46666.pep
SAHASAHASGNSALRELSSPGKSGSVFFLSQDDRFMIKTLRKSEVQVLLRMLPNYYNHVHTYENTLITKFFGLHRVKPSSGQKFRFVVMGNMFCTELRIHRRFDLKGSSLGRSTDKIEIDENTTLKDLDLNYSFYLEPSWREALLKQIKTDSEFLKSQRIMDYSLLLGVHYRAXQHLRTRA

SEQ ID NO: 152249 - protein, 114 aa, Triticum aestivum
  Clone ID: PAT_TA_46667.pep
MATETETFAFQAEINQLLSLIINTFYSNKEIFLRELISNSSDALDKIRFESLTDKSKLDAQPELFIHIIPDKATNTLTIGDSGIGMTKTDLDNNLRTIRRSGTKEFMEALAAGA

SEQ ID NO: 152250 - protein, 129 aa, Triticum aestivum
  Clone ID: PAT_TA_46668.pep
MAAAAEKTAEEIRRELQELQRQHREISERLRDPRGLRRGAPATGPGGPRPLRGFARQAPEPVDQPEPKRRLLSAVVKVDGPGTNGDDAGAEGREDGPTAAQGGERRGASNGGGFRRDGSQWVSRRELDY

SEQ ID NO: 152251 - protein, 138 aa, Triticum aestivum
  Clone ID: PAT_TA_46669.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISASSKDAPMFVCGVN

SEQ ID NO: 152252 - protein, 102 aa, Triticum aestivum
  Clone ID: PAT_TA_46670.pep
RPRTRGFWRNLLQSMGIELHYSTAYHPQTDGQSERVNQCLEQYLRCAVQDNPRHWRRWLSMAEFWYNSSFHTALQCSPFQALYHIAPNFGGMPNLTVSNDSP

SEQ ID NO: 152253 - protein, 61 aa, Triticum aestivum
  Clone ID: PAT_TA_46671.pep
MVVVVRHKAVRLTLHLRLRLRFRYACSHIRTSSPVTRARACTSVNAHEHPRPGERNRCSAD

SEQ ID NO: 152254 - protein, 122 aa, Triticum aestivum
  Clone ID: PAT_TA_46672.pep
RAHHSLSLPSPSLSEGEARGGRRGAMELDEQAFLEELFSLRRDATAAWECNAMGDFFSPACAGAAAMDCFQERHQPTVSVLPTFTVSFDHPQQQAGVTAAGGFDCLSEVYGGGPYPMPSAGG

SEQ ID NO: 152255 - protein, 55 aa, Triticum aestivum
  Clone ID: PAT_TA_46673.pep
NSQVHINCNHLVVIRLSKHRSTMLEIHVCSKKDRQCDNTLGRACVSDWIPGEPGI

SEQ ID NO: 152256 - protein, 93 aa, Triticum aestivum
  unsure (1)..(93): unsure at all Xaa locations
  Clone ID: PAT_TA_46674.pep
TERHVVNRITCGDCICPTHYXXGIKFDAHISCSCGMSGGEYLYTTXFHKXDASSPHTAYDQVLAELRFYGMNSFARTTNATIVEVCRILISFL

SEQ ID NO: 152257 - protein, 100 aa, Triticum aestivum
  Clone ID: PAT_TA_46675.pep
MAPKRGGKAPVPAKKKTEKVTNPLFEKRPKQFGIGGALPPKKDLHRFVKWPKVVRIQRQRRILKQRLKVPPALHQFTRTLDKNLATNLFKMLLKYRPEDK

SEQ ID NO: 152258 - protein, 88 aa, Triticum aestivum
  Clone ID: PAT_TA_46676.pep
CHQPRTLIVLYVLPRTLDSIESCLTFRAWHAFDRLSSFGCLAGLNVRGRTRCHSAAAARSRAWLLPPPPPPFRGSFLEARGGPRVRGR

SEQ ID NO: 152259 - protein, 69 aa, Triticum aestivum
  Clone ID: PAT_TA_46677.pep
ALFMVDGLCCAELGAAAKAGSKSWIIIIMHLHAKPRESTKQSDIMRPNLTYRSGNPCEQQIQHVKQHRT

SEQ ID NO: 152260 - protein, 101 aa, Triticum aestivum
  unsure (1)..(101): unsure at all Xaa locations
  Clone ID: PAT_TA_46678.pep
VRGRVGGLVGGRVGDKEDSIEEYEKIAKQKREKKLEQQEXAEANFINSLNHVQKIEILSGINDMKNELQSFMESFDPSKPVTSDDVKSILKNLARKKQRLS

SEQ ID NO: 152261 - protein, 102 aa, Triticum aestivum
  unsure (1)..(102): unsure at all Xaa locations
  Clone ID: PAT_TA_46679.pep
VRPRVRRNAPQAQLVSRRRVPNLQHPQRAPAATPSTKGVGDAKYRVVMRHNGVYVTFDKDGALDGERMIDYRINKSXEKNNDVKRNQDISVMGKRPIEERRH

SEQ ID NO: 152262 - protein, 94 aa, Triticum aestivum
  Clone ID: PAT_TA_46680.pep
MATGDIACLEHVMDCCLPASPVSPNAHLSDATSSTDGEDRISPLPDTLRRNDDSRLPVKDAARTGALSHRWRGLWRATPLALDDAHLLPDPGPA

SEQ ID NO: 152263 - protein, 37 aa, Triticum aestivum
  unsure (1)..(37): unsure at all Xaa locations
  Clone ID: PAT_TA_46681.pep
MRVGTHNGRFHCDEALGXFLIRLTSHFAGTDVIQTLD

SEQ ID NO: 152264 - protein, 70 aa, Triticum aestivum
  unsure (1)..(70): unsure at all Xaa locations
  Clone ID: PAT_TA_46682.pep
MRECISIHIGQAGIQDGNACWELYCLEHGIQPDGQMPGDKTVGGGDDAFNTNFRETGAXGKHGPRAAIRR

SEQ ID NO: 152265 - protein, 66 aa, Triticum aestivum
  unsure (1)..(66): unsure at all Xaa locations
  Clone ID: PAT_TA_46683.pep
MATSKKVVTREEWEGKLRDVKIRTEDMNRLVMNFLVTDGLLRTARPLSYLVXTQPEIDLVTITDRM

SEQ ID NO: 152266 - protein, 117 aa, Triticum aestivum
  Clone ID: PAT_TA_46684.pep
VRKMHSKGYVHGDVKPENFLLGPPGTLQEKKLFLVDLGLATKWKDTGTGELVEYDQRPDVFRGTVRYASVHAHLGRTGSRRDDLESLAYTLVFLLRGRLPWQGYQGENKGFLVCKKK

SEQ ID NO: 152267 - protein, 54 aa, Triticum aestivum
  Clone ID: PAT_TA_46685.pep
YYAHFAIIYLYYPGQKCFTDICVMSNYRCIGHLYNPHIKVWNICAMSNFPSLTF

SEQ ID NO: 152268 - protein, 78 aa, Triticum aestivum
  Clone ID: PAT_TA_46686.pep
QKQHCIADLVTYSRHFFFLFEDLADCEASEATASLALAILELLMGTSVAWPASSASSASSALTMRFLLSEGSADGPGR

SEQ ID NO: 152269 - protein, 77 aa, Triticum aestivum
  Clone ID: PAT_TA_46687.pep
ERISSTNLRISPVYNHIIPLTHSSKNPSTADPICRSTKPILDEVRQSRQRQSTAKWGLPMPQMETIGSSLLLIRLKV

SEQ ID NO: 152270 - protein, 60 aa, Triticum aestivum
  Clone ID: PAT_TA_46688.pep
RFHYGLHTDVYRHTLECRFTHFATYVVFFFRKGGGPPASTSLKGPICRNRGSIFLTFIQT

SEQ ID NO: 152271 - protein, 53 aa, Triticum aestivum
  Clone ID: PAT_TA_46689.pep
VEVRVGVDVYVDKEPARGVAVKALLSGLEAVGPLGGEVHQDAGGHAGPRVRGR

SEQ ID NO: 152272 - protein, 94 aa, Triticum aestivum
  Clone ID: PAT_TA_46690.pep
SGRLVPPRGRRRRREARRGWRRRRGGAPQPLYEGGGHRGGGAPHGGRRRRRRPSRRLLGAPQEGALRAGLRLLLPCAFHLIRPQSSGSPASTRS

SEQ ID NO: 152273 - protein, 68 aa, Triticum aestivum
  Clone ID: PAT_TA_46691.pep
AFFYPHRNSSRSLRIGDHRSGAWGGTPSLPLAPDRSVSARAWRVSDRPRTSWGPSIKLYSRKKEIPRK

SEQ ID NO: 152274 - protein, 58 aa, Triticum aestivum
  Clone ID: PAT_TA_46692.pep
TEPIIYYHPYSDACTALKNQWWGMIQHGINSSKDVSQLLEFIRTVPLVNSKIVLAYSL

SEQ ID NO: 152275 - protein, 122 aa, Triticum aestivum
  Clone ID: PAT_TA_46693.pep
KEHRTDEMDNKLLELYIYEKSRSPGRFFDLVYHENARVLLHDESIYRFERRSNPTRLSVQLMEYGHEKPEVTAVSIDPNFSAYLYDEYLSSILDSKVSEVCVLERNKRKRGSSNGPQASLAV

SEQ ID NO: 152276 - protein, 89 aa, Triticum aestivum
  Clone ID: PAT_TA_46694.pep
MATLSVPAAVPAVAEDCEQLRKAFAGWGTNERLIVSILAHRDAAQRRAIRRAYAEAYGEELLRAIGDEIHGKFERAVAQWTLDPAERDA

SEQ ID NO: 152277 - protein, 80 aa, Triticum aestivum
  Clone ID: PAT_TA_46695.pep
RFGAIGILHCTALLLDKLYLELSCCHRYCVCLSFKKEMIMGALLPDVPVGVPCVFRLADRLHGQGHFDSRPDPSRHHMLA

SEQ ID NO: 152278 - protein, 118 aa, Triticum aestivum
  unsure (1)..(118): unsure at all Xaa locations
  Clone ID: PAT_TA_46696.pep
MTPPPLYADDPSCGPNSDAPSLPAQVQVSLRDDILEEILLRLSTGDDLVRASSSCSXFGHVVIPHSFRRHYRSLHKVPVLGFLRACLYADHFLHPFGPVFNALEQAADFAFRFLPNLT

SEQ ID NO: 152279 - protein, 152 aa, Triticum aestivum
  unsure (1)..(152): unsure at all Xaa locations
  Clone ID: PAT_TA_46697.pep
RPPTRPPTRPQRYLVVTRSPILGGLAAMRDSEVDYTVEAIMVNPQNESPWRYLRGLYKDDNNLLVADNRISDACLKVLNKDWTCVFALSFLLDLLRMGLQPSNELKGTIEAMENSDPETGHADIAVAVCSILXKCDPLRINYWSWYQTTLSS

SEQ ID NO: 152280 - protein, 82 aa, Triticum aestivum
  Clone ID: PAT_TA_46698.pep
SADAWADAWIALSVKLERNASYVDRSLQLVTAEEHDDMEIDDITSDDTGSQSDSDSCSGWETEKEEGRYFDPAVEGLSTCKA

SEQ ID NO: 152281 - protein, 51 aa, Triticum aestivum
  Clone ID: PAT_TA_46699.pep
RPWSRGVVAHDCLIYALTLLSSGLVVWVCHVIARVAEEMLPIFAELAGSVP

SEQ ID NO: 152282 - protein, 91 aa, Triticum aestivum
  unsure (1)..(91): unsure at all Xaa locations
  Clone ID: PAT_TA_46700.pep
MAGGGDHPGANKRKREAAGRPKAPSKGAGPGDAVKRKKTYYAPAVKPKAEPVTAKDKRVAAKEMSESRKMKRKPNNNLEKELAILXWEKIR

SEQ ID NO: 152283 - protein, 101 aa, Triticum aestivum
  Clone ID: PAT_TA_46701.pep
AVADGEYKVDLDGETIMSEERAGHLTCTTPLVSSLNGSASAAASGQEEEDDAMQNSCCGSDWSSTATATSLLQPATMQERTRKRRRKTAMATTRPPTRPRT

SEQ ID NO: 152284 - protein, 88 aa, Triticum aestivum
  Clone ID: PAT_TA_46702.pep
AQLKVDHGIGEPLEAGEQQADEAQPRQGLGEREKQDGVGRAKRRVQAGGDGGKVPAALGLHRQREEPIRLRHGRPGGRHDIGRGERRT

SEQ ID NO: 152285 - protein, 77 aa, Triticum aestivum
  Clone ID: PAT_TA_46703.pep
SQESEQYDGEVEEGDEDGRKCRRRPSGRALEVLGGAPKAEVRCSLHLPCFGAGLAVVVVWCVCARELRANACVFFER

SEQ ID NO: 152286 - protein, 141 aa, Triticum aestivum
  Clone ID: PAT_TA_46704.pep
CPPIRQTLPPHAPRTNRNGPCRAPQSFHEKQPPRRTAPPPHRTKQARPRRARGSICRGRARDGSRRAEGERECYLGKRAANAATAALLLPRPGGSLAAAARTEDGAAGRRTGDAEAIGVSQLARPGTEAQRTRGRTRGRTR

SEQ ID NO: 152287 - protein, 109 aa, Triticum aestivum
  Clone ID: PAT_TA_46705.pep
SAETGGLKSVLDEVPAVVITEASQGQGSLYPSVEDLLYTSNSGGNRSGFKDMSDAQRNGKFVMPFCEQPGRFTWPRLSPRHPYAYLNEWFQPLRSCGWMVPAVIHIATR

SEQ ID NO: 152288 - protein, 106 aa, Triticum aestivum
  Clone ID: PAT_TA_46706.pep
RPLMEASLPLSTSASAPTHWSAVRATPADPVTARFTTRSCELSSTCYLQLLRGSSNVTEVLLLKGVLVDIHYDFSTPLHLFVTNVQDKIQNILLEHHADANTCFTC

SEQ ID NO: 152289 - protein, 89 aa, Triticum aestivum
  unsure (1)..(89): unsure at all Xaa locations
  Clone ID: PAT_TA_46707.pep
MDAPSVALYNQLKAVQPFFLLAGPNVIESEEHVXLKMAKHIKAITTKLGVPLVFKSSFDKANRTSSKSYRGPGLEQGLXILVKVKAAYD

SEQ ID NO: 152290 - protein, 99 aa, Triticum aestivum
  unsure (1)..(99): unsure at all Xaa locations
  Clone ID: PAT_TA_46708.pep
MAAHHQQQQEPYPQDQWQQQAVGFEDYLPVMADRLGEEGLMEELVAGFRLLMDPVLDLITFHSLXRNAPLLGLGGMYYYYLLGDARRGRLLTCYLVAYV

SEQ ID NO: 152291 - protein, 78 aa, Triticum aestivum
  Clone ID: PAT_TA_46709.pep
PITHPLPTFLLPSDYPWFHRGSISPHVPYTHCCPHRGVTLLDEARFPSIPPEVPSCSHDHLISICLRDPCFSLVVRLE

SEQ ID NO: 152292 - protein, 54 aa, Triticum aestivum
  unsure (1)..(54): unsure at all Xaa locations
  Clone ID: PAT_TA_46710.pep
DATDAYVAWHKKKNLGYHFGSXLDSNEGADVILNVSGERVHAHNLGLAAQSTGF

SEQ ID NO: 152293 - protein, 161 aa, Triticum aestivum
  unsure (1)..(161): unsure at all Xaa locations
  Clone ID: PAT_TA_46711.pep
RPDVTSSPESEGTCKKYDHNSKEDETSGLKVENTSNEFDKKNTADSNSALEHANTAIEFEGTSTSERYEENLMEQDNGKLHEPCAEDANALTESGSSGNGRTNSGFSRGSSEAGLDEDQSSTGKSGDSSFLAGYXKKGFKDLSLFNQSMDSVXSSINGHSI

SEQ ID NO: 152294 - protein, 56 aa, Triticum aestivum
  Clone ID: PAT_TA_46712.pep
MGKPCGGVGAWALDAEREDEVREHAGGLPSLEPARVDGGAIRAACSYSTRAVPCTV

SEQ ID NO: 152295 - protein, 110 aa, Triticum aestivum
  Clone ID: PAT_TA_46713.pep
SATVHPNGMIQTSQNSCSDTSKKQTRRNNWADISKLDQAATYPDSSVYQNVSQHETGNHLDDGRKYKMGIGCQIKRKAAQGDGAKWFEQMPSLITGPTLLDQKKSCSLLS

SEQ ID NO: 152296 - protein, 161 aa, Triticum aestivum
  unsure (1)..(161): unsure at all Xaa locations
  Clone ID: PAT_TA_46714.pep
VRGRVRRHVGQAHVERXTQLHWFLCTHAATHFMHMVRSRDYSKARPTKDDLRGCGTHAMSDAIRRITWCLTLRAQFNSHLPKLAVNSKTAATCTVFDGGVRATYLPWLRKLPLAYELGDHGRRQEEHDERRRPAARPEEQRLAHVAGQYDHHRGRRADDQH

SEQ ID NO: 152297 - protein, 114 aa, Triticum aestivum
  Clone ID: PAT_TA_46715.pep
ASPPRETLERRSRARLVVPGSLFAASMSSPPPEAVWDAGAPSSSGTLPQDISDVSKSTVGQLQAADQEASSQSSQHAWQPHMNPSYQVAQPKLETGVSENENFILQGDTISSQY

SEQ ID NO: 152298 - protein, 129 aa, Triticum aestivum
  Clone ID: PAT_TA_46716.pep
SVRYNYKLVAIQCRICVVLIQTQVWAYGFTLVVAKFTMFIKRCSSIGICGVYSCAGPRLITWYFAVVKRNRSCSHSMVSINHISQSSENTSTPQRVLHPIENRGGPRSDVPLQGCTSWPAANGTARGLA

SEQ ID NO: 152299 - protein, 99 aa, Triticum aestivum
  Clone ID: PAT_TA_46717.pep
MATETETFAFQAEINQLLSLIINTFYSNKEIFLRELIFNSFDALDMIRFESLTDKSKLDAQSELFIHIIPDMATSTLTIVDRGIGMTMSDLGNNLRTIG

SEQ ID NO: 152300 - protein, 90 aa, Triticum aestivum
  unsure (1)..(90): unsure at all Xaa locations
  Clone ID: PAT_TA_46718.pep
EEIFIPQKKKKKYPVFMYAWQRLIPIFIVYSXVNVLYMVKRLVLEVQTESTKHSANIMYQXSDLCLDKLKVLYGVKFQTFRLVLGQSXKS

SEQ ID NO: 152301 - protein, 115 aa, Triticum aestivum
  unsure (1)..(115): unsure at all Xaa locations
  Clone ID: PAT_TA_46719.pep
VLHAPRAIPRRAVLRAMRQHAHRAVLLVVARCGRPVHGHQHPRAGGRDRPQAPRQVGEALQLGGRAGGERVGAGDDARAEVIVTGRGRVGVGVXAKQASVQTPARRPRAPQASVS

SEQ ID NO: 152302 - protein, 138 aa, Triticum aestivum
  Clone ID: PAT_TA_46720.pep
MLPPKLPTPPPARPIVHRGVMILVGENKVVMAELMTLAGTKPNAEKRLPADNTASMEAGCEGKTRGRKMGSKAKKGVETYKIYIFKVLKHVHPSIGIFFKAMSIMNSFINDIFEKLAWESGKLARYNKKPTITFREIQ

SEQ ID NO: 152303 - protein, 44 aa, Triticum aestivum
  Clone ID: PAT_TA_46721.pep
LHSVHFRDSSPRRALTSFIFIEPDRSAWTAWTSPASPAQEHSWA

SEQ ID NO: 152304 - protein, 103 aa, Triticum aestivum
  Clone ID: PAT_TA_46722.pep
VPSAPAACATAGCRFGRPCRTPRAPGGRKGQVPHPVEAPVRLVQQRPELLHRAYPPPPPLPWTWPWPCSATHAMVAPPDAFRSPPPELPGRVAGRVGGRVRAR

SEQ ID NO: 152305 - protein, 45 aa, Triticum aestivum
  Clone ID: PAT_TA_46723.pep
FIGLTSPKIVAYMGTRTSHIHYGSLPALRVMCHSCLKLCTDAWAD

SEQ ID NO: 152306 - protein, 35 aa, Triticum aestivum
  Clone ID: PAT_TA_46724.pep
GEEDSLHKDPPMFRTNLSIPVLFSNEGGGHGGCAR

SEQ ID NO: 152307 - protein, 54 aa, Triticum aestivum
  Clone ID: PAT_TA_46725.pep
NRTISYILVAVSISVILVRKLVPITIVKIYSTSKAVGIKYCMHGPVDTNSLVAD

SEQ ID NO: 152308 - protein, 62 aa, Triticum aestivum
  Clone ID: PAT_TA_46726.pep
VRGRVGPSTTLFLPPHSSLSLRFVEPARQSEKMREILLIQCVQCGNQIVSNSWEVVCDNALH

SEQ ID NO: 152309 - protein, 132 aa, Triticum aestivum
  Clone ID: PAT_TA_46727.pep
RPPPPAPLPPPTRAEPSLPRERNNGREKRVVALLVFIACAPASSPSLPVLIHPRSPLTMGPFGFSAPPSHSWVRAVPSAPSLHTAREERERERERDEREREGRRCMRMNLPPTPPLLSLATFISIIFFLPPS

SEQ ID NO: 152310 - protein, 50 aa, Triticum aestivum
  Clone ID: PAT_TA_46728.pep
SLSAGIACNWSSLLCKHQRLGFFCGWSCSPARHECAFSRTPGGSPCVRGR

SEQ ID NO: 152311 - protein, 61 aa, Triticum aestivum
  Clone ID: PAT_TA_46729.pep
THFVKDPDESVLYADHKFFLSCFALRRPASRTIAIFNEPSFPAASFSTVLHSRQPPAASPD

SEQ ID NO: 152312 - protein, 72 aa, Triticum aestivum
  Clone ID: PAT_TA_46730.pep
RVHHWRVNQSQEAVTVHARGKRKEKARKGIQRRQGTGERTARGTSDELEVAGTEMSKGFLPAPRAAKGQTGR

SEQ ID NO: 152313 - protein, 64 aa, Triticum aestivum
  Clone ID: PAT_TA_46731.pep
MPPKKAAAAKADDAKKQKGAEDKTYGLKNKNKSKNGQKYVQTADQADQAKPDPTKTSVKKKKEE

SEQ ID NO: 152314 - protein, 44 aa, Triticum aestivum
  Clone ID: PAT_TA_46732.pep
ERGGNKAESDRACSDAAMLLAKLALARGSSDNVSVVVVDLRRGS

SEQ ID NO: 152315 - protein, 34 aa, Triticum aestivum
  Clone ID: PAT_TA_46733.pep
EDLLQVVCAPASSIVQMLCSTHESSDAWTQRLRT

SEQ ID NO: 152316 - protein, 63 aa, Triticum aestivum
  Clone ID: PAT_TA_46734.pep
CRMSPRRCAFTHAQASQLADGRLGHALHDVEQHSSGGAWCLSLTSPSSPLSGPTTATLLSPAM

SEQ ID NO: 152317 - protein, 71 aa, Triticum aestivum
  Clone ID: PAT_TA_46735.pep
VIDESFLQCCGGQSSLGYPPGDGEPSSPVVAPAENSAPAVNPAPVAARVAKHIPACFPCISSLQLLPFCSS

SEQ ID NO: 152318 - protein, 73 aa, Triticum aestivum
  Clone ID: PAT_TA_46736.pep
HLLSSWLHQIKHCSCLQKQAIASQSQQPQDNLKLWICVKKSRLLTSFLKTSSPIIKIADSSTASSLEVNVTGR

SEQ ID NO: 152319 - protein, 117 aa, Triticum aestivum
  unsure (1)..(117): unsure at all Xaa locations
  Clone ID: PAT_TA_46737.pep
MSSYTEGPMSHARRDLVLKIQSDAQTWWEXSKVFYAEPVYVPAGPGEKYFGNFPYPYMNGLLHLVHAFSLSKLEGGAAYHTLRGSNVXLPFAFHCTGMPIKASANXLAREIQQFGNP

SEQ ID NO: 152320 - protein, 68 aa, Triticum aestivum
  Clone ID: PAT_TA_46738.pep
LETLTFWCSPIPSVSNSKVMEVKPPYMPEETTPTFYHTQNSMMFLGISMFTVVNLLRVLQLNRYYLDS

SEQ ID NO: 152321 - protein, 91 aa, Triticum aestivum
  Clone ID: PAT_TA_46739.pep
CYQTSSSNCGTYALIYVKTISRKPSLTKMVLSPFLLTSTTPFFEALINCTMSLMPILCHLLHPLTFYLIFLNAKIFCTPPYCPIILYSFVN

SEQ ID NO: 152322 - protein, 134 aa, Triticum aestivum
  unsure (1)..(134): unsure at all Xaa locations
  Clone ID: PAT_TA_46740.pep
FVPRVLFKVKDVMKXHNELPLFKEGNMIMDHLTEXTSLGCGCLLEVVDEYXLIGTFTDXDLRRTLKAWGPSIFSLTVVXMFNRNPRTIXADSLAVVFMDIMELPSSPVHFIPVFDDKNIKSLIISLHELFSAGL

SEQ ID NO: 152323 - protein, 74 aa, Triticum aestivum
  Clone ID: PAT_TA_46741.pep
MSPAVSRLHINGRLYVDGMAPGTGDSDLRRHFGRYGDVADICIPTHRLTGQPRCCSSVQFSRPLDTVCALAYPH

SEQ ID NO: 152324 - protein, 82 aa, Triticum aestivum
  Clone ID: PAT_TA_46742.pep
LLKHTFISFSTVTKKMIATDEVPFSFTETSTSQERFWTTLNIKSSHLCLRTIALSSRLACKNNITASTSSSGNDQGFPELLP

SEQ ID NO: 152325 - protein, 52 aa, Triticum aestivum
  Clone ID: PAT_TA_46743.pep
GANSSVPQPVEGEGEGAPVLVGGEGDASGKGELGCHYLHPVLAPVPSWADEF

SEQ ID NO: 152326 - protein, 108 aa, Triticum aestivum
  unsure (1)..(108): unsure at all Xaa locations
  Clone ID: PAT_TA_46744.pep
HLACLPPETTACATLLKSAFLPTKAAWGATRQAGGPKPMTVCMVVRASAYADXLVKTAKTIAXAGMGILAMDESNATXWKRLAPIGLDNTEANRQAYRTLLVTPPGVG

SEQ ID NO: 152327 - protein, 86 aa, Triticum aestivum
  Clone ID: PAT_TA_46745.pep
PGPSNPSLLTVPPWPTPPWRPAAGAGAEGARAVGAHIRNRLRVAPVDRRWLWRRPEGRAASEAERQWFYRLRAILHRDKQNQGPDQ

SEQ ID NO: 152328 - protein, 62 aa, Triticum aestivum
  unsure (1)..(62): unsure at all Xaa locations
  Clone ID: PAT_TA_46746.pep
VRIPVSNENSHDWNASGESTGNMPNNXVWLGDMPQGAPHEVAIPGVPYMGSRTLQDLARGEA

SEQ ID NO: 152329 - protein, 61 aa, Triticum aestivum
  unsure (1)..(61): unsure at all Xaa locations
  Clone ID: PAT_TA_46747.pep
MSVRVKGGTVLSKGSAKXHRKCFCDNIHGITKPAIRLLARLGGVKRISGLIYEETRGVLKI

SEQ ID NO: 152330 - protein, 52 aa, Triticum aestivum
  Clone ID: PAT_TA_46748.pep
LLLLGEKSPSACVRWSREPRPRRASSPRIEAPPPWIFAGLDSYRILIGLLGR

SEQ ID NO: 152331 - protein, 75 aa, Triticum aestivum
  Clone ID: PAT_TA_46749.pep
MRECISIHIGQAGIQVGNACWELYCLEHGIQPDGQTNGDKTIGGGDDAFNTFFSETGAGKYVPRAVFVDLEPTVI

SEQ ID NO: 152332 - protein, 42 aa, Triticum aestivum
  unsure (1)..(42): unsure at all Xaa locations
  Clone ID: PAT_TA_46750.pep
SAHASGSITEHILKCLTGFLLNTDRHYFMFIXLYELLIIPDG

SEQ ID NO: 152333 - protein, 53 aa, Triticum aestivum
  Clone ID: PAT_TA_46751.pep
PAGIPVDHASAHIFSGSVSVSSSARLSPILSAVGCEERRDSIRDYTSKHTLNR

SEQ ID NO: 152334 - protein, 97 aa, Triticum aestivum
  Clone ID: PAT_TA_46752.pep
MDGCKAKNVAANKFGGPRKKSVTKSIKAGLQFPVGRIGRYLKKGRYAQRVGSGAPVYLVVVLEYLVSEVLELSWNAFKDNKKTRIVPRHLLLAIRND

SEQ ID NO: 152335 - protein, 85 aa, Triticum aestivum
  Clone ID: PAT_TA_46753.pep
MEHRTKGDWPPVAPCKQQQPSSMWQADSTCMGWLDRQRAASVVYVYFGSWVGPIGPEKVRELSLGLEATGRPFLWALQKDPSWRA

SEQ ID NO: 152336 - protein, 108 aa, Triticum aestivum
  unsure (1)..(108): unsure at all Xaa locations
  Clone ID: PAT_TA_46754.pep
AGRDPYSVSGLTSVSRSQAQDRDHCFRRYGHQRSGGRASHDPTRTHDERCVLIHSQACTGYRLGNACXELYCLEHGIQTDRQMPXDKTVAGGDDAKNTLFNETSTGKH

SEQ ID NO: 152337 - protein, 69 aa, Triticum aestivum
  Clone ID: PAT_TA_46755.pep
VRAIARSSTATEPPLPSAVGHGHLHLLRHMLLICGAVHPEASQPEALSQPHPSSLPRQCRPTESHPSSL

SEQ ID NO: 152338 - protein, 106 aa, Triticum aestivum
  Clone ID: PAT_TA_46756.pep
NPENLSSGRTKTTLRQCSLTLKGVMIVMSTSQHKPVTGSPLHCSWTSDAIKTASQSVRPFPAPGNAKVITRQKSQPAPGVLSSPLHRWCLSSNEARPTRPRTRGRT

SEQ ID NO: 152339 - protein, 55 aa, Triticum aestivum
  Clone ID: PAT_TA_46757.pep
PAIKEWIDRLPDASGCPAPLLLSVPHPLRVRSSRAVRGSVADASGVKAIVRVPAR

SEQ ID NO: 152340 - protein, 61 aa, Triticum aestivum
  Clone ID: PAT_TA_46758.pep
VRRMCYLSNGSRDHDVSNFTNFIQKNSGATGLDKYFRAYCHNLWRGLHQWLYAYIQCRLKR

SEQ ID NO: 152341 - protein, 47 aa, Triticum aestivum
  Clone ID: PAT_TA_46759.pep
KLSPRVCTVHLHMEEFPSLHLMKYYRQARKSLLSQIIHAENLYIASH

SEQ ID NO: 152342 - protein, 67 aa, Triticum aestivum
  Clone ID: PAT_TA_46760.pep
FFCCRRVVVLTRHLFQHQYDIYKLLGHISSHAISCDNVVPTSCIQCHIFDAFLQCARYEICLACIQL

SEQ ID NO: 152343 - protein, 125 aa, Triticum aestivum
  unsure (1)..(125): unsure at all Xaa locations
  Clone ID: PAT_TA_46761.pep
CGYRPNQGSAYANGETKPLSSSSSTSSFARCPPFPSHRIPQIDARFPPNRAGIPRRIGPAHGVIEGPSALANEGQWLARYPHQGRDNRAGKGPRLAWDAAPXFFPPPKGNPDGYICGAGNLNHTG

SEQ ID NO: 152344 - protein, 57 aa, Triticum aestivum
  Clone ID: PAT_TA_46762.pep
GWPFFNCLSKHPYMIGLRVSIHGWGCNPILCKGYFIMQVLYTYIENCQGRAGGCLRS

SEQ ID NO: 152345 - protein, 87 aa, Triticum aestivum
  Clone ID: PAT_TA_46763.pep
KTKQGAASKVGFNHRRPKMELLMMLKITPLPPQTPITNIFNTRDFLRPVGSMVLPRLIYRITTILHDIFPGEISNYICHFATEHKFY

SEQ ID NO: 152346 - protein, 100 aa, Triticum aestivum
  unsure (1)..(100): unsure at all Xaa locations
  Clone ID: PAT_TA_46764.pep
MGNEKTHMNILGVGDVYSGRATTTGHLIYKLGGIDKRGIYRLQMEAPYMNMKLFKXACLHDKLKAXRERGITINXALWKFDTTKDYCTCNCCLYGTLTYY

SEQ ID NO: 152347 - protein, 61 aa, Triticum aestivum
  Clone ID: PAT_TA_46765.pep
HPRVCASNPTHLRALLKDFLFHSNNHTFTPVFILQERFNNLTPYYPSSSDLPLILKSLLLI

SEQ ID NO: 152348 - protein, 156 aa, Triticum aestivum
  Clone ID: PAT_TA_46766.pep
SEIVQHPGKALCSQLILGARGLGSAVVTIQDIGLSSRVSTSSLVRVANVDWIQILSEEHISIMEGTTKDFQISAGTQDGQVFGDSQFKYMGIEVHLGDEILDHVNPSESLDGPKFLIKAAKTGTSSFYVSTKQRSGQRVFSHVINVEWYKPLGIHF

SEQ ID NO: 152349 - protein, 55 aa, Triticum aestivum
  Clone ID: PAT_TA_46767.pep
LQIACCPCTCIHINGYHCALKQHQPRRADPLPRHEFDTPSVPNREGAMMDLRRSL

SEQ ID NO: 152350 - protein, 152 aa, Triticum aestivum
  unsure (1)..(152): unsure at all Xaa locations
  Clone ID: PAT_TA_46768.pep
SADAWATDQQTVSPDVIRRYYAATEEGFLNLVRKQWLIKPYIASVGTCCLIGFINEGVLYIANTGDSSAVLGRVDRGVXDINVVQVSTEHNASFQEVRDELRQMHPDDPLIVVLKHNVWSVKGINYVFRTIGDVYLKSSEFTRKPXLARFRI

SEQ ID NO: 152351 - protein, 74 aa, Triticum aestivum
  Clone ID: PAT_TA_46769.pep
YTCVIERGLNPRSAHILNGLLRMCPTGSFPRGLFSPLSPSRSNYGHLCRLVGLLLVTASTLRSGFVRTWTPSFY

SEQ ID NO: 152352 - protein, 76 aa, Triticum aestivum
  Clone ID: PAT_TA_46770.pep
RAGTRHDHAVRARPRAALVLYHFAFVACGYAGEEEMALWSGASSQLMWCEIIPAECRCKDCLSPVSEVVWVLTNTL

SEQ ID NO: 152353 - protein, 56 aa, Triticum aestivum
  Clone ID: PAT_TA_46771.pep
TTAATATATTTATTTTAATTTTTTATMATASPSSQLRAPPTRLPEDSTPWSTTAAT

SEQ ID NO: 152354 - protein, 94 aa, Triticum aestivum
  Clone ID: PAT_TA_46772.pep
ARPIMVKTRIFTPDMKRCSNQHLDDRSFNSRLRQSSTSVPNDTSRLVGCLPTLNHRHGRRLDAHVSLRNWPLLLHNGASHTATCSIPSEPLLRS

SEQ ID NO: 152355 - protein, 72 aa, Triticum aestivum
  Clone ID: PAT_TA_46773.pep
PKADKRLSAGKTVFKVAGCEGKTSCMKKGSMANIGVVTYKIYIFKVLKHVHSDIGIFFKAMSIMNFFINDIF

SEQ ID NO: 152356 - protein, 108 aa, Triticum aestivum
  Clone ID: PAT_TA_46774.pep
VKVPSSLFERIVARSKLFDIGCVLFYNEDVKGICARSGELIPLARHQLAVPLYKVLAIEIDLHSDCGDEIMRGTLEFHPLPECDQTARLISKSGTQIEVKIFISQYFR

SEQ ID NO: 152357 - protein, 71 aa, Triticum aestivum
  Clone ID: PAT_TA_46775.pep
PFPSIIPLLTLLLTPFLFCKRRGGLPLWWGPLNGPNPFPKGKKIKWVDQPRRGGGFSYSSLSLGRQGADQD

SEQ ID NO: 152358 - protein, 92 aa, Triticum aestivum
  Clone ID: PAT_TA_46776.pep
KLPTQNRIHCQILDVLIHVSMCRYRGTRQVLVSIVSEMFQGIDKHNQVSKTLGNLHFLTFYALLIEVTFQSDVYHVCCLLPVYISTSHNASF

SEQ ID NO: 152359 - protein, 165 aa, Triticum aestivum
  Clone ID: PAT_TA_46777.pep
VRSPPPPRRAPSSRPTPPLPDDVMREILLRLPADDPACLVRAAAGCISWRGMVSDPSFAPAYRLRRGAPPMLGFLYDDRPAGEHWISHFLPTATSPPLAARDRQHRHALDSRHGLALFYTPRSHAHFLVCDLVTGEHWEIRADPKCYKIIWSNLLQEMHSLRENE

SEQ ID NO: 152360 - protein, 73 aa, Triticum aestivum
  unsure (1)..(73): unsure at all Xaa locations
  Clone ID: PAT_TA_46778.pep
LPDNGFIPQLKFNLLLAPLQAADSEIPVLPQLNWVALHLPLASXRNIEEAGTDRPSEQVRSLNGERDAPFIHP

SEQ ID NO: 152361 - protein, 80 aa, Triticum aestivum
  Clone ID: PAT_TA_46779.pep
RPIRAGVRRGLPPRLSPRAAPSRRPRPTRSDAPAPSPPLSACTPSAPQPQLLVAVRNCIFLRVYNTCVGALPRTRGRVGR

SEQ ID NO: 152362 - protein, 65 aa, Triticum aestivum
  Clone ID: PAT_TA_46780.pep
DTALLARLERGPANVALTPGAGRLGAGGSCFPGLPVTSCVCLVRAMSSEMRRKVEQGGAPHASAD

SEQ ID NO: 152363 - protein, 112 aa, Triticum aestivum
  Clone ID: PAT_TA_46781.pep
VRIPLVYRPRLLMCGVEGVGLDHVGPAVLHELEKFPVHSLGLPSLLSDPSAKTPEEALVHIFGEARRTTPSILYLPQFHLWWDTAHEQLRAVLLTLLNELAFNLPVLLLGTL

SEQ ID NO: 152364 - protein, 69 aa, Triticum aestivum
  Clone ID: PAT_TA_46782.pep
EKASASRPSLGANLRVSRRFLLVSCVEFKYYFVSWFASCRRRVHVLLLLFVSRVVADVWRHLRLILFEN

SEQ ID NO: 152365 - protein, 126 aa, Triticum aestivum
  Clone ID: PAT_TA_46783.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKE

SEQ ID NO: 152366 - protein, 124 aa, Triticum aestivum
  unsure (1)..(124): unsure at all Xaa locations
  Clone ID: PAT_TA_46784.pep
MLPRPPPHLLPWRYLVLLFLALAVSSNGVSATAKPKAKAPTPAGFGYKLVSLVQRPNGGGLVGCLQVKRRTSTYGPDIPRLRLFVKHETKDRVRVQITDAEKQRWEXPYDLLPREPSPPSGSTG

SEQ ID NO: 152367 - protein, 94 aa, Triticum aestivum
  Clone ID: PAT_TA_46785.pep
TSFGLLGQYINSVKILLSLDQTLIGSECVPRPPPHLLSSNYLVLLLLALTSHYQWRLSDCQTKGQSAHAIRIRLQTDVLRTAPQQLPDSTVAFN

SEQ ID NO: 152368 - protein, 49 aa, Triticum aestivum
  Clone ID: PAT_TA_46786.pep
SGRERDGLALIHSPISVSTLLYFPCTRCYPSRSTTLGITARVSKGVAAG

SEQ ID NO: 152369 - protein, 82 aa, Triticum aestivum
  unsure (1)..(82): unsure at all Xaa locations
  Clone ID: PAT_TA_46787.pep
ISPPXPYRRFPAVLFRSPGGPGYLQTIFLLPSINQLHFMYTFYLRRCSLSTNCKTLFTILFPPIYLYETIPLLMHMHASLCL

SEQ ID NO: 152370 - protein, 118 aa, Triticum aestivum
  Clone ID: PAT_TA_46788.pep
VRNALCLSAYHLSNTSTRFKNKSTRFKLLGRLHGRDQGWEGAFPATSAAARRPSVAARGGRLPQVHGQVHGVPNEADRHFFQGQALRLYTPVELFFSSPKLRDMAAHSKSDPLLVLYT

SEQ ID NO: 152371 - protein, 77 aa, Triticum aestivum
  Clone ID: PAT_TA_46789.pep
YRCFVGGLTWATDDQSLQNALCKYRDIIDSKIITDRETGRSRGFGFVTTTADQATPCAVEDRNAQDLFCRNITVNEA

SEQ ID NO: 152372 - protein, 163 aa, Triticum aestivum
  unsure (1)..(163): unsure at all Xaa locations
  Clone ID: PAT_TA_46790.pep
MQGKKNNLLDSSSQKSLHRGKTPRTRVISSKNVPKDEDDLPSSTTGGSDRNTSGCGPAPKPDQETVLTTLKDRLRKLGQRLHEKENEGRKLEGHLEKKAAAEAVSSSSSSSSLDKTPNVVNRPEQPSVTSXDASMYAPPHSQPVITNGVTEPSSNAQNHRKHK

SEQ ID NO: 152373 - protein, 144 aa, Triticum aestivum
  unsure (1)..(144): unsure at all Xaa locations
  Clone ID: PAT_TA_46791.pep
MGKEKTHINIVVIGHVDSGKSTTTGHLIYKLGGIDTACHXRFEKEAAVMNKRSFKYAWVLDKLKAXRERGITINIALWKCXTTKNYCTAIDAPGDRDFIKNMMTDTSYADCACSIIDCPTVGWDAGMVKEGQTREHALLAFTLG

SEQ ID NO: 152374 - protein, 162 aa, Triticum aestivum
  unsure (1)..(162): unsure at all Xaa locations
  Clone ID: PAT_TA_46792.pep
MDSNANGGRSTMVGEMESTLERVRRQLSSSSTRHILQGPLLKRSDTLRKWNERWVILDPATGKMEYKVRRSDTTVRGIIVFDSTSTVTLSPTNFYGLPKYEGCCVYIGTPQKKEYFLCAETPSAARAWVSTLHATQLVLQAHKQAVDSMGGNGXAKLGTXAT

SEQ ID NO: 152375 - protein, 173 aa, Triticum aestivum
  unsure (1)..(173): unsure at all Xaa locations
  Clone ID: PAT_TA_46793.pep
VRGRVGGRVGRWTPPPVRRRRTPLPALDPTPAVAPTPAAPSPSPPSSSHSSAPPTSPXRPAPPVKRCPVAVQPLQRRFLPHRPSPPRRSRANPSTSSXPPSPSSTPAPSRSPSTGAGPPSSAGSASRPRAPXPPSPAPPNNTEKVASTVRRPPRKIDGDAAGRRCRGDPGPRD

SEQ ID NO: 152376 - protein, 76 aa, Triticum aestivum
  Clone ID: PAT_TA_46794.pep
AIPKAKIKLGRSIKWVAHDMFCASIIIKTNDRRLTFTNRASTTLPKNDKETKKQQPLQLLYYKRHKEKETKTIDTS

SEQ ID NO: 152377 - protein, 90 aa, Triticum aestivum
  Clone ID: PAT_TA_46795.pep
QQFDNGQLSPFTYIKVGSNFRYSLNNLLLPSTIIKHISIAAMRNKYSRLHACIASELDDPRLCLHNQHGKIDIGNLEWDGPTRPRTRGRT

SEQ ID NO: 152378 - protein, 61 aa, Triticum aestivum
  Clone ID: PAT_TA_46796.pep
VRGRVGQKEADKCSSSMDTCEEAREKSAESLLGQRKLTALWEERARELGWKPGNVNLHRNQ

SEQ ID NO: 152379 - protein, 97 aa, Triticum aestivum
  Clone ID: PAT_TA_46797.pep
RPGRSNSNPRMRASLSLAVKVGSVVEEEDQRGGAHIVEHLAFSATLRYTNHDIVRFLESIGAESGACQNALTFSDETIYELFVPWDKPWLFFQAIFV

SEQ ID NO: 152380 - protein, 140 aa, Triticum aestivum
  unsure (1)..(140): unsure at all Xaa locations
  Clone ID: PAT_TA_46798.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGIIPHKTARGEAALARLKAYEGVPASYDRTKRMVIXDALKVLRLQXGHRY

SEQ ID NO: 152381 - protein, 73 aa, Triticum aestivum
  Clone ID: PAT_TA_46799.pep
VRQVYFGLQYISFLVRPYCKKIIPTTMLQSYSFIHQTLFLWLLFLLFQQLVVKLRRALEHFDSLVFLDGPLSV

SEQ ID NO: 152382 - protein, 53 aa, Triticum aestivum
  unsure (1)..(53): unsure at all Xaa locations
  Clone ID: PAT_TA_46800.pep
KNLKCKLLLSQEXVNWIQLVSIVIFQFIXIVYCNNGNFGFITRSYFYRRIFST

SEQ ID NO: 152383 - protein, 66 aa, Triticum aestivum
  unsure (1)..(66): unsure at all Xaa locations
  Clone ID: PAT_TA_46801.pep
VRKAPEIAALWKKDLQKVNLKAAESLADAEEYPNXVEDWQIALNVEATVAPKRGIYPPVEEYMMHS

SEQ ID NO: 152384 - protein, 45 aa, Triticum aestivum
  Clone ID: PAT_TA_46802.pep
SMNLMPAGIGCHLFVKRCCQHSYSFSDVHTQIQRCTHHSNSTNLK

SEQ ID NO: 152385 - protein, 45 aa, Triticum aestivum
  Clone ID: PAT_TA_46803.pep
EQAKDLISGSALEDRNAVAVAKQGSDIRRQLALLEGAHDDSNAWF

SEQ ID NO: 152386 - protein, 109 aa, Triticum aestivum
  Clone ID: PAT_TA_46804.pep
YGLRALRGGGGDGGTTCAETRDCYLSMYLEKKPDKADPNEARLSRFTCWALSGEPLAAPAVVDRLGNLFNKEALVEALNHKRLPKALSHIRGLKDMNPIHLHPKANAAG

SEQ ID NO: 152387 - protein, 110 aa, Triticum aestivum
  unsure (1)..(110): unsure at all Xaa locations
  Clone ID: PAT_TA_46805.pep
MGPKAAEKKPVATADKTTAVKKPKAEKRAPASKEAGGEGKQRCMKNGSKAKKGVETYKIYIFKVLKQEHPVVGIFFKAMYIMNFLINNIFXKLVGESVKLARYNKKATIT

SEQ ID NO: 152388 - protein, 100 aa, Triticum aestivum
  Clone ID: PAT_TA_46806.pep
RPVTISEDRSIFNCECGQFEHTGMLGSHVLRVTEILHLEDIPKHHILKRWTRDARDILPDHLVQYQKDNSQNLSFTFRHATLYFKAMEVVRMGDASAACY

SEQ ID NO: 152389 - protein, 87 aa, Triticum aestivum
  Clone ID: PAT_TA_46807.pep
SADAWAKISRALSTSSRFSFRAPLGLATRPVLVKPAVAVPKPKPYGAKPKKAVVGPAHPVYFKMIKEAIAELKVRTGSSFGRHCLVH

SEQ ID NO: 152390 - protein, 37 aa, Triticum aestivum
  Clone ID: PAT_TA_46808.pep
LGTCIFELHSQNCIEVVGPIHTLLMSDDATPLLQSSF

SEQ ID NO: 152391 - protein, 82 aa, Triticum aestivum
  Clone ID: PAT_TA_46809.pep
EFFDIMNPYYSGDIFLPTISAVIYNFKVLFAATYGNSSSFNIGTFESRFVPAPKVNFRCVFHRTLPFYKICTCHQQLFGSFS

SEQ ID NO: 152392 - protein, 42 aa, Triticum aestivum
  Clone ID: PAT_TA_46810.pep
RRIRFAPWVGFLGKSKEYGDRCAQLCALFSADAWCRPGISVR

SEQ ID NO: 152393 - protein, 39 aa, Triticum aestivum
  Clone ID: PAT_TA_46811.pep
LGIEIYGDKTRVKYDSISRTAKVGESWDQNLICFIVTVR

SEQ ID NO: 152394 - protein, 40 aa, Triticum aestivum
  Clone ID: PAT_TA_46812.pep
PASWYSPFRVVLSLFGPSQMLPGGRSTKPGALYTRSMPRT

SEQ ID NO: 152395 - protein, 65 aa, Triticum aestivum
  unsure (1)..(65): unsure at all Xaa locations
  Clone ID: PAT_TA_46813.pep
VREETDEVVVIGSCMTSADTIYNESDECLESVLTEIRTNTRTGEFTRRXILALSEQVNLEVVMVN

SEQ ID NO: 152396 - protein, 35 aa, Triticum aestivum
  Clone ID: PAT_TA_46814.pep
SSSSREPTLIKSFPHKTHKVPSHYGPTSLWSLVTW

SEQ ID NO: 152397 - protein, 54 aa, Triticum aestivum
  Clone ID: PAT_TA_46815.pep
TPSAYAVGALYLDESTAFNQTIKYFASDIIVSYKYIYQKAVLKSIVNIIQYLIY

SEQ ID NO: 152398 - protein, 71 aa, Triticum aestivum
  Clone ID: PAT_TA_46816.pep
RPAASAITHESTRARDPCLLPSSAGPGLLRREPADHHHAFFFPYLSVYYFYSVLRARAPTGYGHGRRLEHK

SEQ ID NO: 152399 - protein, 102 aa, Triticum aestivum
  Clone ID: PAT_TA_46817.pep
RTSSSSGWWCPSVSSTRECIVPPPACGVLRLRRAPGGRWRPDARPGCLDLTQAGGKGTPPRLVGYEWSSPAGEGKGRRGLGRGRSSQRQEGRIGGERRVERT

SEQ ID NO: 152400 - protein, 74 aa, Triticum aestivum
  Clone ID: PAT_TA_46818.pep
PRASSGRVAIKGVFAVFQDLYFSFIEMNPFTMVNGEPYPLDMRGELDDTASFKNFNKWGNLEFPLPFGRVFSST

SEQ ID NO: 152401 - protein, 49 aa, Triticum aestivum
  Clone ID: PAT_TA_46819.pep
EGSMRLIRGDKEIWRLILIAESVTLPATTSVFFHHAADVATCSERVGGR

SEQ ID NO: 152402 - protein, 56 aa, Triticum aestivum
  Clone ID: PAT_TA_46820.pep
RSSTRSPTRSRTRGRVEAPLTDEELACASEGAYHGDLLVKHSCYMGRLWLLTGVPK

SEQ ID NO: 152403 - protein, 61 aa, Triticum aestivum
  Clone ID: PAT_TA_46821.pep
PGRPNNIICRNASSARDMNIAIVNCRRGEEKLRIVAFSQRYQNPQARGGENSGKQKAPPPL

SEQ ID NO: 152404 - protein, 89 aa, Triticum aestivum
  Clone ID: PAT_TA_46822.pep
SLLQDLPRRVRQPFTLYQSLALLLLGRNNLTLWSSPTCTSSSTLLSLSGVVEARLCFLGSPATLLLADPQEPFSLSIFFTDHFGRVGGR

SEQ ID NO: 152405 - protein, 98 aa, Triticum aestivum
  Clone ID: PAT_TA_46823.pep
RPPTRSPTRPGMFRRSWLRSEEASNGRNKIRKLLLKECESARADDVMTVAYTADGSDDDCLKNEGEAEAPTADGSYEDCETMEGESKVVIPRARGNMG

SEQ ID NO: 152406 - protein, 110 aa, Triticum aestivum
  unsure (1)..(110): unsure at all Xaa locations
  Clone ID: PAT_TA_46824.pep
VRDAVATTFSAKKTTTSSSARRRGSPPRAAGTTAAAAPHLPVASRSSLLIRLGYSSVERPRPHVAPSTASLSHLLVSRHALAPLTGRXRHCGVTGADLVAIYLCFLIFDL

SEQ ID NO: 152407 - protein, 64 aa, Triticum aestivum
  Clone ID: PAT_TA_46825.pep
SSLPTEQYAEPLVRASMLCRRHLLLQVRQQPRRKLGLIHSPTQSLRRSPHLYTCISFICSLYNL

SEQ ID NO: 152408 - protein, 60 aa, Triticum aestivum
  Clone ID: PAT_TA_46826.pep
RPRTRGRTRGVIMRTFLAMQVVTMAEHDFIQREIVPRSTTHPWPRMTTQQNPLYQPNQTF

SEQ ID NO: 152409 - protein, 130 aa, Triticum aestivum
  Clone ID: PAT_TA_46827.pep
SGERMFRMVRSMAYESKILDAMTYPGKVLSLKMAKPPGFRYQSGMYVFVQCPQVSKFEWHPFSFTSAPDDDHLSIHIRSLGDWSYHVYDMFHEALWCSNLDLAKVSIDGPYGAVSQDHSKYEIILLIGLG

SEQ ID NO: 152410 - protein, 57 aa, Triticum aestivum
  Clone ID: PAT_TA_46828.pep
FDLMYAKRAFVHWYVGKGMKEAEFSKAREDLTALKKDYEEVGAEGGDDEDGEEDDDY

SEQ ID NO: 152411 - protein, 52 aa, Triticum aestivum
  unsure (1)..(52): unsure at all Xaa locations
  Clone ID: PAT_TA_46829.pep
RLTFGFSLXTSNILGTRNHNMLKLGLSIDEDDEAPDNDTDMPSLEDYSCESK

SEQ ID NO: 152412 - protein, 96 aa, Triticum aestivum
  unsure (1)..(96): unsure at all Xaa locations
  Clone ID: PAT_TA_46830.pep
PHASARVFFTVAQSSDANIEXPRSDYKRSGACAKNEPNTSRERPQQSLLLIPKSYKEKQALTARQKYKQAVISAQLPDGVILQGVLLPAEATGLLY

SEQ ID NO: 152413 - protein, 104 aa, Triticum aestivum
  Clone ID: PAT_TA_46831.pep
PRVRLGRGARRRLVRRHHGQQRPHHGWRGCVHAARGCARTPGLKAKGAQPEPVPCATNPRDDYQNWIKDMRHRNKKTGQRTWPPFWGRQQGNRKMNNAVTTAGT

SEQ ID NO: 152414 - protein, 66 aa, Triticum aestivum
  Clone ID: PAT_TA_46832.pep
RPCLLESAVHLNYIINLAANKRHTECVRGLAAVVSGACVLNNARREKGRDAFAVSDAISQKIGLTT

SEQ ID NO: 152415 - protein, 102 aa, Triticum aestivum
  unsure (1)..(102): unsure at all Xaa locations
  Clone ID: PAT_TA_46833.pep
MLFVAMSTRPVVFRRPHLLARAAKSTPSSSPATENQXARRSILLPRLIELTXWAVGSKVAAGAEKAGXSRDIMLGTSGLLFVDLGIGNWTCRVILHSLGIKL

SEQ ID NO: 152416 - protein, 79 aa, Triticum aestivum
  unsure (1)..(79): unsure at all Xaa locations
  Clone ID: PAT_TA_46834.pep
VVLFLPIQVDLSLKHVISTLSTESLADGENARPCQLXSLLIREDGRRRRFAVRGHHEVGGRRRLHRALHRLRRVGRQGH

SEQ ID NO: 152417 - protein, 67 aa, Triticum aestivum
  Clone ID: PAT_TA_46835.pep
VVLRPAPRLADARPDRKERGGHDGGATFSGLDSFFPLSIRVPGQGVSFPGLEHPFPFPTENPKPIWL

SEQ ID NO: 152418 - protein, 76 aa, Triticum aestivum
  unsure (1)..(76): unsure at all Xaa locations
  Clone ID: PAT_TA_46836.pep
GIRARPGRLAGALVAFGLALRLVWGLPCGLSWSRCFFRSGACWLWFGLPPALPYRRLGPRSPARPGFWGSGVXGRV

SEQ ID NO: 152419 - protein, 127 aa, Triticum aestivum
  unsure (1)..(127): unsure at all Xaa locations
  Clone ID: PAT_TA_46837.pep
SGLPSPPPXPRPAGAPPGSLPEMPIPPPPPPPPPPEPPQLHGVVIITLPPPDQPSKGKTITAFTYTDEPGAGAPALPPYRGPPMATAGREARRSRRAVLRRAGAMVLVLGALALAAYYSFYSDVAVQ

SEQ ID NO: 152420 - protein, 79 aa, Triticum aestivum
  Clone ID: PAT_TA_46838.pep
VRPRVREKKKECMLALLHECFGEGIITINQMTKGFSRVRDGLDDLALDIPDAREKFLSYVEHGKKNGWLVPSFGVAAST

SEQ ID NO: 152421 - protein, 80 aa, Triticum aestivum
  Clone ID: PAT_TA_46839.pep
MSSSSDNPNTVTDRGLFSKSSKDEKKKQEEKKEEEEGGGGFIDKVKDFIHDIGEKIEEAVGFGKPSADVARIHVPHIGLH

SEQ ID NO: 152422 - protein, 160 aa, Triticum aestivum
  Clone ID: PAT_TA_46840.pep
YAGADAVVKKDRSFRTVGKTSSGVDLKSKATSNSRNNVRGSSGRDEAGSTESEVHDASSRRKSLPRKVEDVRRKVAVGSEILPQSDYSSRQGSNLSRQSSNAEQELSLLGGKVKSVNDANAIPLEQTRVTKPAKGNQDRHDELQMKAHGLEKLFAAHKLT

SEQ ID NO: 152423 - protein, 128 aa, Triticum aestivum
  Clone ID: PAT_TA_46841.pep
RPIRTSLSLPRLPPPPPPPATSSMVATPPPSLLPYLLLISDLLPSPSPDPRRAGAEASFFSGVRLPLISSATAPPLQPPRVAAAPHDGRPGELHRTRWARAISNASARTRCPRQRGPRPRATGTHGSY

SEQ ID NO: 152424 - protein, 94 aa, Triticum aestivum
  Clone ID: PAT_TA_46842.pep
MINARRIAQLAKRWQRVAALGRKRLTMTATTEVEECSTAVAGEGHCVMYTTDGRRFEVPLAYLRTVVFSELLRMSEEVFGFAGTEGGIKLPCRT

SEQ ID NO: 152425 - protein, 75 aa, Triticum aestivum
  unsure (1)..(75): unsure at all Xaa locations
  Clone ID: PAT_TA_46843.pep
MTVPEAVALDIPAEEGSPVARVPRRIRRRLLQARESSADAPATAEEIEAKLRDAQLRRQAIHEKLSCKARHXVRS

SEQ ID NO: 152426 - protein, 80 aa, Triticum aestivum
  Clone ID: PAT_TA_46844.pep
LSSSPSSKIEIGVSKGLSILGFLKGYKPPGYKISGLQWRRNKLPSAKSRRVFNLRIYLSTDKVFESLNSQTWLDFHYDIE

SEQ ID NO: 152427 - protein, 73 aa, Triticum aestivum
  Clone ID: PAT_TA_46845.pep
FCCQRIVDWLAGSFKNDEGIDLLKDKQALQRLTEAAEKAKMELSSLTQTNIRLVGSASHFGVKHCAFCISVSD

SEQ ID NO: 152428 - protein, 57 aa, Triticum aestivum
  Clone ID: PAT_TA_46846.pep
ASTSAKLMIWITHFYLTEPILSGKTYSISIKFRREHREECLLRPQVCNPRSSGYVGC

SEQ ID NO: 152429 - protein, 127 aa, Triticum aestivum
  unsure (1)..(127): unsure at all Xaa locations
  Clone ID: PAT_TA_46847.pep
YLFLPGQFKDQQCSEAKLRKICHVLVXVYSAVEEAKGRQITNYGTLEWLSELNDTVYQGRYLLDTVRCRERELEDEHADKVVAQPFSFSLFNPAKRVRVAACAMKRLLSGHDIGVPEAIDRVVEIRT

SEQ ID NO: 152430 - protein, 88 aa, Triticum aestivum
  unsure (1)..(88): unsure at all Xaa locations
  Clone ID: PAT_TA_46848.pep
MAEEKESTSVPLSQAAEAVDPEDPAKSPPRPSSPTTSTRKACCAVLQSWVSRKFMTGCXFPVAFTFFITWWFVQFGDGFFSPLYAKLG

SEQ ID NO: 152431 - protein, 60 aa, Triticum aestivum
  Clone ID: PAT_TA_46849.pep
GMHDGAEPETVGCFYLSPQLVVSVPWISHHLLVSTTTAYISTRRLIKLIFPTRPRTRGRT

SEQ ID NO: 152432 - protein, 145 aa, Triticum aestivum
  Clone ID: PAT_TA_46850.pep
PAVFKVSPRVRPRVRQQPPTASDLYFKKRKNQIILSSSSSDGQNTKEIAPAESLNSGESNVQIASSNNSINGLKERPHKALRTNNMGTSSHVWTLSGQQPQRKGSAGTSYAKAFPRILPWKRKIYCKNFRNSHTQNVRLLRIVRK

SEQ ID NO: 152433 - protein, 131 aa, Triticum aestivum
  Clone ID: PAT_TA_46851.pep
VREDPLMRIRPHFSETFLAPQGDGNEASTAEETSFRVIWMVQCEARVVGFVFSSSTRQWRAIPSQSWANLLAGFVSSTGLALFYGRQCTCDYFYWLPNCQYDLKMLVLDTLRMEFSVDEPPTEAKNALFLG

SEQ ID NO: 152434 - protein, 77 aa, Triticum aestivum
  Clone ID: PAT_TA_46852.pep
LLHTVRRPMLGVRPSNCTTQRWPLGPPMHSNIKFRAWIDQDGKITCNATQHIMLLHDHCLKMDFQVQCAGLLICLQE

SEQ ID NO: 152435 - protein, 144 aa, Triticum aestivum
  Clone ID: PAT_TA_46853.pep
RPRTRGAYAPRPIPSLLRPPRPGAHTSFPPAAYAADLPTPLLALLRLHHSSAAFPTPKGPPATRASKPASPFLIGPPLLLLVCELHRAEPLGPLLRPHPREHNHRGATSPVPVAPPLQEPAGAPPPSRISMALPWLLLQRPSLP

SEQ ID NO: 152436 - protein, 100 aa, Triticum aestivum
  Clone ID: PAT_TA_46854.pep
LMRRAARDTGKSTKPSFAAPVRQRPPLAPMRQRPPSNNMPQPSGPSRVRFAGKGSSVQNKENIPTTNKTIVDKTAGKARRVSLVPMMRQIPFQPKRRSLI

SEQ ID NO: 152437 - protein, 67 aa, Triticum aestivum
  unsure (1)..(67): unsure at all Xaa locations
  Clone ID: PAT_TA_46855.pep
VGSSEDGEPSDAEIKSAIWEVCGDHGALGLLVDLLRVKMAELEEGTGTXASDSQLLEKFDLTVQMTS

SEQ ID NO: 152438 - protein, 98 aa, Triticum aestivum
  Clone ID: PAT_TA_46856.pep
SCSSRPTHERRCRVSSRPALLRHGPSCSSPPGPSAGPSWARRESSTPGAAAAATGSRPRPCPCSAPSASAGRPCPEEPLHVLLLLAIFSDRGAHASAD

SEQ ID NO: 152439 - protein, 56 aa, Triticum aestivum
  Clone ID: PAT_TA_46857.pep
NSISTYIKGSWENLYGIYRFRARQLVHNSDPKNSPLRTQITSPHNEFPSMIFLLSR

SEQ ID NO: 152440 - protein, 78 aa, Triticum aestivum
  unsure (1)..(78): unsure at all Xaa locations
  Clone ID: PAT_TA_46858.pep
MYTARKKIQKDKGVEPSXFEDTVAQAFFDLENGNQELKSDLKDLYINTAIQMDVVGTGRPGDPWPTRCASPKEDQVGS

SEQ ID NO: 152441 - protein, 115 aa, Triticum aestivum
  Clone ID: PAT_TA_46859.pep
MASPPWVRLVLLLLAAVPACHGRPLFDGDAVIDETQPLRPSMISCSTVGNYTDGSKYHVNLDRLLSAIPVAADSNGFFNGTFGAVGDEVFGMFMCYADDADSECQDCLTRALEVL

SEQ ID NO: 152442 - protein, 88 aa, Triticum aestivum
  Clone ID: PAT_TA_46860.pep
RPPTRAPTRPVLHAVREQCRAMSNVYVIQFLKANGLLGQYRDYYNIVMLSDKVFMERFICPHKKAAPHLAKDYATACKGEVPANFRFT

SEQ ID NO: 152443 - protein, 74 aa, Triticum aestivum
  Clone ID: PAT_TA_46861.pep
SKAYLCLHMESFTAYAGDKHLGSNLTLSLTVSHLKKGDTNVSMCLSLIATYLVSSVHKIVEFLFTLWNKWVVHS

SEQ ID NO: 152444 - protein, 47 aa, Triticum aestivum
  Clone ID: PAT_TA_46862.pep
RSSHLLLANRHNTNQATDGGRQGAYPTGLRRTGQLSEDPQVAGGRMV

SEQ ID NO: 152445 - protein, 46 aa, Triticum aestivum
  Clone ID: PAT_TA_46863.pep
SADASEKRRHDHTEPPSWLWAGYRYQPTLRGVTTIRISCLYQVLTT

SEQ ID NO: 152446 - protein, 110 aa, Triticum aestivum
  unsure (1)..(110): unsure at all Xaa locations
  Clone ID: PAT_TA_46864.pep
RPLTPPPAIWGTLRTLESPTNHGNTHEEAQRALAQKEQXIQMMLANDLHLXTKNCDFHIERYTYKRRSDCIYISNLGMTRNKLHLATRVMDSIQNPHDMKDQSARPYGQR

SEQ ID NO: 152447 - protein, 92 aa, Triticum aestivum
  Clone ID: PAT_TA_46865.pep
RRLNHRGARRARGRSNEGSPRRAPGSRRCRGTTRPGAGPRGRRRSPGPARPARTRWDNPRESQVPHVCADPKIAFYLGSRDSDDCAVAASAR

SEQ ID NO: 152448 - protein, 48 aa, Triticum aestivum
  Clone ID: PAT_TA_46866.pep
FYSERLSHGNAGVYANKDRRIALRTVAESSILSQWRGSDKDDSCSELD

SEQ ID NO: 152449 - protein, 57 aa, Triticum aestivum
  Clone ID: PAT_TA_46867.pep
SNLGHVLHGAIILLSQITLAMTVTSSEMCDYRLLLVTSVHNGIIAHAYVTQVRFSYH

SEQ ID NO: 152450 - protein, 42 aa, Triticum aestivum
  Clone ID: PAT_TA_46868.pep
FKNVIITVAFRITSLLLIPEFSKEVLLLLPRSTCICYRFIFV

SEQ ID NO: 152451 - protein, 93 aa, Triticum aestivum
  Clone ID: PAT_TA_46869.pep
RFCCSSSLSWASYSLVSCSALASFPLVFSSSFICSSSSFCFFSAVLASSLLLFRFPFSGSVLRRLGVLLFGLRFVVLGLARVCRTLGRPGFPV

SEQ ID NO: 152452 - protein, 67 aa, Triticum aestivum
  Clone ID: PAT_TA_46870.pep
LTVGGIGTVVKRETDDKIIMGEKKNPCVQQGQQHVDAPPHESAASARCYIFLVGRAIRKIRVAFSGR

SEQ ID NO: 152453 - protein, 75 aa, Triticum aestivum
  unsure (1)..(75): unsure at all Xaa locations
  Clone ID: PAT_TA_46871.pep
MSTDAAAADIPVPQVEXTAGPVAXTTAAAASGDSKPVKATKAKAAKTSKAPKAKKSSVFGKSNATLFHPTYSEMV

SEQ ID NO: 152454 - protein, 46 aa, Triticum aestivum
  Clone ID: PAT_TA_46872.pep
QAIILHLTVKMFIKNVYHLVDQSGNIILPRDIRCVGARVAVGVLRT

SEQ ID NO: 152455 - protein, 59 aa, Triticum aestivum
  Clone ID: PAT_TA_46873.pep
DTHPLVTARVAVALGGLGPELHTVAYITTTANNLRIYNPGWIVNEMRSQYNRVLGSPPD

SEQ ID NO: 152456 - protein, 58 aa, Triticum aestivum
  Clone ID: PAT_TA_46874.pep
LPGCFMIIAPGAVPPSVGESVTPVSLMRPPPPSLSPVRSLPVPVVWKASARVPFAGRT

SEQ ID NO: 152457 - protein, 43 aa, Triticum aestivum
  Clone ID: PAT_TA_46875.pep
LKMIEQIVPFLESPSHGSPLCYNHGTYRQRNHTILLKPTRPRT

SEQ ID NO: 152458 - protein, 75 aa, Triticum aestivum
  Clone ID: PAT_TA_46876.pep
FQNLRDQGDSYANITSRIKPPSTYIRQCKKYRFSEAAKAFISGINHLKNYSNHKHYQIDSNCEHKAYLAYSRTTG

SEQ ID NO: 152459 - protein, 88 aa, Triticum aestivum
  Clone ID: PAT_TA_46877.pep
MEMTETVLSVACEEDFCEEEVTCTAVLDGEIYDCGAFALLCAGISTPATEGGFEQDVYTVVDAFGQYDCAVNNFVVHVYHCRGHIGCH

SEQ ID NO: 152460 - protein, 86 aa, Triticum aestivum
  Clone ID: PAT_TA_46878.pep
RPLLLAAMEAKRPWHHPSSPPSRCSFKFGGIRLDPDASAPFRPPRLAWVDGHLDDLIPLAGSNCHRWPDTFSPGGDSPTSSPCNIS

SEQ ID NO: 152461 - protein, 61 aa, Triticum aestivum
  Clone ID: PAT_TA_46879.pep
GPSRRRVALPVEAYAAPPVQEPSSVNLRRAAAPTSSASLPAVVRDLAMSTNMGGCVGKMKM

SEQ ID NO: 152462 - protein, 81 aa, Triticum aestivum
  Clone ID: PAT_TA_46880.pep
TQLILKSTLIMVNFGKTLYIYIYIYIYINIPANINMYCTYAFTSCHKYSITKMYACVGLKTPVQPPKTQSSRLYKINKVGS

SEQ ID NO: 152463 - protein, 63 aa, Triticum aestivum
  Clone ID: PAT_TA_46881.pep
HGSWTPSRNNPILILGTLINSTCKVAPDHQVSASGPKPCISAADQTLSIVSTGVPNLCLVHSF

SEQ ID NO: 152464 - protein, 119 aa, Triticum aestivum
  unsure (1)..(119): unsure at all Xaa locations
  Clone ID: PAT_TA_46882.pep
MPPSWYSFTDEAANFAQEIEKHMVTDFFALELHLRTTGHVFGEFVLHFLGLNRIRSVIRRLKVVRVRQGSWGDEACPANCPCDTMNWRTQTISLTALVDLEINGFXAEDHELGFLKLIL

SEQ ID NO: 152465 - protein, 103 aa, Triticum aestivum
  Clone ID: PAT_TA_46883.pep
RSRVAPLRFRRGPLPLALDLWAPFRWRVPVLPCAWLGSRFPVSMGASPRGPPAVLCSPPAVSLRVAVLLARGSVAAVERGCRSSCMQGSLGCLSRAWVGSGLP

SEQ ID NO: 152466 - protein, 135 aa, Triticum aestivum
  Clone ID: PAT_TA_46884.pep
LLLQDMQSSVLQMISASSTYPAVSWMSGPCRSSRSSFIFSMRFCIDLMLCGILFFFIVAAQVEVGFIFKIFKHVGIHKSLQPQQHGLMLDRLSLSVAEHSLHRLYCDLDDCQGEHAPECHPDCRHGSCLLSWAMC

SEQ ID NO: 152467 - protein, 100 aa, Triticum aestivum
  unsure (1)..(100): unsure at all Xaa locations
  Clone ID: PAT_TA_46885.pep
MANMNITGILEKMTGKDKDYRYMATSDLLSELNKESFKADQDLESKLTNIVLQQLEDASGDVSGLAVKCLAPXVKEVSEDRVVEMTDKACDKLLKWKEQH

SEQ ID NO: 152468 - protein, 66 aa, Triticum aestivum
  Clone ID: PAT_TA_46886.pep
PPWWIHRSPSSPSPSASASPCSQSRRSPVSRDRPPALTPCTHFFILSFSCFHSTRCPSSMRTRARP

SEQ ID NO: 152469 - protein, 111 aa, Triticum aestivum
  Clone ID: PAT_TA_46887.pep
RAGPVPKFIRQTDTEPPGATMEQRSKRTRGAWIYLEGKSQDDTDFITRGRRRLAMDSNRRCGQDEQRCQDPCQFCTRRADDRHGTLGFLQGVASERHPQSNLCTYMADETS

SEQ ID NO: 152470 - protein, 73 aa, Triticum aestivum
  Clone ID: PAT_TA_46888.pep
RNPGRLRVRRSEISTDYWPLARPIQRTRRFFTERRHNRRRALAALRPLRVVHPAACNLRVQRSAVGLWYYITC

SEQ ID NO: 152471 - protein, 123 aa, Triticum aestivum
  unsure (1)..(123): unsure at all Xaa locations
  Clone ID: PAT_TA_46889.pep
RPPTRPPTRPXXAPPEPAPPSLIVVARLPPPASPACRDAPASASTKXTPPAPRRSPLPSSTLRPPATPSCAMASRRSAAVVFFLYGPRIVRPPSALATGPHSRSTVALTSPVLVLLPERGYAH

SEQ ID NO: 152472 - protein, 88 aa, Triticum aestivum
  Clone ID: PAT_TA_46890.pep
TIYNDKAKTQDKEGIPPDQQHRIMGGKQLEDGRTLANYNIQKESTLHLALRLRGGMQIIGKTLTGKTITLEGESSDTIHNRKGKNQDK

SEQ ID NO: 152473 - protein, 78 aa, Triticum aestivum
  Clone ID: PAT_TA_46891.pep
PPQPSPRASGTSRSPAAPPRRRGWSGRSPTPVTQLLPHRAERGARSSPPAADSPAKEARRASRSRSVSMGGVRTRART

SEQ ID NO: 152474 - protein, 72 aa, Triticum aestivum
  Clone ID: PAT_TA_46892.pep
GADAWGQLEPSRCSTTTSSNRAAGRGPPTRGTTVTACAGRGTADAPAYNVFTSSNRSAPPSYDDLLGGFGGK

SEQ ID NO: 152475 - protein, 72 aa, Triticum aestivum
  unsure (1)..(72): unsure at all Xaa locations
  Clone ID: PAT_TA_46893.pep
SGITKVSGHADWVQSGKSSVYRASGGSDVSDDXTCSIICSIASKPHKFNDSRWEAIQVILTKEGSLGLSYFM

SEQ ID NO: 152476 - protein, 116 aa, Triticum aestivum
  unsure (1)..(116): unsure at all Xaa locations
  Clone ID: PAT_TA_46894.pep
SGDLCLDRIRKLSDNCTGLQGFLGFNAGGGGTGSGLGSLLLERLSVDYGKKSKLGFTVYPSPQVYTYVVGPYNRVLSTHSLLEHTDVSILLXDNEVIYDICRRFLDIEARTYTNLN

SEQ ID NO: 152477 - protein, 59 aa, Triticum aestivum
  unsure (1)..(59): unsure at all Xaa locations
  Clone ID: PAT_TA_46895.pep
SLTGAEMGLTFTKLFSRFFAKKEMRILMVGLDAAGKTTILYMLXLGEIGTTIPIFGFNV

SEQ ID NO: 152478 - protein, 115 aa, Triticum aestivum
  unsure (1)..(115): unsure at all Xaa locations
  Clone ID: PAT_TA_46896.pep
VRKSLLDEAVSQLKANTRRLVRRQTANLCRXRRRLHRLNKDFGWNLHHIDATEAFQCKSICMYLPRVLNWPALMCSFPSYAMYILLGTTGDSWHVKVIKPCADTVKRFLSNDTTL

SEQ ID NO: 152479 - protein, 83 aa, Triticum aestivum
  unsure (1)..(83): unsure at all Xaa locations
  Clone ID: PAT_TA_46897.pep
TVQSIPILNYFMAPPRFLSLLYLLSCVSRLTSYNVPPSWTLPTCADELLIEQVKHLNSMGXLRKMVSTLSEVTVFHSTTISTS

SEQ ID NO: 152480 - protein, 49 aa, Triticum aestivum
  Clone ID: PAT_TA_46898.pep
MAAILRCCLLLALVAGLLLGNAAALPHHGPAKHDYRDALTKSILFFEGQ

SEQ ID NO: 152481 - protein, 77 aa, Triticum aestivum
  Clone ID: PAT_TA_46899.pep
IFKGITSPGAWSGSAMPPFSSLDTESTTPASMTAGGYRRGAQTPRRRYGRYAIDTREAAAAERTRCRWWEVASAMRT

SEQ ID NO: 152482 - protein, 55 aa, Triticum aestivum
  Clone ID: PAT_TA_46900.pep
CEEIKNGRLAMFSMFGFFVQAIVTGKGPLENLADHLSDPVNNNAWAFATNFVPGK

SEQ ID NO: 152483 - protein, 40 aa, Triticum aestivum
  unsure (1)..(40): unsure at all Xaa locations
  Clone ID: PAT_TA_46901.pep
MGNCAARGDTAVTAAGAGGEDGKRRRRRWKAXREDQLGTV

SEQ ID NO: 152484 - protein, 58 aa, Triticum aestivum
  Clone ID: PAT_TA_46902.pep
RPPTRPSCLEHIFLPAFMTSSDFSPDAYALPIVICHVPLKTYQSSHNISKSTPRLNNL

SEQ ID NO: 152485 - protein, 42 aa, Triticum aestivum
  Clone ID: PAT_TA_46903.pep
VRGVFRAYNYIARCARIARSTHHMLYHGNNGLLTVGITIYLY

SEQ ID NO: 152486 - protein, 89 aa, Triticum aestivum
  unsure (1)..(89): unsure at all Xaa locations
  Clone ID: PAT_TA_46904.pep
MFGFGHHHKDQAPAAWGGNQIFKIYCRASEDYCLAVRDGEVVLAPDNSKDGTHHWLKDMRFSTTVKDXSVMPPFALVNKAIEHLLLKGV

SEQ ID NO: 152487 - protein, 95 aa, Triticum aestivum
  unsure (1)..(95): unsure at all Xaa locations
  Clone ID: PAT_TA_46905.pep
APAARASTSSRGGGAGAXTRISAATSSSPPPRLRXKLSNELWCRCAGGSAVERRGGRAAALKRSGEGVDGIQSFAVTADATLCFDSPVGCRTRGR

SEQ ID NO: 152488 - protein, 114 aa, Triticum aestivum
  Clone ID: PAT_TA_46906.pep
IALSSKPATRLPDEEPLLRARPAAPPRLRFILCLRARTFRTRGNDSASLSLSAPVMDASFSSSSAFGSSVAPSSSSSCPRIFKCSSIFLLSLRISSRYSSYTLGKNNSKFILGI

SEQ ID NO: 152489 - protein, 137 aa, Triticum aestivum
  Clone ID: PAT_TA_46907.pep
RPQVPKLMTEAELAAMFRDVAVVDEVTVIRDKATKASRGCCFLICPSREEADKAVNAFHNKRTLPGAPSPLQVKYADGELERLEHKLFIGMLPKNVTDAEMTDLFSQYGNIKDLQILRGSQQTSKGKNFLWDQLIFL

SEQ ID NO: 152490 - protein, 41 aa, Triticum aestivum
  Clone ID: PAT_TA_46908.pep
SAAPPQVSTKLCYMLCVFVNLETYHQKKDPAVVSRPAPGKP

SEQ ID NO: 152491 - protein, 105 aa, Triticum aestivum
  Clone ID: PAT_TA_46909.pep
LQCSTIRWDGGRRRAACSTRRSSGSGVGAWPAVAGRQSWYQVAPGTAAGARRTGPKMTGEKADWRGAGERRQVAVDRSGWGRPGRTAAAGGPRVRGRVGGRVGGR

SEQ ID NO: 152492 - protein, 67 aa, Triticum aestivum
  Clone ID: PAT_TA_46910.pep
CAHSQPTLPTKGADASHYQPTKPAAPPSGEVATVLTVEGALLASFLINDDPTAHLCLPIIDKRYLHP

SEQ ID NO: 152493 - protein, 46 aa, Triticum aestivum
  Clone ID: PAT_TA_46911.pep
SARTSPIPLGSLLAKRKHPASPTIPMAHVLARDPYPLAPARNDVGH

SEQ ID NO: 152494 - protein, 53 aa, Triticum aestivum
  Clone ID: PAT_TA_46912.pep
ITSPKKISRSAPRANHHCFLKTCIHQRKEDQIKADIPCPLLHSTNKTSLVQRL

SEQ ID NO: 152495 - protein, 105 aa, Triticum aestivum
  Clone ID: PAT_TA_46913.pep
SADAWAAPLPSPAAGARLRPDFGRIRSRRIRPRLTRICRCRSSMAPWTLTLLADPLLPCTTSVVPCVRALRCLALLTSRPRPHNLDCKLSSKHRWRASVTHVAED

SEQ ID NO: 152496 - protein, 94 aa, Triticum aestivum
  Clone ID: PAT_TA_46914.pep
GGVKARLARDLAEDDDESRLLWRGRRRRLMQAADGARRGGGEAEAAVGQERRGRRGHVMSTRRRGEVVGARNSPSLFSIVCLDGEVWSGGWWTD

SEQ ID NO: 152497 - protein, 135 aa, Triticum aestivum
  Clone ID: PAT_TA_46915.pep
SARPLHPAQPRRRQGAGQPAPPLRPATARHPAARSELVIMVRKSAEKSYGRMAACTSSPEPSENNPRQNFCLGDITWVKHDGSSWWPAQVIDEACASSKAKKKTSHDALVRLYGTCLDLYVDPWKSNMEFEMFLK

SEQ ID NO: 152498 - protein, 33 aa, Triticum aestivum
  Clone ID: PAT_TA_46916.pep
FERDSMCVIYIHHSVTGSNVIIRTRGRPGFRPV

SEQ ID NO: 152499 - protein, 79 aa, Triticum aestivum
  Clone ID: PAT_TA_46917.pep
CQIRANNSSSISVNVATHGVNCNIGDNCCQLNFLEYLVFVIFLQQHEPSLSHRNRNLLISLLSILCVFVIFLLSIFSLL

SEQ ID NO: 152500 - protein, 145 aa, Triticum aestivum
  Clone ID: PAT_TA_46918.pep
VRKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTF

SEQ ID NO: 152501 - protein, 165 aa, Triticum aestivum
  Clone ID: PAT_TA_46919.pep
RPPTRPRTRGRTRGRRSPRPVPSLDHPEGNQRERDEERLLRPGVPPLVWAAFFPNTGRRAQPPGSPSLFAMGFFASLVVFMLLIAPSRQQALDQPSYARTFELETTNYIEVPIWLDQTADLTRASQIVFHPVLPPQQLHLPPHAWIFQLLRGLPLPGGNGHEAIA

SEQ ID NO: 152502 - protein, 58 aa, Triticum aestivum
  Clone ID: PAT_TA_46920.pep
SGAVCTMHANCCVGLRRKIADLTLILHDWRNFMSLRAPDKRSASWSAPRNCSLDKVEE

SEQ ID NO: 152503 - protein, 26 aa, Triticum aestivum
  Clone ID: PAT_TA_46921.pep
PHSNSSAHERAITQPLSIIPFVNERT

SEQ ID NO: 152504 - protein, 127 aa, Triticum aestivum
  unsure (1)..(127): unsure at all Xaa locations
  Clone ID: PAT_TA_46922.pep
RPRTRGRYIYNRVILENPTVRASAVSTLAKFGALVDELKPRIFVLLRRCLFDTDDEVRDRATLYLQTLNGEXVVVGNSEKDVKEFLFGSFDVPLANLEASLRTYEPSEEPFDISLVSREARSQPLHE

SEQ ID NO: 152505 - protein, 59 aa, Triticum aestivum
  unsure (1)..(59): unsure at all Xaa locations
  Clone ID: PAT_TA_46923.pep
LVRAHNGRRDRETESTDGGRPDVILGLSXTSXPXTSAGGYDEKNKGLLQTSYFCDVKSY

SEQ ID NO: 152506 - protein, 87 aa, Triticum aestivum
  Clone ID: PAT_TA_46924.pep
RPPTRPKLLNKHGSLENLLNTAAVRTVGKEYAQDVLVKHADYLRKNYEVLSLKRDVNVQLDDRWLSARDTCNDTSVLSDFILKFSKG

SEQ ID NO: 152507 - protein, 81 aa, Triticum aestivum
  Clone ID: PAT_TA_46925.pep
YAHASAHASGARGLPPPPRRFAGAVRASEDFVHSLGIQKRRLQKHKGAVNTISFNSSGSLLLSASDDDFSLNSNNGARGAT

SEQ ID NO: 152508 - protein, 118 aa, Triticum aestivum
  Clone ID: PAT_TA_46926.pep
EVTNLFQLPTCLFDINTVPKTVIKDSPEAIQTAYQIFTLSPLKLISNSNTPKRNKPKIDFYTHHGSIISIHTHITLTSYPNMRERGDETARPAHESGVAAARGLRSPAGAEGQGCCRT

SEQ ID NO: 152509 - protein, 50 aa, Triticum aestivum
  Clone ID: PAT_TA_46927.pep
THASGCHRDICTTPHGSAASGCSPSSPCTGWRTAGPGHRHSRHLQPPLAS

SEQ ID NO: 152510 - protein, 112 aa, Triticum aestivum
  Clone ID: PAT_TA_46928.pep
IALEVEVEADPAAVSVAVARSVLHEVNAIISVVVLSSKPGARMRLAVIEISVSLLAGRRRVVVLPLLHLLRALLPLHRRRHGRPIEERTESIVTANLPTQLREETGVRVGGR

SEQ ID NO: 152511 - protein, 69 aa, Triticum aestivum
  Clone ID: PAT_TA_46929.pep
AVPADRRNLWQLHAGVGVTVQPRHDVLQPIDERDHGLAHCRRLPRRRRSSRCRVSHRRRQCWVLGDYGR

SEQ ID NO: 152512 - protein, 41 aa, Triticum aestivum
  unsure (1)..(41): unsure at all Xaa locations
  Clone ID: PAT_TA_46930.pep
FKHLINYTGNVCWQDLLRITNRISRYALEYIQWCFVRVXXR

SEQ ID NO: 152513 - protein, 79 aa, Triticum aestivum
  unsure (1)..(79): unsure at all Xaa locations
  Clone ID: PAT_TA_46931.pep
HIRGKSSTTDRCERHLVLLHKMHIFAKTLTGKTITLEAECSDTIHNVKAKIHDTEGMPSNQQRLIFAGKQLXDGRTLAD

SEQ ID NO: 152514 - protein, 101 aa, Triticum aestivum
  Clone ID: PAT_TA_46932.pep
VRLHSQPNAGSSKICAGVPCPANCRTGNHASDISHQAPCICDKTANGHNTFECVDDSCTHRSSIVAKIICHCRNSCSSSREFLPSFGQHDQSMLEKSIHRC

SEQ ID NO: 152515 - protein, 76 aa, Triticum aestivum
  Clone ID: PAT_TA_46933.pep
FSKKMCFVLFPAKNKTLRVLLHRGLKKTGHYWQVNFVRGAVRARHKQKCSLIYCKFFFLFFFKKKFSFWVKRKQMS

SEQ ID NO: 152516 - protein, 72 aa, Triticum aestivum
  Clone ID: PAT_TA_46934.pep
ASVTVFQESIVDLVIFSASTSLSGRLRAIFPLLAPITATCKGPYLHNLALAAVSKQVRNFHWCMKRSPTAQK

SEQ ID NO: 152517 - protein, 36 aa, Triticum aestivum
  Clone ID: PAT_TA_46935.pep
RPKHETPNRRPSSTSFGARRQHARWFRRPCAPDYPT

SEQ ID NO: 152518 - protein, 50 aa, Triticum aestivum
  Clone ID: PAT_TA_46936.pep
VRNTKQQNDSQRCPASIFAPNIHYGVVGPLLLTSLLQTRLLTPRAGTDID

SEQ ID NO: 152519 - protein, 86 aa, Triticum aestivum
  Clone ID: PAT_TA_46937.pep
RKRRSRADGRRRRRRGSTRWPLALPIPIPLRLPCEIEERTATPPTGDTLGPKPMGCSGVRIIFLDRMDPSSSAWWVQPNKVRRLEN

SEQ ID NO: 152520 - protein, 116 aa, Triticum aestivum
  Clone ID: PAT_TA_46938.pep
MASGRFMEEMMREHEQSLLEATCGGLFDHIEDLLDFPKEDSAEDVLLLDAPVPDSPLAARVLAGGAPPPAPASLEQQQQQASLMVPPPPPAGDHSAAFLGALGDTHIGTCDELDMD

SEQ ID NO: 152521 - protein, 59 aa, Triticum aestivum
  Clone ID: PAT_TA_46939.pep
VRPSVHAAVQPCHRPHMLTLPAHAEVDLNNPIPIGLLGDVISDQLTATRLLTYRVRGLD

SEQ ID NO: 152522 - protein, 64 aa, Triticum aestivum
  Clone ID: PAT_TA_46940.pep
KKKFAVNKETFVLIPCPYRTPNKIYIPMIPRFLLPPVQNHPLVVFFYHKTKQNTFFLKNPPTSV

SEQ ID NO: 152523 - protein, 130 aa, Triticum aestivum
  unsure (1)..(130): unsure at all Xaa locations
  Clone ID: PAT_TA_46941.pep
MARAVPILPVSKPFPLPVIAPASRPRAGPLHLHRRRLLPLSPSSSCNTSTSALFYSSSPDLLRDDELDHXEEPPPALEADLRSRRIALLGEPSHFDYXYGYKNRLQNFIKYLRETGDEVIVMTTHEGVPD

SEQ ID NO: 152524 - protein, 48 aa, Triticum aestivum
  Clone ID: PAT_TA_46942.pep
VRHRSLPACESKEGAHERAYQRFRHLARFNYVWYAVQPEFSPSCSSGR

SEQ ID NO: 152525 - protein, 127 aa, Triticum aestivum
  Clone ID: PAT_TA_46943.pep
IYSETLGDTNVNLQSQIHLTLLPIFLLIWIYSPNNNWQPMSFLKPLHEDTNLTYGRLTNIYTLTGYKSYLVGPTTHKSECDVSTEDRRGVIRFHSIQLYVLPVLYPYKDDAILNFSRHFSSMPNPMS

SEQ ID NO: 152526 - protein, 77 aa, Triticum aestivum
  Clone ID: PAT_TA_46944.pep
MAPKAEKKPAPDKTPAGKKPAAEKRPAAGKTVFNEGGGDKKGKNTASWSVVTYTIYIFNVLKQEHLDMGLFSAPPPP

SEQ ID NO: 152527 - protein, 146 aa, Triticum aestivum
  Clone ID: PAT_TA_46945.pep
MYSHKNKDPLIMEVVDDLRTCDVSPNTTMNVLTHFHGNYEIMPMNDRDMRNRRAANVLKKRADDVKKLRAFFNEFRAHNSKFYYDVEDDSEGVTKNIFWSHASCQANYAEFGDVVTFDTTYKCNFYKMPLAMFVGSNHHLQNVIFG

SEQ ID NO: 152528 - protein, 95 aa, Triticum aestivum
  Clone ID: PAT_TA_46946.pep
MESTGVARRTSTVQELASALGKPDVPAQYVSRGHHENDQQPAAVPVPVIDIGRLFNHDGADAADDEAVKLRQALESWGLLLVTNHGVDTSVMDGM

SEQ ID NO: 152529 - protein, 130 aa, Triticum aestivum
  Clone ID: PAT_TA_46947.pep
GIMAKCYFDWAALHHLHASRRSKPNTCVCTIKRQLAFFVLHCSRSCASPDLEPKNLPGELHVLYAPASPVKAEPVHTLPDAEKLGIYNKLIRGLCSDRQTETLVLECYWRALEQTEFRTHKKTMNALTVQ

SEQ ID NO: 152530 - protein, 122 aa, Triticum aestivum
  Clone ID: PAT_TA_46948.pep
LERPPWTVPPRHRRRGDVEVMARGRQLLPRGQRDLPSDRPAHTRRTRPIEIREVTADGIVMASEVPFYDVLPKARTKHQLKWRRRIQKLGTYGNATIVYPLAAIEQEILNAMGALAVQQFED

SEQ ID NO: 152531 - protein, 109 aa, Triticum aestivum
  unsure (1)..(109): unsure at all Xaa locations
  Clone ID: PAT_TA_46949.pep
SRAPCRATCTPAPLPQSLRSRPPRRWPSRPPLLLPAGPPEPPGPPASLSWQQHPASSSSSPTXALRPTWKLSSXTPRPPPSPHSSQLSWPMQPQPQRPSSWQPTPHRPG

SEQ ID NO: 152532 - protein, 71 aa, Triticum aestivum
  Clone ID: PAT_TA_46950.pep
KKPPRSASKFASTLRTLSYKKRDELDEDCENLHQQTNEDDPYQILETAYDAHAYINYEAIHGTYMHLRLIL

SEQ ID NO: 152533 - protein, 95 aa, Triticum aestivum
  Clone ID: PAT_TA_46951.pep
AFLCVLRFDQSNDAGPIKRTSKITSEMSSKWLITLMLTVRRGARSGSKFINYIFLNIRYYSCNCSGYCRDCCPQMYPRKDLYLGLNIVLSPICSR

SEQ ID NO: 152534 - protein, 47 aa, Triticum aestivum
  Clone ID: PAT_TA_46952.pep
MSVESTLVFRGTQREQQHLRVTCMHGCMSAWQQVKMFLLARAAGVPY

SEQ ID NO: 152535 - protein, 55 aa, Triticum aestivum
  Clone ID: PAT_TA_46953.pep
TLSWSEYQFPSMVQFWILFSSRCIGFCWSHWLLHFSDTIAQCHAHLLFCKNEKST

SEQ ID NO: 152536 - protein, 47 aa, Triticum aestivum
  Clone ID: PAT_TA_46954.pep
KKSRPRSRLYLGLSISCPSMVQGRATIWFYIYYFLLGPFTSTLVAPQ

SEQ ID NO: 152537 - protein, 139 aa, Triticum aestivum
  Clone ID: PAT_TA_46955.pep
RPAPQYLQDAAQGTVATPPGKRGGGVWSLNVHPHNTVAPTYMKTLRWNQGHFKLDPIRNLAFLKPVPSDPFVMKLSHHDMKTDSIMTNHAAGQRCIASTLIPHKPVMSVQTRLMRHEAPQHKIHAEDIRSTKWFAIPHT

SEQ ID NO: 152538 - protein, 67 aa, Triticum aestivum
  unsure (1)..(67): unsure at all Xaa locations
  Clone ID: PAT_TA_46956.pep
RTRTRGLKIFREDSARFYAAXVVSGLEYLHCLGIIYXDLKPENILLQADGHIVLTDFDLSFLTSSKP

SEQ ID NO: 152539 - protein, 112 aa, Triticum aestivum
  unsure (1)..(112): unsure at all Xaa locations
  Clone ID: PAT_TA_46957.pep
VRVAHDYTSGNGTTSTALLIMEXVKMSERCIEXGTHTPFLGDGSEASKKATIECLETFNTAVVISDQPDXEILKHVARSTLTTKLYESLADXLTDIAANAVLCIRQSDQPID

SEQ ID NO: 152540 - protein, 148 aa, Triticum aestivum
  unsure (1)..(148): unsure at all Xaa locations
  Clone ID: PAT_TA_46958.pep
SADVDMRDKLTTFILKNPPEQKXGGKDKXAMRRAEKERMKEGEAADEEMKKLKKDAKKKGASSKDTKKKAAGGGSDEEHATSPTHSQGADIAAAGDDDDDDDDDVQWQTDTSAEAARKRMEEQLSAATAEMVMLATEETEKKKKQALH

SEQ ID NO: 152541 - protein, 112 aa, Triticum aestivum
  unsure (1)..(112): unsure at all Xaa locations
  Clone ID: PAT_TA_46959.pep
VRGKKLPESRYLFAISCFRMNLLREAEETLCPVNEPNVEVPSGATGHYLLGLIYRYTDRVAAAAEQFTQALTLDPLLWAAYEEMCILXVAEDANECFTEATALRLQQEQTST

SEQ ID NO: 152542 - protein, 51 aa, Triticum aestivum
  unsure (1)..(51): unsure at all Xaa locations
  Clone ID: PAT_TA_46960.pep
MPSNKTFRFRRNLPKKHRQNRPFPYWIRLRPDTTIRXNANRRPWRRTKFEF

SEQ ID NO: 152543 - protein, 132 aa, Triticum aestivum
  Clone ID: PAT_TA_46961.pep
DYEQSIASSHQELLVASSPYQSKCHVQYEAAARMSCWREPAGGRRGGPTRDGQLLRLDARAEELGAGWGASSPCYDDGERAASSARWIQRRAKQMRRVEVGCARRPEETRGGLEGGGAPAGEEHGVGVWWPD

SEQ ID NO: 152544 - protein, 89 aa, Triticum aestivum
  Clone ID: PAT_TA_46962.pep
GALTRYQKFAWRRSGTLGYIRPTRQRDGGHALKWEAELASPNDDGFDLKWKWEAKSKPCAAGKVETKWGAEEANKDDNNPARKCQIKEI

SEQ ID NO: 152545 - protein, 64 aa, Triticum aestivum
  Clone ID: PAT_TA_46963.pep
VVPWVSRKMLLRHERKDGMIERSRGHPLTHGTAFPSASPAMAEGLISWDGSGGGRGSSSRGASA

SEQ ID NO: 152546 - protein, 63 aa, Triticum aestivum
  unsure (1)..(63): unsure at all Xaa locations
  Clone ID: PAT_TA_46964.pep
SQFEKNLDWSYKMFKPGXKDIFXMNQSELEAEIXKVSQDSTLGPRMKAYVSRVAIFDIDGALP

SEQ ID NO: 152547 - protein, 94 aa, Triticum aestivum
  unsure (1)..(94): unsure at all Xaa locations
  Clone ID: PAT_TA_46965.pep
SNNQRKERRKNXLVGPAAERTSVAPLSMFPSLLSSTNYYIPSYPSLHILACIERQICHGEMKQIRRRPGACHLLVGESAACSHCTLEWWQGRAD

SEQ ID NO: 152548 - protein, 122 aa, Triticum aestivum
  unsure (1)..(122): unsure at all Xaa locations
  Clone ID: PAT_TA_46966.pep
MARTKQTARKSTGGKAPRKQLATKAARKSAPTTGGVKKPHRYRPGTVALREIRKYQKSTELLIRKLPFQRLVREIAQDFKTDLXFQSHAVLALQEAAEAYLVGLFEDTNLCAIHAKRVTIMP

SEQ ID NO: 152549 - protein, 111 aa, Triticum aestivum
  Clone ID: PAT_TA_46967.pep
VLTWLALQLQRLRWALLEMLTRMRGEQRTAEQDALLEPSRLQEADDVADMHTCSEDIDQDMHCLIGSKRQRTAGQDAPLQPSRLQEADDVVDMHTCSVDNDQDMHRLIGIP

SEQ ID NO: 152550 - protein, 54 aa, Triticum aestivum
  Clone ID: PAT_TA_46968.pep
QKTTNPLTKFPFTTKFVPPILFSNKSHPYFFTKHPLIHIINPPTLLLLTQNSPL

SEQ ID NO: 152551 - protein, 79 aa, Triticum aestivum
  unsure (1)..(79): unsure at all Xaa locations
  Clone ID: PAT_TA_46969.pep
ARATRPNARTRRRALRVRERPWDCPHRGRDRELTSAGLPTLSLVTPHTGAAPPXPYFSYGLPPRAPHPPVASLPTPTHP

SEQ ID NO: 152552 - protein, 109 aa, Triticum aestivum
  unsure (1)..(109): unsure at all Xaa locations
  Clone ID: PAT_TA_46970.pep
MAPIKIRMNGFRRIGRLGARVALQSPDVELVAVNDPFITTDYMTYMFKCDTVHGQGKHHEVKVKDSKTLLFGEKEVAVFGCKNPXEIPWAAAGAEYVVEYTGVFTDKDK

SEQ ID NO: 152553 - protein, 144 aa, Triticum aestivum
  unsure (1)..(144): unsure at all Xaa locations
  Clone ID: PAT_TA_46971.pep
RPPTRPIRHPHLLMLLGACPDRGCLVYEYMENGSLADRLQRXKGTPPIPWFDRFRIAWEIGSALVFLHSTKPSPIIHRDLKPENVLLDRNLVSKIGDVGLSTLMPPKETLSNRTVYKKTGLAGTLFYLDPEYQRTGQVSVKSDT

SEQ ID NO: 152554 - protein, 103 aa, Triticum aestivum
  unsure (1)..(103): unsure at all Xaa locations
  Clone ID: PAT_TA_46972.pep
LGVNTTSGEWRVSPPLASDXGAGAAGGGWGKGSFLGTGGQGGVDWKAAESLSLPTSRGLEAPTDRQGTPRRRIAKESPPGGVPRISTGSEREALEGRRGRRRT

SEQ ID NO: 152555 - protein, 150 aa, Triticum aestivum
  Clone ID: PAT_TA_46973.pep
VRWTPSHGDQLDNHDLFVIISCCPSLTDLTLSFCSQIDDTGLGYLCYSEKLTSLRLNSATEITSCGLLSVAVGCKSLSSLHLINCEKVGSTEWLEYLGLNGSLEEFVLKNCNGISLYDLIMLGPGWMKLRRFEFRMGGIWDVHEGYDHME

SEQ ID NO: 152556 - protein, 124 aa, Triticum aestivum
  Clone ID: PAT_TA_46974.pep
RPRTRGRTRGRDPKTLRRLAHNREAARKSRLRKNAYIQQLESSMIRLAQIEQELHSARAHGVLYPGSSLLAEQGIAGKGLGGIDGLSSEAAMFDVEYSRWQEEHNRLMYDLRAALQQHLPEGEL

SEQ ID NO: 152557 - protein, 114 aa, Triticum aestivum
  unsure (1)..(114): unsure at all Xaa locations
  Clone ID: PAT_TA_46975.pep
GDHYIVDFTKKAQPKTCLIAKSSKGXWLWHRRLGHVGMRNLDKLIKGNHILGVNDVIFDKDRHCSACQAWKQVGGSHRAKNIMTTRRPLELLHMDLFGRNAYKSLGGNYLADHS

SEQ ID NO: 152558 - protein, 40 aa, Triticum aestivum
  Clone ID: PAT_TA_46976.pep
RLASACSLSSSARSWSMARIPPAELPVNVKKVARPTSPRT

SEQ ID NO: 152559 - protein, 79 aa, Triticum aestivum
  unsure (1)..(79): unsure at all Xaa locations
  Clone ID: PAT_TA_46977.pep
RGSTLTYTNLPHPSLRVGRSNIKSLKFNSQPGDLQNPDWKNLNVTQLNPLLANSLFTKXPNTEQPSKHLPTQHLHSLNP

SEQ ID NO: 152560 - protein, 78 aa, Triticum aestivum
  unsure (1)..(78): unsure at all Xaa locations
  Clone ID: PAT_TA_46978.pep
MGGTASRLAAPIKHRRVERELDNKVAEALRERAKARTKTFRSVNSITMRXPRFKDGLKDIRDVFDHYDTDXNGTIDNE

SEQ ID NO: 152561 - protein, 84 aa, Triticum aestivum
  Clone ID: PAT_TA_46979.pep
DPLLRPTTRRTCRRGRPGEPQPRWRYGLGCEPHAPTRRFRAYAPATSLSRDHIDFLPDARAARRCGSSTRPDRVMREDIPYIFT

SEQ ID NO: 152562 - protein, 75 aa, Triticum aestivum
  Clone ID: PAT_TA_46980.pep
LFFSFFFFFFFIFFFFFFSHKKGGPNQTKEQPTLRNQQLLLLYKPALKISPPWASQPFFPLKQSPALPAFLFTPT

SEQ ID NO: 152563 - protein, 50 aa, Triticum aestivum
  Clone ID: PAT_TA_46981.pep
SAYIISIAPWQPTAYMRGHSYIYHSVHRCNGCHPSLHIGFLYRWYVQQST

SEQ ID NO: 152564 - protein, 115 aa, Triticum aestivum
  Clone ID: PAT_TA_46982.pep
RACTDAPNSRQEEEKQDARSSILRQPSRDTGENLGRYHGPHTRMSCSKSEPRFEVLEESQCDISEERRDARVVFEKSTEAEAVYTNAEIPRIFRQYRPTWATLGLNYLQAITLAP

SEQ ID NO: 152565 - protein, 58 aa, Triticum aestivum
  Clone ID: PAT_TA_46983.pep
RNVDLHVRVRVLIRVTLRIRRHIRISFTVTHTHTKPAGTIRGCDDESHQQGHNIPIAH

SEQ ID NO: 152566 - protein, 46 aa, Triticum aestivum
  Clone ID: PAT_TA_46984.pep
RPPTRPVITCLRSFNYKTNVFVLNVMFDHLGNQVLLDICTPILKQM

SEQ ID NO: 152567 - protein, 35 aa, Triticum aestivum
  unsure (1)..(35): unsure at all Xaa locations
  Clone ID: PAT_TA_46985.pep
MWRLKIAEGXADPWLPTKNAHVGRQVWEFDAAVDD

SEQ ID NO: 152568 - protein, 66 aa, Triticum aestivum
  Clone ID: PAT_TA_46986.pep
MPYCEVDRYQAGDKWEGVRLFYRRYGRGATKVLLVIGLAGTHDSWGPQIRGLTGSMEPGDGGDEPT

SEQ ID NO: 152569 - protein, 65 aa, Triticum aestivum
  Clone ID: PAT_TA_46987.pep
VRSQLTNKRCFQKKGSSFSTSSIPSHESCDGDDDDYLREKANSKADSIGSTVIMLLCAADYKRSS

SEQ ID NO: 152570 - protein, 58 aa, Triticum aestivum
  unsure (1)..(58): unsure at all Xaa locations
  Clone ID: PAT_TA_46988.pep
PTRPXTRPPTRPQSLKLNLSQTALLCSLSVCLVIVLMLFTADFKLSPACMFISSTFLT

SEQ ID NO: 152571 - protein, 132 aa, Triticum aestivum
  Clone ID: PAT_TA_46989.pep
RPLKEFENARVDDVMSEAATADGSDDDCFMKEGESEAPTADGSHEDCVMMEGESEAVIPEAATADGSDDVKPGAATSDGSDGILWKGKSEAVASRDSLEMVVGGGDTFEGTPWSTRKSDGRNTVCVLSEEAT

SEQ ID NO: 152572 - protein, 124 aa, Triticum aestivum
  unsure (1)..(124): unsure at all Xaa locations
  Clone ID: PAT_TA_46990.pep
KPTIHGAWCSSCTHSYRRRPNDAYRASAHFLRETMHAHAEAYHGELPPTVKTXIVSPVRVILAIDEYNATCWKRLDSIGLDNTKANRHACTTLLVFGPGLGNHIYGSILCXETLYHSTVNGKNI

SEQ ID NO: 152573 - protein, 158 aa, Triticum aestivum
  Clone ID: PAT_TA_46991.pep
MTSQTELQKPALTGGPEVSEEPVQPKPAMEISLDLLENMDDSDVSTPMGPGGKQKRSFFKSPVDRTSERLALSEVRQNIDTFRCKANLLIIQADRCWREEGAEVMLELSNSNGWCVAVSYMGHQSSLLRAGFYGQPDTHAYGSKMMELSPAMDWLVKT

SEQ ID NO: 152574 - protein, 113 aa, Triticum aestivum
  unsure (1)..(113): unsure at all Xaa locations
  Clone ID: PAT_TA_46992.pep
MAPIKIGSMVSPDXRLVARVALQSPDVELVAVNDPFITTDYMTYMFKYDTVHGQWKPHEVKVKDSKTLLFGQKEVAVFGCRNPEEIPWAAAGAEYVVESXTGVFTDKDKAAAH

SEQ ID NO: 152575 - protein, 119 aa, Triticum aestivum
  unsure (1)..(119): unsure at all Xaa locations
  Clone ID: PAT_TA_46993.pep
MAAAVRLFLRRRLATATATPPTPASILNPSSPTTPLTSRQKTRLAIYLLKCXPAPPIPELSSARRDSPETTRRVSSSHSGITPDPQTTSLYTANAWLCRRSPSITQVLTSTPLLMATSA

SEQ ID NO: 152576 - protein, 51 aa, Triticum aestivum
  Clone ID: PAT_TA_46994.pep
QRNMFYDENQSSYRCILSVEKIPLLKHYELFFDTMLKVGCIFVKLMVIHSA

SEQ ID NO: 152577 - protein, 152 aa, Triticum aestivum
  Clone ID: PAT_TA_46995.pep
SGKFEGFGKEHNWIAISGLWQLEYFQKLLLRHNIDVMHNEKNVSEALPKTCLDIPEKTKDSNKARLDVALYCDRPKLHLNKNSRGVWKKPRAKYCVSKEDRMTILKWFKEVKFSDGFAANLSKTVNLSKNKFIGLKSHDHHIIMERLLAVAL

SEQ ID NO: 152578 - protein, 100 aa, Triticum aestivum
  unsure (1)..(100): unsure at all Xaa locations
  Clone ID: PAT_TA_46996.pep
RPPTRPTTPTPPAPRXCLPPPPPLSRMASTAPPPPPPFPDAVVMSAFSPTLWSSRHTPLPAYKTPFAPPLSTQPGLPPTGGFVVVTRALPLPDEEMHRPP

SEQ ID NO: 152579 - protein, 97 aa, Triticum aestivum
  Clone ID: PAT_TA_46997.pep
FQLHGHSLSLLRLSSCACDPSFFVISHMCSVFSMMSLKETEMGQQLGYVNAAMIAINHMLHVLVRALLIVPRSLTCPSIYLLSVSASSKLSSHWQDA

SEQ ID NO: 152580 - protein, 125 aa, Triticum aestivum
  unsure (1)..(125): unsure at all Xaa locations
  Clone ID: PAT_TA_46998.pep
AAAGARRPAPAVAAASRGLPCQXAPRRSCSPSCSSCPSHRPSRPELCRRXPPAPPPCSCSCPAPSTTPASCLPHGAAGRAALGRPRRLFHIEQSCGGERERGVKWLSSSREQEGGRQXGVHARGR

SEQ ID NO: 152581 - protein, 103 aa, Triticum aestivum
  unsure (1)..(103): unsure at all Xaa locations
  Clone ID: PAT_TA_46999.pep
WPLHRSSLMSHEAIKPHVPVTHTLFLAAAAASMLFLXSPLHHHHPLHEPPLPRLSCSHLRASKGGRIGRRQRKRRGSRESSEGRDVPAKGDGGGGGCVCGSGR

SEQ ID NO: 152582 - protein, 66 aa, Triticum aestivum
  unsure (1)..(66): unsure at all Xaa locations
  Clone ID: PAT_TA_47000.pep
MGANGHPPPASAAAQNGSHSSGGGGGGGGGGGGGGXXNPSSGSALAPTTGLSGGTREQHLTAVKMH

SEQ ID NO: 152583 - protein, 56 aa, Triticum aestivum
  Clone ID: PAT_TA_47001.pep
MSKRGRGGSAGNKCRMSLALPAADTVNCADNTGAKNLKIIFVKGMKVRHNTLPSAC

SEQ ID NO: 152584 - protein, 79 aa, Triticum aestivum
  Clone ID: PAT_TA_47002.pep
EKWEVRPHESKMIACFQGEVHVICSSIPRSKGQYNSAMDYHTAFVGIYKMCTIKSWSEQNVIIFDRGMSNRFYRSRADG

SEQ ID NO: 152585 - protein, 63 aa, Triticum aestivum
  Clone ID: PAT_TA_47003.pep
LTESRPGFFSRSPSLTLPTGVPPSRWIAWIGHCTIWHTGNISHFSSVGVLTSETLSFCVFFGR

SEQ ID NO: 152586 - protein, 114 aa, Triticum aestivum
  Clone ID: PAT_TA_47004.pep
SAHASASRQRPPAVDPLALPRRRAPPSSTPGRRVEGVRRRRPARTPGRSSTRRRPAPAPGRPQLATATVLKATKHSLSSACISTYIATKQLQLHVFSMSRLSMSQRGTPMLGWE

SEQ ID NO: 152587 - protein, 71 aa, Triticum aestivum
  Clone ID: PAT_TA_47005.pep
MDQRARYPPGIGNGRGGNPNYYGRGPPPTQQHQHQQPPQQQQQAQGQRQSQHSQHHSQQLQHQQWLRRNQT

SEQ ID NO: 152588 - protein, 68 aa, Triticum aestivum
  Clone ID: PAT_TA_47006.pep
MAAAAGEAPRALSQKEQDIQMMLAADVHLGTKNCDFQMERYAYKRRSDGIYIINLGKTWEKLQLAARV

SEQ ID NO: 152589 - protein, 135 aa, Triticum aestivum
  Clone ID: PAT_TA_47007.pep
VRPRVRSSKKTNSPDDSKDNSAQKGRKPDRVGVICFDMEGTYLPNLELISCHCAPCKGQKFLFNEWERHAGCRSKNWKSSIKMKETLMPFGKWIDQHQPSVCSTYPSKRSSQKLKKQQLLDLLNEPYDHVQVKWT

SEQ ID NO: 152590 - protein, 111 aa, Triticum aestivum
  unsure (1)..(111): unsure at all Xaa locations
  Clone ID: PAT_TA_47008.pep
NKLDISTSTHPPMKVVGIEPIMVDRYSILQGDRGYHLXQGAGPSFLPGHPREGPPPSPVIRPPPAAYPALLLRPPPAPLHLSPVGHAGFSRAGSSVPPAAHMRHISSHAWS

SEQ ID NO: 152591 - protein, 89 aa, Triticum aestivum
  Clone ID: PAT_TA_47009.pep
ARVRDRVDEPNSGEDMRKAAHDELLCNTAMHIKASVLKKDEINKHLQKEANVQEEIQETHSVVNRIEDPEAHQIDSHATNTIPIHPAEN

SEQ ID NO: 152592 - protein, 42 aa, Triticum aestivum
  Clone ID: PAT_TA_47010.pep
GSILGPNMAPHPVRPYTAFVLNLILQQSLRNHHTRICIFFRT

SEQ ID NO: 152593 - protein, 77 aa, Triticum aestivum
  Clone ID: PAT_TA_47011.pep
RPTTLLFKLKKQRDEECIINCLPGQLIERIFFKLTESTLLRCTGVCEQCHKIMRGPQFVTSHVQHAPHYALVLLPHE

SEQ ID NO: 152594 - protein, 47 aa, Triticum aestivum
  Clone ID: PAT_TA_47012.pep
KVIKVVEDSDISRLIENYKSVCVCIEVNRKLELGISKILLVGDGGVV

SEQ ID NO: 152595 - protein, 95 aa, Triticum aestivum
  Clone ID: PAT_TA_47013.pep
MKMSSPAALCVFVLLASLLAAARAEDPYRFYTWNVTFGDIYPLGVKQQGILINGQFPGPQIDAVTNDNIIINVFNNLPAPFLLSWQGIQQRRSSW

SEQ ID NO: 152596 - protein, 57 aa, Triticum aestivum
  Clone ID: PAT_TA_47014.pep
MATTAAPAAAYGTLIAFLLVAGAAADDGAALLEVEKSFRNVGNVLYDWSGDDHCSWR

SEQ ID NO: 152597 - protein, 131 aa, Triticum aestivum
  unsure (1)..(131): unsure at all Xaa locations
  Clone ID: PAT_TA_47015.pep
FLVPAAEKFALGGLLGCGXRCSYPRCTGQRLVPLTLSLSQPLQSMAPLPSTALPDPSSPRKGVAPPSLLHATAPPAHLSPRRRHRPPSLPVNFSHRRVEANPTRPPVWHPGQPEPDGSCRRAHGSPYMPAT

SEQ ID NO: 152598 - protein, 86 aa, Triticum aestivum
  unsure (1)..(86): unsure at all Xaa locations
  Clone ID: PAT_TA_47016.pep
VRLPPPADPTRPTNPPSPPQQLGISPRRPPAPRPPPTPXPVPPPPSTPGPAPHGASPPSPPFARRGAAFLLPPPRQRSPAAGFRGF

SEQ ID NO: 152599 - protein, 93 aa, Triticum aestivum
  Clone ID: PAT_TA_47017.pep
MADVEYRCFVGGLAWATDDQSLQNAFSKYGDVIDSKIITDRETGRSRGFGFVTFASDEAMRQAIEAMNGQDLDGRNITVNEAQSRRSVGGGGR

SEQ ID NO: 152600 - protein, 122 aa, Triticum aestivum
  unsure (1)..(122): unsure at all Xaa locations
  Clone ID: PAT_TA_47018.pep
MCIHKKLKCHASFMPNGXMNXPNIVKLKEVIRENDILYFIMEYMECNLYQLMKDRVKPFAESDVRNWCFQIFQALAYMHQRGYFYRDLKPENLLVSKDVLKLADFGLAREVSSAPPYTKYVS

SEQ ID NO: 152601 - protein, 135 aa, Triticum aestivum
  Clone ID: PAT_TA_47019.pep
MARNPASSVYVGNLDEKVPERVLYEILIQAGHVVDLHIPCDKETGRPKGFAFAEYETDAIAQYAVRLFSGLVRLNGKTLKFALSGQDKPSSNGNNPVMPKLNPIPLPKQPQVVHSSDTLVSHKPAYPVVNGGIPH

SEQ ID NO: 152602 - protein, 61 aa, Triticum aestivum
  Clone ID: PAT_TA_47020.pep
VSLTFALRYMNSFTKASPLSDQVTISLSSELPVVVEYKIGEMGYIRFYLAPKIEEDEEMKA

SEQ ID NO: 152603 - protein, 159 aa, Triticum aestivum
  Clone ID: PAT_TA_47021.pep
RPHGPKFGGGFDCRYCPLITRGGGATRFREHLGGIPGDVRECPNVPRNIRAAMRESRDDSMRKKREKKNRRFRLERDIMEGLYHGEGVINIEDDEEEIQAALRETLRDKNVSCAVERRRGSGSGVRVCLGKQSITAYFDKELSSNKVSMQPKISTAFEC

SEQ ID NO: 152604 - protein, 56 aa, Triticum aestivum
  Clone ID: PAT_TA_47022.pep
VRRKMIKYVRSQVCGNYYRPELTNPALARLSAMYRRHQVYTGHGINQEDTGCRLRL

SEQ ID NO: 152605 - protein, 115 aa, Triticum aestivum
  unsure (1)..(115): unsure at all Xaa locations
  Clone ID: PAT_TA_47023.pep
WPSGRGVNLLGWCSPIVSPYMLLAQMALAINGLNYDYFPEDRWSTSDLLITSNPVYKKVPFLIHNGRPVFESLLILXYLYDSVCLAGXNCKSILPAYPYIRTLVSSWPTMLSTCC

SEQ ID NO: 152606 - protein, 110 aa, Triticum aestivum
  unsure (1)..(110): unsure at all Xaa locations
  Clone ID: PAT_TA_47024.pep
MNSTYAEREEMGFTFTKLFSRLFSKNEMWILILGIDSSGKTTILYKFKFCXIVTTIPTITFQCXTLKFKNIIFTVWHISXYFKIRPLWTLYLLNTQCLIIAVVSHYWDLF

SEQ ID NO: 152607 - protein, 165 aa, Triticum aestivum
  Clone ID: PAT_TA_47025.pep
SASSLSRATCGGGWRTRASKAAEESAEVVQEVLSQGIKEFTLAEIIAATKNFAHDTMMGYGSHGRVYRGRLHDGREVAIKRMSENIQLEDFRTELDVVAQLQHKHIIHLLGWCVSSKGKRLLTRRTKELERLIVYEYMENGTLFDHLHRNQAGSSMPSPVDMSLK

SEQ ID NO: 152608 - protein, 166 aa, Triticum aestivum
  unsure (1)..(166): unsure at all Xaa locations
  Clone ID: PAT_TA_47026.pep
MPPAEDASAAAPPQAPTPPPARGMAVGSRLLLQSPPPAFPLGSRLLLQSPPPAFPLGSNDDQLERARARAMARAASVRRRSLAASLAPKTSHPNLLNRDEVMDLFHNCIKLASENKINQKNTWELGLIDHLSEIXXAGEEEDDETNFQKASCTLEAGVKIYSLRVD

SEQ ID NO: 152609 - protein, 51 aa, Triticum aestivum
  Clone ID: PAT_TA_47027.pep
TTAKLSSSITPMHDCHLQSPIAHTDPRSVIAYAGCYRNTWHASSSIARPPG

SEQ ID NO: 152610 - protein, 72 aa, Triticum aestivum
  Clone ID: PAT_TA_47028.pep
FLFFSFFVDFGPNQTEFIWLWIIFSPPNAQGTNPLGPDTTDQTSHRNKKRGKRQESGTLIPISYSHGGTLVQ

SEQ ID NO: 152611 - protein, 94 aa, Triticum aestivum
  Clone ID: PAT_TA_47029.pep
LMVYTCFAWFCHVLGPAPGVASATIAHTAAAAASSVLGMHVYGESSVLVAAAPPFGFSVNRNGYNSSGMFICWRRSFSTNVWLCATFGGRHCMN

SEQ ID NO: 152612 - protein, 105 aa, Triticum aestivum
  Clone ID: PAT_TA_47030.pep
RPPTRPRAHGVAAVASYGVYQNQEVPVSFNAFLYTDKMAALEAQLGTVNGEKIDSKNDWPHVTLWTAPGVAPKEANMLPQLFSSGQAERVLIDPPITITGVLDFY

SEQ ID NO: 152613 - protein, 105 aa, Triticum aestivum
  Clone ID: PAT_TA_47031.pep
HQIAGTNVTLLERQSEFTLFFFTKLFLGILPLLLFLRSAHIVLRKKNKKSKSDYWRTGGIKRERKMERIYMCSLDSPDSQSFPHLRPPHLPKILHTHHKNYTPKS

SEQ ID NO: 152614 - protein, 130 aa, Triticum aestivum
  unsure (1)..(130): unsure at all Xaa locations
  Clone ID: PAT_TA_47032.pep
MSKSLRRFPPKPSNPKANGGLLSLHFNPPRACAYYIIGSARACHTPPPPAALRRRPHTPDPAEPGVRGGAAARWPTRRTPTTPTAPPSSPAXPAHPPSAPTSSPSSTSPPSASASRSERSPRSATAPTSR

SEQ ID NO: 152615 - protein, 96 aa, Triticum aestivum
  unsure (1)..(96): unsure at all Xaa locations
  Clone ID: PAT_TA_47033.pep
MFGFGHHGHHGHXHPDHAPAAAGGNHXKVRSVCTADEGYWLCRRDGNVVLVPSNPRDEHQHWFKDMRFSAQIKDEEGNPAXAIVNKATGLAVKHSL

SEQ ID NO: 152616 - protein, 63 aa, Triticum aestivum
  unsure (1)..(63): unsure at all Xaa locations
  Clone ID: PAT_TA_47034.pep
NNPLKQPQECHASSPPLGRRRFAGSVNAXXAGGGGRMGSAAKXXXXRGGLDPRVRGRVGGRVG

SEQ ID NO: 152617 - protein, 35 aa, Triticum aestivum
  Clone ID: PAT_TA_47035.pep
ARSELVDQHGAGLNAVDDDLEEVRVVVDRSDPKTR

SEQ ID NO: 152618 - protein, 79 aa, Triticum aestivum
  Clone ID: PAT_TA_47036.pep
VRRSLLNATLVIPIFHLNNVWRDPSKFSDMVDEDRFIGTLRQHVRVVKELPKDVLLRFNHNISRIPNMRTKAYSFPDHY

SEQ ID NO: 152619 - protein, 60 aa, Triticum aestivum
  Clone ID: PAT_TA_47037.pep
YSTNSSPQAPLADASNVDLQRWRTIMTTCTVKGQGTQAPPVVHHRPPMPLLHTGKTHQLE

SEQ ID NO: 152620 - protein, 143 aa, Triticum aestivum
  unsure (1)..(143): unsure at all Xaa locations
  Clone ID: PAT_TA_47038.pep
MGKEKTDINIVVIGHFDSGKSTTTGHLIYKLGGIDKRVIERLEKEAAXMNNRSFKYAWVLDKLKAERERGITIDIALWKFETTKYYCTAIDAPGHRDFIKNMITGTSQADCAVLIIDSTTGGFEAGIFKDGQTREHPLLAFTL

SEQ ID NO: 152621 - protein, 98 aa, Triticum aestivum
  unsure (1)..(98): unsure at all Xaa locations
  Clone ID: PAT_TA_47039.pep
ILRQTILMWCQCSFSEMSXXHISSHQSFSCYKLTIHFTSFINDLHKPSLHKIIFHNVICLFSNVSYKYSLFIFINTLSLLLSSTSFILIDLFIFNYQL

SEQ ID NO: 152622 - protein, 80 aa, Triticum aestivum
  Clone ID: PAT_TA_47040.pep
YYLYLQPYYIYLSIYLHFILTYSHTLPTNNFLILAILTLLLYLYNNIILILIIQTYPFYLPLFTQLILPYILTYFSYLYI

SEQ ID NO: 152623 - protein, 87 aa, Triticum aestivum
  Clone ID: PAT_TA_47041.pep
HQLRLICLQRTSTRAAFALAQVMCCQRNMSALHLHQIRGLTTHRLGAKFTSRPTECYRKRKCFQNHASTKDCKAEEPLRGNCSLTRS

SEQ ID NO: 152624 - protein, 96 aa, Triticum aestivum
  Clone ID: PAT_TA_47042.pep
MALESNCSSRCTTETAKGTHVLEIIGYSLKKGLGIDKFVQSAIFTVGGYDWTIRFYPDGANMSYADCVCVSVSREPTGRGLARASCDLRLCNKDTG

SEQ ID NO: 152625 - protein, 91 aa, Triticum aestivum
  Clone ID: PAT_TA_47043.pep
RAFFFTETKNRLKTNNTFTTVSWANDYSPVVINVQVSCACDVLHNVFVEILQSPHFEIPRLIIGTSNGHHDEDEHREHEGHLHCIAVQIRL

SEQ ID NO: 152626 - protein, 47 aa, Triticum aestivum
  Clone ID: PAT_TA_47044.pep
GPSSTLYFSTITLNPPILTHSFPTIIHLPTQYHFTILYPPYYQLIIN

SEQ ID NO: 152627 - protein, 73 aa, Triticum aestivum
  Clone ID: PAT_TA_47045.pep
HHERLLLQNDAQTQVSRGRRRLVKRRRRVTSCCAVPQALSLQHHRHRAGAKEAGAGDGAEKTGDGAARQHPRV

SEQ ID NO: 152628 - protein, 117 aa, Triticum aestivum
  Clone ID: PAT_TA_47046.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDL

SEQ ID NO: 152629 - protein, 76 aa, Triticum aestivum
  Clone ID: PAT_TA_47047.pep
MSAAAVAPSPAAPLPSAPPSSYPAAPPAPFVEDDDDLYGRLKSLQRHMEFVEIHEEYLKGEQKNLKRELLRAQEEV

SEQ ID NO: 152630 - protein, 66 aa, Triticum aestivum
  unsure (1)..(66): unsure at all Xaa locations
  Clone ID: PAT_TA_47048.pep
HASAHSSAHASAHASVDAWAPAEVYSTIXFDPHSLSKILNLTKPTYSVTFLSIIIRHFNKYLNHYS

SEQ ID NO: 152631 - protein, 52 aa, Triticum aestivum
  Clone ID: PAT_TA_47049.pep
VRNCVFPIGACVVSLIDDGKNPDEFTRDVGNSCIAKNQITKGKTDAFKVQMA

SEQ ID NO: 152632 - protein, 51 aa, Triticum aestivum
  Clone ID: PAT_TA_47050.pep
TTYYHISCNRGTFITLKHPLLLRSPFSFTAPLPSLSAIIPSLASPHFLIPI

SEQ ID NO: 152633 - protein, 131 aa, Triticum aestivum
  unsure (1)..(131): unsure at all Xaa locations
  Clone ID: PAT_TA_47051.pep
CDDGSASGNVEKTVSDSEIKPKEVQKKSEERSTWNPLNLIKVGGDIVTSTTGEAGDANVPGLTEQPIAKGRIIVYTKLGCEDWQNXRLFMHQQRLKYVEINIDIFPSRKLELEKNTGSSIVPKVYFNDLLI

SEQ ID NO: 152634 - protein, 139 aa, Triticum aestivum
  unsure (1)..(139): unsure at all Xaa locations
  Clone ID: PAT_TA_47052.pep
SAEGDILSLAAGVESNTNHPLGKAIMEAAQAANCINMKAKDGSFMEEPGSGAVATIGEKQVSVGTVDWIRRHGVVRDPFPEAESFGQSVAYVAVDGTLAGLXCFEDKIREDSHQVISALSKQGISVYMLSGDKESAAMD

SEQ ID NO: 152635 - protein, 47 aa, Triticum aestivum
  unsure (1)..(47): unsure at all Xaa locations
  Clone ID: PAT_TA_47053.pep
FPFLLWHDVCLLKIVCTSHECDDGMVLIERFXXKKKKNNKKKKLKKI

SEQ ID NO: 152636 - protein, 81 aa, Triticum aestivum
  Clone ID: PAT_TA_47054.pep
LMKEFMMKMTLKKMPKSEVHLLQHIKDIDHVRQTTILRHNDILHATMISLAKGLIEQERQIISIRLIKDSSIIEVGHRLNI

SEQ ID NO: 152637 - protein, 51 aa, Triticum aestivum
  Clone ID: PAT_TA_47055.pep
ITCVPACSDDQMNISNGLVAFSRPPPLYSMVGSRVDGIGATCTDMRRSTRA

SEQ ID NO: 152638 - protein, 81 aa, Triticum aestivum
  unsure (1)..(81): unsure at all Xaa locations
  Clone ID: PAT_TA_47056.pep
KMAKFVQHLNAVIRVGTYWLARLLTLAILGLNSSFPIPLSRITCLQGRRSGAEGGGGAXEGRRATSSVHDSMLEISCCWIQ

SEQ ID NO: 152639 - protein, 106 aa, Triticum aestivum
  Clone ID: PAT_TA_47057.pep
MFGFGDHGHHGQNPGGHAPAVVGGNQPTFKIFCKADEGYCLSVRDGNVCLAPYNPRDEHQHWFKDMRFSAQIKDEEGNPAFFIENKATGLAVKHSLGQSHPVKLVP

SEQ ID NO: 152640 - protein, 128 aa, Triticum aestivum
  unsure (1)..(128): unsure at all Xaa locations
  Clone ID: PAT_TA_47058.pep
VRGRVGGHVGGRVGGRVGSPATTSPSSPATAPHRPGGHHLSPSPPSFFRLHSHPSSTRTPPHIRGSSFDAPTSGSGDGGGRWGGGRRGGVPGPRPQARRWRHGGGRAHXPXSQRRRRHGVLARAGRAR

SEQ ID NO: 152641 - protein, 74 aa, Triticum aestivum
  Clone ID: PAT_TA_47059.pep
QPPNLNIFYPIHLYKELNKLSHLLFIKNDHHSSDLVSLNSIFSITFYLNIYPHYSTMFYREATILHTILIHLYN

SEQ ID NO: 152642 - protein, 96 aa, Triticum aestivum
  Clone ID: PAT_TA_47060.pep
SADAWADAWAPVHRRCALELPPRPPSGPHAPRRRRPPCFVESLLSSPPRAILDFGFEVCRGLVDMSWAPIENDPGVFTELLQQLQLKGLQVSNHIP

SEQ ID NO: 152643 - protein, 105 aa, Triticum aestivum
  Clone ID: PAT_TA_47061.pep
NPKSASLGSLTTLIFAARSCGRRIPHLHNLQHRLFRETITREARIFSWVKTPLHHRRCSLLTRKLTALAGCWNLSFLDDAVLRSGRCISLRLILDSILPLQFPAD

SEQ ID NO: 152644 - protein, 64 aa, Triticum aestivum
  Clone ID: PAT_TA_47062.pep
RRAAFLSSSCHRSLTTEEPCSRRAKEDNNKLASAALTQDSIRHEHSLQRRWGSRSRSCSACSFQ

SEQ ID NO: 152645 - protein, 144 aa, Triticum aestivum
  unsure (1)..(144): unsure at all Xaa locations
  Clone ID: PAT_TA_47063.pep
IAERKGEQYHQLVLLIMSRSPHLAARCPPLGPQIIGRDDSLFTQSCRFPSEDPFFGEPPCWLDDLLADSGKMPNLPLLRRACSDSDAILDALRTIQSPIFPIEEGDLQPAGETGDSLDAAVRGESDXGGRVSCVYGPNSPKTRV

SEQ ID NO: 152646 - protein, 110 aa, Triticum aestivum
  unsure (1)..(110): unsure at all Xaa locations
  Clone ID: PAT_TA_47064.pep
RRGGRTGHEAQSFSEAEMGLTFTKLFNRLFVKKEMRILMVGLDAAGKTTILYKLKLGEIVTTIPTIGFNVETVXYKNIIFTVLDFCGXDKNMPLWRHFFQNTQGFIFFVD

SEQ ID NO: 152647 - protein, 112 aa, Triticum aestivum
  Clone ID: PAT_TA_47065.pep
VRSLLIMVSILQLGKSSHLPHPIDSDSYDRIMFCVRLLCRTGNNARKVQLLSSCQSFTKMLAEKQFRKNEKMRVESQNSHAYPDDSIDFDHLKSRKGMCQLELEDEVRDYLK

SEQ ID NO: 152648 - protein, 81 aa, Triticum aestivum
  Clone ID: PAT_TA_47066.pep
MLRKTAPLMNYVQEHPEIVVQLVDLIGITSVMEVLIRLIGADETIYSNYADTMQWLENTDVLGMIANKFSSSDSSEVHANA

SEQ ID NO: 152649 - protein, 48 aa, Triticum aestivum
  Clone ID: PAT_TA_47067.pep
RALTRGAQLCGRGRVMCSARPGTALHGCGRGGAWMLSRAPPSFTQAYL

SEQ ID NO: 152650 - protein, 101 aa, Triticum aestivum
  Clone ID: PAT_TA_47068.pep
EDDRDGTTGTFKFKALPLDKKILASRGDIGVFQTAKRNPTVPKEFNLSTSRKSKQPPLSELFNKLSLSTEACRTMGHQTSERPNYITTKDCKENMIGAIHC

SEQ ID NO: 152651 - protein, 56 aa, Triticum aestivum
  Clone ID: PAT_TA_47069.pep
LFRHIFGGKKPVAPVKPVAEVKKPNATEADAAGSSGDKEEKEDDTTAPRRRSRRET

SEQ ID NO: 152652 - protein, 120 aa, Triticum aestivum
  unsure (1)..(120): unsure at all Xaa locations
  Clone ID: PAT_TA_47070.pep
PADSLPSIAPPASLFVLPPRRQPPSPCFHRGNGLPPRAFAAAPPSSPXLPPRAGLPYPASTPSPASLPLLPPRPRPTSPASTPGMASLPCFRRPAPPLCAILHHRRCQNRSRHCLPGPRR

SEQ ID NO: 152653 - protein, 188 aa, Triticum aestivum
  Clone ID: PAT_TA_47071.pep
VRSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKEIEAAPKFLKNGDAGIV

SEQ ID NO: 152654 - protein, 51 aa, Triticum aestivum
  Clone ID: PAT_TA_47072.pep
VRPRVRPRVRGRVGDNIAYDNVRCSSCLTLFHAISERSSFCIFAKMFLLTS

SEQ ID NO: 152655 - protein, 135 aa, Triticum aestivum
  Clone ID: PAT_TA_47073.pep
VREAALSSDPKFEHIDISEKQKVVNECSGAETWLHEKKQQQDALPKHADPALLVSDIKKKAEALDRFCKSIMTKPKPAPKPQTPPPAETSPPEAQTPEQQPDGATEASEPASEGRAWEQPAAEQMDTDEPDPNSA

SEQ ID NO: 152656 - protein, 53 aa, Triticum aestivum
  Clone ID: PAT_TA_47074.pep
RQPTSSSQVDCETYFIPERDVHVPPKWLPRMPLTPLLASYSRVDSENILHLQP

SEQ ID NO: 152657 - protein, 114 aa, Triticum aestivum
  Clone ID: PAT_TA_47075.pep
LRSSPHPTAGPFLPPSVGALVLATHRPPSPSLHSPSLPTLCLLPLPHPQIQSTQPRCPRTPYCPPWPPPASSRTNPSPRRGGASSPPNPHTPRSMRLHRSAATTPTGPPACPGH

SEQ ID NO: 152658 - protein, 130 aa, Triticum aestivum
  Clone ID: PAT_TA_47076.pep
VRGDAGRRAAVHRDRGGPAAAGVGAWGDQVERRWVVSGEGDESHQGVRHGAGPAQGQVPQDLQCLAQRHGRGAYRQAVHQNDGVWELLLTSGHRQDRAHAHQTWQGVRPPDVRLLPRVATCLPRSRQLTF

SEQ ID NO: 152659 - protein, 123 aa, Triticum aestivum
  unsure (1)..(123): unsure at all Xaa locations
  Clone ID: PAT_TA_47077.pep
MLRLRAFRPTSDKVVKIQLHPTHPWLVTADANDRVSVWDWEHRQVIYELKAGGVDERRLVGVKLEKLAEGETDSKGKPTEAIRGGSVKQVSFYDDDVRFWQHWRNCSAASEASTAXNQQSSGF

SEQ ID NO: 152660 - protein, 94 aa, Triticum aestivum
  unsure (1)..(94): unsure at all Xaa locations
  Clone ID: PAT_TA_47078.pep
TTRRDALPPPTRXAWWRRAALAAPQPPRADGATDIARSLSGGALAGSCELCSARRWSAWPRWGRRGLARRAPEEETCSGIVLATAGARTHASAD

SEQ ID NO: 152661 - protein, 99 aa, Triticum aestivum
  Clone ID: PAT_TA_47079.pep
MGRVIRAQRKGAGSVFKSHTHHRKGPARFRSLDFGERNGYLKGVVTDVIHDPGRGAPLAKVTFRHPFRYKHQKELFVAGEGMYTGQFVYLGRRAIPFRW

SEQ ID NO: 152662 - protein, 101 aa, Triticum aestivum
  Clone ID: PAT_TA_47080.pep
MECIDVIKQIKTEASNRDKLKHFTMNSTTEEDVDLRIHEGSGDETESEDGEDDDEHGDETESEDEEGESEQEDEHEQEEKFDKNRSKHMKLLRRLEEDLLT

SEQ ID NO: 152663 - protein, 122 aa, Triticum aestivum
  unsure (1)..(122): unsure at all Xaa locations
  Clone ID: PAT_TA_47081.pep
TVRPGGXXEVQSRVGWLGGSTGMRNYLGTVYSTSDENSISFYPDFQPTTVCQLSPVPCFLFCPAFKQINGSTPQLFQPGQNDNQELKEPQRYTQSFSMITRLIKGEKTPRPCHLKNTLTNTV

SEQ ID NO: 152664 - protein, 127 aa, Triticum aestivum
  unsure (1)..(127): unsure at all Xaa locations
  Clone ID: PAT_TA_47082.pep
VRPRVRGRVGSRRPQPAIPHPRRDLLPNRRACQMASCQNHGTDLPEFILALPMSASLAAPPARPNPWPLAMAPLGLFMHGEKIVGCLQTEQSRSGWKNSASNDVAFLQNFFRDRGVSYXRTXVMISK

SEQ ID NO: 152665 - protein, 64 aa, Triticum aestivum
  unsure (1)..(64): unsure at all Xaa locations
  Clone ID: PAT_TA_47083.pep
MATAGKVIKCKAAVAWEAGKPLSMEEVEVAPPHAMEVRVKIXFTXLCHTDVYXWEAKGQTPMFP

SEQ ID NO: 152666 - protein, 158 aa, Triticum aestivum
  Clone ID: PAT_TA_47084.pep
VRPRVRGRVGESSCKIYFSHGWQETPLYKLENLGYGHVLEGPVVIMNGNSTVIVEKDCKAVITKYGNIRIEIGASLSTVEISETVADVVQLSIFNHRFMGIAEQMGRTLQRTSISTNIKERLDFSCALFGSDGGLVANAPHVPVHLGAMSSTCCWQLK

SEQ ID NO: 152667 - protein, 180 aa, Triticum aestivum
  Clone ID: PAT_TA_47085.pep
ATPASRPLSPPHASLPLPSSAAAAAATMGRGKFKGKPTGRRNFSTPEEIASGTSGRPRSFKKNVAEAEEEEEEVEESEEEESEDDGEEKKHKGTEGVIQIENPNLVKAKNIKAKEADVSVLQPKAFMTLLVVAKYHKIPCHTGDSIKFPRLFLHCLFYVVIQMALPSFQSGKVKWSSYEL

SEQ ID NO: 152668 - protein, 51 aa, Triticum aestivum
  Clone ID: PAT_TA_47086.pep
RYVQFKKIKKISGTVACFFWQQLINRFLLDGDSDTGNSPHESSLAQLCPDM

SEQ ID NO: 152669 - protein, 137 aa, Triticum aestivum
  unsure (1)..(137): unsure at all Xaa locations
  Clone ID: PAT_TA_47087.pep
VSTKTIVLSTDAYLTDHRDIDACAEARRTTNAGWHTFCALNITLGDWRXRGQSLQGEGFSIAAVTSTVSPCICFSSCAIPSQCPGSPLLSSELHVGSALVWSSRWQRWRLLILALGRTSVSSDGSAPRARRGGGEPF

SEQ ID NO: 152670 - protein, 56 aa, Triticum aestivum
  Clone ID: PAT_TA_47088.pep
LNHKKLKQAMLFHSEALESGLSASGSLPVFPQSYISGKCEEFLQKVWLIKALIHIS

SEQ ID NO: 152671 - protein, 80 aa, Triticum aestivum
  unsure (1)..(80): unsure at all Xaa locations
  Clone ID: PAT_TA_47089.pep
MADTEYRCFVGGLDXATDDNNLQQAFSQYGEILYANINNDRETXRSRGFSLVTLCHDASMRHAIVEMNGKELDGRIMTAN

SEQ ID NO: 152672 - protein, 86 aa, Triticum aestivum
  Clone ID: PAT_TA_47090.pep
VRGRVGSNERNHTLKCSHYVPAVIPENIALPCGIYCQRIRACRADAYEAGVILLAPNITRWALDFAGLGLSGGEYVSLGWHEKQDL

SEQ ID NO: 152673 - protein, 135 aa, Triticum aestivum
  unsure (1)..(135): unsure at all Xaa locations
  Clone ID: PAT_TA_47091.pep
SPASRRPRLARPLACRRSSPPPRPAPPTSTPXALPSRAPSPCPSKLRVEGRTGSGRGGSMVSAMDFEIALACGHVGERASGRGELEPGINLASWSPWTPALHLRRWLVLPDTVQALLHCITLLPGLLDLQEVLMY

SEQ ID NO: 152674 - protein, 75 aa, Triticum aestivum
  Clone ID: PAT_TA_47092.pep
GNNTESLIIFDATSPAKYANIRCMCNQYFCMSDACRKIRIWPLISLLVLTNVLIDVGDPELIWDVEIEEQKNLKP

SEQ ID NO: 152675 - protein, 70 aa, Triticum aestivum
  Clone ID: PAT_TA_47093.pep
SADAWAHRPPASQPRCFSPTSTTPCSPCSAGPSPVGLARLYNLTLPSVSTNTLTCALRDFLLCLPALLDL

SEQ ID NO: 152676 - protein, 52 aa, Triticum aestivum
  unsure (1)..(52): unsure at all Xaa locations
  Clone ID: PAT_TA_47094.pep
FVEMTAMGPRPSLPIFNAMILGLCHMGLIPVAAGLLGVMXKFHVTPEACSYN

SEQ ID NO: 152677 - protein, 64 aa, Triticum aestivum
  Clone ID: PAT_TA_47095.pep
RPKQYNPLSLSLSPCDATSSAPCPVFSRTLTNPSVRRRGPNRTHRSARVLASRPCPSEAYCPVP

SEQ ID NO: 152678 - protein, 81 aa, Triticum aestivum
  Clone ID: PAT_TA_47096.pep
MAEHLASIFGTEKDRVNCPFYFKIGACRHGDRCSRLHNKPSVSPTLLLCNMYQRPDMITPGVDAQGNPIDPVKIQGDFEDF

SEQ ID NO: 152679 - protein, 59 aa, Triticum aestivum
  Clone ID: PAT_TA_47097.pep
SDRATDHSWPYPWDHVKFTYFFNFFKTQGLELANPNRGGQIKPNHITLPKHFKLKYPKT

SEQ ID NO: 152680 - protein, 66 aa, Triticum aestivum
  unsure (1)..(66): unsure at all Xaa locations
  Clone ID: PAT_TA_47098.pep
ILQYLDGDDVYVINMFEVGQIVEVIISDMGGXXLVHCHVCVKSEGSRDVCGCPCVRTRVSTRVIGR

SEQ ID NO: 152681 - protein, 140 aa, Triticum aestivum
  unsure (1)..(140): unsure at all Xaa locations
  Clone ID: PAT_TA_47099.pep
VRGRVGEQRYFDCKEFPANDDHPSHDVARGQRFVKEVYETLRASPQWNETALIITYDEHGGFYDHVPTPVKVPQPDGIIGPDPYYFKFDRLGVRVPSXLISPWVEKGTVIHEPNGPEETSQYEHSSIPATVKELINYVLL

SEQ ID NO: 152682 - protein, 160 aa, Triticum aestivum
  Clone ID: PAT_TA_47100.pep
MNGKYKTLILRSSSLDGPEEIIAAVSYQIVPADTQYAEIPLAAVTSPFQCVGFGHMLYKELSQRLHNVGVTNIFCWADKVSEGFWLKQGFVSVGEVDTKGKIRRIPVRADIKRALCFPGSSTLMVTHIKKDLPTAKKPCFAELQTSQLHAVDQIASLLMI

SEQ ID NO: 152683 - protein, 142 aa, Triticum aestivum
  unsure (1)..(142): unsure at all Xaa locations
  Clone ID: PAT_TA_47101.pep
MLHEEKAAAIKRLKKKGQLPTELTEEDEDGNRWPTKEALISAKRVDFGTDVGWRLLCEHWSILNLRXSLTNKRNRLANGDTVFHCSGARNVVATRQFLKLKTGKDPGIFGAWLHTHKLHRGTDEKQICSQRTCDHWGDFDRQ

SEQ ID NO: 152684 - protein, 104 aa, Triticum aestivum
  unsure (1)..(104): unsure at all Xaa locations
  Clone ID: PAT_TA_47102.pep
VRSIYDLSLATKQTHADINMYRLDWDNSVHVECMSPTTTKHVLNTWDAYEATKDAYGIFIMTDCDEHKTLDYKKIYDSMQNPAFVFDXLNICDSDKLMEIASLS

SEQ ID NO: 152685 - protein, 170 aa, Triticum aestivum
  Clone ID: PAT_TA_47103.pep
SEGSKGKKSGHETDVHGEEDVSTSDQPNDKHSEETSQPSDAIGEHVSEESTGDTGRGRGRGRGRGGRGRGRGYHNNHNNNQYHHNNHPQQQQHYQNSNNQGNNNRSGAHPVGTPPSSHPVKAEQQQTQSSPPAGANKQLPGPRMPDGTRGFSMGRGMPQTSTPSISTSEP

SEQ ID NO: 152686 - protein, 51 aa, Triticum aestivum
  unsure (1)..(51): unsure at all Xaa locations
  Clone ID: PAT_TA_47104.pep
QVEVTTDSCELLLDAISSEYINQSPWFFFHGRCLKKKKKKKILNILIFKFX

SEQ ID NO: 152687 - protein, 133 aa, Triticum aestivum
  Clone ID: PAT_TA_47105.pep
SGEFLQDTRYFIIIDDIWELGTWETLKCAFVKNTLGSRIIITTRIVDVAKSCSPSSEDLVYEMKPLSEADSKKLFFKRIFGCEESCPDSLKEAANDILKKCRGLPLAINAISSLLATTRETKREWDRVRHSLH

SEQ ID NO: 152688 - protein, 97 aa, Triticum aestivum
  Clone ID: PAT_TA_47106.pep
ERGSFRPCCPDCYRNFRLARRRVSILLAEVKKSRRWLVCQWLTGLLHQNLPSLLDRSTSSLCPLQAETLMSTGRLEHQRLLHWLAVQCLLGCLHQTH

SEQ ID NO: 152689 - protein, 98 aa, Triticum aestivum
  Clone ID: PAT_TA_47107.pep
GTCIAAAMMQLHLPPPAWVPSGYSSHGPRPRALAVKGPCRFSGKGDATLVETAGSRVALQIAQATSVSSAKVLQTNLVRNDIQILERTEEPCDLTTTV

SEQ ID NO: 152690 - protein, 123 aa, Triticum aestivum
  Clone ID: PAT_TA_47108.pep
REAMPTIVANKLTGTIKCFVYISPVNREWRKALPKNIDIATSAQLHGTDHDPLIDQTRDDRLDIPRGGRLSEVPTAITAGGCTSDDTHARILQLQRELCKTDSTYDSAKLADRIGQLSGRVAA

SEQ ID NO: 152691 - protein, 136 aa, Triticum aestivum
  unsure (1)..(136): unsure at all Xaa locations
  Clone ID: PAT_TA_47109.pep
RQLSPSLSGPASVTDAARXCLLTFPAAAFLPLTLALPVALPSQCSPPRGLLPTRRMARSTNAARAAQSSLSVPGAPWSHSRRTSSSLAMASSPSSSVASVAAVSSMPGRRFSSAAPGVGERARASRVVNCDESCVR

SEQ ID NO: 152692 - protein, 138 aa, Triticum aestivum
  unsure (1)..(138): unsure at all Xaa locations
  Clone ID: PAT_TA_47110.pep
SAFISSPRGAAAAAERKRPSPERSRRRCRGTRGAATSRSPPSHTXXFMSPLSHTVXSRSPXLHTTSGLLISLLATPHCQPHTALPPWRGFALWRSREVAASTMPAIRSLLLDPYLSTPXXGLIQWRSHNVDLPDSVRS

SEQ ID NO: 152693 - protein, 95 aa, Triticum aestivum
  unsure (1)..(95): unsure at all Xaa locations
  Clone ID: PAT_TA_47111.pep
VRPRVRPRXRGRVGRDWVSPTGRPVGSSSDPQHQPAPRALRSILPLICRDRRRRIEGGRPTSGAQIHRINPRVSLSPPTTGTGSPRYKEGDWGRK

SEQ ID NO: 152694 - protein, 47 aa, Triticum aestivum
  Clone ID: PAT_TA_47112.pep
LLKYTQRPYLTVKYWHMPSTHMQTRLHVHKHRSLQGLYTFQTESDVA

SEQ ID NO: 152695 - protein, 144 aa, Triticum aestivum
  Clone ID: PAT_TA_47113.pep
SADAWADAWADAWAEVHQDGGLENVSSVADALTLMSLYFALCTKKHSLLRRVFEIYGSLPQAAKQAVHRQVPILIRTIRSSPDLLGIISDPPAHCRDLLMQVLQTLTDVAVPSQDLISSIKNLYSKTKDTEFLFPIMAHLPKDE

SEQ ID NO: 152696 - protein, 106 aa, Triticum aestivum
  Clone ID: PAT_TA_47114.pep
AAVPSESRSTPRVRHTRTEKHKKKLKKEYGVEPWTFEQKLGDAVLIPAGCPHQVRNLKSCTKVAMDFVSPENVGECVKLTDEFRATSSVHKAKGDKLEIKKMGLYC

SEQ ID NO: 152697 - protein, 174 aa, Triticum aestivum
  Clone ID: PAT_TA_47115.pep
RPRTRGSRVFGQEQTRLYTQTVVGSYGYMAPEYLYRGEISAQSDIYSLGLLILEISTGEQNCKDKNQPSARNFIDKVREEWTLEHIASKYASLDTEGLHQVKISIELGLKCAEIDRRVRPPIEEIVDTLNGLRANEMANEVPHASPVSKKMGFLGGSRRNKTFAIIGGRLKIWF

SEQ ID NO: 152698 - protein, 75 aa, Triticum aestivum
  Clone ID: PAT_TA_47116.pep
MSVVAAAASIHPSATADGSPPQMATTRLERGSLLVGGRELLSQCPPEVTLRAAVADAAPGAAFLGASAAAPSSRH

SEQ ID NO: 152699 - protein, 157 aa, Triticum aestivum
  Clone ID: PAT_TA_47117.pep
RPRTRGRAAAAGPGLLLALLLLAGAAVASAADMSIIAYNAEHGARGLERTEAEARAVYDLWLAEHGGGSYPNANSIPERERRFRAFWDNLRFVDAHNARAAAGEEGYRLGMNRFADLTNDEFRAAYLGVKGTAERNRAARVVGERYRHDGSDKLPEA

SEQ ID NO: 152700 - protein, 153 aa, Triticum aestivum
  Clone ID: PAT_TA_47118.pep
MPPPSLLRPPLSLLLRRSQTRCPLRRIPSFTPSHLPVPPKRRHLSAAAAQLADPLSAAGVEEAVVGFVAGKRKATEVAHAVWRSIVQKGDTVVDATCGNGNDTFALLKMVSDETGRGRVYGMDIQYSAIDSTSSFLKMACDSREMELVKLVTK

SEQ ID NO: 152701 - protein, 112 aa, Triticum aestivum
  Clone ID: PAT_TA_47119.pep
VWRGMKECRRLGLARSVGVSNFSAAKMERLLALAAVPPAVNQVELNVGWRQEKVREVCARHGVVVAAYSPLGAYGAFWGSDAVMHSGVMHDVAAAKAKTVAQVFFFFLFLFC

SEQ ID NO: 152702 - protein, 65 aa, Triticum aestivum
  Clone ID: PAT_TA_47120.pep
VRFRLSCYGAMHVNTYAVATIFISKCDQCSQRRPLLLLQSLFILAWSVCEVNAYHPSVLVLWGKQ

SEQ ID NO: 152703 - protein, 61 aa, Triticum aestivum
  Clone ID: PAT_TA_47121.pep
VPSDARLLFPRYTVDEAETVCHYYMRQKIIPRESFSEEKWKKIYYLSNGNGSEMRWLAAFI

SEQ ID NO: 152704 - protein, 97 aa, Triticum aestivum
  Clone ID: PAT_TA_47122.pep
MASYCGKYWGELMDNAVYIGTYSRGIRAGVESTGAISKRFGRIYVKNDEDNREDLREVLFWILGGIHGVIEVIMCEETLDETMNGGTPFGKIFKEVN

SEQ ID NO: 152705 - protein, 98 aa, Triticum aestivum
  unsure (1)..(98): unsure at all Xaa locations
  Clone ID: PAT_TA_47123.pep
VRNHKIANIIRCIYTENSEHTMLGEGNNGYAALPATVTGVVICGCSDICIGTTDSILLRXSLGHAFTSIXLSRKTSNRITGNYSFAIEYNILSIYACF

SEQ ID NO: 152706 - protein, 97 aa, Triticum aestivum
  Clone ID: PAT_TA_47124.pep
RPTTCTGPLGPPRARLRPTLSSQQERAPCTVRRPRTPSRMDHHQRRPAPRRTAFYTDGATQLTFDRLVNHRPPVMITGAPSPTERATTTTSVEAAQA

SEQ ID NO: 152707 - protein, 119 aa, Triticum aestivum
  unsure (1)..(119): unsure at all Xaa locations
  Clone ID: PAT_TA_47125.pep
MLTSCKQIEEEEEEDDDTRGWSSGGVATLHEVSKHTSKDYRWLVIEGKVYIVTNFLDDHXGGDDALLSXTAKDATDDFKDMIHNTTVCTMIDEYYFGEIYATTNPIIVKDTPPXQSHYN

SEQ ID NO: 152708 - protein, 158 aa, Triticum aestivum
  Clone ID: PAT_TA_47126.pep
RPAPATAEAHNGERPTDDAPGPSASTSSASDNGNLHRSSTMPGVIKDTEITTETTGPSNLERSKTERRKQNNPADDPTKQLLDDKISIKKKLKMLNRIATVKDDGTVVVNVPSTLEATPIDAGAVDGYEDVVVEESLDGSDIPYRPPIQIVILIVGTR

SEQ ID NO: 152709 - protein, 134 aa, Triticum aestivum
  Clone ID: PAT_TA_47127.pep
TRKIIPGLLSSSPRSVRSSREAPPPPPPLPKSGASSLVARYPAGDSWRGAFACLTRFLECELAHLERQISALHPSKGCKPPHPSLFSALLRWFWQVFARGKFGEAFPSCVFPKLEEAFLDEICGGISVALVEMG

SEQ ID NO: 152710 - protein, 41 aa, Triticum aestivum
  Clone ID: PAT_TA_47128.pep
YNITRRRCIYVRGILKNFYYLNHILFFYQTRYYLFILYINH

SEQ ID NO: 152711 - protein, 114 aa, Triticum aestivum
  Clone ID: PAT_TA_47129.pep
MRQISSMLQGLARSMSLGKERKEAEEPQGTVLRSSGTLWGEGSETFAAVCSRRGEKGTNQDTSIVWEGYGCQDDTIFCGVFDGHGQWGHYVAKAVRESLPQSLLCHWQEAVALT

SEQ ID NO: 152712 - protein, 90 aa, Triticum aestivum
  Clone ID: PAT_TA_47130.pep
SAFVCRMAAPDLDARPAAAAAAGRPNARALPPPSWLCFLLPCPPHVDVVSFLPPVHISSHLIKSRLLWTYLLFWTQLGSLQFDVTPFLPE

SEQ ID NO: 152713 - protein, 153 aa, Triticum aestivum
  unsure (1)..(153): unsure at all Xaa locations
  Clone ID: PAT_TA_47131.pep
RPIHQPRLPFSSSPPSPEPPXPCPAAPNHPWPSPRAPPLSRTSPSPPPARARPPCRSGPRLPRARCGSTTSSPPTPPSSASPAAGSWPPPSNTSSGSPPSWSTTRSRSPTSRRGSSISCSFTSRRRAVTPTARSRSYTGCVRPTAMIARPWDS

SEQ ID NO: 152714 - protein, 81 aa, Triticum aestivum
  unsure (1)..(81): unsure at all Xaa locations
  Clone ID: PAT_TA_47132.pep
SGILSSPFSPRSLPPPSPAEPXPPSLAAPQPPPLPTAXXPYPPSPPLPDXAPPSPFRPKQGGPGAPAEHLPRKEPGRKQQG

SEQ ID NO: 152715 - protein, 154 aa, Triticum aestivum
  unsure (1)..(154): unsure at all Xaa locations
  Clone ID: PAT_TA_47133.pep
FANPNPTPRASRPRAEAPPTGARCRSWKTLRQDHTLEVESSDTIDNVKAKIXDKEGIPPDQQRLIFAGKQLEDGRTLADYNIQKESTLHLVLRLRGGAKKRKKKTYTKPKKQKHKHKKVKLAVLQFYKVDDATGKVTRLRKECPNADCGAGTFM

SEQ ID NO: 152716 - protein, 49 aa, Triticum aestivum
  Clone ID: PAT_TA_47134.pep
NSPHGEPSGERASKVWMMVTLIQSAHAHEGVHDVRALRLSKRPAMCLRT

SEQ ID NO: 152717 - protein, 54 aa, Triticum aestivum
  Clone ID: PAT_TA_47135.pep
RPRTRNWKFANNIATYKCCSLGDRGHSVGVKRHICLSLILKKKNQTKDKKRSRT

SEQ ID NO: 152718 - protein, 158 aa, Triticum aestivum
  unsure (1)..(158): unsure at all Xaa locations
  Clone ID: PAT_TA_47136.pep
SGPVAPGTGNLRRSTRRSCAYTDGGARNAISHVKNSSHEASTSGRQIGADVHEWGSPSKTAGLRSTRNRVPDTHSLAEKPQVSSNCWLMLLEHEDIYRYIPQHGDEVMYLRQGHEEYLNGMRLSDSCPWNRIKGLKAVELSKIQDLCYTTYKGXWESC

SEQ ID NO: 152719 - protein, 108 aa, Triticum aestivum
  Clone ID: PAT_TA_47137.pep
MARFPRARNLPARRGRSSSSDARSSCWKTKEADEQSDLPLACEKREWKGATCPVCLEHPHDAVLLLCTSHHKGCRPYMCGTNYHHSNCLEHFKEAYAKEKLALGDSAE

SEQ ID NO: 152720 - protein, 87 aa, Triticum aestivum
  Clone ID: PAT_TA_47138.pep
MDETLAAEAGAAAATEEKAVPEREQETLEEVISRHRKEKSKLQDKETSLKKAAAKGSKAEQKAKKKQVEEEISRLSAALEAKHAAEL

SEQ ID NO: 152721 - protein, 97 aa, Triticum aestivum
  Clone ID: PAT_TA_47139.pep
MADQLTDDQIAEFKEAFSLFDKDVDGCITTKELGTVMRSLGQNPTEAELQDMINEVDTDGNGTIDFPEVLNLMARKMKDTDSEEELKEAFRVFDKDQ

SEQ ID NO: 152722 - protein, 153 aa, Triticum aestivum
  Clone ID: PAT_TA_47140.pep
MAGEEQPLTEYEKQRLARIRENEARLQALGIRRLAASPILNQPSSAAAAAATKRKQKKRSDDADDEYLPSDGGGGEEEEEEEDSSSAGDQDSEEEFKASSRSNQKGKAKKKMNLGSSSKSTVREEGAPFTDFMDDDAALQQAIALSLAEPSKR

SEQ ID NO: 152723 - protein, 106 aa, Triticum aestivum
  unsure (1)..(106): unsure at all Xaa locations
  Clone ID: PAT_TA_47141.pep
LVPGEDYTHSAHAPPPFHPPPPAVSMWGTAGYMAAPPPYNPYAGYPVPAVPMASPSPLPGPTAYAPVQNMKDNPPCNXPFIGNLGETVVEEELRGLFSLQPGFKQM

SEQ ID NO: 152724 - protein, 71 aa, Triticum aestivum
  Clone ID: PAT_TA_47142.pep
RADQLHRPSPAPCSPVRGCTQHAPPASWPCNPNCACSTLGVVHRPHGLRFRHHASCRSVPFPARSSGSSSY

SEQ ID NO: 152725 - protein, 148 aa, Triticum aestivum
  unsure (1)..(148): unsure at all Xaa locations
  Clone ID: PAT_TA_47143.pep
GLTPPCLLVVLRLVSRGNGFYPPSEPCEHGYGSSHRSSLSCLEPPVTTDLALLHQRRMGWRGSTSSPQAPAETTWIRISSSLLSTAAFIRCAPALQFRFWTEIWRSTRRSRWLQALFPTGPRGTILWLIYIWXQGASSLFPNPPLTVA

SEQ ID NO: 152726 - protein, 174 aa, Triticum aestivum
  Clone ID: PAT_TA_47144.pep
RAKFRPIFEALSTMFPQIHHFAVEESSATPSLFSRYGVRGFPAILLASETTMVRYRGTKDLKSLVQFYQETTGLNPITYIDVDQQESTGSLGSAMPGGRSLRKMAKDEPFLFLGALFIIMKIAAHFVPTVISQLRAFLIVRVQNLNLRIRRGSSQLMERALTVLDVQRLWSKLR

SEQ ID NO: 152727 - protein, 240 aa, Triticum aestivum
  unsure (1)..(240): unsure at all Xaa locations
  Clone ID: PAT_TA_47145.pep
VECNRSRKLAPSQDLKRKREVYSVNKAQCEARAVVKPVKGQWEYTSVRSEHNHPLCPSPSLTKFFLSCKYMSAEEKSFLRALQQSSIHPKKAMKIFKRMRGILGSLPFNTKDANTSQCAEQQGKPNSDVETTVKHLKELELQNPCVSITMQTDEDSIVRSLFWTDARSRLDYEIFGDVLSFDTTYSTISHNMLFTSISGMNEHGRTLVFGYALLQDQKAETFKWMFQTFXHVMGGKMARA

SEQ ID NO: 152728 - protein, 167 aa, Triticum aestivum
  unsure (1)..(167): unsure at all Xaa locations
  Clone ID: PAT_TA_47146.pep
DHASAQSPPPPSPSQIQSCARRPPPSGGARPPRRAAAPPSPARVSATRARTTFVPCCSNPASAPSTSSPPXPDRRTPSPVAVVLHPSSRSRPSLLHQPPPLASPRGQPMPDRPSTRRTSRPVVLLLLPASPRRRRRRQGRWRPPSSSPSSSSPRSLPCMPPPNPSIN

SEQ ID NO: 152729 - protein, 174 aa, Triticum aestivum
  unsure (1)..(174): unsure at all Xaa locations
  Clone ID: PAT_TA_47147.pep
MQMFVKTLTGKTITLEVESCDTIDNVEATSQDTEGISWNKSRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQXIFVKTLTGKTITLEVESSD

SEQ ID NO: 152730 - protein, 146 aa, Triticum aestivum
  unsure (1)..(146): unsure at all Xaa locations
  Clone ID: PAT_TA_47148.pep
MLRGLASAAAPRAFFSPSPAAGHAPRREYGLVPMVIEHTSRGERAYDIFSRLLKERIVCIHGPIADDTASLVVAQLLFLESENPAKPIHLYINSPGGVVTAGLAIYDTMQYIRSPVTTLCIGQAASMGSLLLAAGAXXKRRALPNA

SEQ ID NO: 152731 - protein, 153 aa, Triticum aestivum
  Clone ID: PAT_TA_47149.pep
RPPTRPAPPSSPTSSPSPPPRPPAPPPPTARPRSSSPTPAAHPPRPTPPASSSPPERPPTPSSLSTTAIKPPDSPPAPPRNNNIPIPPRRRRPPPGRPPPTRTIRTWPRRRTSTRASSPPTTSACTASRSTHAPAPTRTTGPSAPSPTRAKNA

SEQ ID NO: 152732 - protein, 92 aa, Triticum aestivum
  Clone ID: PAT_TA_47150.pep
LYKKKMTYKQNIIFYTTSLPAAGRPAKKKTSSNLNTFLLNPPTPFGAPLFYFFNTQRRPTSLFHDLFFDFKSLSTPPVFSKSLTFITFTTPK

SEQ ID NO: 152733 - protein, 118 aa, Triticum aestivum
  Clone ID: PAT_TA_47151.pep
VLGEGQVVRTRRRTVMECMCDCCYSASNSCGTACARSYLRSDLRSSEPRSRSRSRPCSKPPTDAPTAAATAASRSSWPSRWTTPTTSCTCADSGTEPYTSSSSSSPRPSSMAHSLANS

SEQ ID NO: 152734 - protein, 112 aa, Triticum aestivum
  unsure (1)..(112): unsure at all Xaa locations
  Clone ID: PAT_TA_47152.pep
RPARSPRSLSHHLPPASPQSPSSTPPRAGAXRPAPGSPPPRSSFSPGARAPLDPPRPRRSAPAPPYCFVHDLRQTSPAPPPSPEFPVSLPSLASTTARQCLLTRPWSSPSSS

SEQ ID NO: 152735 - protein, 140 aa, Triticum aestivum
  Clone ID: PAT_TA_47153.pep
RPRTRGRTRGQTPNPLLSSAPCTQAAARRAGASPRACKMNLGRTTVQIHRMQQPIRTPGAPAVARLVASAHRKHCEEARSSGGPPRRIPPNFPVGRSPLESIRALNRNGFLEPASSCLSSPIWSLPSSWKRPKRSLKFPP

SEQ ID NO: 152736 - protein, 151 aa, Triticum aestivum
  unsure (1)..(151): unsure at all Xaa locations
  Clone ID: PAT_TA_47154.pep
MVRTKHTARKCTGGKAPRKQLATKAARMFDPATGCVKNPDQVRPGTCALCEIRKYQMSTELLMRKLPFQRLVREVAQDFKTDLRLQSSAVYGLHEAAEAYLVVLFEDTNLCAIHAXRVIIMPKDIQLARRIRRERAYALYAPRSPLGASCF

SEQ ID NO: 152737 - protein, 128 aa, Triticum aestivum
  Clone ID: PAT_TA_47155.pep
MSTDVAADVPAPEVEVAADPVVETTAEAAAGDAKPAKETKAKAAKAKKPSAPRKPRATPAHPTYAEMVSEAITALKERTGSSQYAIAKFVEDKHKAHLPANFRKILSVQLKKLVASGKLTKVKASYKL

SEQ ID NO: 152738 - protein, 116 aa, Triticum aestivum
  Clone ID: PAT_TA_47156.pep
VRGDPAKPGQKWHIYYATEQPEQPMVTLEMCMTGLDKKKASVFFKTQADGHVSCAKEMTKLSGISDIIPEMEVCDFDFEPCGYSMNAINGSAVSTIHVTPEDGFSYASYEVMGMDA

SEQ ID NO: 152739 - protein, 66 aa, Triticum aestivum
  unsure (1)..(66): unsure at all Xaa locations
  Clone ID: PAT_TA_47157.pep
LLDCCGRQEGHKVALNVYDLSNGLARQLSTXFLGKPIEAIWHTGVVVYGNEYFFGGGIQAAPAGAT

SEQ ID NO: 152740 - protein, 149 aa, Triticum aestivum
  unsure (1)..(149): unsure at all Xaa locations
  Clone ID: PAT_TA_47158.pep
RPRTRGWRQVSRPTPIAPSRPPPPLRSRPDDPSWTRSTTLXPPAPSPPSPCPPXPFPPTTPPIIPDAATRGAALPQPTPPFLPSFLPEASGSLPSNGEAARAPLGALPPVQPXPPPPPPPXXAPXLPPPLPPPPAIAPPRAGPRRRVVF

SEQ ID NO: 152741 - protein, 52 aa, Triticum aestivum
  Clone ID: PAT_TA_47159.pep
MEEACEIARLPEELVSAALARTSPRDACRADVVFPVFRAAADSDTVWARFLP

SEQ ID NO: 152742 - protein, 145 aa, Triticum aestivum
  unsure (1)..(145): unsure at all Xaa locations
  Clone ID: PAT_TA_47160.pep
MFSTLEDGTVVRXLAGVPEDGPVLLVGNHMLLGIELISLAAEFMRHKKAVVRGIAHPLLFPKKTKTWSEGHDFFDFLNLWGGVPMTYKYIYELLAAGEFVLLYPGGYREAIHCKGEEHRIFWPDQTEFVRMAAQLNATIVPFGVV

SEQ ID NO: 152743 - protein, 117 aa, Triticum aestivum
  unsure (1)..(117): unsure at all Xaa locations
  Clone ID: PAT_TA_47161.pep
DDSLLRQSLLFHESLRVTVQGEVIEQSFGEEHLCFRTLQRFTAATLEHGMHPPIAPKPEWRALMDEMAVVATEEYRSIVFQEPRFVSXFRLATPELEYGRMNTGKWNLVCVGRVGAT

SEQ ID NO: 152744 - protein, 139 aa, Triticum aestivum
  Clone ID: PAT_TA_47162.pep
RAIKAYFGLSGGYNIHNLVDHFHQRGLNRSIFLSIMDGEESLSRYSPEIVVKESSARTIALLPRIFLMHGTDDYSIPSSASQTFVDVLQQVGAQAKLLLYEGKTHTDIFIQDPLRGGRDPLVEDVFSIIYADDATRRNT

SEQ ID NO: 152745 - protein, 166 aa, Triticum aestivum
  Clone ID: PAT_TA_47163.pep
QACSMVADFMTLSRGAGASYPRLRTFDLWKLHSWAGGLTEFGDGRNQESTSEAVNAYYSAALLGLSYGDKHLVSAAATLTALEMLAAQTWWHIREGDAIYEDDFTSNNRLVGVVWANKRDSGLWFAPPEWKECRLGIQLLPIVPISEALFPDAGFVKGAGEADRAR

SEQ ID NO: 152746 - protein, 74 aa, Triticum aestivum
  Clone ID: PAT_TA_47164.pep
KAARRYSPSRSQTYMTLRDGAGMPKLKGVDPSVRANMLYLDTTHAARDRKAVKEGLFHSPDKTYLVTKVEHVSL

SEQ ID NO: 152747 - protein, 71 aa, Triticum aestivum
  Clone ID: PAT_TA_47165.pep
WEVILEMLIMRGLLPSIMRMCLFNLQLEVQKKDLISTSAKAAPTSADMIPKVKSKGSKVPSLHFKDIGRGK

SEQ ID NO: 152748 - protein, 120 aa, Triticum aestivum
  Clone ID: PAT_TA_47166.pep
MGGEMPGTDGEGHSAPAPASASGFPPSAPPYYQQQQHQYGTFGAPSASGEFPQPAVGFPQPAPPPGFRNYPPPPPPSYAVYPPLQAYSDAAPYYAQGYQAVQGYIPVVEGRPVRRRRLPC

SEQ ID NO: 152749 - protein, 90 aa, Triticum aestivum
  Clone ID: PAT_TA_47167.pep
RLDAVGLIITMDDHHNHPLAPRIAEGPSQTAADLKTVSHDGPQPTRLPPPSAPGRSGQQIAQSRQKRSRSLTPMSDPSRGDWIAYGNNSD

SEQ ID NO: 152750 - protein, 153 aa, Triticum aestivum
  Clone ID: PAT_TA_47168.pep
GPIAATVTVTPIRPPQLLPAASCSPSPPGRSGILASGALDEEGFVPAGDPPLITTTTVVHEVTFLTLVWRVLLNKEYKMKCNACWRELEGQAITTTCGHLLCTEDAKKILSNDGACPICDQVLSKNHIKPYCINPSDEMDKICQKTWRFSPPF

SEQ ID NO: 152751 - protein, 64 aa, Triticum aestivum
  Clone ID: PAT_TA_47169.pep
STLSTMTGSAEGGSGQGASQGTVMMMVMIIREGAAKWHTVTSFLRPCSATSALPGVAADTRLTQ

SEQ ID NO: 152752 - protein, 182 aa, Triticum aestivum
  unsure (1)..(182): unsure at all Xaa locations
  Clone ID: PAT_TA_47170.pep
RTRGRSHRRHSLPRIPCRTNPCIPLDPNPPRFPVLPDPTSALPLLRTGEQRPKAASSSIAVLRHLLLGSLPFPAPRAFLLAGAKPPLPPRNPRRCLVCSFSKTLTEPSPTSMERRLLQPKIPAASRGQGLEQERRSCLLATLSMTLLAPPLVPEAEPPRARNPASASFRVASPVIDATXRPR

SEQ ID NO: 152753 - protein, 94 aa, Triticum aestivum
  Clone ID: PAT_TA_47171.pep
TQVARLDTQNRGVDCHVLMNNNNPNINARYEEAYKIKQTPGQMRKTNSDLLEEKKLLVCGERSGPISICCVLSDIVQEDHSRKALVSCMCLNRT

SEQ ID NO: 152754 - protein, 165 aa, Triticum aestivum
  unsure (1)..(165): unsure at all Xaa locations
  Clone ID: PAT_TA_47172.pep
SGAFGFRISTVRRREESTRAPWRGPVPALTARVLAPPPTPPLSQDARRRRRSVERLPKMDEVEEERTHPVEMETLATPARSRTWSPEELDATLLGMASAPPLPAPPPQPRRRRRSLERLPEMVEVEEERXXPTETRATPARSRTWSPEELGATLLEMASAEPPPA

SEQ ID NO: 152755 - protein, 99 aa, Triticum aestivum
  Clone ID: PAT_TA_47173.pep
RKGRGRTGRRRSRQRRYLRRNRRSRRNHLRRNPQGLSSEVLAEFTETFFAHMCGQDVLTRFTLNSCPRDEACEYLYRDASLAGIFEAAFCSGCKPDPCL

SEQ ID NO: 152756 - protein, 55 aa, Triticum aestivum
  Clone ID: PAT_TA_47174.pep
KVDELLKEVEAEQEKSKLHTGYDPESVATMLKQQEKLRTIRQVEALLELAATLKW

SEQ ID NO: 152757 - protein, 80 aa, Triticum aestivum
  Clone ID: PAT_TA_47175.pep
MTRASTLDFRRKTQGQNNWSGPLRPVNVIRNKFPTYKNGSNGIVIKFADEPETPSLKESVAKETADLLDRRQRLSVRELA

SEQ ID NO: 152758 - protein, 194 aa, Triticum aestivum
  unsure (1)..(194): unsure at all Xaa locations
  Clone ID: PAT_TA_47176.pep
VRRKVNIEPTDVTSIGALIACSHSXYTEEGGGHFDSMTHNYSIHPRIEHYGVMDDLMGQPGLIDEAHHFIKNMPIEPNAVVWTALFSARTVDKTVEIGEEALKQITPLDTNHSGNYILLXEHLLXTGQWKDPSMIPKEMNERGIKKIPECSLIELDRTIFELFAEDSDHHQSREIYEKVYEMIDDIMMAVYVPN

SEQ ID NO: 152759 - protein, 169 aa, Triticum aestivum
  unsure (1)..(169): unsure at all Xaa locations
  Clone ID: PAT_TA_47177.pep
MGIFEPFRAIGYITTGGVPFSLQRLGTETFVTVSVGKAFHVYNCAKLTLVLAGPQLPKKIRALASFKEYTFAAYGSDIAVFKRTDLVVTFTKHEEKVNMLYLFGEYILSADIKGDLFIWAFRGXNPSSEPCGNISLGDKFTPTCIMHPDTYLNKVIIGSEEGPLQLWNI

SEQ ID NO: 152760 - protein, 59 aa, Triticum aestivum
  Clone ID: PAT_TA_47178.pep
VRVAPICYAHLAAAQMSQFIKFEFADTSSGSGVPSSSTAATVPELPRLHADVCSSMFFC

SEQ ID NO: 152761 - protein, 83 aa, Triticum aestivum
  Clone ID: PAT_TA_47179.pep
MAGGSDGTDVPAGGEIWGTLEELLLAFAVCRHGTASWDSVATEVQARCPLAGRPRLTPGRCRLRFHQLHRRFSAGGGAEEEEQ

SEQ ID NO: 152762 - protein, 25 aa, Triticum aestivum
  Clone ID: PAT_TA_47180.pep
ESVLLEPAIDLDYYSTVLELAQLAP

SEQ ID NO: 152763 - protein, 146 aa, Triticum aestivum
  unsure (1)..(146): unsure at all Xaa locations
  Clone ID: PAT_TA_47181.pep
VRCDQVLTISEYRGLLYDYIKSRMNSIASRLSALAGELVGARLISHVGSLMNLPESXAEHTILIMAAENDLFIDMQTYHASPMSGLIYHASLIVQAGSKHMGKISRSLGANSALAIXYDALADGDNNCMGLESRIKLDTLLRVIEG

SEQ ID NO: 152764 - protein, 66 aa, Triticum aestivum
  unsure (1)..(66): unsure at all Xaa locations
  Clone ID: PAT_TA_47182.pep
NLIFTEQCEIDWKKSIYKDSPFHVAFFRAMFIDDFLLWKTLSVCCLKWILHNVVFEFAPXSVTIQY

SEQ ID NO: 152765 - protein, 118 aa, Triticum aestivum
  unsure (1)..(118): unsure at all Xaa locations
  Clone ID: PAT_TA_47183.pep
WRCISIHICQDGIHCWNACYELYRLXRGIQPAGQKPGDKTDGGGDDAFNTSYSETGAEKHVPSAVFADLEPTGIDEVRTGTYRQLFHPEQLISGKEDAANNXAPGHYTIGKEIVDLCL

SEQ ID NO: 152766 - protein, 76 aa, Triticum aestivum
  unsure (1)..(76): unsure at all Xaa locations
  Clone ID: PAT_TA_47184.pep
RESINQSAGAVNERSSPDKGKNLXXXEWGGVGSGALVGLGRGGGSYVNGAAENPVQWLAQLTMWICPHVSAXAWAX

SEQ ID NO: 152767 - protein, 101 aa, Triticum aestivum
  Clone ID: PAT_TA_47185.pep
AADRPNPSPPPHRRTLGSRKRAPFLQTRLAASPAAARTDQRPPTSSRLSKEPGSAASDNRWGRREGAVWRRSAPPPSLSRALALLPQHLLPWPCAVSLGRV

SEQ ID NO: 152768 - protein, 99 aa, Triticum aestivum
  Clone ID: PAT_TA_47186.pep
FPFRAAAKRIRCRARAASPTQIEGPCEIETRSYGGERQWIFRCNQSAGTRIRAFPCGLSSVCRRIAFVAGRGASNFSDLVSLKMWRRARCRPPVTAAVG

SEQ ID NO: 152769 - protein, 93 aa, Triticum aestivum
  Clone ID: PAT_TA_47187.pep
RPIQYNVARPSETQVNAMLGQRRELPRMLVLHRIKIMLVHCLRVLVVLVGSSSYVFSIALQRATIAQGNLNSRLGIDKRYQFKRTVRELEGRT

SEQ ID NO: 152770 - protein, 85 aa, Triticum aestivum
  Clone ID: PAT_TA_47188.pep
MASGTWLGGRRHDAQRVRSARMDSDAKHFEQACGLDVGAAQQVVVAAALQVVVATALLAVVTAALVRPRSPRTAEGRASRAGTRN

SEQ ID NO: 152771 - protein, 92 aa, Triticum aestivum
  Clone ID: PAT_TA_47189.pep
CVRFPKPDRYVWSAIVVSFRSALLGLLVFFRILFLVRGSSDLVWESAKHVMTIRQGHQNHLMVMIYQVYNGNLSDDSVFQVDSSFGSFFMGL

SEQ ID NO: 152772 - protein, 66 aa, Triticum aestivum
  unsure (1)..(66): unsure at all Xaa locations
  Clone ID: PAT_TA_47190.pep
AKYLVRSLEKIRDEXASPSEAYNMPSQWMDVLFELVSGKIRRDLLYYRSIVSARSSFARANNQSVY

SEQ ID NO: 152773 - protein, 80 aa, Triticum aestivum
  Clone ID: PAT_TA_47191.pep
NNVGSARVSTRSLHHRVPAYGASTPRCSRRTGRPPRRRRPWEARRGPWCSTEGGGLKTLGWLAGRGWVGRPFDPFATVGI

SEQ ID NO: 152774 - protein, 76 aa, Triticum aestivum
  Clone ID: PAT_TA_47192.pep
SPYQASTCSVSEWTFSLNWSQENLGPLFLTIVVWSVKGVLSLVRTIIRSTDISCRNLQHSVCGRAHSGSVSYAIII

SEQ ID NO: 152775 - protein, 42 aa, Triticum aestivum
  Clone ID: PAT_TA_47193.pep
SKINLYRLLYVHFNEYMSPPSDKSTTMHTYSSSTAVGRWSGR

SEQ ID NO: 152776 - protein, 138 aa, Triticum aestivum
  unsure (1)..(138): unsure at all Xaa locations
  Clone ID: PAT_TA_47194.pep
PKCLTYVALVSTSASEPCPSLKKEPSVPPADGFSKTRAVIFISAPPSLDPRGARRGRTRCAASRWPHRSSQTCTPXPSSTSASPLPPRRAPSLGAAEEGEGRGCMAETRSAMVGGGDGGGNRGSERKARAAGCLDWRT

SEQ ID NO: 152777 - protein, 69 aa, Triticum aestivum
  Clone ID: PAT_TA_47195.pep
ASGRSWRRRVLPWARPPLTGKSAPALIIADFVYDMHAHPLALPTRLQGSVLGERKVVRPRCDDGDEVHV

SEQ ID NO: 152778 - protein, 137 aa, Triticum aestivum
  Clone ID: PAT_TA_47196.pep
MIQPSSSPHDLVATAPTHAVRFRRAPAARNAPPSTPLPPPHPDPAISLPPLVDRFGFDDDGAAIRVLSDVDPVAPRQQQPTGANIRRELARLVADVRAGDSLFFHYSGHSTRLSAETAQDDDTGYDEWIILFDMDLS

SEQ ID NO: 152779 - protein, 36 aa, Triticum aestivum
  Clone ID: PAT_TA_47197.pep
KACSCGSGKSRSVFLLDSALERGRRDAAVDRDLYPR

SEQ ID NO: 152780 - protein, 50 aa, Triticum aestivum
  Clone ID: PAT_TA_47198.pep
SVRPQRSAPQSVQPTRSPTRPPTRSRTRGKKKKRKKKKNIIKKRVGQYRG

SEQ ID NO: 152781 - protein, 60 aa, Triticum aestivum
  Clone ID: PAT_TA_47199.pep
VASKLSAASSILSRQLAAASPSRLILRHRHPSRPIRGHLILTERVESQPHPPEVHAVALV

SEQ ID NO: 152782 - protein, 64 aa, Triticum aestivum
  Clone ID: PAT_TA_47200.pep
ISRLLGCQQAVLFLLYVSLMTCTLYTLTNMVYIHEDATALSLRALTNRIYMRSKERNHFMLSLT

SEQ ID NO: 152783 - protein, 98 aa, Triticum aestivum
  Clone ID: PAT_TA_47201.pep
RPPGVPFIPFPQLQRGSPCPSTSTSTQMSMRQNNSSRYRGRGFDRGGRVQRNGRNGARTRYPYDHHQGRRFPSNHHRSEKWQPWPQERDGGSRSRGRQ

SEQ ID NO: 152784 - protein, 147 aa, Triticum aestivum
  Clone ID: PAT_TA_47202.pep
SALTADMWTSNHTLSYLCITCHLINSKWILQKRIFRFFMVETPHNGVTMFNVLLKSLQECNIEDKLFSMTLDNASVNGTMVNNLRKNLNSKHMLPIKGQLLHIRCACHVINLIVQDGLTTMKGVIDDIRESVKYIKSSPSRLDKFKE

SEQ ID NO: 152785 - protein, 81 aa, Triticum aestivum
  unsure (1)..(81): unsure at all Xaa locations
  Clone ID: PAT_TA_47203.pep
MSFLCWNCRGLGTDATVGELKWLISKFCPSLIFLSETKMRDSRARKFMWSLGXFSGSFAMSSDGLSGGMALIWSSSISVSL

SEQ ID NO: 152786 - protein, 39 aa, Triticum aestivum
  Clone ID: PAT_TA_47204.pep
THLIQWMCQVKKLETEQLVPLFKFVQRSKLSNKSVVSRV

SEQ ID NO: 152787 - protein, 99 aa, Triticum aestivum
  Clone ID: PAT_TA_47205.pep
MGISRDSMHKRRATGGKQKAWRKKRKYELGRQPANTKLSSNKTVRRVRVRGGNVKWRALRLDTGNFSWSSEAVTRKTRLLDGLQFVNNELGGLDPKNAL

SEQ ID NO: 152788 - protein, 57 aa, Triticum aestivum
  unsure (1)..(57): unsure at all Xaa locations
  Clone ID: PAT_TA_47206.pep
RPRTRGFYLPHRLGRKNSCGCGKNTEKKYXVDPVRTRGSVKPAGSCSNFFSLTFFSC

SEQ ID NO: 152789 - protein, 81 aa, Triticum aestivum
  Clone ID: PAT_TA_47207.pep
HIVLITPYGWGHHITIDDDIYMISEFCPQSKSKPGHKRWCLTGAARLELEDLGEAAVVEANHFSSSCGGLGLVILLFFLPD

SEQ ID NO: 152790 - protein, 133 aa, Triticum aestivum
  Clone ID: PAT_TA_47208.pep
MSTTTNSSNGTTCSSESGSECEVESDIKKMELGKKKLQQYMYVAFVVAMHNQKYLMKKERREVRCTGQQWGYDCLGSLKDCYMMFRMHRPCFDLLHETLVHNYGLRATCNMCSEEALWMFLWTIGSPQSVSQV

SEQ ID NO: 152791 - protein, 46 aa, Triticum aestivum
  Clone ID: PAT_TA_47209.pep
SAVTLVSCLEGPAMCPLVVGACRMAQSNARYGSHTRDRSSECTIAP

SEQ ID NO: 152792 - protein, 184 aa, Triticum aestivum
  Clone ID: PAT_TA_47210.pep
SAHASVDTPLDEQKCFDHVTSLISVSPNTVMPQGCLAHDLIEKVEVEVKRLKHLKASKMKELVLKKMTQLEEIYRSVHMHIDSDHEWRILTELIDSGRADLSELLTDMDDRIAEARDLALSRKDILEKVEKWTSATEEEGWLGEYEGDQNRYNAGRGAHINLKRAEKARVLVSKIPSLLENLTT

SEQ ID NO: 152793 - protein, 116 aa, Triticum aestivum
  unsure (1)..(116): unsure at all Xaa locations
  Clone ID: PAT_TA_47211.pep
LEIIXARGSSCREDVRLLCTVYFKNSINRYWRTRRDSYGISNEEKDHLRKNLLLNIREENNQIALQLAVLISKIARLDYPREWRDLFSILAQQLQSADVLASHQVFMVLFRTLKEL

SEQ ID NO: 152794 - protein, 113 aa, Triticum aestivum
  Clone ID: PAT_TA_47212.pep
MVVVATASPGGPEALHVREVEDLPAPGEGEVLVGVAVVSVNCGDTVQWQWPIASASSYPGLECSCTIVSLVSALDPLYQVCTLFTGSGYIEKAYSPRRILITLPTGHFLHIHS

SEQ ID NO: 152795 - protein, 81 aa, Triticum aestivum
  Clone ID: PAT_TA_47213.pep
RPRTRGNPPPWVAKKAVKAWPSAGFIPGVGPNSSGMPNSGSSGALGGGGVPGMPGSYMGGYGGGGGYGGPPGGPGRNYMGH

SEQ ID NO: 152796 - protein, 94 aa, Triticum aestivum
  Clone ID: PAT_TA_47214.pep
ESPFDFHGKSIPLNVSGINILTVHSVLSRKIFCIFTDTDFVVCLMAHYFTGFLTTCSPIQMNGFFYVHTGYLSYVYQLEGSTVYQSKAKQREFF

SEQ ID NO: 152797 - protein, 73 aa, Triticum aestivum
  unsure (1)..(73): unsure at all Xaa locations
  Clone ID: PAT_TA_47215.pep
MAETEYRXFVGGLFCATDDNQEAFSQYGEILDSKIINDRETVRSRGFGFITFGSEESMRQAIGEMNGKELVWR

SEQ ID NO: 152798 - protein, 178 aa, Triticum aestivum
  unsure (1)..(178): unsure at all Xaa locations
  Clone ID: PAT_TA_47216.pep
MADLATMVPDYVLAGXLRLLAPRXLAASRCVCKAWRRVIDDRRLLRSDLLPRSLGGIFLNYLDLWFTQLLSRPTTGTAISGRLDYTVPGEPDLMPPIHXRDHCNGLLLLHHCVVNPATQQWAPLPPAPDLPQPPPSGMISFAREHLVFDPTLSPNYFEVLIVPDVPSKNNDDCEEEAE

SEQ ID NO: 152799 - protein, 84 aa, Triticum aestivum
  unsure (1)..(84): unsure at all Xaa locations
  Clone ID: PAT_TA_47217.pep
DELRELSERRRXGRADAVEGGERQPRDSAGRGAEDGGRLPGAAVGAEARRSCQVASALPHSGGVVQSSRTRANTEPQHPEIRHR

SEQ ID NO: 152800 - protein, 155 aa, Triticum aestivum
  Clone ID: PAT_TA_47218.pep
VRADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRY

SEQ ID NO: 152801 - protein, 37 aa, Triticum aestivum
  Clone ID: PAT_TA_47219.pep
GWHPRQAPSCCRHRGRALVRPRMIRSYDALIFGWRMV

SEQ ID NO: 152802 - protein, 155 aa, Triticum aestivum
  Clone ID: PAT_TA_47220.pep
MDASATVATGKGKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSAKKTAKSPKKA

SEQ ID NO: 152803 - protein, 98 aa, Triticum aestivum
  Clone ID: PAT_TA_47221.pep
RDRPNRRPRVGRSPASIIGQCYPLVASAATRPLSVLPTPASAFLIKRRPLSGLGASTYGTHKPSSVPGLRTRDPTRYTHGLARTNVQQKESGARLSRP

SEQ ID NO: 152804 - protein, 72 aa, Triticum aestivum
  unsure (1)..(72): unsure at all Xaa locations
  Clone ID: PAT_TA_47222.pep
MAETEYRCFVGXLACATDDHNLQQAFSQYGEILDAKIINDRETGRSRGFSFVTFGSEESMRQAIEEMNGMEL

SEQ ID NO: 152805 - protein, 70 aa, Triticum aestivum
  Clone ID: PAT_TA_47223.pep
RASKRPNFDERNQQIHKPISSSIDFSSPCCGPSRRPKMQIFVKTLTGKTITLEVESSDTIDNVKAEIQDK

SEQ ID NO: 152806 - protein, 46 aa, Triticum aestivum
  unsure (1)..(46): unsure at all Xaa locations
  Clone ID: PAT_TA_47224.pep
VRYMNANYIQLPTFIYMHDACLMRRPLLRVIIPFFSLXGKYTYTAL

SEQ ID NO: 152807 - protein, 67 aa, Triticum aestivum
  Clone ID: PAT_TA_47225.pep
RPPTRAFALLKCLPGTPIRIVKNLRVCGDCHLVIKLISKVYDHEIIVRDRSRFHHFKGGECSCKDYW

SEQ ID NO: 152808 - protein, 147 aa, Triticum aestivum
  Clone ID: PAT_TA_47226.pep
MEFGRSKTQFGSDWLNSSVLVYLKKLWGVKRLFHEKGDDRFFVFNLKIAELFLCLSTCVDDTMFPAEELCQFVSSLFAKSKVLRNKDLMETHLSPLITCIPGLIASCADDSKGYLLEAFTDAFRDSKVDCKLMLPYLDAVREMLLPE

SEQ ID NO: 152809 - protein, 56 aa, Triticum aestivum
  Clone ID: PAT_TA_47227.pep
FSFLDYCAFVATAHTLNNSEMERFLFTCPTQCYKVKNFLSKGPRSLLLVCFWGDDS

SEQ ID NO: 152810 - protein, 155 aa, Triticum aestivum
  Clone ID: PAT_TA_47228.pep
MAPIKIGINGFGRIGRLVARVALQSPDVELVAVNDPFITTDYMTYMFKYDTVHGQWKHHEVKVKDSKTLLFGQNEVAVFGCRNPEEIPWAAAGAEYVVESTGVFTDKDKAAAHIKGGAKKVIISAPSKDAPMFVCGVNEKEYKSDLDIVFNASCT

SEQ ID NO: 152811 - protein, 167 aa, Triticum aestivum
  Clone ID: PAT_TA_47229.pep
MNPDNFTHKTNEALVAAHEAASEAGHAQITPLHLAAALAADRSGILRQAVAGASGGNASAGDSFERVLSAALKKLPSQSPPPDSVPASTALIKAIRRAQSAQKKRVDSHLAVDQLLMGLLEDAQIADCLKGAGVFASRVRAELEKLRGGDNARKVESGFGDTNFQAL

SEQ ID NO: 152812 - protein, 203 aa, Triticum aestivum
  Clone ID: PAT_TA_47230.pep
RPPTRPDSDASEKSFETRKMNKWFKSFFEVINTLSVDQIHEHTRQWHCPACKNGPGAIDWFKGLQSLVTHARTKGSKRVKLHRELAALLEEEMSRRGSSVVPSGEQFGKWKGLRESTDREIVWPPMVIVMNTLLEKDEDDKWLGMGNQELLEYFSDYAATKARHAYGPGGHRGMSVLIFESSAWGYMEAERLHKQFIDQRTDR

SEQ ID NO: 152813 - protein, 154 aa, Triticum aestivum
  Clone ID: PAT_TA_47231.pep
MEFTEAYKQTGPCCFSPDARFLAVACDYRLVVRDVVTLKVVQLFSCVDKINFLEWAPDSEYILCGLYKRPMVQAWSLSQPDWTCKIDEGSAGIAYARWSPDSRHILTTSEFQLRLTVWSLVNTACVHVQWPKHAARGVSFTKDGKFAGICTRRD

SEQ ID NO: 152814 - protein, 159 aa, Triticum aestivum
  Clone ID: PAT_TA_47232.pep
MKALHPFALLPFWSFLLLSTDNASGYGHGEALHGDALALLSLKASLSCRPHVLRSWLPGNVASVCEWTGVRCAGGRVVSVDIANMNVSTGAPVTAEVTGFAALANLSLAGNGIVGAVVVSALPELRYVNVSGNQLGGGLDGWDFPSLPSLEVFDAYDNN

SEQ ID NO: 152815 - protein, 177 aa, Triticum aestivum
  Clone ID: PAT_TA_47233.pep
CGHASVQILEAREELLQSLQAKNKRGSETARESSENANESSAPAEEKVIEPSIIQDKEVSISEVRSFEEPTSDITPEIEAEKFPVSTTEVEIIDKSVIEEELLSVKDKIRAPLVQSRLHADTDEDEVDEWPDDDSTEEPEAVAAASNRASLGREEDVSFSDLEDDDDDDDGNKGSGK

SEQ ID NO: 152816 - protein, 72 aa, Triticum aestivum
  Clone ID: PAT_TA_47234.pep
RPGNASPITKQPLSLPKISTPKVRQPLSNLSEFFLQAPPYSSPTSFPTYLYTQKLYPLFPYACQLAALILMN

SEQ ID NO: 152817 - protein, 185 aa, Triticum aestivum
  unsure (1)..(185): unsure at all Xaa locations
  Clone ID: PAT_TA_47235.pep
CACLKIVQKCKRKFVTQQVGENEPFVSELLXSNLATTILDLEPHQIHTFYESVGHMIQAESDNTKRDEYLKRLMSLPNQKWAEIIGQAGQSIDILKNQDVIRSVLNILQTNTSVATSLGPHFFPQISLIFLDMLTVYRMYSELVSSTIAEGGPYASKSSFVKLLRSIKRETLKLIETFVDKAEDL

SEQ ID NO: 152818 - protein, 179 aa, Triticum aestivum
  unsure (1)..(179): unsure at all Xaa locations
  Clone ID: PAT_TA_47236.pep
VRGRVGLYFISQLLYRKYSGNFLVNLLGIWGESEYSGXHSIPVGGLAYYVTAPSSMADILANPFHALVYVVFMLSACALFSKTWIEVSGSSAKDVAKQLKEQQMVMPGHRESNLQKELNRYIPTAAAFGGVCIGALTVLADFMGAIGSRTGILLAVTIIYQYFETFEKERATELGFFGF

SEQ ID NO: 152819 - protein, 201 aa, Triticum aestivum
  Clone ID: PAT_TA_47237.pep
RAGVRRADRVDGETMELMTAIACGWIERLVVSGGDVSDVSALLGEMDCVGLRPGFSLVEKAVALYWDRSERARAVEFVRDVLRRGSVAAGGEYDGERGGPVGYLAWKIMMDGDYRDAVKLVIEFKESGLKPEVYSYLIGLTALVKEQKEFSKALRKLNLSVKDGSIAKLDTESMHNIEKYQSKLLGDGVLLSNWAVQEGSS

SEQ ID NO: 152820 - protein, 62 aa, Triticum aestivum
  unsure (1)..(62): unsure at all Xaa locations
  Clone ID: PAT_TA_47238.pep
MSMVSNLHAFTLDVTGTLLTYKGQIADYYCMATHAAXKPCPDYDPMHELSNLSYTEMARKYP

SEQ ID NO: 152821 - protein, 88 aa, Triticum aestivum
  Clone ID: PAT_TA_47239.pep
MARNGGGRKKAVARSTKAGLQFPVGRIGRFLKKGRYAQRVCSGAPIYLAAVLEYLAADVLDLAGNSSMDNMKTLIVPGHLLPRHPLRP

SEQ ID NO: 152822 - protein, 88 aa, Triticum aestivum
  Clone ID: PAT_TA_47240.pep
VLKRWRTIIIGRHSVSCTDWCCRQRIEFPVVLFGESGHWAGCRWTYLACPMVTWMLMRQHPLYFYPLWFFVSMSEISLFIGTGPPRWI

SEQ ID NO: 152823 - protein, 175 aa, Triticum aestivum
  unsure (1)..(175): unsure at all Xaa locations
  Clone ID: PAT_TA_47241.pep
DLLNRGYTTGAEVSPSRAAAATGGAITXXSTXKNGAIGADLQTQGKIKNFTGGVKATSDSRGGTTITGPELDTPGLEGGLSLPFPYQKATPGKGELQDLDPHLGINGRGCLNSNPLGNFSGGIGTKGFGFGGDVAFDTGSGDFTKDNGGLSHTNQGRTGSVNLNNKGNTRGCFLL

SEQ ID NO: 152824 - protein, 68 aa, Triticum aestivum
  unsure (1)..(68): unsure at all Xaa locations
  Clone ID: PAT_TA_47242.pep
GRASTRPATRPSSGTNTRASWYMCXXWLSGPYGGGGXFLMQTEVYGRRFTGLACFREENSSYWRSHQT

SEQ ID NO: 152825 - protein, 207 aa, Triticum aestivum
  unsure (1)..(207): unsure at all Xaa locations
  Clone ID: PAT_TA_47243.pep
CAQMQKDMLSNLNNILTDTDVAFDVVTTSGADEGNTAALMLSAGISPGTEPHLKALLLAIRSSQLLGLLEKSRIFVPKGRWLMGCLDELGILEQGQCFIRASSPVLNNSLLKHGPRSSSANNNAETVKGTVVMAKNPCLHPGDVRILEAIDVPALHHLVDCLVFPKNGERPHANEASGSDLDGDLYFVTWDEKLIPPGKRSWXPMDY

SEQ ID NO: 152826 - protein, 67 aa, Triticum aestivum
  Clone ID: PAT_TA_47244.pep
RAGTHLLPYCPQAPHTLPLPSPPTAPISMGAAEEFQHFLCVLNTNANGNQKTLLGLTSIKGGGRRFS

SEQ ID NO: 152827 - protein, 151 aa, Triticum aestivum
  Clone ID: PAT_TA_47245.pep
MYRADALLDLPLQIMPKRSNPQPRTRAMETLEPIQQTLGEIDKRIPDALRAAFGLEKRASCSSEDAIASFFALYLEPPHHRERRERDGEEPRALRMNWASCYAPRHNEDAHFGHDEAGVVGVADGVCGYRKIGVDAGAFSRGLMTSAFLQV

SEQ ID NO: 152828 - protein, 71 aa, Triticum aestivum
  Clone ID: PAT_TA_47246.pep
PRVSVRDRGVGVLAEAAPISLTRGIVVAAAAPCDGRSEAGSGGRRGLDGTLLVHQIVVVARHSRPPPRPCS

SEQ ID NO: 152829 - protein, 75 aa, Triticum aestivum
  unsure (1)..(75): unsure at all Xaa locations
  Clone ID: PAT_TA_47247.pep
FNAPIHIHKRAKNLYADNIDTLMAVMHNPRHFIVPNYFLNTINDYKDSRFFHFDPTPSTYXLKDDLYRLNMIMNH

SEQ ID NO: 152830 - protein, 67 aa, Triticum aestivum
  unsure (1)..(67): unsure at all Xaa locations
  Clone ID: PAT_TA_47248.pep
CGNGHTTVLSLSPYTTANHAPAMNTSIKNGAIETLEPIXYILNEIDKRIPKNMFAMNFINFVGWRSF

SEQ ID NO: 152831 - protein, 124 aa, Triticum aestivum
  Clone ID: PAT_TA_47249.pep
SEPARGRRRALHHHRAGGPLLVSRVCLFLRPLRSYRRCWWTLSFSRPEWPHVAPPHRPPRPTPPRGRAPSSPIYHTSNPLLPFYDDSLARTRSCSIFISSSISVYVYVHMNETIFFDIPILINF

SEQ ID NO: 152832 - protein, 160 aa, Triticum aestivum
  unsure (1)..(160): unsure at all Xaa locations
  Clone ID: PAT_TA_47250.pep
AGSERAAASAVAATPATLLRRKATIAAATSASXGSLSPTQSPASAAWAIPANPRPKNRAPAPQYHQSAPVKVPVRPPPKPAMDKWDELDDDDXLRHGDAIMLPPHEMVARASAGGAGPAAPFSMLEGAGRTLKGRDLRRVRDALLRQTDGSTESGEVIWL

SEQ ID NO: 152833 - protein, 171 aa, Triticum aestivum
  Clone ID: PAT_TA_47251.pep
VRDFFRMLSCYFTTVGFYFNSLISVVGVYGVLYGQLYLVLSGLQSALLIKAHHQNMKSLETALASQSFLQLGLLTGLPMVMELGLEKGFRAALSDFILMQLQVASVFFTFSLGTKAHYYGRTILHGGAKYRPTGRKFVVFHASFTENYQLYSRSHFVKAFELIFLLIIYHL

SEQ ID NO: 152834 - protein, 71 aa, Triticum aestivum
  Clone ID: PAT_TA_47252.pep
VYVVLSQWKFAYVAYNRPDYLQDSDIVLSRFQQKNIYGPWEQSLGLEHSDMPTKRANQNRHSFEKPVKIYN

SEQ ID NO: 152835 - protein, 55 aa, Triticum aestivum
  Clone ID: PAT_TA_47253.pep
VRDSYSTFTWEEIDNATASFSESLKIGTGSNGTVYKGHLNHLDVAIKVLHSNDST

SEQ ID NO: 152836 - protein, 149 aa, Triticum aestivum
  Clone ID: PAT_TA_47254.pep
VRTACHSGSGVHPPPPATPAAASTSRRWLPRSRRPPLAPPSAPWSSVPCRRHGQQSPLGHLHDPPPWREAGGLRPWHLLWLRGLRGAWPGGRVVGACCPGRPAWLGAAPTVQEGAVASPPRCRRPGATSSVPAQGALRGLTGDGGPLFP

SEQ ID NO: 152837 - protein, 126 aa, Triticum aestivum
  Clone ID: PAT_TA_47255.pep
RPPTRPVGFKYPIALSLIHYAGALVLMAILKALSLLPVAPPSKSTPFSSLFALGAVMSLSTGLANVSLKHNSVRFYQMAKIAVTPTIVAAEFMLFHKKVSCQKVITLATESIGVAVATATDLEFNF

SEQ ID NO: 152838 - protein, 68 aa, Triticum aestivum
  Clone ID: PAT_TA_47256.pep
RPLTRTVRLKNPIALSLIHYAGALFIMTIPNVLSFTPDCLSFQVDSLLLSVRFGPRDVFLHRPSERLL

SEQ ID NO: 152839 - protein, 95 aa, Triticum aestivum
  unsure (1)..(95): unsure at all Xaa locations
  Clone ID: PAT_TA_47257.pep
RPRTRGRTRGKKRGQFIIHNMKSFRGPLRGMEQEMWEATREATRDPPAAAVASRRPDPAALPASRVGGRFWVLADSDDEDNDXEEPAGGSTTDYS

SEQ ID NO: 152840 - protein, 66 aa, Triticum aestivum
  Clone ID: PAT_TA_47258.pep
HIEEPWLWSGPFCRSGPSTCHSVLPIIMYSIYLKWVLYWIRWSACLQKAHPFCFELSLQTVIGSPM

SEQ ID NO: 152841 - protein, 90 aa, Triticum aestivum
  unsure (1)..(90): unsure at all Xaa locations
  Clone ID: PAT_TA_47259.pep
MASGSGEHFLRQLSSSNGLQAAQDGYGGGGGGRRRGSRRWSKKRAGGRGYGGGGKGEAAASASAGRKRVMVVVDYSSXAKHAMMWALTHV

SEQ ID NO: 152842 - protein, 108 aa, Triticum aestivum
  unsure (1)..(108): unsure at all Xaa locations
  Clone ID: PAT_TA_47260.pep
VRGRVRAXEYILKLGLLPKRYNHVMSMIKNSQLCGQASISYGQQRGTSEAALHCATDEKTTFNLPLESRSIQIAVAFAKDLNDKDHWARLXIEALRHGNVGIVEYSYQ

SEQ ID NO: 152843 - protein, 114 aa, Triticum aestivum
  Clone ID: PAT_TA_47261.pep
GENAPTISMFSNRVSIFWSKEATFFPPRRKALHSEGSPLTGSSPSWAGETMGRGPLGFAPRQTARVAREGTPGLKKEVVGLRGKQGSPAVGGARDKEKTPMVLLCSARKQTPQT

SEQ ID NO: 152844 - protein, 117 aa, Triticum aestivum
  Clone ID: PAT_TA_47262.pep
MLHFLLFIVIHVSDTFYWLVFVFLRLLVAIQICSHREVYEPIIQGPGGNYSLEVWCLQHVIPARVYADHVMMVALARALEVPLRVESLQRGYAPDIYTGPGVPRPSVTLLYTGDHYD

SEQ ID NO: 152845 - protein, 96 aa, Triticum aestivum
  Clone ID: PAT_TA_47263.pep
GRTSRSGRRSWRRTTRSWRRRRGRRTRTSTCTRSRTRSRCPRPARRRRPRAAPPSSSPRRGGTSRTRPSGSPCQSEQSRPNQGRKERSSRRSEMSG

SEQ ID NO: 152846 - protein, 99 aa, Triticum aestivum
  Clone ID: PAT_TA_47264.pep
MATRIQFENNCEVGVFSKLTNAYCLVAIGGSENFYSTFESELADVIPVVKTSIGGTRIIGRLCVGNKNGLLLPHTTTDQELQHLRNCIPDQVVVQRIDE

SEQ ID NO: 152847 - protein, 95 aa, Triticum aestivum
  Clone ID: PAT_TA_47265.pep
PMGTKPPPAKRSPEGPGPMKTPKFNNCGNRGAPPSFIGGQKRTPANMYFRRTRPFQGRWGKKNIKMDRSGAAFFFPPKKTHLNKRTTIPVKKNPM

SEQ ID NO: 152848 - protein, 85 aa, Triticum aestivum
  Clone ID: PAT_TA_47266.pep
PNYMRAAASIDVMRCLVLYLFNLLGVVMDLHLLGMLYFHLESHHMEVASAILGGSPSGTHFCSSQHMFINFPYMESSLRHFLVLL

SEQ ID NO: 152849 - protein, 58 aa, Triticum aestivum
  Clone ID: PAT_TA_47267.pep
YSNTSLSSLRSHLPQAQVIYLCRNQRTCLKADKALPHSLCVIVLSIAYRPNRGRSIIE

SEQ ID NO: 152850 - protein, 106 aa, Triticum aestivum
  unsure (1)..(106): unsure at all Xaa locations
  Clone ID: PAT_TA_47268.pep
CTSLCIGFIGFLYLRYVADPKILWTWYEPYLKDDEEFSPGSNGRMTTMGVYVRDLILGQKLCQXLDKFLSQYYFDSILPRVPVPVVRQVTTNLEKMKLPTKLSGVT

SEQ ID NO: 152851 - protein, 95 aa, Triticum aestivum
  Clone ID: PAT_TA_47269.pep
MGNTVAEEDIEDIPNSDANPPILTEYHITVPTLHDGLMQGEHQHERRLLDFLKATPSVQWLKDINVCAPLGKFQLPSIGVHRYLHVHFIRTVDWS

SEQ ID NO: 152852 - protein, 56 aa, Triticum aestivum
  Clone ID: PAT_TA_47270.pep
GFWAVWAGTRTKILQACSLTQLVPEGNKEAPQNQLLESYRSKCHLISANVTEAYVL

SEQ ID NO: 152853 - protein, 113 aa, Triticum aestivum
  unsure (1)..(113): unsure at all Xaa locations
  Clone ID: PAT_TA_47271.pep
MSGGPAAVSFLTNIAKAAAGLGAAASLLSASLYTVDGGERAVVFDRFRGVLPETVGEGTHFIVPWLQKPYIFDIRTRPHNFFXNSGTKDLQMVNLTLRXLSRPDVVNLPTIFT

SEQ ID NO: 152854 - protein, 80 aa, Triticum aestivum
  unsure (1)..(80): unsure at all Xaa locations
  Clone ID: PAT_TA_47272.pep
MFGGPSAGSALTNITKAAVGLVAXTEYSRSXLYSANGGQRAWRMERVLXVLIKTGGCGTYALGARLHRQYIIDIRSRSLN

SEQ ID NO: 152855 - protein, 90 aa, Triticum aestivum
  Clone ID: PAT_TA_47273.pep
AGSHRWPAAASRSSGGVATSCGRRGSGMERYEVIKDIGSGNFGVAKLVRDVRTKELFAVKFIERGHKIDENVQREIMNHRSLRHPDIVRF

SEQ ID NO: 152856 - protein, 101 aa, Triticum aestivum
  Clone ID: PAT_TA_47274.pep
HLSFRLSSRNMSLRVWYYGLLGETARLYSLCQVSLLVRVQLLNIGSSRRRRLRHHPSSQPQSICSVSATVQRSQPYHLLLPRARQRDRTRHVQLRSDLCRS

SEQ ID NO: 152857 - protein, 142 aa, Triticum aestivum
  Clone ID: PAT_TA_47275.pep
VRFEASRDGLYFVSEDKSSGQSTDKGRAWQQTFVNLLTRLDAAYHSFTCAEQDWKRGQLNMETAGKGLYSATNQLSVVSVKAKSALVDLQDTLVDMYERACEVSVSLSGFKHISQDRTALTAECGSLLEEVLAIAEGLHDVY

SEQ ID NO: 152858 - protein, 112 aa, Triticum aestivum
  Clone ID: PAT_TA_47276.pep
MAGTVTVPGSSVPSTPLLKDELDIVIPTIRNLDFLEMWRPFFQPYHLIIVQDGDPSKVIKVPEGFDYELYNRNDINRILGPKASCISFKDSACRCFSYMVSKKKYVFTIDDD

SEQ ID NO: 152859 - protein, 118 aa, Triticum aestivum
  Clone ID: PAT_TA_47277.pep
SGAPEEFGVDPTRPNSPHFSVFPVVRADLCLCVLSSPGPIVDGIWPLTSRPGRIPCLAKLLLNLLTISTFYLGLRKLQFSPTNRSDLFLSRSNFSFWVSCLRSSPNRSEIINHFPFLC

SEQ ID NO: 152860 - protein, 92 aa, Triticum aestivum
  Clone ID: PAT_TA_47278.pep
NKTKGSIYYSTHELNLSVAKSKQKNLLSTTGQLRTFHNSQSPAHVYLEILYKLPHLPHLGPPSSSDLGQPRMHGAMLVCSVKMDYMEHASGT

SEQ ID NO: 152861 - protein, 58 aa, Triticum aestivum
  Clone ID: PAT_TA_47279.pep
PLGLYNKQHSCWLKHNSFPSTKAWYTIGRTFRRSAHKELIPYGQSAALSPSDLAPPPV

SEQ ID NO: 152862 - protein, 151 aa, Triticum aestivum
  Clone ID: PAT_TA_47280.pep
VRPRVRDNVFVFDEKCTPKTAGKSANGNSGCLRNLRSSNRKAKVELQKVNCSSMISDKITPDGREGRLSSRNAPSENKGEKTTSFSSLSRTGKTAESCSRSPTKEKRLNGMAKVEPQKMQSSEKLLSTTLNEGEDKLSFQNISSKSKANYS

SEQ ID NO: 152863 - protein, 144 aa, Triticum aestivum
  unsure (1)..(144): unsure at all Xaa locations
  Clone ID: PAT_TA_47281.pep
FEYIEXRLKENNHMVIVVAEGAGQDLIAKSIPVADQLDASGNKLLLDVGLWLTHKIKDHCKSKKMEMTIKYIDPTYMIRAIPSNASDNVYCTLLAHSAIHGAMAGYSFTVGMVNGRHAYIPXHRVTSTRAAIVYFSPFDSTDAD

SEQ ID NO: 152864 - protein, 28 aa, Triticum aestivum
  Clone ID: PAT_TA_47282.pep
FYSQKCLINPPKETRFIKRTPHLNYPTP

SEQ ID NO: 152865 - protein, 144 aa, Triticum aestivum
  unsure (1)..(144): unsure at all Xaa locations
  Clone ID: PAT_TA_47283.pep
RTRGRTRGQALNVFRMRLLGAEVRGVHSGTATLKDATSEAIRDWVTNVETTHYILGSVAGPHPYPMMVRDFHAVIGKETRKQALEKWGGKPDVLVACVGGGSNAMGLLHEIXNDTEVRMIGVEAAGFGLXDSGKHAATLTKGRC

SEQ ID NO: 152866 - protein, 55 aa, Triticum aestivum
  Clone ID: PAT_TA_47284.pep
SSVMGHHHKSLCFTAYHSSPMTTMSCDAPIMVNHPFCKAHNKLVTISALSMTDQP

SEQ ID NO: 152867 - protein, 54 aa, Triticum aestivum
  Clone ID: PAT_TA_47285.pep
SCCECFSFLLLPIIFCFENFHPSCFLVMYWAFLLEDQTNRVITLKEVIWNYLEA

SEQ ID NO: 152868 - protein, 114 aa, Triticum aestivum
  Clone ID: PAT_TA_47286.pep
PLEPAPPARSRTREPVRSPLVRPGLSAPTAAHLDPSAPAQPARPDPSDPAEPALRDSSAPARRAIVARAEGAGAGVLGLAAARLKRGSRGLTGSNAVPAGRRRVRPYQHGVGEV

SEQ ID NO: 152869 - protein, 112 aa, Triticum aestivum
  Clone ID: PAT_TA_47287.pep
MAPAATPCSPRLLLASSASPPPLFRVAVRPLLPGSRRGGVRLRVRCGAADEEAEVRRGEQVKASVEEMAPGLDLVTLAACLVGLLTGVSVVLFNLSYMVFACADSRVSHRSP

SEQ ID NO: 152870 - protein, 115 aa, Triticum aestivum
  Clone ID: PAT_TA_47288.pep
MRIPLMAGLTKILLPLLLLLSVAAASSPSSDAEAVSRFQEYLRIDTAQPTPDYAAAVAFLRDQAAAVGLEARTLEFAAGKPLLLLRWPGRRPSLPSILLNSHTDVVPSEPKKWEH

SEQ ID NO: 152871 - protein, 111 aa, Triticum aestivum
  unsure (1)..(111): unsure at all Xaa locations
  Clone ID: PAT_TA_47289.pep
MGEINIGINGFGRIGRLVISVALQSDDGELVSVNDPFITTEYMTYMFKYDTVHRHWKHSDIKLKDDKTLFFGXKPVTVFCVRNPEEIPWCEAVDDYLVESTGVCTDKDKGG

SEQ ID NO: 152872 - protein, 58 aa, Triticum aestivum
  Clone ID: PAT_TA_47290.pep
TPKNRLIAGKNVFHNGPKGECFCFHQGSCPRKLNGISVRISTLEKNGINRGFVPPEVK

SEQ ID NO: 152873 - protein, 95 aa, Triticum aestivum
  Clone ID: PAT_TA_47291.pep
RGRLTRRLPRNIQRVIQRVGPPMAPTIPTVNQRAIQRVVPPIRPPMKMSKTSSQTRLAMMLLLLILLLGVASGGTPKGNLKATLQLAPRMLPLIL

SEQ ID NO: 152874 - protein, 54 aa, Triticum aestivum
  Clone ID: PAT_TA_47292.pep
MAAMNSDLGGLGPRPANAPPNPFESAMYGAGPGLIRTGLGAYGEKFLGSSSEFM

SEQ ID NO: 152875 - protein, 50 aa, Triticum aestivum
  Clone ID: PAT_TA_47293.pep
SDPPTAPIFDPEEITKCSTYRSVILNFLDTLVFLYMTGGTLMIYNHQTNP

SEQ ID NO: 152876 - protein, 88 aa, Triticum aestivum
  Clone ID: PAT_TA_47294.pep
MAAAAKLTRSFSRQLSSGAARVWRQLSLEPHTPRRGAPVAAAAGPTRFGLARQSSLDPTPAPDDGAVLAMPENLDATMRLLYAACQGG

SEQ ID NO: 152877 - protein, 69 aa, Triticum aestivum
  Clone ID: PAT_TA_47295.pep
MADGEDIHPLVCDNGTGMAKAGFAGDDAPRAVFPSIFAAAGHTGLMVGMCHKDAYVGDEAHAKRGFLTF

SEQ ID NO: 152878 - protein, 89 aa, Triticum aestivum
  unsure (1)..(89): unsure at all Xaa locations
  Clone ID: PAT_TA_47296.pep
GLSPWPSAVAPSPAPPRPPPQQPYPGDPCSSPPLARAQVSSPRPSSSSAPXRAPSRPRRPPSPAMTRPSPGPRRTTGGSSTVVYRVGDI

SEQ ID NO: 152879 - protein, 129 aa, Triticum aestivum
  unsure (1)..(129): unsure at all Xaa locations
  Clone ID: PAT_TA_47297.pep
MASAARALGALLHRASSFSSSASALRSASLVHRNGPTGGASLFQGHVARRRIWTFQPLCMGRRSCKIAGRKGAQNLKKMKRNSKIGKELVAAIKKGGPSPSSNTALAALLKKVRELDVPXEVVERNIKR

SEQ ID NO: 152880 - protein, 65 aa, Triticum aestivum
  Clone ID: PAT_TA_47298.pep
GFQMNCCSDSQLTNKWKVGARSIPSGDPSTLWALSLLPTPQDPFYVDNCMYRSSTFSTTWNETHV

SEQ ID NO: 152881 - protein, 90 aa, Triticum aestivum
  Clone ID: PAT_TA_47299.pep
MQSSSSPSKQAPNQSSAPEGSRVHGPGRETGLASAAPCGSTGPVLEAGSGAPEEPRCFKPGSQSTSESSPRRSTSTETRTESARSRTTSS

SEQ ID NO: 152882 - protein, 137 aa, Triticum aestivum
  Clone ID: PAT_TA_47300.pep
VTAEPMHPQLTPDLDPDLLGPLQSAATTFSPPTQISSALAPAAAPKSSICSAVDFFSVANWRSRSRPRRLQFTWNHIWHRQAYYFPRLDLASTSDFLRFLHCMDLDSLRAPPDWKGIFPSFPLSRYWFNTKGGFILS

SEQ ID NO: 152883 - protein, 151 aa, Triticum aestivum
  Clone ID: PAT_TA_47301.pep
FSLQPLPPAAACGAEGAGAHPHHHDGASVCPTCRGAFLFRAHRIDPMWGAFLEIPGGVAGDDGEDAPRGDLSRIKRWIAERPPDDWPPMPPQAPPMQMPPQVPPTRRKQGRRRGREEGGGCCGGGRNCNGGDSSGGEGTSAAPKREWWGGA

SEQ ID NO: 152884 - protein, 87 aa, Triticum aestivum
  Clone ID: PAT_TA_47302.pep
PRVRPRVRLCFLCVLWCELKRAERRRRILGMTEASTTTSKARAVPEPPQGRWVEDIRCQRAAHVGVRDIGAVGVNGHRPETGRWGML

SEQ ID NO: 152885 - protein, 109 aa, Triticum aestivum
  Clone ID: PAT_TA_47303.pep
PTRPNPQKKTLTAFVPTHSRLPCPKRRSRIQPRSDRRGDRAVPPTRFGRVRARKFVRHAPRGFVFVFPFWFPVARSVTAFNLIASSIHLCYCVGMCVLLIACARSRCWS

SEQ ID NO: 152886 - protein, 85 aa, Triticum aestivum
  Clone ID: PAT_TA_47304.pep
PTRPNTQKKTLTAIALTQSGRGSTKRGSIIQHLIQSPIRPLPYRPLDSIVCSLGSATLTRLMVLCSFCLFWFAKDRWLTDFNLIA

SEQ ID NO: 152887 - protein, 80 aa, Triticum aestivum
  Clone ID: PAT_TA_47305.pep
PRVRSLLGYCLFPMDVGALICLLKDKDMLKIVVVAVTLAWSSWAAYPFMSTAVNPRRKALALYPVFLMYVSISFLIIAIN

SEQ ID NO: 152888 - protein, 119 aa, Triticum aestivum
  Clone ID: PAT_TA_47306.pep
MNGLLVSPCTRPPLLRPLPSPATRLLPARTLVLRPLRLPRGVCASPSSPRAAAAASAVGGLLAPLEVGLRSINLSPLRPPVAAAMSAAVRWLGVYREVLLVGVLFSWFPNIPWDRQPFS

SEQ ID NO: 152889 - protein, 136 aa, Triticum aestivum
  Clone ID: PAT_TA_47307.pep
AAANWCYATVAPRARSSTIVASLGTPAPSNSFFFRPKLIRNTPVQAAPVAPALMDAAVERLKTGFEKFKTEVYDKKPDFFEPLKAGQAPKYMVFACADSRVCPSVTLGLEPGEAFTIRNIGNMVPSYCKNKYAGVG

SEQ ID NO: 152890 - protein, 137 aa, Triticum aestivum
  Clone ID: PAT_TA_47308.pep
SIQIPNPVSAPTFSPPLPSPNPPWRGEPPKHAPPPKAAADYGSGGGGEKGAPRQKCGEQPWKYRCPGCSRLTCSLGALTTRCAPAPSPSRSPSSTTTNFSPITSWRERQALSWSLSTGCSAASAATSAAASTNAMAR

SEQ ID NO: 152891 - protein, 38 aa, Triticum aestivum
  Clone ID: PAT_TA_47309.pep
MARTAATKLGLVALGAAMILEASDPAINWGQVSLALTP

SEQ ID NO: 152892 - protein, 102 aa, Triticum aestivum
  unsure (1)..(102): unsure at all Xaa locations
  Clone ID: PAT_TA_47310.pep
SSLRRRLVKSVHRYSPAGIHNFLPTAAXTTTTRRVTGLAAPREAALASARLAPRNGFLSTPAEAVAEVEASAMGAGVASPVPVRSLTRAAEWQLGRLLRTRG

SEQ ID NO: 152893 - protein, 88 aa, Triticum aestivum
  Clone ID: PAT_TA_47311.pep
NKASPSSRRGGDRPPRTLDALSSRPPRRRPDGPPAPPPGATRPPSRPTRRNRNLRRINPILSAIRRARRRRRARRRPPLLLESPERRG

SEQ ID NO: 152894 - protein, 85 aa, Triticum aestivum
  Clone ID: PAT_TA_47312.pep
AACNSFLCSKIPKASAILFSVQKFPKHQYFVSGYTMFLQISIMLVCTKCVHLLLLICCSAEKLPYCGLTWRWLLHVDTIIGPTCY

SEQ ID NO: 152895 - protein, 98 aa, Triticum aestivum
  Clone ID: PAT_TA_47313.pep
MALSGRDPSGFVDCTILLQSEIVVDNSPSKSVNTKEQIISITAEKTSATDARGSTSLKSPEGAHEKANFLGKGGEQPYVYQPNVNVPQPQTVYSGGYI

SEQ ID NO: 152896 - protein, 121 aa, Triticum aestivum
  unsure (1)..(121): unsure at all Xaa locations
  Clone ID: PAT_TA_47314.pep
MCVRLPAVFAKTRGVCDSRQHMRRAAWRLIVCQGSCYNGQSCGGWSCEEDLHVSASLVRQKMKYLRLLLKRXMNTKPCHXPYHLLAPHKILLRTILGMITHKTVRXKAVLFRLKAYNSLMS

SEQ ID NO: 152897 - protein, 70 aa, Triticum aestivum
  Clone ID: PAT_TA_47315.pep
ERERSPAKVVVASQPGVVLCCDRSRPGEQPRPPPHRRRVPVVDVQAQRLRPRRDEGQKQQSPRRRAHTGS

SEQ ID NO: 152898 - protein, 135 aa, Triticum aestivum
  Clone ID: PAT_TA_47316.pep
MAQIIDGKAIAGEIRREIAAEVAALSSAHSIVPGLAVVIVGSRKDSQTYVHMKRKACAEVGIRSFDVDLPEDISEAALVAEVHRLNADPAVHGILVQLPLPKHINEENILNQISIEKDGDGFHPLYIGKLAMKGR

SEQ ID NO: 152899 - protein, 92 aa, Triticum aestivum
  unsure (1)..(92): unsure at all Xaa locations
  Clone ID: PAT_TA_47317.pep
DAWVAQNDAVNGNGATTRPAXTSXPIRLSKFFQANMRILVTGGAGFIGSHLVDKLMENEKNEVICADNFFTGSKDNLKKWIGHPKFELIRHD

SEQ ID NO: 152900 - protein, 45 aa, Triticum aestivum
  unsure (1)..(45): unsure at all Xaa locations
  Clone ID: PAT_TA_47318.pep
THRSRPPFFIVSHTGXSLPLPXRCGVCRRMEIPRRGRPRAVNELA

SEQ ID NO: 152901 - protein, 52 aa, Triticum aestivum
  Clone ID: PAT_TA_47319.pep
VRAYGEKDWSPMLATCFADYHLHPHNTCFSLIIICPIIGHQAAPYTLVVPAD

SEQ ID NO: 152902 - protein, 65 aa, Triticum aestivum
  unsure (1)..(65): unsure at all Xaa locations
  Clone ID: PAT_TA_47320.pep
AARADSWSPTETAGGQPTSGIYLSNKTLLKSNAVXKYMLDTTFFPRELECMLYLCLITDKHPWGY

SEQ ID NO: 152903 - protein, 45 aa, Triticum aestivum
  Clone ID: PAT_TA_47321.pep
DKPKRAGERKELAGADGRRRHRRSVRSSGLWRGLMGIGYVVAQAS

SEQ ID NO: 152904 - protein, 130 aa, Triticum aestivum
  unsure (1)..(130): unsure at all Xaa locations
  Clone ID: PAT_TA_47322.pep
MGALEEAHLAACGCDEEEEGEEDLLAELGGGEAAGDAIEPAVRALLAGLGEDDRREGLCRTPKRVAKAFRDGTRGYRQKVKDIVQGALFPEVGVDKRTGSAGGTGWQVVARDIDPYSYXGTCLLSFSIQC

SEQ ID NO: 152905 - protein, 76 aa, Triticum aestivum
  Clone ID: PAT_TA_47323.pep
LDLILPPHRAATPARPCTAPPPSRPTFHRAAPPSLPPRRAAPPRPGSHRAAPPRPAFHRAAPPRSVLLRVARPPTA

SEQ ID NO: 152906 - protein, 44 aa, Triticum aestivum
  Clone ID: PAT_TA_47324.pep
WVPVRGSNVIDPEIFGGFQNEINLYWLHWLRAEGKKGNKILLGE

SEQ ID NO: 152907 - protein, 71 aa, Triticum aestivum
  Clone ID: PAT_TA_47325.pep
SSHVQQLKKHHAAIIVLPLGYQQEIRLGAQIRIVLIWQQEPTRLEWNHLFRERHLFAFFVSSLQASDEGIR

SEQ ID NO: 152908 - protein, 135 aa, Triticum aestivum
  Clone ID: PAT_TA_47326.pep
AERRGETKEKSGLALLLRPGDSAPAPPGASLLALLRSVVRPSKAPRKLGAIPGLRRSISSPTPGQDRSSQVLYQGQFQVLKVTTSPLARWASRSKMCNNRNAVESLIPPPSHQLRNTVSKNRATPVYQPAALTRT

SEQ ID NO: 152909 - protein, 31 aa, Triticum aestivum
  Clone ID: PAT_TA_47327.pep
VKSTSYLDPSATTARTGPEKAGPPNRPRTRG

SEQ ID NO: 152910 - protein, 86 aa, Triticum aestivum
  Clone ID: PAT_TA_47328.pep
MATKVRPPSTDAEKLEVGEIDTRAPFESVKAAVSLFGEVRVSSDKSAARKPKAPQAEQKVLAKETELHLAQKELNKYREQLSNAET

SEQ ID NO: 152911 - protein, 72 aa, Triticum aestivum
  Clone ID: PAT_TA_47329.pep
WRMACLVCHTYCHNNNGRSFVIYVCDANEIFPTLMDAHKQIEHKIETKTEVSLKEGACQQPKTLCTRSLSCV

SEQ ID NO: 152912 - protein, 118 aa, Triticum aestivum
  Clone ID: PAT_TA_47330.pep
DARRSAVAAAASAVGEIERGNRGVGFGLDTKAVSSLLRDGSTGSDMVDQKLSLIQVASLIESSAKRGTTELNLRGKLVDQIEWLPVSLGKLQDVTELDISENRIMALPSTGGSLRYLT

SEQ ID NO: 152913 - protein, 89 aa, Triticum aestivum
  Clone ID: PAT_TA_47331.pep
MGMTKIGINGFGRIGRLVASVGLHSDDVELVAVNDPFITTEYMTYMFKYDTVHGHWKHSDIKLKDDKTLLFGEKPVTVFGVRNPEEIPW

SEQ ID NO: 152914 - protein, 72 aa, Triticum aestivum
  Clone ID: PAT_TA_47332.pep
CRAMVQWSMHHPFKDCRFVASYACPKRVQGHDRSIHDCLVISIEQARPVINGYIISNEALFLDAEAGLIWRA

SEQ ID NO: 152915 - protein, 127 aa, Triticum aestivum
  Clone ID: PAT_TA_47333.pep
RDEHVYKSFLDILNMYRKDNKSIQDVYHEVAVLFSDHKDLLEEFQHFLPDTSVSPQAGAAPRGGLVKREALMPPASRGHIEKPRAFPSHTDRDASVDRPDVDHDRQRQREKNKERKAERDRRDYDRD

SEQ ID NO: 152916 - protein, 59 aa, Triticum aestivum
  Clone ID: PAT_TA_47334.pep
IVDDCAGLEGPQVPDDILPHRFAGWQHSFIEPPPELSALVVGAEINLAGEQNHGTGHGG

SEQ ID NO: 152917 - protein, 87 aa, Triticum aestivum
  Clone ID: PAT_TA_47335.pep
CGTGGEDRWRRGGQAPVFGEVATVKEGRRVWCIEPLCLFSVASPCYPCPTPRCSSCARCSPHSPFIVPPAAFRESAPNNFCRTPRGA

SEQ ID NO: 152918 - protein, 50 aa, Triticum aestivum
  Clone ID: PAT_TA_47336.pep
HGTKEDQVDTIADQMKKHDIKMDCIVFRESGVQHNSCMDENGRLFISLQR

SEQ ID NO: 152919 - protein, 42 aa, Triticum aestivum
  Clone ID: PAT_TA_47337.pep
STIHNLDSTQRSMGLVSPVPCRPSASSPIIHDRWFYSSDKTS

SEQ ID NO: 152920 - protein, 73 aa, Triticum aestivum
  unsure (1)..(73): unsure at all Xaa locations
  Clone ID: PAT_TA_47338.pep
DHASADACFDPRFRARFLRTYVPLLVSISFNTHHDTLNIVEKYANSNIQIHTFNHSQDPCXWPSMGRTVKDGW

SEQ ID NO: 152921 - protein, 134 aa, Triticum aestivum
  Clone ID: PAT_TA_47339.pep
PKIQVGVFSATMPPEALEITREFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDV

SEQ ID NO: 152922 - protein, 96 aa, Triticum aestivum
  Clone ID: PAT_TA_47340.pep
GSPASGRARGEIRGSGGEDRSMAKGTTEMEVGSDGVAVIYVANPPVNALSIDVWYSLKRHYEEALQREDVKAIVLTGSGRSFSAGLDVSVFADIHK

SEQ ID NO: 152923 - protein, 124 aa, Triticum aestivum
  Clone ID: PAT_TA_47341.pep
MDLSSLASPQALRGGSTGALGAHAARRRSVQLLRPRRPTFRCSVEAANARQQVQGTLAAEAARKECFGVFCTTYDLEALASGEVFGQDQPIALKLLGSERSLQALEGVAMELEDSLYPLLREVS

SEQ ID NO: 152924 - protein, 46 aa, Triticum aestivum
  Clone ID: PAT_TA_47342.pep
PVKTQDQRLDWSDRLHLKVEPEDERNLALWPIHPKSFKDDLHEYPL

SEQ ID NO: 152925 - protein, 54 aa, Triticum aestivum
  unsure (1)..(54): unsure at all Xaa locations
  Clone ID: PAT_TA_47343.pep
KTKVGGGFKDIVKDYKLTYXQPILRNYYSVLFCVITAESSSTFYPWDPKSTFIH

SEQ ID NO: 152926 - protein, 66 aa, Triticum aestivum
  Clone ID: PAT_TA_47344.pep
YVYGWMSTASVNAIVDSIETGISEQQLFHFDHITLFLLKNHNVLFKFVGVFPDLFATWHESPFMHV

SEQ ID NO: 152927 - protein, 30 aa, Triticum aestivum
  Clone ID: PAT_TA_47345.pep
TAELLGLNFKAWICLHTQAKLFMAPASKVM

SEQ ID NO: 152928 - protein, 50 aa, Triticum aestivum
  unsure (1)..(50): unsure at all Xaa locations
  Clone ID: PAT_TA_47346.pep
VPXPAHAYAHAFVQFGPSFSDLHLSNLQSSLLYAGAAPPPFAVHVTPLAP

SEQ ID NO: 152929 - protein, 42 aa, Triticum aestivum
  Clone ID: PAT_TA_47347.pep
CPRPCRRNWGSNPRGHKRAQRRRTGRGRGLVFVERSKENMDW

SEQ ID NO: 152930 - protein, 65 aa, Triticum aestivum
  Clone ID: PAT_TA_47348.pep
TLGHLRSISGVLPLWSTQKTAPPPRHRSSLRAIVRVLEVPSFRLKRMGQLLQLPVLIAKMLPKTI

SEQ ID NO: 152931 - protein, 134 aa, Triticum aestivum
  Clone ID: PAT_TA_47349.pep
HASGGGSDDEDDEGYGSDQEGPAVEGDADELAISRLGLPAQLVATLEKRGITHLFPIQRAVLIPALEGRDLIARAKTGTGKTLAFGIPMIKQIIEQDEGRTPGRGRIPRALVLAPTRELAKQVEKGIMESAPKL

SEQ ID NO: 152932 - protein, 107 aa, Triticum aestivum
  Clone ID: PAT_TA_47350.pep
MGKVVVAEATARQVASFVLGAAAALTVVMLVQYRAPAAGLSRARTPAHFSGLRSSSDDQHHRRNGTAARAVLHHTSPSIAGSAARDDDHRRRPANATTITKRSSTST

SEQ ID NO: 152933 - protein, 45 aa, Triticum aestivum
  Clone ID: PAT_TA_47351.pep
SWSALSHRRSLSTRRCRAPSCSPTCTSHDPIRTRGPSWTVAVLTC

SEQ ID NO: 152934 - protein, 115 aa, Triticum aestivum
  Clone ID: PAT_TA_47352.pep
QGLKSTACLPVSRRSNGASLGSVSNGGRIRCMHVWPIEGIKKYETLSYLPPVSTEALLKAVDYLIRSKWEHSLEISRVGFILREHNASSGYYDGRYWTMWKLTMLGCTDATQVIN

SEQ ID NO: 152935 - protein, 66 aa, Triticum aestivum
  Clone ID: PAT_TA_47353.pep
AICLLNSGHSTDRKTTQILSRLIGAQPVARSSYLLQIYFHQYASSIIPTHTYRRTNLKQDCAMVRT

SEQ ID NO: 152936 - protein, 85 aa, Triticum aestivum
  unsure (1)..(85): unsure at all Xaa locations
  Clone ID: PAT_TA_47354.pep
MASTTYCGSADYASPHPYHMARNPSCAGYIGNWDERVSERFADETLIQQXLLTILXIPRDRATRRPRXICXAEYETEEIAQYTVR

SEQ ID NO: 152937 - protein, 149 aa, Triticum aestivum
  Clone ID: PAT_TA_47355.pep
SFLVAFRACIFPEFGVGDFIFFLALSGYHLSWLTWTSWTSSSSSLAADSAPHYDSCPDLRPRSAQSLRPCSASPPCSGALPARETTISAQLSRIHQPPGKAGTAGRGVGDLRRGIASKDRVESVEQRRVAEPGGQGAGARGTPWRLSGR

SEQ ID NO: 152938 - protein, 37 aa, Triticum aestivum
  Clone ID: PAT_TA_47356.pep
LLCRGKAELGDDLQVHALCLRRPSPCSACTAVLHAPA

SEQ ID NO: 152939 - protein, 72 aa, Triticum aestivum
  Clone ID: PAT_TA_47357.pep
IGVLPQNLCHSIFLYFLGVSCVSWRPSVHPQIASLMRRRRRRRSRRRPGESPASVARATALVRGGDGSNRGG

SEQ ID NO: 152940 - protein, 118 aa, Triticum aestivum
  Clone ID: PAT_TA_47358.pep
PRVREDAIHSAALRCTAGRPRRRRGMDLSSSQIRFLLPAIGGDKYTQAAHTVLDLLDGAAESSTREVGKRRLFSEQSTGLDDLQALAGQKAALVMRANTPLEMHASNTYTRLCSRNLV

SEQ ID NO: 152941 - protein, 100 aa, Triticum aestivum
  Clone ID: PAT_TA_47359.pep
CICHHSSSKNEHFRCRPSSRHLTTSSYKFFSSPRFPSRSKTGMLFARGHIPLNNSPMGASCVPSCGSSFMERRVVASPTRRPLLCLCPPDVSVRVGGRVG

SEQ ID NO: 152942 - protein, 107 aa, Triticum aestivum
  Clone ID: PAT_TA_47360.pep
YPHGQLVLTVFDRQLVLYRDEYRCPHRYDLRAPMTLHRCYVRERMRACCNVGCGGVLQTYDGGGQVVRGRVCGDVWSSGDSYWIAETWSWFCRWCVGFALIWLKLCD

SEQ ID NO: 152943 - protein, 101 aa, Triticum aestivum
  Clone ID: PAT_TA_47361.pep
MRQMTTISVGIVVLATLVLASEGRIARKDLGLNLGGVGLGTDTGVNIGGNIGIGGAGSASGSGSASGSGSGSASGSGSGSGSGSGAASSAGSGAVFGGGSY

SEQ ID NO: 152944 - protein, 75 aa, Triticum aestivum
  Clone ID: PAT_TA_47362.pep
SSVTPYRAQETKSTSSTKVPANQHKSIKTAQEMKSTSSTKVPANQHKSVKTAQETKSTSSTKVPANQHKSIKTPS

SEQ ID NO: 152945 - protein, 123 aa, Triticum aestivum
  Clone ID: PAT_TA_47363.pep
RSFPFLAAAAASYPLEADPTMADVDVDTEVAAGAQPKKRTFRKFSYRGVDLDALLDMSTDDLVQMFPARARRRFKRGLKRKPMALVKKLRKAVSCPVLFLCFRFMNILTDITQVTTSLLPYTV

SEQ ID NO: 152946 - protein, 127 aa, Triticum aestivum
  Clone ID: PAT_TA_47364.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAI

SEQ ID NO: 152947 - protein, 77 aa, Triticum aestivum
  Clone ID: PAT_TA_47365.pep
HGIDISKNIVGATGRATAMGTLYVKLNEQDGAGIDAGFNAHYDVHQKANGGATEGAVALGAALRSASTLDPALEHDI

SEQ ID NO: 152948 - protein, 150 aa, Triticum aestivum
  unsure (1)..(150): unsure at all Xaa locations
  Clone ID: PAT_TA_47366.pep
PRPLGFRSTTPAPWPGTVSEAGAAAGDDGLEVARLGISPRIVERLAARGINRLFPIQRAVLEPAMQGKDMIGRARTGTGKTLAFGIPIMDRILRHNEKNGSGRNPLAIILAPTRELARQVEKEFRESAPLDTXCVYGGVPISQQMRTLNY

SEQ ID NO: 152949 - protein, 48 aa, Triticum aestivum
  Clone ID: PAT_TA_47367.pep
SQNKSRYQPKMTRIPCCLQTIQTADMLSDKHISLPLYTGYDRSVVNLT

SEQ ID NO: 152950 - protein, 108 aa, Triticum aestivum
  Clone ID: PAT_TA_47368.pep
SPRRHPPPPHLPSPPQILSPLPTPRSNFPPPPPAPNPGDLRRDSTVPSRPTPVTGHGGGGPLRRRRANETYTCPVLLLSSVSLSLPHASSLSLRYIYNSPAMDGLFTS

SEQ ID NO: 152951 - protein, 88 aa, Triticum aestivum
  unsure (1)..(88): unsure at all Xaa locations
  Clone ID: PAT_TA_47369.pep
PTRTGSTTASTTGTDDAYVYPLSRNLSKIDSVEVVGAKQRTGDVSFGERMVGVKEYTVYLLKVRSGEXEREIERRYREYYAXYQQLKL

SEQ ID NO: 152952 - protein, 151 aa, Triticum aestivum
  Clone ID: PAT_TA_47370.pep
PRVRPRVRIFSVKDFLTSYYKDEHTLRKVLNKATKLVWTTIVDHAKKCVPGKELYSFIVEGHDVVLFFNCFYRIVGITSSDQYTPFKDLDKPMQGRVEQWSKVAYETLTNLQPDYVMDNGKPRPINQSIFQGLQQNCAERNVHEADDHQST

SEQ ID NO: 152953 - protein, 155 aa, Triticum aestivum
  Clone ID: PAT_TA_47371.pep
LNGEVAGDYGYDPFGLGKKPENFAKYQAFELIHARWAMLGAAGFIIPEALNKYGANCGPEAVWFKTGALLLDGNTLNYFGKNIPINLVLAVVAEVVLLGGAEYYRITNGLDFEDKLHPGGPFDPLGLAKDPEQGALLKVKEIKNGRLAMFAMLGF

SEQ ID NO: 152954 - protein, 57 aa, Triticum aestivum
  Clone ID: PAT_TA_47372.pep
MDMASATLLKSSFLPKKAEWGVARQVVAPRVSMVVRAGAYDDELVKTANTIASPGRG

SEQ ID NO: 152955 - protein, 109 aa, Triticum aestivum
  Clone ID: PAT_TA_47373.pep
WTTHKDAHGILWKRFVCAREGWRKEAPEEERIKPKRKFKLTRCGCEAMIGLRRQDDGKYKVARFVQSHIHQLISPSKRHLIKSNREVSSELRSKLLTCHKAMVGTSAAY

SEQ ID NO: 152956 - protein, 53 aa, Triticum aestivum
  Clone ID: PAT_TA_47374.pep
AVYQMSLGSPQSASHGSIIAWRALYAMPANAIIRVCEWHHANLQIGASHLVAS

SEQ ID NO: 152957 - protein, 135 aa, Triticum aestivum
  Clone ID: PAT_TA_47375.pep
RTRGFPFTITESCTVSCANLKSAFLLDIIILAITTYVSVVTVQDNPTFGSDEAAPPSSHEEEAFLFELFGSFKYFTMPVWMVLIVTSLTWIGWFPFILFDTDWMGREIYRGSPEIVADTQKYHDGVRMGSFGLML

SEQ ID NO: 152958 - protein, 87 aa, Triticum aestivum
  Clone ID: PAT_TA_47376.pep
GHRGRALGTGTSSGRTWRRRPSRRQSGGRQGRIQWREALIRRSDDAGRAGSTQERLGGAGSRRRRRGGRLKKVGWRDRELEVAYAWA

SEQ ID NO: 152959 - protein, 40 aa, Triticum aestivum
  Clone ID: PAT_TA_47377.pep
AAETSSIMGGAGADQADVLQCRRHCHSLRAVQLSRFLSLI

SEQ ID NO: 152960 - protein, 126 aa, Triticum aestivum
  Clone ID: PAT_TA_47378.pep
APLRIRRRRIRVSVSSSSESKEEGAGSTNGSLPGLPPVGEEEEDDESCPVECVTEFKTDEEFSRFLERSKATGALVVVDFFRPSCGSCKYIEQGFMKLCKGSGDHGSPVIFLKHNVIDEYDEQSEV

SEQ ID NO: 152961 - protein, 128 aa, Triticum aestivum
  Clone ID: PAT_TA_47379.pep
GQHGFRGGHGVAEDDGGGGWEQSSRTSRRRSRHGRVEELVVHHHHPQSRSEIEKKRKIYWRLFFCWDSPELTGESWDGGDSEEDEGQERCRPGERKPVLSRTILLLCACGFILGVLLTDRFRAMPDLK

SEQ ID NO: 152962 - protein, 111 aa, Triticum aestivum
  Clone ID: PAT_TA_47380.pep
TTILSRRWKQIPAMLSKIIITVGSFEPKRGRGTKLTSHDIARANTTVREATRSILECRTGSLHTIHLMSMQFYLGDDSIFIGQTVGHTIATQKVASVEFVILTEGRTNWYV

SEQ ID NO: 152963 - protein, 63 aa, Triticum aestivum
  unsure (1)..(63): unsure at all Xaa locations
  Clone ID: PAT_TA_47381.pep
CACSTPXRSVRRALCAPRQWTQVAASPRRVGSRGRPWGSARTSAPPSARRPMVSVVTQLRQSS

SEQ ID NO: 152964 - protein, 131 aa, Triticum aestivum
  Clone ID: PAT_TA_47382.pep
MAPTVMASLATFVAPFQGLKYTAGLPVSRRSSSAGLGSVSNGGRITCMQVWPIEGIKKFETLSYLPPLCTEALLKQVDYLIRSKWVPCLEFSKVGFVFREHNSSPGYYDGRYWTMWKLSMFGCTDATQVLN

SEQ ID NO: 152965 - protein, 103 aa, Triticum aestivum
  unsure (1)..(103): unsure at all Xaa locations
  Clone ID: PAT_TA_47383.pep
RSTQRRSQPSEIPLLHCDDGPEICGGGYWKCKGTVELVESILYTINAGQIACTDVGNIGISPPYIVLPTKKEKLRTXIQVAGENCXVKKGSCFTGRRQSSLCV

SEQ ID NO: 152966 - protein, 121 aa, Triticum aestivum
  Clone ID: PAT_TA_47384.pep
HAYDLDNFFGGPAFLSWSRMDNMHGWGGPLPQTWLDDQLTLQKRILSRMYAFGMSPALPAFSDNIPAALKLKFRSAKVTHLGNWFTVDSNPRRCCTYLLDASDPLYVKNPTFVIEQQITEY

SEQ ID NO: 152967 - protein, 104 aa, Triticum aestivum
  Clone ID: PAT_TA_47385.pep
LDSVFFSNSKYVFFSNTNQWISRAGFELPTIRRKGPRTRSFITSNQIPSKLQSSSKHPCRRRVRRRKKRRVRRRNKRWTCVAACSESGEGRCGGGDGRRCIQAL

SEQ ID NO: 152968 - protein, 124 aa, Triticum aestivum
  unsure (1)..(124): unsure at all Xaa locations
  Clone ID: PAT_TA_47386.pep
RIHNQANYLEKXHDRGLAYKDHTAVVLNCYTKWKDDDTVDPFIKDEDGVSETKLDVETAIPLCRAAGYHEHAMVLAKNAGRHELYSKMLRQDHATYDEALHHTSGLDGRQPVLTGNQYGKILGD

SEQ ID NO: 152969 - protein, 77 aa, Triticum aestivum
  unsure (1)..(77): unsure at all Xaa locations
  Clone ID: PAT_TA_47387.pep
MMLAADQRSRLGAANTARDHHILFGRCEGIKKFETLAYLPPSQTDALLKQVDYLIRSKGVPCLXFRKGEFILREHNA

SEQ ID NO: 152970 - protein, 124 aa, Triticum aestivum
  unsure (1)..(124): unsure at all Xaa locations
  Clone ID: PAT_TA_47388.pep
MGEPPSREGSYSSFPNSDDDEPETTGSERGGGGGGEDAHRPLPLRQQLVGACRADDRLRPLLTLNVSCSAAENRFISYLSQHFEVSEVGMLARCLCVPLVXSLRVGKVDRHGPLLWPTTIRGKA

SEQ ID NO: 152971 - protein, 132 aa, Triticum aestivum
  unsure (1)..(132): unsure at all Xaa locations
  Clone ID: PAT_TA_47389.pep
AMLTAVDGSVRLLVDRPYKAGEPIIVWCGPQPNSRLLLNYGFVDEDNPYDRIAIEASLNTEDPQYQEKRMVAQRNGKLAIQKFQVCVGKEKETISEMLPYLRLGYISDPDEMQCILSSEGDTCXVSPCSERA

SEQ ID NO: 152972 - protein, 109 aa, Triticum aestivum
  unsure (1)..(109): unsure at all Xaa locations
  Clone ID: PAT_TA_47390.pep
MLLANSARSPGQPETDIAVRCTLLISVDISPGRXAALENLHCLSKAQYIGAMACTGLHAGVDHSTPRLLVLXSIPQSTPSPIPTKKTHFADLKDEDRMVTNLYGLHDPF

SEQ ID NO: 152973 - protein, 83 aa, Triticum aestivum
  unsure (1)..(83): unsure at all Xaa locations
  Clone ID: PAT_TA_47391.pep
LSLRVIHVDKLDTGERGATMGVMRYACKNWGLFXLLNHGILVELMDXVELVSKAHYSGRREEQFKELAAKTLEAGEKGDYLKD

SEQ ID NO: 152974 - protein, 101 aa, Triticum aestivum
  Clone ID: PAT_TA_47392.pep
VFAEKSILASEAQGLQSWLFDISEERKHFVSVIDEMHQTLQRRLDLAEAERAAAEMEMIEREKMAQEMLKEHEVLLDAAKEESKKLEQQAEENAKLGELLM

SEQ ID NO: 152975 - protein, 92 aa, Triticum aestivum
  Clone ID: PAT_TA_47393.pep
MQDLQSIPGLAGRLFGGAAAADIRRVQGPASRCGVFSQAAYAQSEAAVKCPRCESTNTKFCYYNNYNLSQPRHFCKSCRRYWTKGGVLRNVP

SEQ ID NO: 152976 - protein, 99 aa, Triticum aestivum
  Clone ID: PAT_TA_47394.pep
HAFCHAFCDTAENAAENEFELQRTVVKMVLEALDLQDERIDAHFDSLGLSGWVVRYGVPTDMDTCMYLQEHCDNSVTTTIVQHRVEGLEVQAKVGSWLD

SEQ ID NO: 152977 - protein, 97 aa, Triticum aestivum
  Clone ID: PAT_TA_47395.pep
RAPDRALVLESFDHVLHTGGGHAVVPVRLHAHPGLHIGRPPVAPEPSRVRDAVELRVYVLVINRHLRQYPIHDRPVHRSNDVGRGARCLPQCSLRRM

SEQ ID NO: 152978 - protein, 127 aa, Triticum aestivum
  unsure (1)..(127): unsure at all Xaa locations
  Clone ID: PAT_TA_47396.pep
QAYKLKEVESLSYDEMIGECKTIFAAGQDSXATLLTWAMFLLSIYPEWQEKLRKEVLRECRDDDGDAPNSNSIQVLGKLKLLSMFLLETLRLYSPVPFLLKKTASDTTLANIKXPKRTMNTIPIMML

SEQ ID NO: 152979 - protein, 70 aa, Triticum aestivum
  Clone ID: PAT_TA_47397.pep
SPLSSGGMFKQHSFSAMGSAEKSVLAMPPHQSNESFLKVYDWGLILDDRDTFGPRSRRKVVDNIRSHFNI

SEQ ID NO: 152980 - protein, 136 aa, Triticum aestivum
  Clone ID: PAT_TA_47398.pep
HASGTMAEETRNPARDIPIGLVGSMAVTTALYCVLAVTLCLMQPYGAIDKDAPFSVAFADRGMDWAKYVVAFGALKGMTTVLLVSAVGQARYLTHIARTHMMPPWLAQVHPRTGTPVNATVVMLLATAAIAFFTDL

SEQ ID NO: 152981 - protein, 42 aa, Triticum aestivum
  unsure (1)..(42): unsure at all Xaa locations
  Clone ID: PAT_TA_47399.pep
MTYVVLKGYLYDPIDCIRPAVAIERGKXYRKDSSFQFRLSIY

SEQ ID NO: 152982 - protein, 155 aa, Triticum aestivum
  unsure (1)..(155): unsure at all Xaa locations
  Clone ID: PAT_TA_47400.pep
MKFNLRRSFPLLTTKRVFWRGVVEELLWFISGSTNAKVLQEKGIHIWDGNASREYLDGIGLTEREEGDLGPVYGFQWRHFGAKYTDMHADYTGQGFDQLVDVIDKIKNNPDDRRIIMSAWNXFDLKLMALPPCHMFAQFYVAEGELSCQMFQRSA

SEQ ID NO: 152983 - protein, 88 aa, Triticum aestivum
  Clone ID: PAT_TA_47401.pep
SPLLPSATRSRPRGRRFRCVAAASKGEEVFGGRKELTGVQPLVEALPPAGRAVLELAVVAAAAAGGYSLGTRYGGTRTTAVAGAGRGS

SEQ ID NO: 152984 - protein, 89 aa, Triticum aestivum
  Clone ID: PAT_TA_47402.pep
MEHGDGKTAAKRTRLSAAGGGGTDDLLSALPDDLVLHILHTLRDSPTAARTSLLSRRWRRLWALLPHVYFPGYTAPHLIAPALAAHEAP

SEQ ID NO: 152985 - protein, 36 aa, Triticum aestivum
  Clone ID: PAT_TA_47403.pep
QAIVTGKGPLKNLSDPLADPVNKNAWAFPPKFVPGK

SEQ ID NO: 152986 - protein, 130 aa, Triticum aestivum
  unsure (1)..(130): unsure at all Xaa locations
  Clone ID: PAT_TA_47404.pep
MATSTSLAAALPSRVTSPGRRAALSCTTSRARPRPHPARAVSSVGPRCRLVVTCNAQAAAPMSIGQGTPVRPTSVLVVGATGTLGRQVVRRALDEGYDVRCLVRPRPAPADXLRDWGATVVNADLSKPET

SEQ ID NO: 152987 - protein, 144 aa, Triticum aestivum
  unsure (1)..(144): unsure at all Xaa locations
  Clone ID: PAT_TA_47405.pep
MLSSSLMLTCGHAPLPPFRKPRRLTLDRTAAVTQTSASLSTFLPGRGGGAAAPRRGWAQICRDSSRPGADAAEQDRESKNDLATATVPKIGGGGGGGGGGGGQLSDWITSVLLFGIWAGLMYYXLQLAPNQTPYRDTYFLQKLL

SEQ ID NO: 152988 - protein, 155 aa, Triticum aestivum
  Clone ID: PAT_TA_47406.pep
EILGVVTSVGAGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVDGLGGLGHVAVKFGKAFGMRVTVISTSPGKREEGAE

SEQ ID NO: 152989 - protein, 138 aa, Triticum aestivum
  unsure (1)..(138): unsure at all Xaa locations
  Clone ID: PAT_TA_47407.pep
GIATSCAARLAGRHAPIPPKRILKGLTDLQTYPRTSCSSTSCVMKTCDHWQATIMGPCAQXYAHGLSTATIHFSPYYPLRTTNAACKTHVFHPNVHSTGCMTLDICKEQWTPSLSATXVLFSICSLLTDPNLDNPMVS

SEQ ID NO: 152990 - protein, 64 aa, Triticum aestivum
  Clone ID: PAT_TA_47408.pep
MKGRRRKKDRASATLLKYYFLPKKVEWGVARQDGVPRVSMVVRAGAYDDELVKTAKTISSPGRG

SEQ ID NO: 152991 - protein, 136 aa, Triticum aestivum
  Clone ID: PAT_TA_47409.pep
MATATASTSLRPPPSPSPPRLAGSLRQWCWGTPTHSSRRAFHAHRRKRNTLLCAAVKGPEESFKKTIEVDRLIDMLRDANPGELDLIVVENILAFSEGFWVRLAARIDLCKSDDDKKDYEELAENVMNIVDRVVHK

SEQ ID NO: 152992 - protein, 52 aa, Triticum aestivum
  Clone ID: PAT_TA_47410.pep
RHLSCLMGCTATLDIAHCTTVALYQGRERVRWRATRRRTGRTSGNNVPARPD

SEQ ID NO: 152993 - protein, 56 aa, Triticum aestivum
  Clone ID: PAT_TA_47411.pep
RAVRPRHRNTRAPRALCLACGRHPPVISGEPPHGGRRSPANRADAVGPDGSLEEEG

SEQ ID NO: 152994 - protein, 63 aa, Triticum aestivum
  unsure (1)..(63): unsure at all Xaa locations
  Clone ID: PAT_TA_47412.pep
NRNLPPFIPLKKPFGFCAQTFYXYQAXTRGIKGPYLDCTGGSLEEIIKKTLFGRKLRGPIGMD

SEQ ID NO: 152995 - protein, 95 aa, Triticum aestivum
  unsure (1)..(95): unsure at all Xaa locations
  Clone ID: PAT_TA_47413.pep
ANKREVKGVLNFYKKTLATDGIRGLDPRFNGAIGGITLYWGLYFGIYHTIKAFGLIRPVEGNFLGKFGLGLAINSIFGACAXSFDTLRPKMVVTL

SEQ ID NO: 152996 - protein, 102 aa, Triticum aestivum
  unsure (1)..(102): unsure at all Xaa locations
  Clone ID: PAT_TA_47414.pep
SLKVVRDGGSVVDAEYLRQVDKGRRASPALIGFKGCXAPIIPRLALDDSCTYXWNTKTWGANGLIRFQGKGPHWSNGGLKIAIDLLGPIKREHSKVTYAKLY

SEQ ID NO: 152997 - protein, 55 aa, Triticum aestivum
  Clone ID: PAT_TA_47415.pep
DIRRGNWSGFLTHPFSRARKSLWDFGRIYSILPLNSKGSGFRINLFLYKGNWTIK

SEQ ID NO: 152998 - protein, 82 aa, Triticum aestivum
  unsure (1)..(82): unsure at all Xaa locations
  Clone ID: PAT_TA_47416.pep
MKTILAXETMDILEEVTVKVSAKMISVTGSRGTLTRNFKHLNLHLQLQEGGPKLKVDALFCTRKTMAGIRTGIFQVQKLITG

SEQ ID NO: 152999 - protein, 146 aa, Triticum aestivum
  Clone ID: PAT_TA_47417.pep
AGARVRPRVRIQSFSPAASSPTLGWVRGASIHRAAAPDLPRLPGPTNHHRPSKPPRSPRREPRGGAPCRLPPRAGLGSFGAPTGGRAAQRRGLLWFGSCPAPGGLPLHNRRASVSPTNGMPREPSWWYRCSGRAETTSTRPSQERP

SEQ ID NO: 153000 - protein, 146 aa, Triticum aestivum
  unsure (1)..(146): unsure at all Xaa locations
  Clone ID: PAT_TA_47418.pep
YSHAPTVMASGGPXVAPFQGLKFTAGLHISRRSNGASLSSVSNGGRIRCMQVWPIEGIKKFETLYYLPPLSTEALLKQVDYLIRSKWVPCLEFSKAGFIFREHNASPGYYDGRDWTMWKLPMFGCTDATQVINEVGEGKKEYPDAY

SEQ ID NO: 153001 - protein, 104 aa, Triticum aestivum
  Clone ID: PAT_TA_47419.pep
MEEGVPASANSQASTGDAAADQPINGYVWDLDETLILLKSLLDGSVAGHFEGLKDHEKGTEIGKRWENIILELCDEHFFYEEIENYNQPYLSSLHEYDDGKDLT

SEQ ID NO: 153002 - protein, 125 aa, Triticum aestivum
  unsure (1)..(125): unsure at all Xaa locations
  Clone ID: PAT_TA_47420.pep
ARGGFKAGGGDYTWADYTLEYETKDTGMLAGLLVSAQSGALSEKAWAGLAAKSFTGTLTTGWTDGLTKLDRSXRRSYHIXPVSGEDRHWIWYVAYPLDLFEEXGVTNMCTSIVGNGFGFKGLRAL

SEQ ID NO: 153003 - protein, 86 aa, Triticum aestivum
  unsure (1)..(86): unsure at all Xaa locations
  Clone ID: PAT_TA_47421.pep
RDPNEDPDPDAEPAPHMPMLPPILPPVSVPKPPPPRFRHKSFREMRPSHAKPSVASPPIPPEMVVICXIVEDPLRTSPCLYVTQIC

SEQ ID NO: 153004 - protein, 69 aa, Triticum aestivum
  Clone ID: PAT_TA_47422.pep
GLALSTKSQNLSQPKTRFPTNPQNSYLSFKERPWKIHHPHGPTGNKELVNPKNSERVINPEGWATGNSD

SEQ ID NO: 153005 - protein, 54 aa, Triticum aestivum
  Clone ID: PAT_TA_47423.pep
KHRSDHKLKVHRIPTNTPQKELHQIDLQETIVLRIKREREREIEREREREPSSY

SEQ ID NO: 153006 - protein, 91 aa, Triticum aestivum
  Clone ID: PAT_TA_47424.pep
SQILTFVTFFFWRAGQTHTRGAARKIGNRCGFRLPPGGPTRFPRFVAPIFFFRISTAKGFPAANTHFKGGFCGQTRKELFSRGGGNQGGGA

SEQ ID NO: 153007 - protein, 46 aa, Triticum aestivum
  Clone ID: PAT_TA_47425.pep
GQGGTPGPRPLLPPPRAPPPYVAPRRRPSPRPPRARAPPRRRGRGR

SEQ ID NO: 153008 - protein, 111 aa, Triticum aestivum
  Clone ID: PAT_TA_47426.pep
PATANGGHRGGSSTPPTTEESLCLGSFWSVLFSAIVAKCLQYKPVKKESLVIMPAFGIQLEQHFWSGRVDRKFVPISKILQPVLNECVTPVTCYWSLALLLRDEDETMLVF

SEQ ID NO: 153009 - protein, 64 aa, Triticum aestivum
  Clone ID: PAT_TA_47427.pep
LVFPTTSFECIFFSGAALPSWPSGLGGGRRPSLAGPIRRQTPWPGVFSATPAAALRRRSCVERS

SEQ ID NO: 153010 - protein, 102 aa, Triticum aestivum
  Clone ID: PAT_TA_47428.pep
MPTLHGPLLFVNPGAYQEPKSFPKSTASPFNNLLGCNTVCSSVEGHHVQKPHIVSSFRVNFTRVSHYLQRSLNERTTRHWLHRFHVNASSDEDFRSSRNIAT

SEQ ID NO: 153011 - protein, 101 aa, Triticum aestivum
  Clone ID: PAT_TA_47429.pep
SVIFSDRNADRSGDWRGAWRIAMNIESRYRMRYSRDHVVYGCIAMWRATTTGSSITWCVTEAAFHARLSVARSLPMGDLLTHSPISSFGTLFCTLFATCVA

SEQ ID NO: 153012 - protein, 130 aa, Triticum aestivum
  unsure (1)..(130): unsure at all Xaa locations
  Clone ID: PAT_TA_47430.pep
HASDLLGEQERWVGVETMMSEMKEQGLVPNIITYTTLVDVYGRSGRYKEAIDCIEAMKADGLKPSPTMYHALVNAYAQRGLADHALNVVKAMRADGLEASTVVLNSLINAFGEDRRLXEAFSVLQFLKEN

SEQ ID NO: 153013 - protein, 74 aa, Triticum aestivum
  unsure (1)..(74): unsure at all Xaa locations
  Clone ID: PAT_TA_47431.pep
MSFRSIVRDVRESFGSLSRRXFDVRISGLPGLSGHHHRGMSFGPPVEPHGGXVVADQNGWVGLPPGLLRDVVKR

SEQ ID NO: 153014 - protein, 42 aa, Triticum aestivum
  Clone ID: PAT_TA_47432.pep
TSNSGISNRERFTLVKPGPFSIKSIGRGARRNYPAGPAPVPQ

SEQ ID NO: 153015 - protein, 138 aa, Triticum aestivum
  Clone ID: PAT_TA_47433.pep
LHGASPAVLEGSLKINGSSRLNGSGRVAVAQRSRLVVRAQQSEETSRRSVIGLVAAGLAGGSFVQAVLADAISIKVGPPPAPSGGLPGTDNSDQARDFALALKDRFYLQPLPPTEAAARAKESAKDIINVKPLIDRKA

SEQ ID NO: 153016 - protein, 54 aa, Triticum aestivum
  Clone ID: PAT_TA_47434.pep
RVVCTHTWYLLEHLQCHSLFISRCTLTCALTRYSSASELYRYASDADMSIICCY

SEQ ID NO: 153017 - protein, 54 aa, Triticum aestivum
  unsure (1)..(54): unsure at all Xaa locations
  Clone ID: PAT_TA_47435.pep
MKISPPPLLSPPPSFLAXPPPSPSPSYSPAPPPPSSSPSYSPAPPPASPFPSKP

SEQ ID NO: 153018 - protein, 118 aa, Triticum aestivum
  unsure (1)..(118): unsure at all Xaa locations
  Clone ID: PAT_TA_47436.pep
APEPMLLDEQPPTAIACEKKQQDGEAPYAEGNDPITGHIIFTTIGGKDGEPKQTINFMAERVGGXGRLGLAFKLKGLETGGMGALKKGLKTNRTRTGSWNLCRRRSIPKVASLKTGFF

SEQ ID NO: 153019 - protein, 41 aa, Triticum aestivum
  Clone ID: PAT_TA_47437.pep
ETKFGSINPPQGIIHYLLQHQAQKLSARLVNRGFSAHVQIF

SEQ ID NO: 153020 - protein, 81 aa, Triticum aestivum
  Clone ID: PAT_TA_47438.pep
PTRPREHNASPGRYNGRYWTMGKLPMFGCTDATQVINEVEEVKKEYPDAYVRIIGFDNMRQVQCVSFIAFKPPGCEEFGKA

SEQ ID NO: 153021 - protein, 125 aa, Triticum aestivum
  Clone ID: PAT_TA_47439.pep
MAAPPLPPLLCSAASSYRVTLLAPHALPYRAAARPMVSRSSSPPCIAPTLRRAGARAPLPCAAKRGGEASSIGGEGTRMLLQAALWGAEAAYILWLFLLPYAPGDPLWAISQATITDLVGLSLNF

SEQ ID NO: 153022 - protein, 107 aa, Triticum aestivum
  Clone ID: PAT_TA_47440.pep
TRVRRRVRQPLPRGARGGRTMATATALTMVLATGLRMFCVRGLYFLGLMPVYYMGSVPATAERFDATWAEEVHATVDEVDPEIADIMELEKVLHWKELELISAENVT

SEQ ID NO: 153023 - protein, 139 aa, Triticum aestivum
  Clone ID: PAT_TA_47441.pep
TLLLRDLPCSTPAAVYEGVVAACPQLRVLHLISCSFDNDTARWVVFDAPMSEIRELVADGQLMTVKLRSLPKLERLTAVDGSVLLCSDANVPCLADVSLVFSIGPLDHSIVNHLIAMFMLFLKDAAISLRNLILRFTGP

SEQ ID NO: 153024 - protein, 71 aa, Triticum aestivum
  Clone ID: PAT_TA_47442.pep
PTRPGPSRGTQRTRHSQPASAPASTRLSPTLAPKKDGQGPHQARQLHHPAEGLPGALRHSGRLMAHVKHRG

SEQ ID NO: 153025 - protein, 135 aa, Triticum aestivum
  unsure (1)..(135): unsure at all Xaa locations
  Clone ID: PAT_TA_47443.pep
LGRVSNGGRIRCMHVWPIEGIKKFETLSYLPPLSTELLRQPYRLXLMRFKWVLCLKFNKVGFVFREHNNFSGYYDGRYWTMWKLPMFGCTDATQVLNEVEEVKKEYPDAYVRVIGFDNLRQVQCVSFIAFRPPGC

SEQ ID NO: 153026 - protein, 137 aa, Triticum aestivum
  Clone ID: PAT_TA_47444.pep
SPNLDDTADSSGAIGEPFPPTPLAAMTADLRRSDGPYGRAGKATPAPDPTGALGNGEAGAECSRESEGETTGAVVISDCSRWVRGRCQGSEIEQAWVGFELVAGKLGQAAPELELGSSTLGNRAAGVGVGVGSAAAE

SEQ ID NO: 153027 - protein, 122 aa, Triticum aestivum
  Clone ID: PAT_TA_47445.pep
PLGGSSAAGCLDLEPLPLACLRPLSPPADPSLAVAVAASSSTFEPTECTHVDSLRVGTRRLSHLGETGRGLLALAGARGWRLKLSGFSSNTPASARQKKKTSVSNTHQDLCYAHAWVAPPFS

SEQ ID NO: 153028 - protein, 104 aa, Triticum aestivum
  Clone ID: PAT_TA_47446.pep
PTRPPTRPEPGWRDVPVHDPVVKDAASHAVKSIQQRSNSLLPYELVEIVRAKAEVVEDFAKFDILMKLKRGTKEEKMKAEVHKNLEGAFVLNQMQPEHDESSSQ

SEQ ID NO: 153029 - protein, 95 aa, Triticum aestivum
  Clone ID: PAT_TA_47447.pep
SRLEKLVPSVKVSTYGRWNWLKRANSLPGSGSDDPTEASKPIFQSSSKLRSGLQTEVVDKIAVIELSFPSLFRAIVSLSPAGSVDPDAVAFFFPR

SEQ ID NO: 153030 - protein, 102 aa, Triticum aestivum
  unsure (1)..(102): unsure at all Xaa locations
  Clone ID: PAT_TA_47448.pep
FSPLLLFFRHFSXLFFFFPFFFXFXTEEVSITYRDKQMYTRKFLPERRPIAHDSQKRKDPSPMTVHTQNRNRIRHYSLQIKRQVPGKKKKQVFQIRIKICAT

SEQ ID NO: 153031 - protein, 104 aa, Triticum aestivum
  Clone ID: PAT_TA_47449.pep
LVSSPSRPRTPRRRRHLRRLLPATSDAAQHAPELLTVRASLPSDQILRSRPLQPACNPTPVARVPGKASPARLRRPQGIGRFRGGAGELGAGKAYALADEEFLL

SEQ ID NO: 153032 - protein, 65 aa, Triticum aestivum
  Clone ID: PAT_TA_47450.pep
TAITIASPGRGILALDDSYATCGKRLASYGLDNTEAYRSAYRTLLVTPPGLGIYISGGILFEETL

SEQ ID NO: 153033 - protein, 74 aa, Triticum aestivum
  unsure (1)..(74): unsure at all Xaa locations
  Clone ID: PAT_TA_47451.pep
MGYIAAYMDEYADVDAFMYALQLVLPMTLKMTLKXAIVLTLLDTLVDVVDKLLTPAKVAAKLKSTANNIADYML

SEQ ID NO: 153034 - protein, 92 aa, Triticum aestivum
  Clone ID: PAT_TA_47452.pep
RARLMPALIATLLCPFIPPPSSPSPHLIWSQASLTGADNEEKEGEVVGLGPGAEAMARRGGGMEKAGEAVGIAGNKAKGWVVVGAGVGRGED

SEQ ID NO: 153035 - protein, 91 aa, Triticum aestivum
  unsure (1)..(91): unsure at all Xaa locations
  Clone ID: PAT_TA_47453.pep
MVALRFHQFQVVSRXMSTPGDEPPKIYRMKLWATYEVHAXSKYXDLPRKLKKVKMSNVQMLNINEIFVLNLTTIYNYSLCLSYQSRTGFHN

SEQ ID NO: 153036 - protein, 126 aa, Triticum aestivum
  Clone ID: PAT_TA_47454.pep
KLCRTCADRALKSTSDTPGRSDYRSTSRDQSSSRRHHRSKKKSAPPKRPPQQTTRQRCRNPRGEDAAIHRSPSHCRLRDDAPKEEKDAKTPPSPDPADLRIPSGAKAVGRSRSTSTMTLPRKPTRP

SEQ ID NO: 153037 - protein, 113 aa, Triticum aestivum
  Clone ID: PAT_TA_47455.pep
PDPLFLLSRGYAAAAADLPIRASQPPPICLSGQTRPSRITRTPAPPAPRMRRPRRLGCVARHHHDGTSLMPLGMDCRPEGGQGGGHRGPPNSRGHIPDRGPSLPTDASHALRG

SEQ ID NO: 153038 - protein, 98 aa, Triticum aestivum
  unsure (1)..(98): unsure at all Xaa locations
  Clone ID: PAT_TA_47456.pep
LPICFFYSRLSPMKTQPQIARVHHSPSSPLPVPTSATSGSTVAGRRIGGGAAVISLSWSAEAQPPRLLHPPPATPYHWTVXTRPNPGHRPLGSQSLLR

SEQ ID NO: 153039 - protein, 103 aa, Triticum aestivum
  unsure (1)..(103): unsure at all Xaa locations
  Clone ID: PAT_TA_47457.pep
MAQTMASMTGLSQGVRLPGPAGRRASRFIVRASSAEAEAAGRRAVLGLMASGVVGSAFAQVVHAGTVAAIKVGPPATIFGGLRGAVNFYQARYFXLPLENRFY

SEQ ID NO: 153040 - protein, 55 aa, Triticum aestivum
  Clone ID: PAT_TA_47458.pep
QKYDTDQRHQPASFFLRHYTKLTMSDCQHDTLLQLHLIVGTNPASRSQVPITTII

SEQ ID NO: 153041 - protein, 118 aa, Triticum aestivum
  unsure (1)..(118): unsure at all Xaa locations
  Clone ID: PAT_TA_47459.pep
ATVDTFIGSTSSNPLRVAIADTTCPEAPMPXKLTFSSLEXIGAAHAYVITDCEFNLTEYSXLSAYLPTITAETVDIKHIVTNLPLNTWSMVLYNNRVYLMISPIFXFLTGEHKKLFIA

SEQ ID NO: 153042 - protein, 111 aa, Triticum aestivum
  unsure (1)..(111): unsure at all Xaa locations
  Clone ID: PAT_TA_47460.pep
FKSYREGLMSPQTETKAGVGFKAGVKDYKLTYYTPEYETKDTDILAAFRVSPQPGVPPEEAGAAVAAESSTGTWTTVWTDGLTSLDRFKGRCFHIEPXAGEEHQRDLVWIL

SEQ ID NO: 153043 - protein, 79 aa, Triticum aestivum
  unsure (1)..(79): unsure at all Xaa locations
  Clone ID: PAT_TA_47461.pep
GRRGHTTVPKVRVVRRGSYTTCFHQMVHLFNAXINKQFNQDXSNALVQELTSDYHQTHVIRNPEFKKLATXMQGPLRQI

SEQ ID NO: 153044 - protein, 76 aa, Triticum aestivum
  Clone ID: PAT_TA_47462.pep
PSHESRWTSTRTWSKGPSAFCTRQLLGYSGRCCPSRRRPAGTVWDQLDDTARRLDHETSGHDSNRRAAGGGDGRNL

SEQ ID NO: 153045 - protein, 94 aa, Triticum aestivum
  Clone ID: PAT_TA_47463.pep
RIGHGHPDDQQQEHQAGLICQQYHCRTPSMGGQEVVAASGRCRGTTRSREVAKVTSVVLEVGDAAALARCRSRRVAAVRARPVGAAPVRQVGVP

SEQ ID NO: 153046 - protein, 48 aa, Triticum aestivum
  Clone ID: PAT_TA_47464.pep
RYIDHQRKDSRLRSSPKGGFYGGSTREGCFMISRRILLLDGRSWPPME

SEQ ID NO: 153047 - protein, 55 aa, Triticum aestivum
  unsure (1)..(55): unsure at all Xaa locations
  Clone ID: PAT_TA_47465.pep
MVNAIAGCPSKIWFRMPTEWXPHEQRWLGWTYRSHNWWEHAEPSRNTFERTAIGI

SEQ ID NO: 153048 - protein, 113 aa, Triticum aestivum
  Clone ID: PAT_TA_47466.pep
TTRERKKGERSAHPPPRWLGSARRPHRRRGRTCHRITGIRRRPGTTTAEDGSTNRRDGVRRPGAPATLPHYQRSALVLRGSPVGQSVRHLLHFLELGSPFPFLRSSFFFFGIT

SEQ ID NO: 153049 - protein, 66 aa, Triticum aestivum
  Clone ID: PAT_TA_47467.pep
NGSKTRMPVQAQWMLCNGRGVYPVAASSLSRCIELHQKCNILNSSSHSGAVHIHTPVHIRVKQWFT

SEQ ID NO: 153050 - protein, 102 aa, Triticum aestivum
  Clone ID: PAT_TA_47468.pep
MAPEPDPEDGRELYALLHLSPESSDEEIRRAYRQFAQIYHPDKYQDAQMKDVATDNFQRIRDAYEILFDENKRQIYDIYGLEGLKSGLELGPKFNKPGRIKR

SEQ ID NO: 153051 - protein, 108 aa, Triticum aestivum
  Clone ID: PAT_TA_47469.pep
MATTAMALSPSSFAGKAVKDLPSSALFGEARVTMRKTAAKAKPVSSGSPWYGSDRVLYLGPLSGDPPSYLTGEFPGDYGWDTGGLAARPVTFVQNRELEGIQWRGAML

SEQ ID NO: 153052 - protein, 58 aa, Triticum aestivum
  Clone ID: PAT_TA_47470.pep
MATTAMALSPYFFAGKAVKDLSSSALFGEARVTMPMTVGKAKPVSSGNPGYGSDRVLL

SEQ ID NO: 153053 - protein, 78 aa, Triticum aestivum
  Clone ID: PAT_TA_47471.pep
IIHVDLILKGLSSGILCSKIGTGGVGMLLLSFSSLIAMCPLFKIGSSRYSYVMILPNDATKVATFTLQPDSCHMLIRG

SEQ ID NO: 153054 - protein, 122 aa, Triticum aestivum
  Clone ID: PAT_TA_47472.pep
PTRPEAGISKDGQTREHALLAFTLGVKHMICCCNKMDATTPKYSKARYEEIVKEVSSYLKKVGYNPEKGPFVPISGFEGDNMIERSTNLDWYKGPTLLEALDQINEPNRLSDKPLRIPLRMV

SEQ ID NO: 153055 - protein, 57 aa, Triticum aestivum
  Clone ID: PAT_TA_47473.pep
QENTPVPAMGEEEKRRSRCTHVRCVVMVNGTVGTLCRLATQHTASGGEGLGGDGGWC

SEQ ID NO: 153056 - protein, 101 aa, Triticum aestivum
  Clone ID: PAT_TA_47474.pep
ANQLGLVLNTPPSEGKARRPAAAVRQSHGGPRRVQEAGEQLEGGRLVCQVPGRRHEQQPAEQAPGPPRRPRRHRLRPHLPRGRAQRRPFCARHLPGGVDRF

SEQ ID NO: 153057 - protein, 105 aa, Triticum aestivum
  unsure (1)..(105): unsure at all Xaa locations
  Clone ID: PAT_TA_47475.pep
MAANEEEEGTSPLLIKGERRHHPGCPGCDHHRRKELRTGLPYKEFSYVWMIWLTTALPISSLFPLLYFMIRDLHGAKEQXDIGFYAGVGGASFMFGDXLTSTLWG

SEQ ID NO: 153058 - protein, 73 aa, Triticum aestivum
  Clone ID: PAT_TA_47476.pep
SKVSTFLRRKKKNMLCTVRPRYRISLPPASRSGAATATAEKSIFLPSFLLPGRLPARMCSVSFGWLATTSPLP

SEQ ID NO: 153059 - protein, 101 aa, Triticum aestivum
  unsure (1)..(101): unsure at all Xaa locations
  Clone ID: PAT_TA_47477.pep
SPLQPRIRRGVDGASGAAGVWGGLNSGVVLRIIRVLWTVVWQNLEHLQLQQLXGAKLRRHARRVVALVDLYLSRNIDEYDGGADAPRRGLQGGHGRPGLGD

SEQ ID NO: 153060 - protein, 35 aa, Triticum aestivum
  Clone ID: PAT_TA_47478.pep
APRAERSVTRKALGHIVREHEPRATVKATPSVATG

SEQ ID NO: 153061 - protein, 53 aa, Triticum aestivum
  Clone ID: PAT_TA_47479.pep
HKQVLIFHLIVALNHLLLKRLRIIQTGDYMFETLRRVEFSGQGMAQNMDQGLY

SEQ ID NO: 153062 - protein, 118 aa, Triticum aestivum
  Clone ID: PAT_TA_47480.pep
MAARSQLTGGAQDYTPTNYLRKKLTKHTSWCVNYHGTSSKGNTLTVMAVENIYQKRNTDKWKGLAYDICHDQQDITRGKGIVDFLFQAPTGDGTHEAVLSSYEYVSQGLKKYDFDNTM

SEQ ID NO: 153063 - protein, 73 aa, Triticum aestivum
  Clone ID: PAT_TA_47481.pep
AHYVEHQEEPLHGGLPLGLPVVLGLLSSRHSRRQRLGPRLALLLTQKLNSSCSYSTCYRLCLWSDQSKAEREA

SEQ ID NO: 153064 - protein, 51 aa, Triticum aestivum
  unsure (1)..(51): unsure at all Xaa locations
  Clone ID: PAT_TA_47482.pep
MASTSCFLHQATARLAVSSRPAPTVGRTQLFVCKAQKNDXAASDAAVITKS

SEQ ID NO: 153065 - protein, 58 aa, Triticum aestivum
  Clone ID: PAT_TA_47483.pep
SEVHVGGVRGGVHLHVHRGGSVRTRDRLHPLADAALQRRMLDQKRRWPGTATCGRSRR

SEQ ID NO: 153066 - protein, 32 aa, Triticum aestivum
  Clone ID: PAT_TA_47484.pep
RVRGWKGCDATTALRRVFVARAPNRKILMYSY

SEQ ID NO: 153067 - protein, 119 aa, Triticum aestivum
  unsure (1)..(119): unsure at all Xaa locations
  Clone ID: PAT_TA_47485.pep
LIASRQRRPEISLSPPCAGVVQRSKKMAASNLEGVLLGMGNPLLDIFDLRDEAFLPEYDVQPNNAILAEDKHLPMYDELSSKXNVEYIAXGATQNSIRVPQWMLQTPGATRYIGCIGKD

SEQ ID NO: 153068 - protein, 119 aa, Triticum aestivum
  Clone ID: PAT_TA_47486.pep
MASSSMITFAAALCLVAASAVAVPPATLQETCQSAGEQEALCVQLLSSTPAAQKTPVDTPGLAQAAVMAAGSNATETAAHLQRLFDSEDLKNMSPELQRCVEDCTESRPPSSWAKHRRR

SEQ ID NO: 153069 - protein, 109 aa, Triticum aestivum
  unsure (1)..(109): unsure at all Xaa locations
  Clone ID: PAT_TA_47487.pep
VFLLHLHRHHIEHAAACTHGDGGTGRLWPHPRRDARQRGRGRLQPPTKRPPVGDTDRDTRVSTEGLAGLGRCRGRCYHIEPVAVEDRQWIXMPLYPLDLFEEGSVTNMF

SEQ ID NO: 153070 - protein, 139 aa, Triticum aestivum
  Clone ID: PAT_TA_47488.pep
SKILIERARSMSPALKYHNEGEPQFMLQMVTNQRLTKGDSERDVRHFELEDRYSPISYQVGDALEILPSQNPSAIDAFIKRCNLDPDCYITIRAKGGDKLSKGSPMNSLMDPIKLKTFVALTMDVTSASPRRYFFEIMS

SEQ ID NO: 153071 - protein, 137 aa, Triticum aestivum
  Clone ID: PAT_TA_47489.pep
FGINNISSSVAIKISTWRAGATTWLHEDFPNLFPSYFRRLGNILYSDGLFYTASETALGVFDPTARTWNVLPVQPIPMAPRSIRWMTEYEGHIFLVDASSLEPMVYRLNRLESVWEKKETLDGSSIFLSDGSCVMTY

SEQ ID NO: 153072 - protein, 93 aa, Triticum aestivum
  Clone ID: PAT_TA_47490.pep
DAKLNAAGWISEQLGGVSYLEYLRDLETKIDQDWDRISASLEEMRKSLFSKEGCLINITSDSKNLEKSGQHIAKFLDALPSAPSLGSDPWLSR

SEQ ID NO: 153073 - protein, 116 aa, Triticum aestivum
  unsure (1)..(116): unsure at all Xaa locations
  Clone ID: PAT_TA_47491.pep
MAAQGLLSGRQLLGRPLQSYISRSSSSRKSPFVVRASSSPPAKQNDNRQLWFASKQSLTYLDGTLPGDFGFDPLGLSDPEGTGGFIEPRWLAYGEIFNGRTAMMGGGGXIAPEALG

SEQ ID NO: 153074 - protein, 60 aa, Triticum aestivum
  Clone ID: PAT_TA_47492.pep
HMHPLSITIMVFVLTLRYDFNKRLTLRSYRYHGSTLISDSLSSLTALDKKFDLPAPFVVN

SEQ ID NO: 153075 - protein, 57 aa, Triticum aestivum
  Clone ID: PAT_TA_47493.pep
VIAEYLQKVDPKSDGAKRDWVAIYDECANVLYQVRLSYAHNLRSVTISCLSQLMFLK

SEQ ID NO: 153076 - protein, 80 aa, Triticum aestivum
  unsure (1)..(80): unsure at all Xaa locations
  Clone ID: PAT_TA_47494.pep
AIGTDGCRSFRIPCSVCGIDGWKTTFRRADMAGVVCDAXTFDVASPLTSSVADSALWYSALAGYITYGQTYAYTFHAMSS

SEQ ID NO: 153077 - protein, 130 aa, Triticum aestivum
  Clone ID: PAT_TA_47495.pep
GTNASVVQSLISFYLREGQFKQALKLCLSLSNREISWEALVKDFAQGDDHVGILNLLCVIQRSGGVLDYPTSLHILNSCGKLELLREGLQAHAYLTKRGLASEPCISNHLIDMYSNCGSLKNALDAFRYM

SEQ ID NO: 153078 - protein, 102 aa, Triticum aestivum
  unsure (1)..(102): unsure at all Xaa locations
  Clone ID: PAT_TA_47496.pep
EEEAVIHVWNACWELYCLEHGIQSDGQMPGDKTVGGGDDAFNTFFTXTGAGKHVPRAGYVDLEPTVIDEERTGAYRQVFHPEQLINGKEESANNFPRGDFTI

SEQ ID NO: 153079 - protein, 34 aa, Triticum aestivum
  Clone ID: PAT_TA_47497.pep
GCCRRWPSQGHPLSSGTQYPPWITFPLSVNPRLG

SEQ ID NO: 153080 - protein, 80 aa, Triticum aestivum
  Clone ID: PAT_TA_47498.pep
LKMILMVMTKHQYLICLRGCNALVGVLVLQLQYTCSNSCGKFELPPDRRRARAYLTKRGLAFEPCINQHPIDIRYNCPSP

SEQ ID NO: 153081 - protein, 98 aa, Triticum aestivum
  unsure (1)..(98): unsure at all Xaa locations
  Clone ID: PAT_TA_47499.pep
SRISKPWGGKTPPPPGSPQEGGRGLSTPPLPAGXHFPVLHPNRGDPPPQPRPIPTGYPRGETPQAPRAPSRKWPPPPPNLSPFTKTPRQKRTRAPPPT

SEQ ID NO: 153082 - protein, 110 aa, Triticum aestivum
  Clone ID: PAT_TA_47500.pep
VAKRGLDPRRQAAEQVPNPGDRLHPHRRHEHQPPVPQEPRHPAPHLRHCLQHLPQNSNPNQHTRTRVRPEKKLMQEAELGLLTGRIWDGNEKPSRRFLGGKQRTGREEPE

SEQ ID NO: 153083 - protein, 84 aa, Triticum aestivum
  Clone ID: PAT_TA_47501.pep
MAGESDDRGAARAPHVALLSSPGMGHVVPVAELARRLHAEHGFTATVVTYASSDSAAQRAFLASLPPAVGSALLPAVPLDDLVA

SEQ ID NO: 153084 - protein, 145 aa, Triticum aestivum
  Clone ID: PAT_TA_47502.pep
MAATTMSLSSPAFAGKAVKNLPSSSVFGEARVTMRKTAAKAKQVASGSPWYGSDRVLYLGPLSGEPPSYLTGEFPGDYGWDTAGLSADPETFAKNRELEVIHCRWAMLGALGCVFPELLARNGVKFGEAVWFKAGSQIFSEGGLD

SEQ ID NO: 153085 - protein, 129 aa, Triticum aestivum
  Clone ID: PAT_TA_47503.pep
ERERELKDLKDQFREDFPVGPLIGKCCTMDQGKAVINFLDSILDKSLRSTVALLAARGRGKSAALGLAIAGAIAAGYSNIFVTAPSPENLNTLFDFVCKGLNAMEYKEHLHYDVMKSSDPNLKKAIIQI

SEQ ID NO: 153086 - protein, 98 aa, Triticum aestivum
  unsure (1)..(98): unsure at all Xaa locations
  Clone ID: PAT_TA_47504.pep
TQGNCQDLSLHDEELSETQSSADNPTLLIPHHLGVCNTGXAQATLVNCRYEAIAVMLPLAKSSDNTVDVPIENESAPIHHTDTRDQDTDATPAYSSPN

SEQ ID NO: 153087 - protein, 159 aa, Triticum aestivum
  Clone ID: PAT_TA_47505.pep
VRCETNISAGAVSVSSAAVELAMMKLPKSECLSARMLLIGAGKMGKLVVKHLIAKGCKKVVVVNRSVERVDAIREEMKDIEIVYRPLAEMYEAAADADVVFTSTASESLLFTKEHAEALPPVSLAMGGARLFVDISVPRNVGACLSEVEHARVYNVDDL

SEQ ID NO: 153088 - protein, 161 aa, Triticum aestivum
  Clone ID: PAT_TA_47506.pep
HASAHACADAWVTSAVNYHGKSSKANRFTVMAAENLDEKRNTDKWKGLAYDISDDQQDITRGKGIVDSLFQAPTGDGTHEADLSFYEYVSQGLKKYDFDNTMGGFYIAAAFMDKLVVHLFKNFMTLTNIKIPLMLGIWGGKGQGKSSQCELVFLKMGMNPI

SEQ ID NO: 153089 - protein, 53 aa, Triticum aestivum
  Clone ID: PAT_TA_47507.pep
TRILHYLIFPRPTDHINACVRRLIRNCSLVPAALYLKDQTFTSSYYNADAKLL

SEQ ID NO: 153090 - protein, 113 aa, Triticum aestivum
  Clone ID: PAT_TA_47508.pep
PRVRITIASEGFVYLVSINGVTGARPDVNPRVKDLLKEIKQVTNKAVAVGFGISTPDHIRQVAQWGADGVIIGSAMVKHLGEADSPREGLKRLEVYARSLKDALSGGSIIGAS

SEQ ID NO: 153091 - protein, 125 aa, Triticum aestivum
  Clone ID: PAT_TA_47509.pep
HASAHASAHASDGMKESDQTNPTIRITDSEENAFMELLSYMYSGKLTTAEPTRLLDILMAADKFEVLSCMRHCSQLLISLPMTTESALLYIDHPCSGSMVNEVRPLIDASKGFLGHQDQDFYEFK

SEQ ID NO: 153092 - protein, 162 aa, Triticum aestivum
  Clone ID: PAT_TA_47510.pep
FKPMHSIPSIDLGVESRPTDSDRSVESSDAATVPGGGTQGCLLQEAVATGESPMEGSRGRWRWGGRRRSMLMVALALCFVVAVVSLCCCARPGACSASACSGRSTVAVLRSDFWRRTAESFGNQDRSSASGSGGRRRLLVVAGPGRTRPGARASAAAAARAT

SEQ ID NO: 153093 - protein, 106 aa, Triticum aestivum
  Clone ID: PAT_TA_47511.pep
PGRFGLPGRPRRSAGGGEVAELHHQPARMSTYSDPYEVARRALDLMFPREEDAWSTWSAREEGTDDDVDDEQGGEKVDDCSTQEGSDYEEDDDDDGNCQVILPETN

SEQ ID NO: 153094 - protein, 88 aa, Triticum aestivum
  Clone ID: PAT_TA_47512.pep
EKQDITKAIILQMVFSSNTADAVARVTIYTLPPVQGDAIDGMGAHETLLHYRVMRNYLSAYQAQKSTKSSGMVLCLATCSDDRAHWLK

SEQ ID NO: 153095 - protein, 128 aa, Triticum aestivum
  unsure (1)..(128): unsure at all Xaa locations
  Clone ID: PAT_TA_47513.pep
MDEGYTSLLTSHLLGSVPAVAEGNDERKPGAPDEVGNAGVTXRLHDFAADPAGNGGGYHPPGSPVGGDAKTQTYWKGYFNAAYYTAYTNVDTDVLVDRLITSDDPMEGIFRKIDVYPDMYGTLWITTT

SEQ ID NO: 153096 - protein, 152 aa, Triticum aestivum
  unsure (1)..(152): unsure at all Xaa locations
  Clone ID: PAT_TA_47514.pep
MVFSVSIFASVAPYLVSALLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHXTVRRHLAPNFTPKXLSTYSDL

SEQ ID NO: 153097 - protein, 138 aa, Triticum aestivum
  unsure (1)..(138): unsure at all Xaa locations
  Clone ID: PAT_TA_47515.pep
GGEGAAAATEVRLMATAGLRLLEEGVREAILVSCRDALRASGFRFEDSWAKVIPGSDEGIYAWVAANYALGTLGGDPHKTIGIIELGGASAQLTFVSDEVLPLELSTNXTFGETTYTLYSNSXLNFGQNAAQDSYREI

SEQ ID NO: 153098 - protein, 123 aa, Triticum aestivum
  Clone ID: PAT_TA_47516.pep
APTCGAVTLAVNRSALLSTRCVGAPSTLCSASISDAQHADVLRRRAPENRNLHAQAATSAKSQTLTTARRCPRPLSPGGWCRGLDQLKTQRSFLRQCTVQPPPYAAAAAHGLHGGMEKLPDAW

SEQ ID NO: 153099 - protein, 130 aa, Triticum aestivum
  Clone ID: PAT_TA_47517.pep
MGSGEGPVSPRSTSRRHRRSYGDGGDEASSPKRQKRSHHHRHHGHGHGDRGDQQAGSRSRMSAAKPGEREVEDGEIVDDAAAAASRGPDAGFGKAVSVFGGLAPAPGCDDKFDANKKCREANHRKRSEEI

SEQ ID NO: 153100 - protein, 88 aa, Triticum aestivum
  unsure (1)..(88): unsure at all Xaa locations
  Clone ID: PAT_TA_47518.pep
CSVSADDRDADFYNELCSQIVVRACVQNDVRAMDVATFKVAMNRFMRIMRNFIGCXNRRENXGVYAIALNDSAGVTNTSHLFKSTSML

SEQ ID NO: 153101 - protein, 42 aa, Triticum aestivum
  Clone ID: PAT_TA_47519.pep
AHRAYKHHDPAYFILAKAVRHLGRLLNESSAPETPHSNSMRR

SEQ ID NO: 153102 - protein, 55 aa, Triticum aestivum
  unsure (1)..(55): unsure at all Xaa locations
  Clone ID: PAT_TA_47520.pep
NLGASRRPPSSAHYXCPWVGPNPSRSFMNSTFNKCRLIVASLLQYHVQRRVTVAS

SEQ ID NO: 153103 - protein, 97 aa, Triticum aestivum
  Clone ID: PAT_TA_47521.pep
MATRRNIPYSVLPTEDRDEDNVDRRFTYTPKSLRRIPWKSIALALFLLFLGSSVLFLSYFISTGHMEGDSSHVYGLLILGILAFLPGIYETRVAYYS

SEQ ID NO: 153104 - protein, 132 aa, Triticum aestivum
  unsure (1)..(132): unsure at all Xaa locations
  Clone ID: PAT_TA_47522.pep
MAEKLQWLRLCCLMVFASFFSLSGSTSAAHHHQRDVLHPVVLLPGLFCGQIEARLTDAYNSPSPLCGVLKGDGRGFRLWKNITGLQDLPDVPCFDDQLRLVYDPTAGDYRNEPGVETRVLSFGSTXGFLFDQ

SEQ ID NO: 153105 - protein, 112 aa, Triticum aestivum
  unsure (1)..(112): unsure at all Xaa locations
  Clone ID: PAT_TA_47523.pep
MRNGSTVCDAAAAVGLGVAPRYRGVRKRPWGRFAAEIRDPAKRARVWLGTYDSAEAAARAYDVAARTXRGPLATTNFPHDLVFFPTLPALARTFSPASPGPAWSASFTGESY

SEQ ID NO: 153106 - protein, 115 aa, Triticum aestivum
  unsure (1)..(115): unsure at all Xaa locations
  Clone ID: PAT_TA_47524.pep
MHRCKLTXPVRFIGDSVKNQGDMNPINTVFDAKRLIGRSLSDSVVQSDAXLWPFKVIPGPADKPMMXVQYRGEDKQLXAEEISSMVLNKMKETAEAYLGTTIKNAVLNVPSYFNV

SEQ ID NO: 153107 - protein, 132 aa, Triticum aestivum
  Clone ID: PAT_TA_47525.pep
LTLRSASAAPGAAEDPRGAATGCESGTKEPLEAAASRSGESRSDTSCVSCGKRERTSASRPYLGSANPGGKTGVGGEGGAGGGLAAAAWVAAGAGAARRRSAGKKAIFSTPPSVCFACHCYSHKLLLFEMNP

SEQ ID NO: 153108 - protein, 79 aa, Triticum aestivum
  Clone ID: PAT_TA_47526.pep
MASAHLCGPKVASAAMAKPTLADGLRIRTSMSARSVPTARRLRGLVGRAATGVSPKYTSAKPSGDRVLEKTQTTGDKTG

SEQ ID NO: 153109 - protein, 32 aa, Triticum aestivum
  unsure (1)..(32): unsure at all Xaa locations
  Clone ID: PAT_TA_47527.pep
HKWMISFVTLRXSSQDPVMVCNDRSMCTSTIR

SEQ ID NO: 153110 - protein, 141 aa, Triticum aestivum
  Clone ID: PAT_TA_47528.pep
MSSASPFPPPSPSSASVPMVVITVVGILAAFALLAGYYAFVTRCQPLRALLSRGGPTTSVSPGPSPPAAADEKRGLGLPLIRMLPVVRFTAAEDAAAPRISVSECAVCLSEFAERERVRLLPGCSHAFHIDCIDTWLQGSA

SEQ ID NO: 153111 - protein, 89 aa, Triticum aestivum
  Clone ID: PAT_TA_47529.pep
HASGRRGEKRKLLCSRDDDDDDLRRGDDDPPSRPPRPRRYPRGVPRPHSGGPARIRRGIHHRWPHQDRRSVPSPPWFKLDASGNFCMRG

SEQ ID NO: 153112 - protein, 78 aa, Triticum aestivum
  unsure (1)..(78): unsure at all Xaa locations
  Clone ID: PAT_TA_47530.pep
TAPGTMMACRALIMLLLPGRSRRRRRGAQLEGGAAAEQGRHVHLAHRSXRLLIGASNEEILLXLGSLDSINGVGRVAS

SEQ ID NO: 153113 - protein, 94 aa, Triticum aestivum
  Clone ID: PAT_TA_47531.pep
KPLAYDNTRDERMVRWLKKRMELLPPEPWRTEEADDDDQAYTMSRKGKDTGTSVLGATPTMNMRRIKRTDLYLGVDDFEEDQIDPQLRYSFQRI

SEQ ID NO: 153114 - protein, 154 aa, Triticum aestivum
  Clone ID: PAT_TA_47532.pep
MADEPALPVAAGRDKDERRRLMGRCALAVVGIMSTLLVYGVLQEKLMRVPYGAEKEFFRYSLFLVFCNRITTSMVSALVLLSSKKSTDPVAPIQKYCVVSFSNILTTTCQYEALKYVSFPVQTLAKCAKMIPVMIWGTIIMKKKYGGKDYFFAV

SEQ ID NO: 153115 - protein, 119 aa, Triticum aestivum
  unsure (1)..(119): unsure at all Xaa locations
  Clone ID: PAT_TA_47533.pep
LPPAGPDSRFAPRPRRSVVLLXSEVARELLPIQHGSGPVLLLINHGRASRALPLLHFFQTGMRGVQGRRGSSLAAPVAYRQRATADHTATAETLVLSVGEAFCDAQKHMRDWQMMRANT

SEQ ID NO: 153116 - protein, 79 aa, Triticum aestivum
  Clone ID: PAT_TA_47534.pep
GDHYIPPDNNLVVARAEAELVIFSAIDDLLAKTGVTPDAVGVVVVNCSVFAPVPSLSDMIVNRYKLRSDVRGVNLSGMG

SEQ ID NO: 153117 - protein, 104 aa, Triticum aestivum
  Clone ID: PAT_TA_47535.pep
HASAHASGACTHHRTMPGSIRVSDIQPPVAAPLFLQVNLGKKEYSGYIGQDGFSFPVTSLRDSMVLSLYDADKELVSKTEVKTRSIVELGSTDVVFTLDSGGEI

SEQ ID NO: 153118 - protein, 104 aa, Triticum aestivum
  Clone ID: PAT_TA_47536.pep
PTRTIEQRRKGKKSRTRLRISAAGAAGWGRDGEGARSSTISSRSSLVDSLEESDEMPELGYMPMEAASLARPSRVRWLLELTLMVVVSWLLLLLAGVNPASPVI

SEQ ID NO: 153119 - protein, 148 aa, Triticum aestivum
  Clone ID: PAT_TA_47537.pep
LDNANSDLILYVNLELVNKKSDRRYIVEEMLGQGTFGQVAKCWDAETNSYVAVKVIKNQPAFYQQAIMEVSLLSMLNDKFDPDDQHHIVRMLDFFPWKNHLCITFEMLGHNLYELLKKNNLRGLQLQFCRTFLRQILDALIVMKGAGI

SEQ ID NO: 153120 - protein, 104 aa, Triticum aestivum
  Clone ID: PAT_TA_47538.pep
SATSWSATEPLHPPIPQSSSDQLLFQMSGQQRETNYLQGNMSCYSCSLYVTDGHISFRTDLKMILQIEVPWRHHRRILVHFHPPMSRRYLIIILLLKVCPCFAI

SEQ ID NO: 153121 - protein, 62 aa, Triticum aestivum
  Clone ID: PAT_TA_47539.pep
HASDKIDERTRAVLVDKVGGPGEGYDELVAALPGDDCRYAVFDFDFVSVDNCQKSKIFFIAW

SEQ ID NO: 153122 - protein, 62 aa, Triticum aestivum
  unsure (1)..(62): unsure at all Xaa locations
  Clone ID: PAT_TA_47540.pep
VRGVSVDSCTGSWTTIWTDRCTIXXRLRLPCFYTELVDAVHQQKCCYVASPLXIXXQGFDTS

SEQ ID NO: 153123 - protein, 92 aa, Triticum aestivum
  Clone ID: PAT_TA_47541.pep
EEEAGADAHGPARPAGPGQYRVKCWCVSAWTPSTHIGTVRFSSSKHIQQVRPPCSGDNNDQHCRTTIRFYSPCLCPLATVPCFDNALIQPCR

SEQ ID NO: 153124 - protein, 66 aa, Triticum aestivum
  Clone ID: PAT_TA_47542.pep
PLIQGRTSSGKRRGLLVAPLEGLACSSGACADPPIRRNPRTTARNQEKAAMFARRPTLRTPGERVG

SEQ ID NO: 153125 - protein, 113 aa, Triticum aestivum
  unsure (1)..(113): unsure at all Xaa locations
  Clone ID: PAT_TA_47543.pep
TALTIAENAKHVADSALKPRVTQWAPEXSLAERVIGAVRVALMTYRMAYEEEYDETPIGSVMDDVISAMRYTDHANDKTYSLMSMPEGKPACAISYAILCTIRDAHTGEECAQ

SEQ ID NO: 153126 - protein, 110 aa, Triticum aestivum
  Clone ID: PAT_TA_47544.pep
RQDLSEQNVVRLIKEKENAENMIASLKEEMEVMEKRNRLHEKNVVQLIEEKESDENMISSLKEKMEEMNSLHEQNVGRLIKEKEDGQNMISRLKEEMEEMNRLHDQNAHQ

SEQ ID NO: 153127 - protein, 104 aa, Triticum aestivum
  unsure (1)..(104): unsure at all Xaa locations
  Clone ID: PAT_TA_47545.pep
SCLLFIFLVAHAHGEGRQKGREMAADSVLLKSSLFLSSPLSDLRGSSVSISTQNLRRAWQPRAARLQVDAAADCKSTLMVGGTSLIXSSSLQEAGAAGAPGHIV

SEQ ID NO: 153128 - protein, 83 aa, Triticum aestivum
  Clone ID: PAT_TA_47546.pep
IQMANGEKKTIRKNVTERMYSALKNEIKQREAMWDGVYWEMVEPVVKIRTLQARLIGIDRTDLMKAFIQLTLEFLTKQKFEAY

SEQ ID NO: 153129 - protein, 104 aa, Triticum aestivum
  Clone ID: PAT_TA_47547.pep
CARDIDSSKSRSRFQQISTLVPANLDAGSNIITSHPVEASARRSWLFRRPVAASTARLQHGLPLPWQHARPVGASAPANGGVDASRLAAFLLSSAHHGDGRRRA

SEQ ID NO: 153130 - protein, 93 aa, Triticum aestivum
  unsure (1)..(93): unsure at all Xaa locations
  Clone ID: PAT_TA_47548.pep
LSPRSTKSAELINSGRFASIQMASSAGNGKEMAALESGHASSSSSSSSSPAAAAKMTAVAXKPRPFTWTGPAIVMGFELLESIAFSGVALNLV

SEQ ID NO: 153131 - protein, 111 aa, Triticum aestivum
  Clone ID: PAT_TA_47549.pep
HHICSVLRRTRLGHRSTPPGRSSSSSSSSALLCCRGVEIQPELDRLLLLNQCASHRSGHGSGFFQPFLLGISSNTYQCSEVSGYRCWSAAYQAYSAKEKRNALCWESFKSR

SEQ ID NO: 153132 - protein, 113 aa, Triticum aestivum
  Clone ID: PAT_TA_47550.pep
GISSCSLTPEAFFNIPPQIRRVRRNQGAQAQTLMNTRQSFLDPRRTREGEIGDQSCTHRWLLPAWHCCLALLFLLLQCDAHQMTPVQSLHKTTSRRVLVAGSKDGEWRVCGRV

SEQ ID NO: 153133 - protein, 130 aa, Triticum aestivum
  unsure (1)..(130): unsure at all Xaa locations
  Clone ID: PAT_TA_47551.pep
PRIRPLITMDTAANTGTNLSETITMPSVLLTKDLSEDLKKCAVDGDMVSGLLDWRESVPHAEERVESDCWADCSDECGTQCDMQMGFVRSCQGTAHVVDPQGNTQYTTXYITWACTEGKTGSKQCIYHCI

SEQ ID NO: 153134 - protein, 115 aa, Triticum aestivum
  unsure (1)..(115): unsure at all Xaa locations
  Clone ID: PAT_TA_47552.pep
MEHGQSTNRSDXYCNPLDVHGVGTGMGAHGGLGTDAAAGGHFQPTREEHKAGGIHDGSFSCSRYTQDDDDGMHVRRTXAILDKIKEKLSAGLCDQQQTDATYWQDGHTRMTGTGA

SEQ ID NO: 153135 - protein, 35 aa, Triticum aestivum
  Clone ID: PAT_TA_47553.pep
VYGMLMARPTYEGMVMASTDRRLICSYTERGVYSE

SEQ ID NO: 153136 - protein, 137 aa, Triticum aestivum
  unsure (1)..(137): unsure at all Xaa locations
  Clone ID: PAT_TA_47554.pep
MVRTCVFAPSILQGHQVELGDSRDGLDRVETKPGKQYLAPLLMGRAESFLAIYAGARGDGQARLCASKEKDRQVGPGWLSQNRSAPRLDRCRGRERFRDRGEQTGVADRQSVKEGIPRVRXRVGRPRVRPCVRTHAS

SEQ ID NO: 153137 - protein, 120 aa, Triticum aestivum
  Clone ID: PAT_TA_47555.pep
MQIFVKTLTGKTITLEVESSDTIDNVKAKIQDKEGIPPDQQRLIFAGKQLEDGRTLADYNIQKESTLHLVLRLRGGMQIFGKTLTGQTITLEGESSDTIDHVKAKIQDQEGIPPEQQRLI

SEQ ID NO: 153138 - protein, 149 aa, Triticum aestivum
  Clone ID: PAT_TA_47556.pep
LHPHILLVVTMPWYGESRSLMAEIQQLVATEEMELGRLKLMVVYRNSEKLLSDAIGATEGTKFIYYQQSIQFKYQGKLRARDILYSVRHIMSLKHEEAPFGALHTKDDVEEFIQSTDRAVLLSEFCGWFTRLARGRSNRSSGVTPSKTH

SEQ ID NO: 153139 - protein, 114 aa, Triticum aestivum
  Clone ID: PAT_TA_47557.pep
PCVRWLVTLLETKLAMGSTGSPSSVAALPTSGRPLPIRTPRSATGSDDSAAEEPGSPTGIPMDPIYIGGTIRLGWPVNLPVLKGRLGNQLGRYPRLPKISVARRWQNPRGEAPG

SEQ ID NO: 153140 - protein, 39 aa, Triticum aestivum
  Clone ID: PAT_TA_47558.pep
FGRVPVRVDAAVIVGLNVLALLVVEQLVVLLLQHGWLID

SEQ ID NO: 153141 - protein, 60 aa, Triticum aestivum
  Clone ID: PAT_TA_47559.pep
SLGPRVCTGQNFGIVQVQVVMAMILSKFSISLSPAYVHKPKYLLSLTPRLGMPLILRNLL

SEQ ID NO: 153142 - protein, 71 aa, Triticum aestivum
  Clone ID: PAT_TA_47560.pep
LHTHALQWLRASQPPRSYPPDSQPIGGDLDRRGPHHDRPPKRPSLHREHQSTCIIARYLSALVPREQRFMF

SEQ ID NO: 153143 - protein, 92 aa, Triticum aestivum
  Clone ID: PAT_TA_47561.pep
QETALESSVRAYAENREGHVINPKIGTEFDSLDEAYEFYNLYSWKTGFGIRLAKSRLNVQRLCVPVRYVCGKNNFFHASGIIVVYQASFINI

SEQ ID NO: 153144 - protein, 86 aa, Triticum aestivum
  Clone ID: PAT_TA_47562.pep
YNGAQVRTGHGDGAGDDGRGEETVHALQLHAASVHACASGAIMSGALAMCVCRVWPRRNTETNGRKRRFPLVLGVPRACFMWSSSN

SEQ ID NO: 153145 - protein, 141 aa, Triticum aestivum
  unsure (1)..(141): unsure at all Xaa locations
  Clone ID: PAT_TA_47563.pep
MSFPAMEVARSPHLPCVPVDANATDSNSATDVLDLWRQQKQIPAPFVWPHADARPSSMLELDVPVVDIGAALHSAAGMGRAAAXVAEACASHGFFQVTGHGVDLALARAALDGAADFFRLPLATKQRVRRSPGTVEGYASA

SEQ ID NO: 153146 - protein, 82 aa, Triticum aestivum
  Clone ID: PAT_TA_47564.pep
TQFCLPPSGGTPVTNRAKRTTVTTAPTNATIGPVWTRLRILRSPAARGARPNTTSPKGAAPEGILTGSRLGIMGTSRMGRKA

SEQ ID NO: 153147 - protein, 100 aa, Triticum aestivum
  Clone ID: PAT_TA_47565.pep
LGLVDASAPPGGALSAELVDGAQPAHLRHLAGALIGTVWLASLTAAAPPTRPWRPAPPPAAPAPPWPSSLLLPRSTPTPRTDEPTCCSPCRFCRSCRSLA

SEQ ID NO: 153148 - protein, 117 aa, Triticum aestivum
  Clone ID: PAT_TA_47566.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIID

SEQ ID NO: 153149 - protein, 36 aa, Triticum aestivum
  Clone ID: PAT_TA_47567.pep
TSVCVNGAKFTLHADVSETVGAFNEVVVGSCDVPEP

SEQ ID NO: 153150 - protein, 154 aa, Triticum aestivum
  Clone ID: PAT_TA_47568.pep
NHILISTPINMAPGSATLAVRAVAVASFLAMLVLPSLGRCPSLGPEPPMAAPAPAPGPAQAMRCDDCGPHCISTCRVSVPLKCSKPCDAPSCDECRSDVMGKCRAGCTGGSCDCDGEATRSCYDSCSNGSACTDCMRFASKQCSANCNSQCAAT

SEQ ID NO: 153151 - protein, 46 aa, Triticum aestivum
  Clone ID: PAT_TA_47569.pep
MAMVAVVREAAAYCVVTLLWVLCVSTLGTYTDRFTTYLSLHEIIHY

SEQ ID NO: 153152 - protein, 95 aa, Triticum aestivum
  unsure (1)..(95): unsure at all Xaa locations
  Clone ID: PAT_TA_47570.pep
SDLAGREGAIALNWKPAEPPRDAEGIFRGVYIFFVHHGVQPRRLXVWKQKLVQMGGRLENKDACAKGARINHMLTVDDEVLLLLARILTVFTCFR

SEQ ID NO: 153153 - protein, 37 aa, Triticum aestivum
  Clone ID: PAT_TA_47571.pep
NSTLGLCFSLSVQVFFCALRCCFRTFHIILCFKIFTL

SEQ ID NO: 153154 - protein, 83 aa, Triticum aestivum
  unsure (1)..(83): unsure at all Xaa locations
  Clone ID: PAT_TA_47572.pep
GGPPETAVRGDQGKGQGGGGDEAGAALVGPVVEEPEPGGCRVELAXRGWNSGLETVWLQVLRTMEARRRRTGPSGGRRRGTSS

SEQ ID NO: 153155 - protein, 83 aa, Triticum aestivum
  Clone ID: PAT_TA_47573.pep
DRRRQGSYLGGQWESRGHGGAQRTGRSREFGCGTSRAPVTPGAASERDVGKGMGGGFPRNLKKHRKKEKQWWSIEKDGQGRLI

SEQ ID NO: 153156 - protein, 119 aa, Triticum aestivum
  Clone ID: PAT_TA_47574.pep
MGNCCRSPAAAVREDVKSSHFPACDAARKNKPHQPRSGAVGTGGGGGQKRLAGLGEEGCDFIGGIDDKYLLDRELRRGEFGGTYLCVDRDTKEQFACKPIFKRKLRTPVDVEDVRREVA

SEQ ID NO: 153157 - protein, 99 aa, Triticum aestivum
  Clone ID: PAT_TA_47575.pep
CVSQLDCMEVVSVSRLNACCFGCVVQPLRRCCTSGERVHEFKIRPVWLGALHVSLFKPLYSLFKPLYPVHLLVRRKKQRKGTSPAVPQISLCVCACACA

SEQ ID NO: 153158 - protein, 91 aa, Triticum aestivum
  unsure (1)..(91): unsure at all Xaa locations
  Clone ID: PAT_TA_47576.pep
QLRTHVGKLIPYLSLHLCMEGFMPVTSRXHRWTDXMNGSVITHEMTHSKNIMCDVDPGDDRYHRRYVIVCGMMRTKVGAKQVIKLLNKNSY

SEQ ID NO: 153159 - protein, 104 aa, Triticum aestivum
  Clone ID: PAT_TA_47577.pep
PRVRDRRLGNRRAERFVDGCSRQLWQTWWRGEQRRRSCRVWRGGKSAVKHDPKGLGWIRSLSILNLWSSSHGSVQDEVGEIEGWGRCTARFVGGCSRQLRQPWG

SEQ ID NO: 153160 - protein, 152 aa, Triticum aestivum
  Clone ID: PAT_TA_47578.pep
SDLMNIAMTTLSSKILSQDKEYFAELAVDAVLRLKGSTNLESIQILKKPGGSLKDSFLDEGFILDKKIGLGQPKRIENANILVANTAMDTDKVKIYGARVRVDSMSKVADIEAAEKQKMREKVEKIIGHGINCFVNRQLIYNFPEELFADAG

SEQ ID NO: 153161 - protein, 147 aa, Triticum aestivum
  Clone ID: PAT_TA_47579.pep
MAFASSLVAPLPPPPPAARAGWRRARAAPRPLVLAASSRGGGPVPAPAPSTFDRLREQLLQLHAEADLTQSKANSARVRLVRLTEAAENLKKRAVVSVRMGRENEAVELLVQKKKLTNALENIKERIELLDKLSAKISEVISVKQNM

SEQ ID NO: 153162 - protein, 56 aa, Triticum aestivum
  Clone ID: PAT_TA_47580.pep
LFTIRSFSNFLAFNMAVVSAFIFVIFFILQVLYKETSDQIKKDSLYIHAYAKNMSP

SEQ ID NO: 153163 - protein, 77 aa, Triticum aestivum
  Clone ID: PAT_TA_47581.pep
MSSSASRREAARSGELGRTCGADGPPPRPAPKARSGELLLPPKGGAEAAAAAAVRHEGWMVRYGRRKIGRSFFHTRY

SEQ ID NO: 153164 - protein, 110 aa, Triticum aestivum
  unsure (1)..(110): unsure at all Xaa locations
  Clone ID: PAT_TA_47582.pep
MSDREGLMXPQTDSIARVGFKADVKDYILTDYIIEYDTEGTDXIVAACQGRNLGWGSLXEIRAVESDESSTGAWTTVRTVRLTHFDAIKGRCYYTEPVAGEDSQWILLCS

SEQ ID NO: 153165 - protein, 31 aa, Triticum aestivum
  Clone ID: PAT_TA_47583.pep
TVICNSPCYRRRLFLENRWLGTLGCEIIVIL

SEQ ID NO: 153166 - protein, 82 aa, Triticum aestivum
  Clone ID: PAT_TA_47584.pep
MAKKRKRSFDAPASAAVEKPDDSAPERAERTLFGFKDSAAEPASKDAGPLFRNKEKVLITCSRRIIYRYRHLKQNVVSLLAH

SEQ ID NO: 153167 - protein, 67 aa, Triticum aestivum
  Clone ID: PAT_TA_47585.pep
ELLFLRCFSSTGGHPWSVCLSTLVFSSRTSTWSKLSRSPFTIIFHCAPSGSYVFSNFFSSFTPLILT

SEQ ID NO: 153168 - protein, 152 aa, Triticum aestivum
  Clone ID: PAT_TA_47586.pep
YTITTNSKSAQSTPNRTEAWKPPATGIAVQFDPVEEAVTSPLQLGKARIDRHRATTMAAAENGGAPNTVPRDVAAVAAVGERRPLSVALRLATAVLSLAFFAVMASARTFGWDGDHFDRYDQYRYALAMNVIVCAYSIAQSLGEIRRLVAAR

SEQ ID NO: 153169 - protein, 75 aa, Triticum aestivum; identical to SEQ ID NO: 106874
  Clone ID: PAT_TA_47587.pep

SEQ ID NO: 153170 - protein, 113 aa, Triticum aestivum
  Clone ID: PAT_TA_47588.pep
MSFLDDTCGKKGLWPELVGKFIEEGQKIIMKDRPDVKIIEVFPVGTAVTGDIKPDRVRIFFDTVAEISPHWVSFVDAPPRYVCVCVCVMCLRKPYLVSGDHVCILLLAMSGAL

SEQ ID NO: 153171 - protein, 96 aa, Triticum aestivum
  Clone ID: PAT_TA_47589.pep
DYRAVDGGVTVAHAGRTTAHLARFGVGVRAARMVTRMEESRTIDDVAFDVPELGPDTFIPPEEVRRSRFYDAMAAAGGKENTRSYAGSREWGKWNT

SEQ ID NO: 153172 - protein, 134 aa, Triticum aestivum
  Clone ID: PAT_TA_47590.pep
MMPIDPTQGAFMADTMSPNRLLFGPRPEWDRSAEGTGSFPSPAASPEPFGGVSRTIGQSNFAMASGMMYPQQKSLFGCGTPGDSYGRGFCHRGGFPHATNYGGSFPGYGMNGTSFIPIDKGRRRGRGNTLLCTC

SEQ ID NO: 153173 - protein, 64 aa, Triticum aestivum
  Clone ID: PAT_TA_47591.pep
VDPIRFLRLPTARVGIWNQGNGALLRTARTWDRCFYSHPWLGPTSFFCKERTKEGPTLVLRSGT

SEQ ID NO: 153174 - protein, 139 aa, Triticum aestivum
  Clone ID: PAT_TA_47592.pep
TGADVPGRGGPLPEPEQRAPLLLAALRATRLRDEESRRPDPLFIDPYAAVLLSLDVAHQASESLVSHLMPSAEHYRLTTKYLDDKLQHLISRSDNFRQMEWTLAHIGLAGQGCLSCTMYHLEESSVQQPSNSEEQEQKH

SEQ ID NO: 153175 - protein, 34 aa, Triticum aestivum
  Clone ID: PAT_TA_47593.pep
HTFENLEERPLKVQAMKHSETISYTISLSTEKTT

SEQ ID NO: 153176 - protein, 39 aa, Triticum aestivum
  Clone ID: PAT_TA_47594.pep
TTHVDPSKLLDQMASGGLLARVHMANGRYVDVSLHVQHG

SEQ ID NO: 153177 - protein, 92 aa, Triticum aestivum
  Clone ID: PAT_TA_47595.pep
VVTVPRAIWADPAALDAHLGCGWEVRAGGCKITSVWLLGSRKRHVSASFTVVQEPVSVVSVLMVKDRLLQCMLYPRGMGLAGHLQPVKYHGP

SEQ ID NO: 153178 - protein, 65 aa, Triticum aestivum
  Clone ID: PAT_TA_47596.pep
SLINDRIKTYQCRSSRLINPKNIACRLEFHISKPHQSIKHSTKSAVTNSNCYGGEYIKREGPTRP

SEQ ID NO: 153179 - protein, 71 aa, Triticum aestivum
  Clone ID: PAT_TA_47597.pep
CDVTASILYAPPTPTRLLWWGAQLRPACVEVVLDAPSPLGNGHTWAEQFRPAATRTIDAPRSEGGSDCVCA

SEQ ID NO: 153180 - protein, 56 aa, Triticum aestivum
  Clone ID: PAT_TA_47598.pep
QTSSAGVIWPVADFLPDYPLEPPPHCPHNRSRLRRVFSRRQPRRTSVSPQTSSLDR

SEQ ID NO: 153181 - protein, 47 aa, Triticum aestivum
  unsure (1)..(47): unsure at all Xaa locations
  Clone ID: PAT_TA_47599.pep
MGFAIISFLAGALLYRFEKPGGGPITRVCHIVAGTVRXWNAHVPEDR

SEQ ID NO: 153182 - protein, 45 aa, Triticum aestivum
  Clone ID: PAT_TA_47600.pep
LSSYSDTLERPSIRLFSYSGNAPNMALQPLMNRSKFLTTIGGAST

SEQ ID NO: 153183 - protein, 43 aa, Triticum aestivum
  Clone ID: PAT_TA_47601.pep
ICHNHSIMCIIPLKLKHTAEHLLLFSPAFHRIYSLCFHSRVNA

SEQ ID NO: 153184 - protein, 46 aa, Triticum aestivum
  Clone ID: PAT_TA_47602.pep
TVWHPLTPLAHSLKVPGNYCMVSPIRSAPAWYDTDVKKCVSLYTDR

SEQ ID NO: 153185 - protein, 79 aa, Triticum aestivum
  Clone ID: PAT_TA_47603.pep
GDVTLEHLFEPRSCHICISRLGLKLPMWNRLMVPTEQCATGVMLDSGELYQSRQSVSTLVRSTSSSLGDRREERDEVSR

SEQ ID NO: 153186 - protein, 46 aa, Triticum aestivum
  Clone ID: PAT_TA_47604.pep
MNGIGYKAPLHATATPSVPQYKNGFYSSIVSITFCIFWDTESNKRQ

SEQ ID NO: 153187 - protein, 62 aa, Triticum aestivum
  Clone ID: PAT_TA_47605.pep
KQISLPAKTRTHRDLQSRHDVSTPAMNMASFGCLRGNNWYIYAFNALKKNASMQIWSTDSSC

SEQ ID NO: 153188 - protein, 49 aa, Triticum aestivum
  Clone ID: PAT_TA_47606.pep
IHVPTLTPQIQIHFPQFILPRLNQGPPLINTTSGPAYTPYRYETEAMST

SEQ ID NO: 153189 - protein, 50 aa, Triticum aestivum
  Clone ID: PAT_TA_47607.pep
LCHSNPVAIHSSSSSVPPVAKIEDTPSGSRVTRASYASGYWAVIDTLSIL

SEQ ID NO: 153190 - protein, 29 aa, Triticum aestivum
  Clone ID: PAT_TA_47608.pep
VYPLCTTALKVFILAEQYEVVMRHMCISR

SEQ ID NO: 153191 - protein, 111 aa, Triticum aestivum
  unsure (1)..(111): unsure at all Xaa locations
  Clone ID: PAT_TA_47609.pep
MAAVVRTAWYGITEKSLTYFLRYTRTXGYLKCLAYGHLLQTKTHNIAATLVRYVTLRNKCYDKLHDTHYGRHMHVEYAVNGLYNASKVPAEWHAWLLHITHSTAYKLLDET

SEQ ID NO: 153192 - protein, 80 aa, Triticum aestivum
  unsure (1)..(80): unsure at all Xaa locations
  Clone ID: PAT_TA_47610.pep
MTVVTARAGAQELPGHTXTVCVTSSSWYIAARLRTLLVKQIYTITGTLRHSNDPKNAHLMALDSSVNRMVFCKADLLDYD

SEQ ID NO: 153193 - protein, 90 aa, Triticum aestivum
  Clone ID: PAT_TA_47611.pep
QVPFASLSSDISLSCPFCLTTIHSNVFDDTCSNLVTVMSFVYVDSRSSPALGICQCAAMSPSFHGCICSHEGAPPVDYLCRRRRPVGRVG

SEQ ID NO: 153194 - protein, 48 aa, Triticum aestivum
  Clone ID: PAT_TA_47612.pep
HAFAPSAPTTIVPSAAIEPYKYLPSSSFNFSNVDHQLQFSCLEHLVLY

SEQ ID NO: 153195 - protein, 84 aa, Triticum aestivum
  Clone ID: PAT_TA_47613.pep
ACGYSRPLAAAMQWVRRAPPRGYAVGYVRRPRARVVLLIWATHCSLLHSHIVELLLPASLHTSRADAGHVRTWDRVGRVRVKLH

SEQ ID NO: 153196 - protein, 87 aa, Triticum aestivum
  Clone ID: PAT_TA_47614.pep
EVEVGRRWFGIGTEHWEPALALGDTCSRRPSQRQNGVRQARIQWTESLIRRSDPAERARSPQKRLRSEGSLHPRHGGRFKKLASTDR

SEQ ID NO: 153197 - protein, 61 aa, Triticum aestivum
  Clone ID: PAT_TA_47615.pep
QAALSIWLKGGRQSDPQMAARFGRRWLDLGGSGRWLVAMHKMRRRVMRTAPEAATEDGRSR

SEQ ID NO: 153198 - protein, 46 aa, Triticum aestivum
  Clone ID: PAT_TA_47616.pep
ELPTPNPRCVARSRKRNSPFLRTFLEMKVFDAPKGPAPGNFYGAQG

SEQ ID NO: 153199 - protein, 70 aa, Triticum aestivum
  unsure (1)..(70): unsure at all Xaa locations
  Clone ID: PAT_TA_47617.pep
RPRVQHEVGRMVLIFTDQPMLLAPNIEMVFAALALAQCEEVRFFQHRXIALSKSTPGRTVYIDATCPPIV

SEQ ID NO: 153200 - protein, 64 aa, Triticum aestivum
  unsure (1)..(64): unsure at all Xaa locations
  Clone ID: PAT_TA_47618.pep
MVYALAACPSQMRFPMPAERXPHNHCWMVLPQRPYNWREHAEPSQKTFVRTVIAMSNSVLVTIC

SEQ ID NO: 153201 - protein, 83 aa, Triticum aestivum
  Clone ID: PAT_TA_47619.pep
LCLCSSMARVVVAVPVLLVILLVWANASFIDTVLGQKRSAIVAGPFLVPGVDKHAVIFYSWSTSTPLLVFKFDNKIDLLEIRD

SEQ ID NO: 153202 - protein, 41 aa, Triticum aestivum
  Clone ID: PAT_TA_47620.pep
PREILSPVFLPTNGRSKLDDHEHYSNVGSKHRLADYHPDCV

SEQ ID NO: 153203 - protein, 62 aa, Triticum aestivum
  Clone ID: PAT_TA_47621.pep
SSWFARRTTTTVLWRGARPGTQCACRRGSAPPTMGGPSWLTPASRGTSSGAAAGAWRTCSCC

SEQ ID NO: 153204 - protein, 55 aa, Triticum aestivum
  unsure (1)..(55): unsure at all Xaa locations
  Clone ID: PAT_TA_47622.pep
PQILCQKITLLTPHALQXISIDDVHLHLMLTSFQSFTTLIKLINLXLYHPINENL

SEQ ID NO: 153205 - protein, 68 aa, Triticum aestivum
  Clone ID: PAT_TA_47623.pep
RSIVRRSQPSLEMRQAGISAVARNEASTDFDRRQAGTRCGGRAFYRRCNWFCACTFLAGLLGGHRSVC

SEQ ID NO: 153206 - protein, 64 aa, Triticum aestivum
  unsure (1)..(64): unsure at all Xaa locations
  Clone ID: PAT_TA_47624.pep
TEKEARNATYTKKDCDSATQPYTKSMALDDXTYXYLTNRTAVYLEMRLYEDCMNDCATAVERGR

SEQ ID NO: 153207 - protein, 75 aa, Triticum aestivum
  Clone ID: PAT_TA_47625.pep
LLIRRKIIPARNTLYMIYGSLDNFIAPNPWITSRYYTLPKQPLYDTYYPVLTCAGAYCADTQYEILLAQRRTPFG

SEQ ID NO: 153208 - protein, 56 aa, Triticum aestivum
  Clone ID: PAT_TA_47626.pep
MHWTNLFIEEPIPMVSILQPSKPHLFPTMTKIEATLGAKTPSGEAISACLKAGMSV

SEQ ID NO: 153209 - protein, 67 aa, Triticum aestivum
  Clone ID: PAT_TA_47627.pep
PRVRPRVRLIRQLAAAARLPSEPKDGASCARRRIAPLSALTMGAYCSSCCTNRKLLIKKLYEKESTT

SEQ ID NO: 153210 - protein, 66 aa, Triticum aestivum
  Clone ID: PAT_TA_47628.pep
GRDSELAELSLPHLLGAAGISQLAALVHGLHWRPHARSVRDFAASQELTWSGADADGVPSILFYGR

SEQ ID NO: 153211 - protein, 73 aa, Triticum aestivum
  unsure (1)..(73): unsure at all Xaa locations
  Clone ID: PAT_TA_47629.pep
MAAGGRLPAPTSCKTXENRLHXRDPSEELPSLVGDLEKAIPSHRLKRSIPXSFSYPNSDIIIALCFFYLVTNY

SEQ ID NO: 153212 - protein, 66 aa, Triticum aestivum
  unsure (1)..(66): unsure at all Xaa locations
  Clone ID: PAT_TA_47630.pep
MATAMLCTAMAPLNGGMLEFCGLTSSTTLSLRRNARCDDXMSAGSFTTYAMSTNXRSRKAPTDAKL

SEQ ID NO: 153213 - protein, 41 aa, Triticum aestivum
  Clone ID: PAT_TA_47631.pep
SPLASRGDLPPIRLEGAAPLYLFLVRRAWLCVACWYAAVRR

SEQ ID NO: 153214 - protein, 72 aa, Triticum aestivum
  Clone ID: PAT_TA_47632.pep
ITSADERQHRHGRYCDTSEWHKAAVLKEVMNAHYPCAYEEDDYALTRFLRALYQIMNKALATLLMYLAWKTM

SEQ ID NO: 153215 - protein, 116 aa, Triticum aestivum
  unsure (1)..(116): unsure at all Xaa locations
  Clone ID: PAT_TA_47633.pep
TAFEETCSSQQEQMETLHKLLALATEKLQHAELTAIQAMTGYETQHETIXICKSVRAMQGFKXIASDNLQKKLHNTIWELKGCITLFLMVRPYLSDANSNGAGRSHYFLCIICGKC

SEQ ID NO: 153216 - protein, 79 aa, Triticum aestivum
  Clone ID: PAT_TA_47634.pep
SETRVLHPIIQLGLEAIAIYIYSAGSNDLFIQIYRFRRSHRFANLSDSYCRAIYQFRVFKTHGSLSRGGGSRRPRRGRR

SEQ ID NO: 153217 - protein, 55 aa, Triticum aestivum
  Clone ID: PAT_TA_47635.pep
SYEWSSTGYDYVVVENSLQAETLAFERPLEKQPLHLSSTSQGSPVALPVVISEIA

SEQ ID NO: 153218 - protein, 109 aa, Triticum aestivum
  unsure (1)..(109): unsure at all Xaa locations
  Clone ID: PAT_TA_47636.pep
RRAAICAAMDYMDQFDRDSEGMIANDGSADQTYYAWTVHGIIAYCGALCLAALQPDATIXRHRLGDRTFAEKSKLKFMKANAVYEAKLQTGFYFTYDSDTSDDSRSIHA

SEQ ID NO: 153219 - protein, 34 aa, Triticum aestivum
  Clone ID: PAT_TA_47637.pep
VNAKMLSQIQLSYGTKYLRNCSDILNKFLTEEST

SEQ ID NO: 153220 - protein, 41 aa, Triticum aestivum
  Clone ID: PAT_TA_47638.pep
WGRRPCTTRSSTRTLRTCITPCAGSYNYHLPNCRRRARGSS

SEQ ID NO: 153221 - protein, 37 aa, Triticum aestivum
  Clone ID: PAT_TA_47639.pep
PKVLSDNMHGMTKSDICRLSRTSRLKRISRLIYEETC

SEQ ID NO: 153222 - protein, 58 aa, Triticum aestivum
  Clone ID: PAT_TA_47640.pep
NMKHSVCNGSSGHGREAQLANAISAAAIPYWELHVLLGVCIIRDLLFNPKMHKLSLSS

SEQ ID NO: 153223 - protein, 28 aa, Triticum aestivum
  Clone ID: PAT_TA_47641.pep
SQSSALCATGSSVDLTVSQSSLAGSRCD

SEQ ID NO: 153224 - protein, 96 aa, Triticum aestivum
  unsure (1)..(96): unsure at all Xaa locations
  Clone ID: PAT_TA_47642.pep
LRAPALAAHAVFTARPIPTRARMHTTAACRHRVHSSDLSGLRTPSCSMSAARREASLFDVITPQVRPRASSXNAARTPSDAILKVAINGVSRIRTN

SEQ ID NO: 153225 - protein, 73 aa, Triticum aestivum
  Clone ID: PAT_TA_47643.pep
SIKKCLFLVRDYDKIVCVKTKTMSGCGFLNCNVSTRVFPYNVYVCAHTLVHVVCGIEASSVHVLSGIESLQAY

SEQ ID NO: 153226 - protein, 70 aa, Triticum aestivum
  Clone ID: PAT_TA_47644.pep
GGQLEANLVGGVCGKQGPEVVPPGGGGAQVVLHCGQVRNHSVFGVRILWDSAHQVSFSLFGLYGIFLFFV

SEQ ID NO: 153227 - protein, 58 aa, Triticum aestivum
  Clone ID: PAT_TA_47645.pep
AREERYIVPSSKRAMLAKRRRSIHSARRVCCAMHKSSKVTSGCVNAHKHYALVLACCT

SEQ ID NO: 153228 - protein, 56 aa, Triticum aestivum
  unsure (1)..(56): unsure at all Xaa locations
  Clone ID: PAT_TA_47646.pep
HLDPDDATLLXTESLCWLLMGDGRKALIDANLCRKMRTHWPYTRTLQAEALMLLMD

SEQ ID NO: 153229 - protein, 44 aa, Triticum aestivum
  Clone ID: PAT_TA_47647.pep
AKQPEAAASAACSVGGSTWRRTLSRLIRSVSTRGYPHDHQRIRA

SEQ ID NO: 153230 - protein, 48 aa, Triticum aestivum
  Clone ID: PAT_TA_47648.pep
HKWISSFRVQNGRTSQKYFTSNSEPLLARDGINSACVYRPGVQAKETL

SEQ ID NO: 153231 - protein, 108 aa, Triticum aestivum
  unsure (1)..(108): unsure at all Xaa locations
  Clone ID: PAT_TA_47649.pep
TYFTYSKDYYRRIGKGXQRGYLLHGPSATTXCTMIATMSIYLXXDIYDIELTTLKSNSDLCKLLMATTGKSIIAIEDIDCCLDLTGRRTTMLPAMTRFDDRGTACYHM

SEQ ID NO: 153232 - protein, 70 aa, Triticum aestivum
  unsure (1)..(70): unsure at all Xaa locations
  Clone ID: PAT_TA_47650.pep
MHPEADTMYVKEVDVCXEHYRTICSSLVKYLLLVQLQDNTGIVFANLKRIYMRGMQSNRMLMCASDATDE

SEQ ID NO: 153233 - protein, 45 aa, Triticum aestivum
  Clone ID: PAT_TA_47651.pep
SFCLVRYRVREKCLHSTLTIVEEKFHINIAVIDHLTLESRQPLDT

SEQ ID NO: 153234 - protein, 45 aa, Triticum aestivum
  Clone ID: PAT_TA_47652.pep
ASSVGPSSHCQAYGGLNAPLKERRRWPLRPSRVRAMAVLCRYIAC

SEQ ID NO: 153235 - protein, 68 aa, Triticum aestivum
  unsure (1)..(68): unsure at all Xaa locations
  Clone ID: PAT_TA_47653.pep
MRGASMQAVAGMRRRLTIDPAGEDEAPPQXFWRVVRESPVTIFTRRGWYMAHVMKSLIWGVGAHSTLM

SEQ ID NO: 153236 - protein, 47 aa, Triticum aestivum
  Clone ID: PAT_TA_47654.pep
LLNLIVIGSCISDEESNGIILDDRVLSLWNGSCQSDHSTNDVIPILK

SEQ ID NO: 153237 - protein, 39 aa, Triticum aestivum
  Clone ID: PAT_TA_47655.pep
GGAPTVTSGGSAMDGASQSTGNLSASSPLVPSSRKAQVS

SEQ ID NO: 153238 - protein, 40 aa, Triticum aestivum
  Clone ID: PAT_TA_47656.pep
HLLSRRMGPSPACQPVSLWSMAMISLRVDSPRGDSSTAIP

SEQ ID NO: 153239 - protein, 67 aa, Triticum aestivum
  Clone ID: PAT_TA_47657.pep
RTRGRTRGPPSCYALTTLGVADRPCVDSSSPRRRRQREGLRPIVCLLRWSLLLDGGTLSLIELYGGV

SEQ ID NO: 153240 - protein, 85 aa, Triticum aestivum
  Clone ID: PAT_TA_47658.pep
PSSTDRANQKQSDEQLSGYSARLEMLLSSLFCHSSTEDNFCGPSVVERCPFLMNINGATTLSFSSALSEAARGSKAAILDDRPQL

SEQ ID NO: 153241 - protein, 99 aa, Triticum aestivum
  unsure (1)..(99): unsure at all Xaa locations
  Clone ID: PAT_TA_47659.pep
TIKVLVSMILNNIKGGINSDNPQHSRXYELCDIFRIYVIDEANIHTQGFDESSHFIHSTLXPIWAKVILDRLAYIVDSDKNHACIIIRPLRNETSYGPN

SEQ ID NO: 153242 - protein, 70 aa, Triticum aestivum
  Clone ID: PAT_TA_47660.pep
PRCETTETSTYRVLAPIGCDDLRAEGDHALPSVQGERPVGAQERLTSARRAGACPAAQRDNHRHQARRHA

SEQ ID NO: 153243 - protein, 60 aa, Triticum aestivum
  Clone ID: PAT_TA_47661.pep
LSRVRPHVRVPTVQTRRRTERHGSHVNRWHTVCGGGGDSLGRVPGARLCQACSLAGGGTL

SEQ ID NO: 153244 - protein, 78 aa, Triticum aestivum
  Clone ID: PAT_TA_47662.pep
QVEVGAEFRHQLGSIPDRVGRQVRVRGSSLPPPQTACQRLAWLPRRSVLLLVRTVGTLTCLRTRGSTRASTRAYGWRV

SEQ ID NO: 153245 - protein, 58 aa, Triticum aestivum
  Clone ID: PAT_TA_47663.pep
QTRGSAPCSLPHTLWCRSGLSVTHRMECAMELSLLKRAMHYHGIAGETASSVSVLRAR

SEQ ID NO: 153246 - protein, 101 aa, Triticum aestivum
  Clone ID: PAT_TA_47664.pep
MRTSSEERAPMSSSVVATPSALLGTWLADSAPQKRRIVARMGLRKKKAPAKKGKAPPTTDRTLRVPCAQAPDYIDWTLVSDYGFYPFSLGKSTEYLQYNVD

SEQ ID NO: 153247 - protein, 63 aa, Triticum aestivum
  Clone ID: PAT_TA_47665.pep
FIWNMAKKSFTMHTSSSALNTIAIPAYKGSIAHPYLRSQRSLTDSDRWLKSRSDWLSPETATG

SEQ ID NO: 153248 - protein, 46 aa, Triticum aestivum
  Clone ID: PAT_TA_47666.pep
VRYGPTTRSTAISTNAAVNHRLRTDTPSTYREGNEAYCSHIRPLSR

SEQ ID NO: 153249 - protein, 50 aa, Triticum aestivum
  Clone ID: PAT_TA_47667.pep
QRLLEVIRVGAPPQMGRHVFQQVLQTLIRYVSMVPGVSVSPSLADSLYYQ

SEQ ID NO: 153250 - protein, 62 aa, Triticum aestivum
  Clone ID: PAT_TA_47668.pep
FLGTCDLGALVHYQDQLTESSDLPTISSQSKFRPTHEVKHVQIHQGYHRDAPADQSVERRGD

SEQ ID NO: 153251 - protein, 69 aa, Triticum aestivum
  Clone ID: PAT_TA_47669.pep
MVNATIMNICAARTSAHVRRLYNKEANSRVRMVVTGDDVSTMYAPVIRDGTIRTLYWTVTRNNPMGVCK

SEQ ID NO: 153252 - protein, 54 aa, Triticum aestivum
  Clone ID: PAT_TA_47670.pep
PCHMKQHTSWIPSRLHGPWLSDTLAGDLQHFQQRTGIPFSERHMYMRASASDIV

SEQ ID NO: 153253 - protein, 36 aa, Triticum aestivum
  Clone ID: PAT_TA_47671.pep
FISCTVYFKKNLAPLEEYNVCNDLLLNRINVSNNLN

SEQ ID NO: 153254 - protein, 83 aa, Triticum aestivum
  Clone ID: PAT_TA_47672.pep
HFRSSLSPMRQTRSADTFAQPPNDGMAQTPAGLCVRMVASPSRPMVSSAGMDTISKFFNFMIQCQVDIFRTSPSGSSRLPTWS

SEQ ID NO: 153255 - protein, 45 aa, Triticum aestivum
  Clone ID: PAT_TA_47673.pep
ALVVTGKFNVTHARFDDLMERAASRVVFYTVNKPGDVVCRTLRNT

SEQ ID NO: 153256 - protein, 55 aa, Triticum aestivum
  Clone ID: PAT_TA_47674.pep
SSSPRPDTPYCTRTALTEMGQSVDAVRSTVLDVKRVYKDVMLAWFSPLLSADGAL

SEQ ID NO: 153257 - protein, 93 aa, Triticum aestivum
  unsure (1)..(93): unsure at all Xaa locations
  Clone ID: PAT_TA_47675.pep
TGLTLKNLEGLNLGTMDQAKDSGLSSYVTXQIYRTLRWYDVXWLESITTMTILWKGVITAEDSWLAIHSGASWIILCKHXARQMKYVPATMSA

SEQ ID NO: 153258 - protein, 63 aa, Triticum aestivum
  Clone ID: PAT_TA_47676.pep
MACATLVKSRVIPKKAKWGTTRKVAVPKPTTVCMVVRARAYADELGKSAKTMRSTGTGILDMD

SEQ ID NO: 153259 - protein, 57 aa, Triticum aestivum
  Clone ID: PAT_TA_47677.pep
IMYIIHTEECTKHVCEHLWAGALSINTSQTKWAANTSYDPRRIIPNHTTSFGPHTYN

SEQ ID NO: 153260 - protein, 48 aa, Triticum aestivum
  Clone ID: PAT_TA_47678.pep
TVLRPRSPRSCRCRARAIARIWTRTRTSGRAPSHREFNSRRITVLVRR

SEQ ID NO: 153261 - protein, 93 aa, Triticum aestivum
  unsure (1)..(93): unsure at all Xaa locations
  Clone ID: PAT_TA_47679.pep
APMRPVLSNLMYEEDHGNESELGDIHVCAWVGAFDDAXKHVADDVHITILDTEERSTLHWAVDRDHLDAVLVIANXNADVNAHDIERQTALHY

SEQ ID NO: 153262 - protein, 52 aa, Triticum aestivum
  unsure (1)..(52): unsure at all Xaa locations
  Clone ID: PAT_TA_47680.pep
MKEILHIQGGQCGNQIVSKFXEVVCDEHGIYPTRRVVCTSVLHLERVNVYYN

SEQ ID NO: 153263 - protein, 123 aa, Triticum aestivum
  unsure (1)..(123): unsure at all Xaa locations
  Clone ID: PAT_TA_47681.pep
VPARTVSDIAVDPLVRLCLLMLDALLADAAGHGDTSRCSCSFHSSHNEEPDQHHDHSHSCSSAXDDINDERHHHYIHHNRDKMQMLISEELAKDAVIKLKGFENKHHEHYDHHQHHMHRDLQP

SEQ ID NO: 153264 - protein, 45 aa, Triticum aestivum
  Clone ID: PAT_TA_47682.pep
MLAARPQQMNGMLSCGVGTDSASGVRRGSLPNSLVRTHAWAYARV

SEQ ID NO: 153265 - protein, 61 aa, Triticum aestivum
  Clone ID: PAT_TA_47683.pep
ELAEARRQGLPPAPAMERGNPRHCASHAGFEHQTSAPAVYISGAGQGAPHCTGCQARRPTQ

SEQ ID NO: 153266 - protein, 33 aa, Triticum aestivum
  Clone ID: PAT_TA_47684.pep
RSPSNGSTINIMYTMRGPHDHNIPPAARCTGLT

SEQ ID NO: 153267 - protein, 73 aa, Triticum aestivum
  unsure (1)..(73): unsure at all Xaa locations
  Clone ID: PAT_TA_47685.pep
RAELNDKTRAATSGADLGRAYTVQFGRCXVKLQIDRLXDLTKQXKVTFMTDYLEIECEGKDKFKCGSNVLWKW

SEQ ID NO: 153268 - protein, 75 aa, Triticum aestivum
  Clone ID: PAT_TA_47686.pep
ALLRGRVVNNESAIITLLASTCEYSNSGVGYHVRIMVLQPTSFQTADDMGSDPRIINESAINTLLPSTSQYSGGG

SEQ ID NO: 153269 - protein, 92 aa, Triticum aestivum
  unsure (1)..(92): unsure at all Xaa locations
  Clone ID: PAT_TA_47687.pep
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 153270 - protein, 36 aa, Triticum aestivum
  Clone ID: PAT_TA_47688.pep
CETFSFTDTHDSECPYISQPEQLRVCTSVTRQVDGV

SEQ ID NO: 153271 - protein, 44 aa, Triticum aestivum
  Clone ID: PAT_TA_47689.pep
MLHMLHRRASYIVLTEPGLTVIIRAVLTRSCIFQRMYNYTIYAC

SEQ ID NO: 153272 - protein, 54 aa, Triticum aestivum
  Clone ID: PAT_TA_47690.pep
VVYIRVLYTSICLTHNHGIVVDLLDRLRCGGSNDASTLVVICVELHLGDGRLCG

SEQ ID NO: 153273 - protein, 86 aa, Triticum aestivum
  Clone ID: PAT_TA_47691.pep
GDIPLLLLLLPTTYHSWEDLILRSHTSSARTRGDALLPLEPNQAMGADDYRHGVGVPVVNLQPQPLDTGAQGQARGTIHVAWCVGR

SEQ ID NO: 153274 - protein, 51 aa, Triticum aestivum
  unsure (1)..(51): unsure at all Xaa locations
  Clone ID: PAT_TA_47692.pep
KVSCYRPLISMKRPELFTTNEKAAPCPYFNQCRIVDLCIKKRTXLDQKTYI

SEQ ID NO: 153275 - protein, 76 aa, Triticum aestivum
  unsure (1)..(76): unsure at all Xaa locations
  Clone ID: PAT_TA_47693.pep
GQTITLEAESSNTMDFVKAKIQDXEGIRTYQLRVILPSTQFEDGRTLADYNIQKESSLHLVLTLLAGMQICVKTLT

SEQ ID NO: 153276 - protein, 40 aa, Triticum aestivum
  Clone ID: PAT_TA_47694.pep
TDHDSTAACPKTLTKEDATYIRNTIIKDYYFQMYYDDLPL

SEQ ID NO: 153277 - protein, 36 aa, Triticum aestivum
  Clone ID: PAT_TA_47695.pep
KSGSKWLVITIPWAPLIPTSVCPVRNPYSACSMCQR

SEQ ID NO: 153278 - protein, 70 aa, Triticum aestivum
  unsure (1)..(70): unsure at all Xaa locations
  Clone ID: PAT_TA_47696.pep
HASACSSSYGAHAHHLCDLLTPACQPAMRPELTFYAAAFQPLSSAXRRRALWLLWQVRAKQPVADEEAKK

SEQ ID NO: 153279 - protein, 51 aa, Triticum aestivum
  Clone ID: PAT_TA_47697.pep
PSASDQYGDLLICAVIWIRLWQQVQLWNLRVRPAGAVVANHSRTCGRTRGR

SEQ ID NO: 153280 - protein, 68 aa, Triticum aestivum
  unsure (1)..(68): unsure at all Xaa locations
  Clone ID: PAT_TA_47698.pep
GFEMFKTEVYDKKPDFSXPLKXGHAPKYMLLACAYYRVCPSVTLGLEPWXAFTIRTIANMVQSYCKNK

SEQ ID NO: 153281 - protein, 73 aa, Triticum aestivum
  Clone ID: PAT_TA_47699.pep
GWSYWSFRSHSRPARRLAATSSSWWAPAVWSASALWPARVPIGTWPAADPREESERTPSPWMVFGVWIPLTID

SEQ ID NO: 153282 - protein, 83 aa, Triticum aestivum
  Clone ID: PAT_TA_47700.pep
MHRLLHGRPSSTEMAVGLSSTVGAPACTPTNLLGTKLTKHVTSAGNYHGESSTANRFTALARGKIVATMYTDKWKGFAYGMSY

SEQ ID NO: 153283 - protein, 79 aa, Triticum aestivum
  Clone ID: PAT_TA_47701.pep
DHAFDLAEIWLKCLIPVTEKWLHCFRYASIKVHSVYMPTAKLDFTYEHQEWVEHEANEVVDPSVLLYTEGLNALHQMAE

SEQ ID NO: 153284 - protein, 41 aa, Triticum aestivum
  Clone ID: PAT_TA_47702.pep
WWCENSHFKSHREGLMSPQTETIAGVGTTAGVKDHKLPYYT

SEQ ID NO: 153285 - protein, 72 aa, Triticum aestivum
  Clone ID: PAT_TA_47703.pep
PAAKHIASPCNLCVVLVVQSRFMLSNKDCSSGVDVADSSSISMRSSILVRSEAYRIQFMLAQIVGVYDMDSL

SEQ ID NO: 153286 - protein, 90 aa, Triticum aestivum
  unsure (1)..(90): unsure at all Xaa locations
  Clone ID: PAT_TA_47704.pep
ACTTSTAAANWCYSTVAPGARCSTIVASLGTSAPXKSSSLRRKLIRNSHVQGEPVEPALESGRGEERNNRRLAAGTPAPYFMMSGWLCLA

SEQ ID NO: 153287 - protein, 89 aa, Triticum aestivum
  Clone ID: PAT_TA_47705.pep
GCCENSHFKSHREGLMSPQTETNAGGGSKAGGIDHKLPYYTPEYETKDTDMLAALQVSPQPVAPPVEARAAVAALSYTGTWTTAWADGL

SEQ ID NO: 153288 - protein, 77 aa, Triticum aestivum
  Clone ID: PAT_TA_47706.pep
YAQPRFAELVAVRLVSLAAAAEHVVGVARTTSESFGESRRCALSEATEGVWLRLVSILAASLSAAIGIRLVFFYDVG

SEQ ID NO: 153289 - protein, 72 aa, Triticum aestivum
  unsure (1)..(72): unsure at all Xaa locations
  Clone ID: PAT_TA_47707.pep
MAFCTPHSNTYVXCTCTTIPYSRLTQNQVILFTTRSTWRSNTQHGTRTLQVXCATEHAIKIALCADSACGKY

SEQ ID NO: 153290 - protein, 38 aa, Triticum aestivum
  Clone ID: PAT_TA_47708.pep
ARAYLNRGVLIRARAWPPHPSYDSTDVDLDSLLRQQKR

SEQ ID NO: 153291 - protein, 75 aa, Triticum aestivum
  Clone ID: PAT_TA_47709.pep
ARHRPRGLCSVSRERTPALWRIHGGGNRSNSGFRVDRQQHDYCALRGPELAQLLRAEVDAHPLVVPRAAATVRVW

SEQ ID NO: 153292 - protein, 47 aa, Triticum aestivum
  Clone ID: PAT_TA_47710.pep
DLHEDAVCDPGRSWSAFEPQHGRPWRCPVCRRGVGYGTATRTARVGV

SEQ ID NO: 153293 - protein, 84 aa, Triticum aestivum
  Clone ID: PAT_TA_47711.pep
LTRVQPADHERYFVRPDDRRSPYKSEAITRTMSLSALYPDSPMSIPAACKMVERLLCLLEGAGQEHQLYSDHWFTQHQIYEDLS

SEQ ID NO: 153294 - protein, 46 aa, Triticum aestivum
  Clone ID: PAT_TA_47712.pep
MDPYKYRPSSSFNAAMRSTNSGAHVWDNYNCMTVRCRGKILIEDYH

SEQ ID NO: 153295 - protein, 54 aa, Triticum aestivum
  Clone ID: PAT_TA_47713.pep
MAHCSASGMGTQGGLPTDRTPSDSAAGDKKDKKLKPPNRPVPMGRKQWKQRGPY

SEQ ID NO: 153296 - protein, 82 aa, Triticum aestivum
  Clone ID: PAT_TA_47714.pep
TLTPCVEKIIQPSDTRREMDCTMSTGSAHRSEDVQSVPDYLYGERQGCGDLYDRLAAIIDPSESQYFRGVLLNHKQFLPECP

SEQ ID NO: 153297 - protein, 34 aa, Triticum aestivum
  Clone ID: PAT_TA_47715.pep
GATEGVDLPALATASCWVLGGRCGWIVRVGRRVV

SEQ ID NO: 153298 - protein, 47 aa, Triticum aestivum
  Clone ID: PAT_TA_47716.pep
APAAGPSLCLAGHGGCRLHMSGSSPRFIPSRYRVRRTKDIYLLHAQK

SEQ ID NO: 153299 - protein, 67 aa, Triticum aestivum
  Clone ID: PAT_TA_47717.pep
MACATIVKSRFIPKKAKWGATRKAAVPKPTTVCMVVRAKAYADELVKTAKTMRSTGTGILDMDESNA

SEQ ID NO: 153300 - protein, 47 aa, Triticum aestivum
  Clone ID: PAT_TA_47718.pep
AGRSSPSRAKKEKDSYVGLLSVEVIMHVRVWRPLSQDLSVCTGSVVS

SEQ ID NO: 153301 - protein, 50 aa, Triticum aestivum
  Clone ID: PAT_TA_47719.pep
CNTAVVPILTNMRYNAANICISPDVTTEEPRYGFEDEYTLLQKDINGPMG

SEQ ID NO: 153302 - protein, 80 aa, Triticum aestivum
  Clone ID: PAT_TA_47720.pep
AIRFSHLHHMCSWSMQHPAYAHGAAHVSQCLRQLGCQCPTECSPIPHERFFRHSCAADIFLRTATLILIHSLWHSRRRVD

SEQ ID NO: 153303 - protein, 88 aa, Triticum aestivum
  Clone ID: PAT_TA_47721.pep
GPRKIALSKTRVLTRNRGLLNNPAWPFTRFWGRLRLAFPKVLKKVRSFPPYRPKNRGKIPSLLLTIHPENSIAVGGRSSIKFGCGCGP

SEQ ID NO: 153304 - protein, 52 aa, Triticum aestivum
  Clone ID: PAT_TA_47722.pep
QGGGRRVKKKVHALVDEKYVSRARASKSVTCICEDGMAAMNIDLRGLASMPT

SEQ ID NO: 153305 - protein, 58 aa, Triticum aestivum
  Clone ID: PAT_TA_47723.pep
LCLLMLAALLADAAGHGDTSRCSCSFHSSHKEEPDEHHDHSHSCSGAIDDINDERHHH

SEQ ID NO: 153306 - protein, 46 aa, Triticum aestivum
  unsure (1)..(46): unsure at all Xaa locations
  Clone ID: PAT_TA_47724.pep
MAKPISIEARNPCGKYRVVSTXFMPSTRWIKVLTNKECRLEICSGN

SEQ ID NO: 153307 - protein, 59 aa, Triticum aestivum
  Clone ID: PAT_TA_47725.pep
CAWFHPEHARAPAAPALRQDRRGTQDLRVTSDNYCCAQAREEPQTVPSSNGDHNQEAKD

SEQ ID NO: 153308 - protein, 74 aa, Triticum aestivum
  Clone ID: PAT_TA_47726.pep
VLPSQGTSTTERATVAILSAGRVLLIDDSGTALRGPARRDGRSPEQCGVLLTQETARERAAIVCFHGLSAGSHV

SEQ ID NO: 153309 - protein, 56 aa, Triticum aestivum
  Clone ID: PAT_TA_47727.pep
CGQYSSSRGFDMGIGSSLRSFLLRTPCIGWLLRRRHPGRRGRRPSESAETYSARTS

SEQ ID NO: 153310 - protein, 51 aa, Triticum aestivum
  Clone ID: PAT_TA_47728.pep
RDIPLRDDPPSRLYADACGALVWCRLQRLRLLCGPLGFGTLITIACRLRSC

SEQ ID NO: 153311 - protein, 53 aa, Triticum aestivum
  Clone ID: PAT_TA_47729.pep
RLQPPTNRRRRSHAAHEALGIFLSDRIHAELYTRIQSQRRRASSSLPFTPATT

SEQ ID NO: 153312 - protein, 68 aa, Triticum aestivum
  Clone ID: PAT_TA_47730.pep
SISGQSTYTSSPWRFNEASDRVNMATPPSVSVCMGSANMVCRRAYGLDIAYDNGLLLGSHYLTRHAST

SEQ ID NO: 153313 - protein, 44 aa, Triticum aestivum
  Clone ID: PAT_TA_47731.pep
VHFAISQTVLLGIWVLSALCYSAEPLCWSSKLRVALCYPMVSKL

SEQ ID NO: 153314 - protein, 81 aa, Triticum aestivum
  Clone ID: PAT_TA_47732.pep
GVVHVLDSYVSLTLGRLLDQRIVQSRASGGHQHSTVFCSPALYADRSPSPAAGVGHEIGRTAGQSRLRDPSSGGSIRSKSA

SEQ ID NO: 153315 - protein, 84 aa, Triticum aestivum
  Clone ID: PAT_TA_47733.pep
PCYLREEVDSLKVPPVHGTEINKGLGVAVCNVEDHHERRRLEHQYHSSPPLPCHRLSCPPYQRVAVASVRLAPEKGGRNGARNS

SEQ ID NO: 153316 - protein, 91 aa, Triticum aestivum
  Clone ID: PAT_TA_47734.pep
ILVGVPRSLSLNSSTSSFPPRQSIAVSLSKMTAPNYKPVTAILHQHMQVCSGCFSILNLGSRVRHSCHLHRSSWDLLVKGAQIQSKLIAAQ

SEQ ID NO: 153317 - protein, 85 aa, Triticum aestivum
  Clone ID: PAT_TA_47735.pep
MNFYEHFNFTAKQAGSTVLLFAEVIPDEEELCDVLCCKPLDSDDNGHCFGCKNQGSVDLRHPAGGSLYVGGHVDCEFPFMWDSIR

SEQ ID NO: 153318 - protein, 93 aa, Triticum aestivum
  unsure (1)..(93): unsure at all Xaa locations
  Clone ID: PAT_TA_47736.pep
MATAMMAAATTSCSPRRALLKPAASSSSAPPPRPQSRFFLKQILGLAAXTSAAAADVSVPIPAXLAVVMEMAALFYFNLTLLAITIEXLLLMV

SEQ ID NO: 153319 - protein, 51 aa, Triticum aestivum
  Clone ID: PAT_TA_47737.pep
IPSGRPGDQGPPALTTYRGGCFLGGFRPGSNRPVKALWKFFKGIPGPTGGK

SEQ ID NO: 153320 - protein, 156 aa, Triticum aestivum
  Clone ID: PAT_TA_47738.pep
RAQLLSKLTTSTNTVARIIRMLDWTSPKDKTIRLYATKVTAELAKDLRVVAFPGTMQTVSALLDADSSPKRGNPLLDTDDEQEERQDQFLKTEDSQEQEHHTVRDVAVNQSQRQDPLQDTNYLLEETQTRSTQQPLVDKKNSYIIRCWQRIKELHS

SEQ ID NO: 153321 - protein, 63 aa, Triticum aestivum
  unsure (1)..(63): unsure at all Xaa locations
  Clone ID: PAT_TA_47739.pep
LLHELIIEAINHVCAIICSSCWTPYGFAEVYAGVEHVRXNVRRNYFSHCFRQKLRDQVSAQVC

SEQ ID NO: 153322 - protein, 54 aa, Triticum aestivum
  Clone ID: PAT_TA_47740.pep
REVYWLMNSIPWLTLIFVRLPPFPKYESFRAPLANCSDAFIASRARSRLVFLSW

SEQ ID NO: 153323 - protein, 155 aa, Triticum aestivum
  Clone ID: PAT_TA_47741.pep
MSWWWAGAIGAAKKKLDEDEPSQSFESVALIIGVTGIVGNSLAEILPLSDTPGGPWKVYGVARRPRPTWNADHPIDYIQCDVSDAEDTRSKLSPLTDVTHVFYVTWTNRESESENCEANGSMLRNVLQAIIPYAPNLRHVCLQTGTKHYLGPFTN

SEQ ID NO: 153324 - protein, 66 aa, Triticum aestivum
  Clone ID: PAT_TA_47742.pep
SAERLSQPRKLKQLHFDHSNAFPYPLRTERPLQHRFLCSAAEGANSRSLARTTWTIYGWYGSSCVL

SEQ ID NO: 153325 - protein, 92 aa, Triticum aestivum
  unsure (1)..(92): unsure at all Xaa locations
  Clone ID: PAT_TA_47743.pep
EKSYWKRHREALTSPQTDAEARAGFKDGEXDYYSTYYATKDAAIDTDILAGSQVGAQPEEAPAEAGAASSAESCTAAWTAGRTDGLTSLGRC

SEQ ID NO: 153326 - protein, 102 aa, Triticum aestivum
  Clone ID: PAT_TA_47744.pep
MRRAPSATARLRTLSFDDLSRTLALSGMHAFTVAELRAATRNFSGSHFIGEGGFGPVYKGFLDDKVVPGMQPQHVAGKYLDAEGLEGHREWLGEVGYLGMQL

SEQ ID NO: 153327 - protein, 85 aa, Triticum aestivum
  Clone ID: PAT_TA_47745.pep
MVFVKNQKTRAYSKRFQVKFKRRRQGKTDYRARLRLTNQDKNKYNTPKYRFVVRFVSLSCSLSRFALVNRLFISIGVIYGHSFYY

SEQ ID NO: 153328 - protein, 117 aa, Triticum aestivum
  unsure (1)..(117): unsure at all Xaa locations
  Clone ID: PAT_TA_47746.pep
MASGGGAVREVGSKAELDEAVGGARADAVHFWAAWCEASKQMDEVFAHLAVDFPHALFLRVEAEEQPEISEAYGVTAVPYFVFCKEGKPVDTLEGXNPSSLANKVAKLAGPANVAES

SEQ ID NO: 153329 - protein, 133 aa, Triticum aestivum
  Clone ID: PAT_TA_47747.pep
VINRSAKLFIVHKLTPNGRLLQIPPHRNINNSSVRFHGFIPRRRFRVASPAQLLPLSPLSHTFSWISLALPRGQEEKSHSPTLSPSLFLTPVQVSPPLRQGLSRNPGSCHTRRSASSAGAPVEVDPAILVEHH

SEQ ID NO: 153330 - protein, 117 aa, Triticum aestivum
  Clone ID: PAT_TA_47748.pep
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSKAFQDCINHYGS

SEQ ID NO: 153331 - protein, 58 aa, Triticum aestivum
  unsure (1)..(58): unsure at all Xaa locations
  Clone ID: PAT_TA_47749.pep
GLLISPAASRVSPHALVATDQAGARVSAPSLTRTXATEWTDGLTRLDRYRRLCYHIEP

SEQ ID NO: 153332 - protein, 117 aa, Triticum aestivum
  Clone ID: PAT_TA_47750.pep
PRVRDEVTAMVESVHRAAAGPGNEGKPLVVRNHLAMVSFNNITRLAFGKRFMNANGDIDEEGQEFKIIVNNGIKIGASLSVAEYIWYLRWLCPLNEELYKTHNERRDRLTKKIIEEH

SEQ ID NO: 153333 - protein, 97 aa, Triticum aestivum
  unsure (1)..(97): unsure at all Xaa locations
  Clone ID: PAT_TA_47751.pep
IGYALVPMIARGVMLGADQPVILHMLDIEFAAEALKGVKMELIYAAFPLLKGVVATTDVGEACTXXNVAVMVXGFHRKEGMERNDDMTKYVSIYKAQ

SEQ ID NO: 153334 - protein, 118 aa, Triticum aestivum
  Clone ID: PAT_TA_47752.pep
LQCAESVNSDDLDEAQRALLEIAELATPFGTSTQRVAAYFAEAMSARLVSSCLGLYAPLPNASSPAASRLVNSRVAAAFQVFNGISPFVKFSHFTANQAIQEAFEREDRVHIVDLDIM

SEQ ID NO: 153335 - protein, 111 aa, Triticum aestivum
  Clone ID: PAT_TA_47753.pep
VPSCLLQESSKVVEDGCPECAVSFSPLHKSIKQLEKAAMKIHMEKKVCEQKFDWKAAFTEISSYKTCTLLMTIRAASREMGPKHEGTHTESQRDERPLDRLMMGERAFTNR

SEQ ID NO: 153336 - protein, 115 aa, Triticum aestivum
  Clone ID: PAT_TA_47754.pep
MSYLLSYISKMLCIRTPSSSEEAAAKRPAAGEECCVCLSRIRAGEATRRLPCEHAFHRDCVDRWLALCKRTCPLCRVYVADGNGGGRQAAAKHAGEGALADDLVIWFSTMLVPGF

SEQ ID NO: 153337 - protein, 58 aa, Triticum aestivum
  Clone ID: PAT_TA_47755.pep
FGSDLTVATRSLQTLASYLPRAAVSGALGPSAPSNRRWLREVPLPSVALFSIAAHPEG

SEQ ID NO: 153338 - protein, 111 aa, Triticum aestivum
  unsure (1)..(111): unsure at all Xaa locations
  Clone ID: PAT_TA_47756.pep
MGTMEEKPALGLGSLVXSLKVVYKSVSTSTLPWRRSQLKGLIRLLTEKEEEIFNPLHDDLVKPRTESLIDEVRVVVKSIKHTLENLERWAAPEKAPTPLVSFPATALVLPE

SEQ ID NO: 153339 - protein, 55 aa, Triticum aestivum
  unsure (1)..(55): unsure at all Xaa locations
  Clone ID: PAT_TA_47757.pep
MVLTCAYGSCFTFERNVMGGLXIQSWAIPRYNFYYGLNWDKEAFNYLVVKVICEA

SEQ ID NO: 153340 - protein, 53 aa, Triticum aestivum
  unsure (1)..(53): unsure at all Xaa locations
  Clone ID: PAT_TA_47758.pep
NGASLNSVSNGGRITFMHVWPIEGIKKLETLTYLPPVITEALXLKHMDYLDPL

SEQ ID NO: 153341 - protein, 48 aa, Triticum aestivum
  Clone ID: PAT_TA_47759.pep
FKSYREGLMSPQTETKAGGGFKAGVEDYKLTYYTSEYETKVSVILAAI

SEQ ID NO: 153342 - protein, 57 aa, Triticum aestivum
  Clone ID: PAT_TA_47760.pep
KILSMALLLKKHDSASITAYEDLAAFSTDGKRANILVASGPLIYDGRIEIKSILCPA

SEQ ID NO: 153343 - protein, 81 aa, Triticum aestivum
  Clone ID: PAT_TA_47761.pep
WRLNIGLRCLLASTGRGRRPTEYGKNCCAVEGHVPLMFFRSFSLCNLTCYRHTLFLYIGTFAYLGARLIIFKLNFSLTVIA

SEQ ID NO: 153344 - protein, 132 aa, Triticum aestivum
  Clone ID: PAT_TA_47762.pep
KLREGKRRKTIPSRRSMSRRKNQGTPQMARSRRRRASGTAAHRPANPKVLYCVPIVKNPNPQGILEQWWRQWEAGWEESTEGEKETNTGAVDRRRAAAADAPDEEDGDGVADHHRNSSCFSLRRLNCPEGTV

SEQ ID NO: 153345 - protein, 152 aa, Triticum aestivum
  unsure (1)..(152): unsure at all Xaa locations
  Clone ID: PAT_TA_47763.pep
SEATEPMIKELEEEREESQDPEIEFAISGAVRECGGLEIILSMIQSLRDDELRSNQDELASVLNLLKYXCKIRENRCALLRLGALGLLLETARRAFSVDAMEPAEGILLIEESLTLEANAXHKYLAKSILQLSGEETGACEQAKKIVLMFLE

SEQ ID NO: 153346 - protein, 151 aa, Triticum aestivum
  unsure (1)..(151): unsure at all Xaa locations
  Clone ID: PAT_TA_47764.pep
HASAHASVLIHRHRLRSLAASPRLPDRPRPRLHRPVSASAAPNGSSSAGEYDYDLFTIGAGSGGVRASRFATTLYGARAAICEMPFSTISADDLGGLGGTCVLRGCVPKKLLVYASKFSXEFEESHGFGWTYDTDPKHDLGTLIAQQNTEL

SEQ ID NO: 153347 - protein, 92 aa, Triticum aestivum
  unsure (1)..(92): unsure at all Xaa locations
  Clone ID: PAT_TA_47765.pep
MSSGTGKVVCVTGAFCYMGWWLDKFLXLHRGYTVRSSFWYTAYLKKTLHLLASGWSXDRLYLVKAGLLYEGFFYDACFGCXCVIHTVYTFYY

SEQ ID NO: 153348 - protein, 47 aa, Triticum aestivum
  Clone ID: PAT_TA_47766.pep
WEQKEFAFTFLLMGVMFCMAVGVFFVVTVDIHFAHIYMQGDDALIAF

SEQ ID NO: 153349 - protein, 85 aa, Triticum aestivum
  Clone ID: PAT_TA_47767.pep
VHVVVLEVVVRQHLLVVSPRHGSSCGWIGNTCSMWVSTALPFRSSGCVCSAVSCGTAQSARARAPSSSNGSRSVSSSPCTEADVS

SEQ ID NO: 153350 - protein, 126 aa, Triticum aestivum
  unsure (1)..(126): unsure at all Xaa locations
  Clone ID: PAT_TA_47768.pep
MQIFVKTLTGKTITLEVESSDTIDNVKAKIQDKEGIPPDQQRLIFAGKQLEDGRTLADYNIQKESTLHLVLRLRGGMQIFVKTLTGKTIXLEVESSDTIDNVKAKIQDKEGIPPDQQRLIFAGKQL

SEQ ID NO: 153351 - protein, 137 aa, Triticum aestivum
  unsure (1)..(137): unsure at all Xaa locations
  Clone ID: PAT_TA_47769.pep
RGFKACVKEFKLSYYTPEYETKVTDIWAAFRVSSYSGVSTEEAGAAAAVESSTVTWTIVWTDGLTSLDRYKGRCYYIXLYAGEDSQWILXVAYPLDLFEEGFVTNMFTFIVSNLFXFHNLCALRLDDALISFFYLKT

SEQ ID NO: 153352 - protein, 26 aa, Triticum aestivum
  Clone ID: PAT_TA_47770.pep
QYTSVKNALILWDGGSISDFSVTYVL

SEQ ID NO: 153353 - protein, 51 aa, Triticum aestivum
  Clone ID: PAT_TA_47771.pep
CGVSHTCCPPVHIMCLEFIVLTTLFSRLTVQLHVQLLPQRNVLALLRKELE

SEQ ID NO: 153354 - protein, 44 aa, Triticum aestivum
  Clone ID: PAT_TA_47772.pep
IMDYLTEGLDEYGADAHHFRRNVNDYPSLKGGSVVYFMSGYDHE

SEQ ID NO: 153355 - protein, 115 aa, Triticum aestivum
  unsure (1)..(115): unsure at all Xaa locations
  Clone ID: PAT_TA_47773.pep
DTFKFXLRHSLVIKGWEQGIKTMKKGNNAVFTIPNELAYGESALPPTIRANATLQIDVELLSWTSDRDMCKDGGIFMKILVDGDKWANXKDTXEVFVINKACLKDGTVGVQFEGA

SEQ ID NO: 153356 - protein, 49 aa, Triticum aestivum
  Clone ID: PAT_TA_47774.pep
NMTALDTLWLFFFKKLKVKRRSVVYVCISARLDGVVSDRELAASCCMAV

SEQ ID NO: 153357 - protein, 38 aa, Triticum aestivum
  Clone ID: PAT_TA_47775.pep
SILDTSEISRTPPVSLTRPHRILPGCLPLKNSEYRQRP

SEQ ID NO: 153358 - protein, 94 aa, Triticum aestivum
  Clone ID: PAT_TA_47776.pep
LILQAEVFFLGQLRHRNLVKLVGYCYEEEHRMLAYEYMGTASLEKHLFRSIDGPMPWMTRMKIAVGAAKGLAFLHGADTPVIFRDLKASNILLD

SEQ ID NO: 153359 - protein, 58 aa, Triticum aestivum
  Clone ID: PAT_TA_47777.pep
MLSLLPIFCANYCPLDFRYSWSIFPKDAKSTMFHLKSVISMDKKYTLCCRQSNTDLLA

SEQ ID NO: 153360 - protein, 63 aa, Triticum aestivum
  Clone ID: PAT_TA_47778.pep
QNLSDPLSYPPSNLLGPRPWQDQFHSHQTQRLEKEFIKRYCTLPLPCFPPTRQVGGVAYFWLD

SEQ ID NO: 153361 - protein, 103 aa, Triticum aestivum
  Clone ID: PAT_TA_47779.pep
TRELLLSAVLVTILPLQSKLKCHRPFCLYSSPACLTTPKLRYHSLKGQRIAHMRPCRSRHRLESVVSDSIVSVVAWSESLKLVIVAGPLLQTSMAPTGVGEIS

SEQ ID NO: 153362 - protein, 104 aa, Triticum aestivum
  Clone ID: PAT_TA_47780.pep
MAQTMASMSRLSQGVRLPGPAGRRASRFTVRASSAEAEAAGRRAVLGLMASGVVGSAFAQVVHAGTGAAIKVGPPPPIFGGLPGTDNLDEARDFDLPLKNRFYL

SEQ ID NO: 153363 - protein, 153 aa, Triticum aestivum
  Clone ID: PAT_TA_47781.pep
CWDPWPPSRPSTGEKKKKIQTEQQQKKRTPPSARTQPRARPAYVCLQEKIADATSNNTGITTSTIGIQTTYGNRDEEHEDEEAVLEAAGVGGGAAEREAAHHWLQTGNTQWDPLLPSFLPSSLTGGGGEKQICFLSSSGGRWTEKAGLIRGSP

SEQ ID NO: 153364 - protein, 39 aa, Triticum aestivum
  Clone ID: PAT_TA_47782.pep
EHWLHSIDSYIYTLRAHVVLDGRQSINSPSCRCRYVLGR

SEQ ID NO: 153365 - protein, 52 aa, Triticum aestivum
  Clone ID: PAT_TA_47783.pep
GPCLSKGRRCERVTMQPRSLQRGRPSRRSASRLLPWMMALSSFGRVSTERVG

SEQ ID NO: 153366 - protein, 84 aa, Triticum aestivum
  Clone ID: PAT_TA_47784.pep
NLIEQLGLTTSRNTYIGDEGTRGVSGGERRRVSIGVDIIHGPALLFLDEPTSGLDSTSAHSVIEKVHDIACAGSTVVLTIHQPS

SEQ ID NO: 153367 - protein, 55 aa, Triticum aestivum
  Clone ID: PAT_TA_47785.pep
TRTLSLNYELRQWRLSGGLRCWGPGTTSSDLCKYATTAPTGGAQKSVYLYDRFKK

SEQ ID NO: 153368 - protein, 80 aa, Triticum aestivum
  Clone ID: PAT_TA_47786.pep
ISASYTPGPSCRGARRLRFFVPISTMILVPILLCVLFLTCKHRVFTAIVMKTAAVAQSGYTVAVTAADMPNIPTSSKSNH

SEQ ID NO: 153369 - protein, 117 aa, Triticum aestivum
  unsure (1)..(117): unsure at all Xaa locations
  Clone ID: PAT_TA_47787.pep
MSMLGSVIACAVGKQILSKLSSEITLQCGYREKVLXMEEKMKGVEALLGDADNRSRRQGQXGGRVFQSWLTKLKHACYDMEDVLDELDANKLINNTQPRVTNSSAIYICDFASTLGY

SEQ ID NO: 153370 - protein, 100 aa, Triticum aestivum
  unsure (1)..(100): unsure at all Xaa locations
  Clone ID: PAT_TA_47788.pep
MDRTLLEGGNWKCNGTKQQVESIVHTMDARQIASTDVANGLXRPTYVFLTTAWGSLRPEIQGTAQTWSVEKGDAFTEQVSAEDACPPKGHLCHTKTLLKE

SEQ ID NO: 153371 - protein, 60 aa, Triticum aestivum
  Clone ID: PAT_TA_47789.pep
QRGYDHMSLVTNGCYNLLCQTGVQKSRVNCSLVKSVAAGDVIFGASIDIKEVGPLASIGG

SEQ ID NO: 153372 - protein, 82 aa, Triticum aestivum
  Clone ID: PAT_TA_47790.pep
LTMAYVGFGSSVAAGAPASEDEPYAPQRTRLRAPATAPRRNKGAQASTAFRWEFYFRPEACGCLVSYASIMVLRRAVTRDLS

SEQ ID NO: 153373 - protein, 82 aa, Triticum aestivum
  Clone ID: PAT_TA_47791.pep
VPTSPRRLVLSVESTTYHRRSLLIPTVHLHIPAVHVWQWHHNSSNWFVINCSSLYCFIDMLCAKLDSFTGENQERAEQLNCS

SEQ ID NO: 153374 - protein, 161 aa, Triticum aestivum
  unsure (1)..(161): unsure at all Xaa locations
  Clone ID: PAT_TA_47792.pep
LHDAARSASDIELTEPRLSPIIRAVLTRRCISXSMKNSTTYAATITIPIALCFMLTALLXNSDRDPFMVLIMAIINGGAILTTSMDRSNPFPLPYSWELNEIFDAVVALGAYLALMTVVFSVVIHKTNFLTNKFGVRLITDSEFDMMSALYLPVSLVSQAL

SEQ ID NO: 153375 - protein, 59 aa, Triticum aestivum
  Clone ID: PAT_TA_47793.pep
SPPCWPRRSRRAHRSASFPSPGPPVPPSSRTPAPPRTAEARPPAPGEPIPSPPPSTSRT

SEQ ID NO: 153376 - protein, 161 aa, Triticum aestivum
  Clone ID: PAT_TA_47794.pep
EMVARWENSMSTEGLSEIDTCPEFQNFTGDVIARTSFGSNYQEGKKIFELQGELAKRLMQAFQTFFIPGYWFLPTKNNRRMRAIDHEIRMIMRGIIGKKERAIKNGEASSNDLLGLLLESNMQQSNGKAGQGMSIDDIIEECKLFYFAGMETTSVLLTWTL

SEQ ID NO: 153377 - protein, 101 aa, Triticum aestivum
  Clone ID: PAT_TA_47795.pep
VPSVGQLPPQVPQVARVRVRVAKHPQLLPTMTAPPLLAAGRAAVRRRSGQQHPDHQHRQAEKGSGGGRRRRAAPATLHGVPRPLWRCGTWPASRPSAALRA

SEQ ID NO: 153378 - protein, 108 aa, Triticum aestivum
  unsure (1)..(108): unsure at all Xaa locations
  Clone ID: PAT_TA_47796.pep
MLSKTETKAGVDFKACDKDYKXLTYYTSKYXTNDTDILTAFRVSPQAGVPPXEAGPVVAVENSTGTLTNFWTDGLTKFDRYKGRCYHIKPLCVEDNQRICYVAYSLNL

SEQ ID NO: 153379 - protein, 55 aa, Triticum aestivum
  Clone ID: PAT_TA_47797.pep
IVHASNNMPPFTAQAMNMMLPRLMLSQGPSRLVRIESRIMLIFDSDHLICLPTRP

SEQ ID NO: 153380 - protein, 55 aa, Triticum aestivum
  Clone ID: PAT_TA_47798.pep
NFVCLIFHAPCNKMNNWAAFSVASHLILMLCQCVLGLPLPGVFWIWVAKKPSCSF

SEQ ID NO: 153381 - protein, 91 aa, Triticum aestivum
  unsure (1)..(91): unsure at all Xaa locations
  Clone ID: PAT_TA_47799.pep
MAVAFTSTVGAPASTSTNFLGKKLKKHVTSDVNYHGKSFKANRFTVMVEENIVEKRNTDKWXGLADEISDDQHDITXGKGIVDSLLQAPTG

SEQ ID NO: 153382 - protein, 120 aa, Triticum aestivum
  unsure (1)..(120): unsure at all Xaa locations
  Clone ID: PAT_TA_47800.pep
LKSFDVARQILISGRVQSRKQAGNLQHPLVCIDAVEEGIVSGPRAGLRKEAMAFQELFFXFTCKSLIHVFFSQRATSKVPGVTYLSLLPRKVSKVAIVGGXPMGFSDRTTLILSHFSVIL

SEQ ID NO: 153383 - protein, 83 aa, Triticum aestivum
  unsure (1)..(83): unsure at all Xaa locations
  Clone ID: PAT_TA_47801.pep
MDIYMVDRSLMRQGRHELASFQRLKSTGWVMVSRYLHGDSLDXCCNGGRVRCMHVRPIQGIGKSETLFNLPQISTGGPAQGWR

SEQ ID NO: 153384 - protein, 78 aa, Triticum aestivum
  Clone ID: PAT_TA_47802.pep
SRKGARCLGEGLRQYYLLYMHELQLQIRQKTHNLNRVEAQRNDVNCPGRMLMVELQLLHDPGYYVGEEDNDKVKTKVL

SEQ ID NO: 153385 - protein, 74 aa, Triticum aestivum
  Clone ID: PAT_TA_47803.pep
CFGPFNSFLFSLLAPDCRSAYSYICVLLFSDASLHQPCRWPLGADQEVHPMNQTAMGHTIIRRAWLSLRSYPPP

SEQ ID NO: 153386 - protein, 60 aa, Triticum aestivum
  Clone ID: PAT_TA_47804.pep
TMDTTTPSQVCYGTHHRTSQTQQRVPIDCGGATVVRGHSYHMASCTTRWALTPTLLRTPR

SEQ ID NO: 153387 - protein, 136 aa, Triticum aestivum
  unsure (1)..(136): unsure at all Xaa locations
  Clone ID: PAT_TA_47805.pep
IARRELRKLKMAARDTENLKVEKEKLEEHVEELTSRLGLEMKLRADLENSKAGEISKLQAALREMEHRVEEATAVQESESAKRAVEEALAQEREKITILTNEVEGIKVLLSRERXENTCNKDDLAIAXERCEDLDG

SEQ ID NO: 153388 - protein, 103 aa, Triticum aestivum
  Clone ID: PAT_TA_47806.pep
MARRSGGGRSSRPAPRAAPVRNPPAPARQAPPPATTQNSGGGIMSGIGSTIAQGMAFGTGSAMAHRAVDAVMGPRTIQHETVVGEAAASMTPMDNAADDSVAT

SEQ ID NO: 153389 - protein, 48 aa, Triticum aestivum
  Clone ID: PAT_TA_47807.pep
VAVGLSNAICAIHISSSISDGCVLHVEEHYGLAKYEWCLTPNPQWLGL

SEQ ID NO: 153390 - protein, 107 aa, Triticum aestivum
  Clone ID: PAT_TA_47808.pep
AVDHQVDLRNHNNAVRYARLDRVDKCLCVLQLKRVDYPYGHHHARPVHRFNLAIPQVDRHGCAVSYLSTHPAEAFVAMGYPSSSCSAVSPRRHNPRAPPHRGKGGCG

SEQ ID NO: 153391 - protein, 104 aa, Triticum aestivum
  Clone ID: PAT_TA_47809.pep
KEEGRGTGKRATLWRQQPVDRRIEFACGGGRFGLPPAPALPRSLSFLRGEGEALLTAPIHRGHGGRLPATCPARAAINGCRAGAMPPAYVPPRPRYFRPPSPPG

SEQ ID NO: 153392 - protein, 98 aa, Triticum aestivum
  Clone ID: PAT_TA_47810.pep
CGHHSGPDNACACPRTPFPPAHTTVVNPPSARHTVRASLLSLAGENPLLRGDELRRFGGALRARMQQMATTVTLLARAASFPRDGAARDGVQCSRMLP

SEQ ID NO: 153393 - protein, 144 aa, Triticum aestivum
  Clone ID: PAT_TA_47811.pep
MTHSLEHLARPLPFLTLNLNPSSSAESHGGPSPLLQPDGAILGQGVCNHFVRTGTCKFGDACRYFHPKPHAVNPALAPSGPVPGAMGQQSNCLGTQPNFVGYPAWEGNSFSGNILTGHTSWGNLPPSLQPPPEGGYPPLPFVDW

SEQ ID NO: 153394 - protein, 82 aa, Triticum aestivum
  Clone ID: PAT_TA_47812.pep
ILKKILMQMVKHSGQGEAASETVEFCLRALEDFDLALHESPSNGSASIEAMRSKIIDIIEALDNILQIVPLKLMPKGRMLGD

SEQ ID NO: 153395 - protein, 87 aa, Triticum aestivum
  Clone ID: PAT_TA_47813.pep
KACTARTEPHARASPRSPQIRISPGRRPAAALDLEPPLAIAEYGGRGGDGDGVHGEARGWLGGSRSGRVWYEGERASAGADAWADAW

SEQ ID NO: 153396 - protein, 93 aa, Triticum aestivum
  Clone ID: PAT_TA_47814.pep
MGRGKVVLQRIENKISRQVTFAKRRNGLLKKAYELSLLCDAEVALVLFSHAGRLYQFSSSSNMLKTLERYQRYIFASQDAAVPTRDEKQNNYL

SEQ ID NO: 153397 - protein, 135 aa, Triticum aestivum
  Clone ID: PAT_TA_47815.pep
MMEERLASHKRAPRKPKPPPRRTKPTVPAAPTSSPSLTGPPRPPGVPPPPGPPPRLPGGPVPPAPSMKVPGKGRAPVAVGGGGERMRRAPEIVEFYQSLTRRGEARQAGSRGPKASGGSTAPKSDLIGEITKNSP

SEQ ID NO: 153398 - protein, 45 aa, Triticum aestivum
  Clone ID: PAT_TA_47816.pep
ICFPWKTDNSSFIHYHGNKGGAFDLMAMGLDGTVSITYYLALRSC

SEQ ID NO: 153399 - protein, 109 aa, Triticum aestivum
  Clone ID: PAT_TA_47817.pep
APSLAGYIIDYEFTLELALKLGGGLHIFVQTLTETTITLEVELYVTIYDAMANIQDKVGITADHQRFKFGVIHVEDGLSVADYIIENEFTHELMLKLRVGLHSFVKTLT

SEQ ID NO: 153400 - protein, 39 aa, Triticum aestivum
  unsure (1)..(39): unsure at all Xaa locations
  Clone ID: PAT_TA_47818.pep
SFGFHHPFMPXMRPGGAPVADFMMPIAYQGQHPLRPTVM

SEQ ID NO: 153401 - protein, 41 aa, Triticum aestivum
  Clone ID: PAT_TA_47819.pep
PFRLHASADAWADSWFLMHPHPYSSLSFEWDRLDQQKGRKT

SEQ ID NO: 153402 - protein, 73 aa, Triticum aestivum
  Clone ID: PAT_TA_47820.pep
PTRPLQQLKGMLGLQHFTTSTDVVYVMRSVLYQTHQWQWESAVLGWDFLFLLRVTQCFMKRQRWFFLLFHVVQ

SEQ ID NO: 153403 - protein, 132 aa, Triticum aestivum
  Clone ID: PAT_TA_47821.pep
ARPHPLGIYFILLRRLPLLRIHLSEHLLSTGSVGAARFAFGATLAPRPSPDGRPSKSLSFSSSGSSALIPSTHVWTNLSALLSVTTLGSGAFFSGGGFFFSDGCSVAITGGAGLETRGGEAGSGGGLAGTGR

SEQ ID NO: 153404 - protein, 79 aa, Triticum aestivum
  Clone ID: PAT_TA_47822.pep
KPHRRSLRISIVQFLRHQRAHSVHPCLDPLKRLVERELYEEQGLLLRRRLLFLRRLIGRHLRRSWSEHEGRRSRLGWRA

SEQ ID NO: 153405 - protein, 30 aa, Triticum aestivum
  Clone ID: PAT_TA_47823.pep
SGAVTTALLIVSLGEPKQFSCYQHHGKFLQ

SEQ ID NO: 153406 - protein, 58 aa, Triticum aestivum
  Clone ID: PAT_TA_47824.pep
PPASAFGEDALRVSLLARLSPGYGTRIALAQSGHERHGMSPPELCFDVIVVYCDSLIY

SEQ ID NO: 153407 - protein, 103 aa, Triticum aestivum
  unsure (1)..(103): unsure at all Xaa locations
  Clone ID: PAT_TA_47825.pep
MAGLALDETTSFVGTVPGCDDLVRSVGGSGGRVTMRRTVLSAPQSIWFGPDRPTDLVPLFQQAHVVLTVYVAGYYGGDTGGLSXSPETFDKNRLLDVIHSRRA

SEQ ID NO: 153408 - protein, 67 aa, Triticum aestivum
  Clone ID: PAT_TA_47826.pep
SRSRGLPQSTPGSISCRTGTHGMTCTSLGVLQRNLESMHASHVNRHHERRHYLGWIWSNELSPRVCV

SEQ ID NO: 153409 - protein, 140 aa, Triticum aestivum
  unsure (1)..(140): unsure at all Xaa locations
  Clone ID: PAT_TA_47827.pep
MEPTVMASEVTSADAFQGLRDTVGLTLSLRLNGASLGSLSNGGRIRCMHERPMEGIKNDGTLHYLPPVKRGALLKQDGYLIPYKWVRRLLLSKDQFMFLEHHAFPGDYDGRYWTLWKLPMCGXTDSTQVINEVEDVKKEY

SEQ ID NO: 153410 - protein, 71 aa, Triticum aestivum
  Clone ID: PAT_TA_47828.pep
STLLCPKPAYPLHLVPQSAEAEAAADSISYYTMVYRLTCWTKGEHHDQHGLPGYPHGVDKGVHAEDSGSIC

SEQ ID NO: 153411 - protein, 148 aa, Triticum aestivum
  Clone ID: PAT_TA_47829.pep
GIACLPLDMGLALGGIFNLHLVGVRFGWLPLYLDLAGGFDLHLAMVGMDSLPLDLGLTVGLDLHNHLVGVGIEWPHLLIDLVGGFAFHFHRRRQRRGNTADGALFLVAVARHGGRPMMSRRDGTVERVRGAGAYGCAHPEVIGPVQQA

SEQ ID NO: 153412 - protein, 101 aa, Triticum aestivum
  unsure (1)..(101): unsure at all Xaa locations
  Clone ID: PAT_TA_47830.pep
MPCTREMSEIQRAXLAHALLGPRLFSVVGKTVDDKTLDVXIPVIEKLYGEKWSQEDGVGRIIVSATNDLCAQIXEAGRKVGKHHNFSGWAIDKRTVLGARE

SEQ ID NO: 153413 - protein, 111 aa, Triticum aestivum
  Clone ID: PAT_TA_47831.pep
HVLAADRIANGVGHEVAPEVPAVGRVAEREGHPQRQRVHDVVDHVPDHERDHERDPALHHALHHLLLLVPLDVSPDPSTTTASMSVNVCVYPSSSVRSAVLASLCAWCGVS

SEQ ID NO: 153414 - protein, 95 aa, Triticum aestivum
  Clone ID: PAT_TA_47832.pep
GRSRSRAGSVGSPAPSARWSFCSPRGSGSSGACYRQPPPRVPSAYVSDALYPRPRGVLSFCSGAGLRYPLSTVTDWREHLDVVMTGSRSRLNSYL

SEQ ID NO: 153415 - protein, 159 aa, Triticum aestivum
  Clone ID: PAT_TA_47833.pep
CFLPTARAGREMKMAKKTGVDEPLVQYRRVGSTHERNAIPKQVWERMDTRKKTGLNDTDNMSGSVDNVESPKPVECDTSGCEKLDTGREPLDQAFERSTDVCKSETDQPYGQREENQSACSDGTPMTNKQKCHSTNNEGSKPDEELMTNSASSDGSSSC

SEQ ID NO: 153416 - protein, 158 aa, Triticum aestivum
  unsure (1)..(158): unsure at all Xaa locations
  Clone ID: PAT_TA_47834.pep
PRVRNDVHIAHLDDRSKPSLLSMARLDRVXNMTGLVDAYSKNAMLRTMINLVVRAGYNNVEKXTDRDEIADIEKMHELIKTYNLFGQVRWISVQTNRARIGELDRYIVDTNGAFGHPDMDEAFELTVAEAMTCGLSTFATLYGGPGRIIEHGISGSHI

SEQ ID NO: 153417 - protein, 47 aa, Triticum aestivum
  Clone ID: PAT_TA_47835.pep
RHAALLLLTRAHPILPAQPIDRRGAIFVGALYFTFITFQYLSSLIYY

SEQ ID NO: 153418 - protein, 40 aa, Triticum aestivum
  Clone ID: PAT_TA_47836.pep
SPLVRARVRLLGRLREKRTACYGGTSRCGESMEGAGDFTF

SEQ ID NO: 153419 - protein, 158 aa, Triticum aestivum
  Clone ID: PAT_TA_47837.pep
ISLLVEIALRLTKDGEKVKSNAVRALGYLSRFIRFNHHCDAVDDSRNSVFYGDPVCLQTMVQALMSSVTTGNVKVQGNVCHAFSNLFMNDTVRLSEMQWASSVYSILLLLLRDSNNFKIRLLAAVALAVPVTGLDFGSSFPDVVRGVTHVLEVLSSNR

SEQ ID NO: 153420 - protein, 85 aa, Triticum aestivum
  unsure (1)..(85): unsure at all Xaa locations
  Clone ID: PAT_TA_47838.pep
NWVPTEEAGAVVTAESYTGTWTTVRTDGLTSLDRYKGRGYHIEPGAEEDSLWIXXVTYPLDLFGEGCGTNKLTCSGGNVSGLKPY

SEQ ID NO: 153421 - protein, 128 aa, Triticum aestivum
  Clone ID: PAT_TA_47839.pep
HACANACATARGRRHARRLAHGCRTREGNADEYITRTKASNNVEINLDINRKLCMIKGVVNGEPNRKAEENHKTYYHIYDIILVVDDLVIENLIEMMVHSKKVRKAVAKDIGDLADKLLDRSPNHTLD

SEQ ID NO: 153422 - protein, 37 aa, Triticum aestivum
  Clone ID: PAT_TA_47840.pep
MGIEGVELEYCWLSRSRHNMKRRKQFQRAEMNVRIDC

SEQ ID NO: 153423 - protein, 100 aa, Triticum aestivum
  Clone ID: PAT_TA_47841.pep
GAERSENTTRKCTTRSTPGDTRYLHTCRAKTITHCQANIPTTMDRDICAYPVKHHFPSSIGARIEYLRSFGDVPFSYNTVHRHHQPTPSFGPSFESSYLH

SEQ ID NO: 153424 - protein, 77 aa, Triticum aestivum
  Clone ID: PAT_TA_47842.pep
SENQQLRIGLLRTTYTGLLDLARLAAKKDNNHLLLLKPRSPLGCFPRRHADGLPEGRHQEPRRHVPRPHDVQGPSSR

SEQ ID NO: 153425 - protein, 77 aa, Triticum aestivum
  Clone ID: PAT_TA_47843.pep
VTVAPLRATRRLTSSANGIRWPNTGRHQHGDVRRAASLRPHPRFGRDARGSRRRSPPPSPFLLVWLKVDSCVVGDGL

SEQ ID NO: 153426 - protein, 66 aa, Triticum aestivum
  Clone ID: PAT_TA_47844.pep
TDTDYTRFLLHPHDINGDGGGERRRDSRDHVLSGGRGGGLPFYCCRLRSYHFMVRLYHVYTAVKKV

SEQ ID NO: 153427 - protein, 159 aa, Triticum aestivum
  Clone ID: PAT_TA_47845.pep
AGTGIGLEFRESGLNLNGKNDRLIKEGMIFNVNLGLSNMQAETNNEKTKQFSLLLADTALVNDKAAEILTNCSKAVKDVAYSFNEDEEEVPKPKRAKVEPNGAEALPSKATLRSDNQEMSKEELRRQHQAELARQKNEETARRLAGGGSGNGDGRGPFR

SEQ ID NO: 153428 - protein, 91 aa, Triticum aestivum
  Clone ID: PAT_TA_47846.pep
AHPDYPPVQPWAPPPNNLHHLLFRRLPQLENLNNVSVIESQACCCLVIIRTGNTVGRAACVRLPPLSSTVSRLLNAHSCASVHGIDNLCVS

SEQ ID NO: 153429 - protein, 60 aa, Triticum aestivum
  Clone ID: PAT_TA_47847.pep
MLGHPGGVGVVRASVAREPLLTLSIIADVQYADIPDGRSLLGVPWYYRHRITALQRAVRS

SEQ ID NO: 153430 - protein, 128 aa, Triticum aestivum
  unsure (1)..(128): unsure at all Xaa locations
  Clone ID: PAT_TA_47848.pep
PTRAATRTGCCLTEVTRVSAPNPPYEDECVLXGVFTVFVDAFCKLDDTKXQSFANRVCMLQTITRASACFLMWDLVCDNXSRIHXRHFFRIISQTLQEAVGNFMETIMMFVIQESEPVHPAVLCGLLR

SEQ ID NO: 153431 - protein, 135 aa, Triticum aestivum
  Clone ID: PAT_TA_47849.pep
MGRRPARCYRQIKGKPYPKSRYCRGVPDPKIRIYDVGMKRKGVDEFPFCVHLVSWEKENVLCEALEAVRIACNKYMVKSAGKDAFHLRIRVYPFHVVTINKMLSCAGADRLQTGVRGALCKALGTCARVAIGQVL

SEQ ID NO: 153432 - protein, 69 aa, Triticum aestivum
  Clone ID: PAT_TA_47850.pep
GQEEPIADPAPPMNCRPSGPRSSSLLPPPGGHPTGSPSSGCSPSPHTGPATVPSALRRGNSPRVWGPGL

SEQ ID NO: 153433 - protein, 73 aa, Triticum aestivum
  unsure (1)..(73): unsure at all Xaa locations
  Clone ID: PAT_TA_47851.pep
MRGACCWRGLAYDNLDGPLDITRWIVLGDSLFLAPTGDRKHESLLSCYDFVMAXLMMYYYYITIGGYYLAPVF

SEQ ID NO: 153434 - protein, 124 aa, Triticum aestivum
  Clone ID: PAT_TA_47852.pep
LSRQPEIAIDSPYFDARQSIFEDPSESKGHPFGNLNLSTGPSISGTQNLASPVGAQSSSEHMYLSHEAPSPSSVIDARANEGIGGSEAINSRNRTDWGQIEAPGIHQSMLLSDFLAVLCDSKNT

SEQ ID NO: 153435 - protein, 129 aa, Triticum aestivum
  Clone ID: PAT_TA_47853.pep
TPAALCSTVMAWPSTPANFLALTLRKQVTSAVNYHGTSSKANRFTVMAAENIDEKRNTDKWKGLAYDICDDQHDITRGKGIVDSLFQAPTGDGTHEAVLSFYEYVSQGLKKYDFDNTMGGLYISPAFMD

SEQ ID NO: 153436 - protein, 102 aa, Triticum aestivum
  unsure (1)..(102): unsure at all Xaa locations
  Clone ID: PAT_TA_47854.pep
MVRLPMYVATHXLYRLCPPTILXPKHLKKLVERMIDVHRAMDXTELNHALMTLDIGEEYELRRDLKVRALKTYHTIPSQGNLIYSVEXKLKTDYLGLPGSEI

SEQ ID NO: 153437 - protein, 129 aa, Triticum aestivum
  Clone ID: PAT_TA_47855.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWIWFVAYPLDLFGEGVRTNMITSIGGNVFGFKA

SEQ ID NO: 153438 - protein, 54 aa, Triticum aestivum
  unsure (1)..(54): unsure at all Xaa locations
  Clone ID: PAT_TA_47856.pep
HLIPFPRLQCLMVGFAPXTFRASQNNRALTVPELTHKMWYAKNMMSLLMILRHG

SEQ ID NO: 153439 - protein, 67 aa, Triticum aestivum
  Clone ID: PAT_TA_47857.pep
GKQFPSAIYSCTMGFIKVSHFFKSLICCNSFVGTLQSPYFAWGKIPRSVSIAIPTFFVFLAFQNTPC

SEQ ID NO: 153440 - protein, 109 aa, Triticum aestivum
  unsure (1)..(109): unsure at all Xaa locations
  Clone ID: PAT_TA_47858.pep
LLPKYAAEAYRRRFLRNTGLCGDIAGLCXDSQGSSGNHCGIIXMMRWILILAADVXVGGVAWLYXRYRSVNKAKLKVERSNWTLTCFHRVSIIEHNILDCNDEDNVIVC

SEQ ID NO: 153441 - protein, 49 aa, Triticum aestivum
  Clone ID: PAT_TA_47859.pep
KCVTHSTRSFEFIIFDLHMNGSKLRDIGTFNRAFSSPNNPYLNSRNFQN

SEQ ID NO: 153442 - protein, 104 aa, Triticum aestivum
  Clone ID: PAT_TA_47860.pep
FRPISPQNNLSLHSFLLFLTSSSNIGSFCTPIGNPYNLVIAVTSGIFFGSFLFGIFPAMIVGVITNTCILLCYFWKHLSVDKERHQESAVGQDFFVADDEVTSY

SEQ ID NO: 153443 - protein, 56 aa, Triticum aestivum
  unsure (1)..(56): unsure at all Xaa locations
  Clone ID: PAT_TA_47861.pep
MASATLLKSSFLPKKAKWGVSRQVAAPRVCMVXRASTYDYELCKTAKTILLPGRGI

SEQ ID NO: 153444 - protein, 130 aa, Triticum aestivum
  Clone ID: PAT_TA_47862.pep
PRVRDFIRVTEIPKKHIVKRWTRDARDVLPAHLMQYQRDNAQEKPFSFRHFNMYKQAMELVRMGDSSVAAYDRLTSLFNHCAAEMKPYTDVRDGLLEDRLVGNGTVHKMIQSGGDVCNPFEATQVNDGND

SEQ ID NO: 153445 - protein, 57 aa, Triticum aestivum
  Clone ID: PAT_TA_47863.pep
RLQMPWFTSSNNRQFLQAAWMTPMVVPLSPVSSFSTWITRKLNEAAALAPTRPPTRP

SEQ ID NO: 153446 - protein, 151 aa, Triticum aestivum
  Clone ID: PAT_TA_47864.pep
SGTGSLLRLTKPGTPQPQFFCPPPSRSHFHLRTRPAKAKSPIAGAIASSSMAAAQPQTCDGQQQRAEEAMKLLFVEMGVGYDQHGQDITSAAVRACKDAISSNSIPAFRRGSIPGVNSEQMKLEIKLGVPRPVQHLLDFERIKAGFPYGEI

SEQ ID NO: 153447 - protein, 80 aa, Triticum aestivum
  Clone ID: PAT_TA_47865.pep
PLLGLLDLDGGSRRLDLGLGRREGLLRLRDLLAGDGRLHRGRLLSQSGRRVLDISGGHCRRGCKKMPGPPEAGYLKLVLP

SEQ ID NO: 153448 - protein, 88 aa, Triticum aestivum
  Clone ID: PAT_TA_47866.pep
ELHERKIMHNIRQNQLPLQRYMAMMDLQEGNERLFYKLLIDNDEELIPIVYTPTEGEACQKYGFIFRHPQGLYINLIEKGKILEVLKN

SEQ ID NO: 153449 - protein, 62 aa, Triticum aestivum
  Clone ID: PAT_TA_47867.pep
RSRSVVSLLTGVALSRAVTIMLLLWTLLAPPGLLFLTMYGKENGDLNYGALLCKFLVFEDWR

SEQ ID NO: 153450 - protein, 48 aa, Triticum aestivum
  Clone ID: PAT_TA_47868.pep
PTRPHRKRREPLSMGGGVMRTAAKVGLAGCAVAACGPFSQRFLVLCHG

SEQ ID NO: 153451 - protein, 86 aa, Triticum aestivum
  Clone ID: PAT_TA_47869.pep
GRVRKKERTPSQPRVSAAAAAAAGEHRCLITQESADLPNSSPACHREETSPQVPFLAIWEASWYMAASTTQILQRDKLIETDTTNI

SEQ ID NO: 153452 - protein, 75 aa, Triticum aestivum
  Clone ID: PAT_TA_47870.pep
LLHGRRGGVEARGDPEPRHRRRQRRPAADLRRARPSDPALGEEPGAAAEGEGGRGGAREERGRHGGRVLASWGSR

SEQ ID NO: 153453 - protein, 51 aa, Triticum aestivum
  Clone ID: PAT_TA_47871.pep
RPNIDKILNLRLLWTYSSHATPRPGAPSVVKLGFYTMNGLTRRQSMKFMIL

SEQ ID NO: 153454 - protein, 131 aa, Triticum aestivum
  Clone ID: PAT_TA_47872.pep
PTRPAVFNTATVKEPSLPAKMNPAGGLAWQSYSEDTNALDSSAFTKDGLVEQLSMTWDKSDYLWYTTYVNIDSSEQFLKSGQWPQLTINSAGHTVQVFVNGQSFGVAYGGYNSPKLTYSKPGKMWQGSNKI

SEQ ID NO: 153455 - protein, 63 aa, Triticum aestivum
  Clone ID: PAT_TA_47873.pep
STLSQVMIRCTPQPSLVKAAQAQRVGVLTEELTRQAPRRVHLPRQRRLLHRGGVEDGRTRGRT

SEQ ID NO: 153456 - protein, 126 aa, Triticum aestivum
  Clone ID: PAT_TA_47874.pep
MSDAPPRKRPPASSVARAAAAVVVAALASSFVALSPRCAPADAGSRPGMSKARVYTDVNVVRPKEYWDYEALTVQWGEQDDYEVVRKVGRGKYSEVFEGFSVNNSEKCVIKILKPVKKRKIKGEIK

SEQ ID NO: 153457 - protein, 87 aa, Triticum aestivum
  unsure (1)..(87): unsure at all Xaa locations
  Clone ID: PAT_TA_47875.pep
MATISAAAATTVVARAVIVRPQALGLPQLXDEEREGEVQLLQGRQGGDPCRRRPGGWRVPTRRGGRGDRVRRAGAGAGRRADVDGGH

SEQ ID NO: 153458 - protein, 75 aa, Triticum aestivum
  unsure (1)..(75): unsure at all Xaa locations
  Clone ID: PAT_TA_47876.pep
MALSSVFRRVNIKELISNVPVYTSSTETSGGMSLVFRRWATKKTAGSTKNGRDSNPKYLGVKKFGGEKXEPGNII

SEQ ID NO: 153459 - protein, 85 aa, Triticum aestivum
  Clone ID: PAT_TA_47877.pep
GRVGGRLGPPTFSPLTQRVLGELGLKTLASGASTSVYPSGIQNVCHAPAGWVIVGLVQLAVHLEIQKPRLSTMNCGKQEGHFISC

SEQ ID NO: 153460 - protein, 89 aa, Triticum aestivum
  Clone ID: PAT_TA_47878.pep
GRADGDLADAGKNRRCHPSMADTQLLKVHDRASCVWCARGILLPPQQSGPSRFCGKGDAAPVDLQIALATNLSSVKGLQANLSEMIFRF

SEQ ID NO: 153461 - protein, 53 aa, Triticum aestivum
  Clone ID: PAT_TA_47879.pep
FSSLPWCVHATRVYCTNEHGSSFITYQRGHTLIPCLHGPGSVYLSTPLVDAPV

SEQ ID NO: 153462 - protein, 57 aa, Triticum aestivum
  Clone ID: PAT_TA_47880.pep
TNILVKTWIVGNAVVLVRRLITRFTWYSMFLAPWTNTWFRQGPFHYGNMLVRHRARV

SEQ ID NO: 153463 - protein, 72 aa, Triticum aestivum
  Clone ID: PAT_TA_47881.pep
EPHYHSTLERTDVHVGGACSLRRGRRSLGKTFLYLARNSPPRAVDRKRVLDSCAALADEKIYRVPIAKQKSI

SEQ ID NO: 153464 - protein, 57 aa, Triticum aestivum
  Clone ID: PAT_TA_47882.pep
RRDPRVYIGGPTNRARLRRRRCGGRAGEPTRRRVTARDLSASPVVTLTAMMYVLCCR

SEQ ID NO: 153465 - protein, 99 aa, Triticum aestivum
  Clone ID: PAT_TA_47883.pep
SSSPGTVRADSAPLFPPIFKSGIPQIMPSVPVPTIRVNGVGEAQVINVGRVHVDVHPIREGLRVLVDLRRHRLHHAADLEVWSIYERSQRPESDAGYGD

SEQ ID NO: 153466 - protein, 106 aa, Triticum aestivum
  Clone ID: PAT_TA_47884.pep
YWSLIYDLIHRPSSLPLQYRRFFFSMRFLHNSQPGRGRGRGLSLLSTGEGAHYRSDLVPTGHDIYLLIYRLWHQRSHCHDGPLKRLHIVMTDLREIMPTKRCLMRS

SEQ ID NO: 153467 - protein, 24 aa, Triticum aestivum
  Clone ID: PAT_TA_47885.pep
STFCYELSEIQFAHTVRLTGDGGK

SEQ ID NO: 153468 - protein, 34 aa, Triticum aestivum
  Clone ID: PAT_TA_47886.pep
PSLYALDLADRGDCIGTCVEGSVVRTLTIWSAQT

SEQ ID NO: 153469 - protein, 69 aa, Triticum aestivum
  Clone ID: PAT_TA_47887.pep
PCSSVNELLMPVLSDLSGPSILSSLSIIWHASGLFAGSKSMHSIAISLHTLTCSNCMSPSDTLNRSDAW

SEQ ID NO: 153470 - protein, 78 aa, Triticum aestivum
  Clone ID: PAT_TA_47888.pep
MAVLVELTKEYGYVVLTVVAYAFLNFWMSFQVGAARKKYKVFYPTLYAIESENKDAKRFNCVQRGHQNSLEMMPLFFV

SEQ ID NO: 153471 - protein, 56 aa, Triticum aestivum
  Clone ID: PAT_TA_47889.pep
MAPAVKVYGWAGAPFMARPVLCLEEAVYHYKLGLMSRAVGYHCLPDFLSRNLFGQV

SEQ ID NO: 153472 - protein, 98 aa, Triticum aestivum
  Clone ID: PAT_TA_47890.pep
TLASLQHSWRASPTSTCHAAGSSARSPLQPSRSSIAAPGAVVPGSIAAPEELHCSSGCRGAELHCSPGRRRPQYPVVSRRPYSHLCRLAAQALSFAAT

SEQ ID NO: 153473 - protein, 82 aa, Triticum aestivum
  Clone ID: PAT_TA_47891.pep
MVLPDAIRTVIGVIGNGTVLVLFLSPVPTFISIWKKKTVEQYSVVPYLATLLNCMMWVLYRLPLGHPDSMLVITIKGTGMLI

SEQ ID NO: 153474 - protein, 61 aa, Triticum aestivum
  Clone ID: PAT_TA_47892.pep
EGRMGRLAPFHLPEGVHGVCGLSPTTMIFSRPRKPLLILGRGILVMDESYAFCVEAPILDR

SEQ ID NO: 153475 - protein, 136 aa, Triticum aestivum
  Clone ID: PAT_TA_47893.pep
KNLASSGQSLVGGPLRPNKSSSHTPPFHPIKCECFFAILSSSALEGDAWPWSSPPVRSVGDFSTGTSPNGEEVEVGSAIARHGNWEEGDQEGTRVGSNRQFLRGVSGSPAVRTTHAAWEAGEGLDARQRRRLADAW

SEQ ID NO: 153476 - protein, 84 aa, Triticum aestivum
  Clone ID: PAT_TA_47894.pep
TSVGLLCRTGEPLAKCRRGTGILQLGNSIWTPDALCPLEVEVGTNDPGLLSICSEAIAAAHLSICAHSGLSLLQRTLTYMVQIS

SEQ ID NO: 153477 - protein, 131 aa, Triticum aestivum
  Clone ID: PAT_TA_47895.pep
TKRIGDDATITLLIGKDLSESGGVSMEGDSAKRAPLSRKNSLKLDTEKGKEPARPMPTPLTLNALKNQAPPLCGPLLKSISFKNSKVPKVKQLVTEVPQKPKNLKEPISLITKQDGPGITLAKATSGKKLN

SEQ ID NO: 153478 - protein, 64 aa, Triticum aestivum
  Clone ID: PAT_TA_47896.pep
SEAEGQRTKEIRVALFLYPNSVLLFFYIFNLQSCVPNNSCGLTRQSGGSRNEIKTFFYLNISKG

SEQ ID NO: 153479 - protein, 113 aa, Triticum aestivum
  unsure (1)..(113): unsure at all Xaa locations
  Clone ID: PAT_TA_47897.pep
DTATYLNVLSCIYCGLNDYNKGVFNDMVLTXSPYKLTEENIYDTGVTVNNGDLHARYXFNDRMSQNMTKYANNLEVNWKTPPWHVHSTTDNVLDYGKHLGDMLIEKEATLTYA

SEQ ID NO: 153480 - protein, 127 aa, Triticum aestivum
  Clone ID: PAT_TA_47898.pep
AVPLLIPSRVRRLLGIPSNTMTSVAAAVALLRLPLARLSSHLRSLPSRPVPSARLRLSAPHRPLCSLLTSGHGLVVAAVSEAVAAADEEEFEATEEQQEEAPPSFVLPRLPLPKLDVKERKELASYA

SEQ ID NO: 153481 - protein, 156 aa, Triticum aestivum
  Clone ID: PAT_TA_47899.pep
HASGSIKALERSMQALGSLIEGHGNLQIIQVVAHRSSVRYGGTSKATISWDILAPPPHLQRFECSPHSPIIFYGIPRWMEQLRNLCILKIAVSELLIYDVSILGGLPALSALSLYVEKAPYDKIIFDKAGFSVVKYFKLKFSSGIAWLKIKADAMP

SEQ ID NO: 153482 - protein, 49 aa, Triticum aestivum; identical to SEQ ID NO: 147490
  Clone ID: PAT_TA_47900.pep

SEQ ID NO: 153483 - protein, 74 aa, Triticum aestivum
  Clone ID: PAT_TA_47901.pep
LKSNQALESNYGQAASSACTLHSGIFTSFRATCWIHSVLKKIATLIGKKVRMVPCHCNFADQQPGKQFGCPDHH

SEQ ID NO: 153484 - protein, 57 aa, Triticum aestivum
  Clone ID: PAT_TA_47902.pep
PHLLAGSAKERAQGTGQPIIGKRRFVGGVVGVDQCHRCSISALADCACSGKGERAGA

SEQ ID NO: 153485 - protein, 155 aa, Triticum aestivum
  Clone ID: PAT_TA_47903.pep
PRDSFSRFNISKLARLAEIYHEDFSSYDREHIQDHLELFIIYMRRIEDFRDCHDIASLAKKMVELERHIMFPTVYRLIELALLLPVATATVERAFSAMKIIKTELRSKMSDGWLNDLMVCYIERGIFKSLDLGKIKEDFHKKGRELPLPGSSTRH

SEQ ID NO: 153486 - protein, 42 aa, Triticum aestivum
  Clone ID: PAT_TA_47904.pep
MGNCQAAEVAAAVVQHPGGRVERIYWSTPAAEEMRANPGHYV

SEQ ID NO: 153487 - protein, 88 aa, Triticum aestivum
  Clone ID: PAT_TA_47905.pep
ERNLVCVALNKAGTNYCQSSLFWGLGGLSIQSAWERVKMRGKRRKARRVKLWKEDREVQVFMGYGISMGLACIHTAPRGKTMSDCSNV

SEQ ID NO: 153488 - protein, 74 aa, Triticum aestivum
  Clone ID: PAT_TA_47906.pep
YGTTVGPLTAWMYKESRLSTFSWMEPNDGRISSRRRSAPAAPGAERTKDARSRSESIAESAHGSRMLSHTHIGR

SEQ ID NO: 153489 - protein, 47 aa, Triticum aestivum
  Clone ID: PAT_TA_47907.pep
RSYQAIYLHSTSMVSTEMASGGTSDDTVQGLKSTAGLPGAVVPTALV

SEQ ID NO: 153490 - protein, 57 aa, Triticum aestivum
  unsure (1)..(57): unsure at all Xaa locations
  Clone ID: PAT_TA_47908.pep
MTGKNRMGEAGRVDXTDRCMYGAFRSAANSLSEVYTLDMGGQKLSLXAGVRHAMEKL

SEQ ID NO: 153491 - protein, 101 aa, Triticum aestivum
  unsure (1)..(101): unsure at all Xaa locations
  Clone ID: PAT_TA_47909.pep
HASASLHDAHGQYHQASSDLLRFGGGGGGEMAVXLNHLLSSSNAPSFLHLPPPQVPPFHLDLSQEFVDGNGSPVYLHGKPFHGLMQLSGSSEKQVLGARNI

SEQ ID NO: 153492 - protein, 132 aa, Triticum aestivum
  unsure (1)..(132): unsure at all Xaa locations
  Clone ID: PAT_TA_47910.pep
AIQCSTKRSSLLPLPSPPPLPLPPTLSPSPRTPPPPPPPRPPFAPQPCRPTRTTTALWTRGWTPSRAVAARRRRPTRPPPRRRRPGASPRGTAXRRGPAGPRGVLRAGYRRRRRARGGSGRRRERRRSERRA

SEQ ID NO: 153493 - protein, 61 aa, Triticum aestivum
  Clone ID: PAT_TA_47911.pep
VVLFDYPRDPSEYVPRVGRTALGASGDGKAFVFAVGKQVSLARRVMERNLKGHPLHDVPCF

SEQ ID NO: 153494 - protein, 55 aa, Triticum aestivum
  Clone ID: PAT_TA_47912.pep
HTGFISPFSLPNAINLSAQWQSRVGPVQWLKPYTDEVLVELGQKGVKSLLAVPVR

SEQ ID NO: 153495 - protein, 57 aa, Triticum aestivum
  Clone ID: PAT_TA_47913.pep
ICCWTKLRLSSHSLLADASFSIPKHLLFFMFLYAMGLGHKQLFVLSTKNFCFKITMC

SEQ ID NO: 153496 - protein, 121 aa, Triticum aestivum
  Clone ID: PAT_TA_47914.pep
MWYLCVFYHRLLDYRRPEVQSLAELFGGPGGGAAVEWRMPENHHEDSPFHLVRLPGDERLAAQIANRSLLVKGIYELWGQGATYDELEKAIRAYPDERKLPYLTPESSFKIIVDSFGKAVS

SEQ ID NO: 153497 - protein, 47 aa, Triticum aestivum
  unsure (1)..(47): unsure at all Xaa locations
  Clone ID: PAT_TA_47915.pep
KENPWEEGVATASVGFKASVXDYKLTYYTPKFETKDPDLFAPFPVRS

SEQ ID NO: 153498 - protein, 151 aa, Triticum aestivum
  Clone ID: PAT_TA_47916.pep
RWKGLDDSGVELDDGLSGLQTEVENLNLQEQALDERISDMREKLRGLTEDENSQRWLYVTEDDIKGLPCFQNETLIAIKAPHGTTLEVPDPDEAGDYLQRRYRIVLRSTLCPIDVYLVSQYDDGFENLCGAATPARHTNVPKSGPCEDLHA

SEQ ID NO: 153499 - protein, 97 aa, Triticum aestivum
  Clone ID: PAT_TA_47917.pep
PFHLSSSSSPRARAPPLSRVPELLAVCRSGGLAFAARPKPPRAGRRCTCWRPGRPLCNTFTSNLDAHVLVDVLSYFLHTRCLCVCLNLFQSQILEPT

SEQ ID NO: 153500 - protein, 64 aa, Triticum aestivum
  Clone ID: PAT_TA_47918.pep
HVLLSWSTDLVEDVRQFSLINHPMRTFILSFCFLLYDFPFFHITSCSISFPKEQYHFTIFGSLP

SEQ ID NO: 153501 - protein, 53 aa, Triticum aestivum
  Clone ID: PAT_TA_47919.pep
FLGSIDQSSLEKIWHIKAEEKVRFFIWLLAQNRLPTADRLQARGCNHEDTCSL

SEQ ID NO: 153502 - protein, 145 aa, Triticum aestivum
  Clone ID: PAT_TA_47920.pep
PRVRTHLGGEDFDNRMVNHFVQEFKRKSKKDITGNPRALRRLRTSCERAKRTLSSTAQTTIEIDSLYEGIDFYSTITRARFEELNMDLFRKCMEPVEKCLRDAKMDKSTVHDVVLVGGSTRIPKVQQLLQDFFNGKELCKSINPD

SEQ ID NO: 153503 - protein, 105 aa, Triticum aestivum
  Clone ID: PAT_TA_47921.pep
SRPPRRRASPTPPPRRRRRGEAAPAWAPRRRRRPGSPAGSTPTRAAGRPPARPAGPPASTTATPAAPAARPPRPRPWPDGSARRSLLEGGRRARAGSDFRVRSVA

SEQ ID NO: 153504 - protein, 61 aa, Triticum aestivum
  Clone ID: PAT_TA_47922.pep
FFYFSSTRAHAFFFPHTPPTSLLPPEPPLIPRHRRRDPPSSDASGHVRHAGSCAAGGGCAG

SEQ ID NO: 153505 - protein, 140 aa, Triticum aestivum
  unsure (1)..(140): unsure at all Xaa locations
  Clone ID: PAT_TA_47923.pep
NDFGPRARIIMYFPCEGSQYTPPHCSVNFFWKDYCPMVFRNLREMFHIDAADYMMSICGGDSLKELSSPEKSGSIFYLSQDERFVIKTLRKSELKIGLMXYVLQILLKMLPKYYNHVKAYDNTLITKFFGVHRITLKAGK

SEQ ID NO: 153506 - protein, 116 aa, Triticum aestivum
  Clone ID: PAT_TA_47924.pep
MAPTQEKHSSEELLRAQVDLWHHALGFVKSMALKCAMELQIPNTIQHHGGSMTPSELAAKIGLHPSKLPRLRRLMRVLIVSDIFVVHEVASPNKGVAYGLTPTTRLLAIDEVRSNL

SEQ ID NO: 153507 - protein, 132 aa, Triticum aestivum
  Clone ID: PAT_TA_47925.pep
QAAPLAPRLGRSPCHQAAPYLSPRRGPSPRHEAPTLAPCRGPSPPHEFALLAPRCGPSAPLAPRRGPSPSHEAAQLVPCRRPPCHQATLLVSRRGLSPCRSTAALLPSTIIFRCSCHWAMMEMEQTRCGQGE

SEQ ID NO: 153508 - protein, 148 aa, Triticum aestivum
  Clone ID: PAT_TA_47926.pep
GWSGMSYFYFSNAQSLCWFLDPEFEREVRRVHRLVGNAAVDDGYHLVVGTGATQLFQAAMYALSPPGAERPAGVVSPAPYYSSYPPQTDLLLSGFYRWAGDANAFDGDGHIELVCSPNNPDGAIREAVLSSESGKAIHDLVYYWPQYT

SEQ ID NO: 153509 - protein, 150 aa, Triticum aestivum
  unsure (1)..(150): unsure at all Xaa locations
  Clone ID: PAT_TA_47927.pep
GRVGDPPGPQSNGRRSGSSRRGILPCPLHFPAPPPLPSHPDPPTPPSRQQDPDALPEATPPPAPPXASPSSPPPPEDAXQPTPSSSPSPAPPPTRRRXADPKPPXPAPSPSPPPQPSAKESSGSKEAFERALEYRNGNGGGLDGGSSLLN

SEQ ID NO: 153510 - protein, 100 aa, Triticum aestivum
  Clone ID: PAT_TA_47928.pep
MNNQCVPSWDLDETVSAGLNPVSAGSTQRMAPGDSGLTGPVAMPMPDQYDEVAELTWEKGNIFWQGLLNRSVPKYLRPRRGADARHRRRGRSPGDASSSG

SEQ ID NO: 153511 - protein, 102 aa, Triticum aestivum
  unsure (1)..(102): unsure at all Xaa locations
  Clone ID: PAT_TA_47929.pep
PRVRTVSITESRSYPAATKTANEPMRVLVTNTAXQIGYALAPMIATGAKLGADQPVIQHKLDIESAADALKGVKKELIEAAYALVKGADATTDVAEANTGVN

SEQ ID NO: 153512 - protein, 151 aa, Triticum aestivum
  unsure (1)..(151): unsure at all Xaa locations
  Clone ID: PAT_TA_47930.pep
GAGVTFIQRGMLSFESTCSRCGGSGKIVKNFCKTCKGQQLVKGKKSVKLDIMAGIDDNETIKVRGQGGADAERNKPGDLLLTIKVREDPIFRREGNHVHVDAVLSMAXAVLGGTVTIPTLTXNVSVKVRQGTQPGEKVSYGQRNKGEEFVI

SEQ ID NO: 153513 - protein, 109 aa, Triticum aestivum
  Clone ID: PAT_TA_47931.pep
GVISHPTIGISAGRCTRTTLSILHPCSSYAALFSTAPALAPAPAPAPAPAPHRGGLNTGHGGSVEPPIFFNKMNRVEPRHTSSCRRDRRRKIRREPRELLRFEMAGALR

SEQ ID NO: 153514 - protein, 55 aa, Triticum aestivum
  Clone ID: PAT_TA_47932.pep
ISIDRNQEISRRTRPNRTEVYRARDREELWLLSSKKSGLGATGVTCQPVSIEEPV

SEQ ID NO: 153515 - protein, 66 aa, Triticum aestivum
  Clone ID: PAT_TA_47933.pep
MAMASSSGLRSCSAVGVPSLLAPSSRSGRSGLPFCAYATTSGRVTMSAEWFPGQPRPAHLDGSSPG

SEQ ID NO: 153516 - protein, 52 aa, Triticum aestivum
  Clone ID: PAT_TA_47934.pep
TTVWTDGLTSLDRYKGRCYHIEPVAGEDSQWICYVAYPLDLLKRFRTTCYFM

SEQ ID NO: 153517 - protein, 91 aa, Triticum aestivum
  Clone ID: PAT_TA_47935.pep
MWQGHFFPSAPPHPTHPVHSPSPSRSSCSPPPFACCLMASIAGSAVSFAKPVKAINTNSLSFSGARRGNAFLRLQPVPMRFAVCCSAKQDT

SEQ ID NO: 153518 - protein, 115 aa, Triticum aestivum
  unsure (1)..(115): unsure at all Xaa locations
  Clone ID: PAT_TA_47936.pep
IRPACSFIVNSLSLEEWYLRGGCRVVSTNSMPCSPGIKLLTDSNCRLEICTEYKTMLAVXDIPALIVDYCQGVIGLLTKDCGEELFSVLKLARXVQPLTYMFVGYNNVYDNFCNK

SEQ ID NO: 153519 - protein, 79 aa, Triticum aestivum
  Clone ID: PAT_TA_47937.pep
KYNFAVCVCVRTHPRVPDCQTTPVDDKKTLVHKNTMLFTKKLSGLCFNNFIYPDQSLPSLCLERLSLKKLILYVWCLFV

SEQ ID NO: 153520 - protein, 72 aa, Triticum aestivum
  Clone ID: PAT_TA_47938.pep
MAAATAMAMLAALAILVLMPSARGLGRAEFPPGFLFGVATSAYQIEGAYLEDGKGLSNWDFFTHTNSRGIDD

SEQ ID NO: 153521 - protein, 126 aa, Triticum aestivum
  Clone ID: PAT_TA_47939.pep
RLKTGFEKFKTDVYDKKLDFFKPLKAGQAPKSMVFGCADSRVCPCFTLGLEPREAFTMRNISNMVPCYCKNKYSCVGSAIEYAVCALKVEVIAVTGHTRCGGIKAMLSLKDGADDSLHSVEDWVRI

SEQ ID NO: 153522 - protein, 33 aa, Triticum aestivum
  Clone ID: PAT_TA_47940.pep
LARATSTAMEALASSPRARFIRTAYPTTALFTP

SEQ ID NO: 153523 - protein, 89 aa, Triticum aestivum
  Clone ID: PAT_TA_47941.pep
MSVLADMLAEIFREPTLAGVARELATLAAPLWLAALVGLLIGWAWRPRWAVAVVDVAGHQQQPVPAAAVAHQAPAPQTTVADHLAVVPR

SEQ ID NO: 153524 - protein, 145 aa, Triticum aestivum
  Clone ID: PAT_TA_47942.pep
AFHHSITLQSFTVFFLLAVFVADYHVQGGDDGCSLFSCGHLRDISYPFRRRGDPRECGVEEYELGCTSSKATIHINTGTYYVTAIKYTGSYFWVMDPNFNTSTSCPLPLWNHLPYSGSGIIDSGEHGTTDSASPVFQYLATQSDY

SEQ ID NO: 153525 - protein, 93 aa, Triticum aestivum
  Clone ID: PAT_TA_47943.pep
RDREKFGWFAEFGGDLPCGTCVGSDLFGGGDADAVSARKVKDRAGDFVCYDMHLIRLTDRNGRARLVNITVHRRLETDSCTVRLPLVSFCLGL

SEQ ID NO: 153526 - protein, 59 aa, Triticum aestivum
  Clone ID: PAT_TA_47944.pep
VDPELVIAAMLTVAAAELVDDLIYADAPADQLEAHILTHTLSHTQKPDHEHEIADHAIV

SEQ ID NO: 153527 - protein, 117 aa, Triticum aestivum
  Clone ID: PAT_TA_47945.pep
MAPTKGEGPAIGIDLGTTYSCVGVWQHDRVEIIANDQGNRTTPSYVAFTPERLIGDAAKNQVAMNPINTVFDAKRLIGRRFADAPVQSDIKMWPYKVIPGPADKPMIVVQYKGEDKQ

SEQ ID NO: 153528 - protein, 145 aa, Triticum aestivum
  Clone ID: PAT_TA_47946.pep
SGLVIDDRMSKFINSLANDADQQLKVVSIHGFGCLGKTMLAKVLYNKIGRKFHCRAFVRVSKKPDMKRLFHDMLSQLHRKQPQASQDASDELRITAENIGNCLHGKRYLVVVDDLWDTSAWDVINQLFPKGSQGSRIITTTQIED

SEQ ID NO: 153529 - protein, 140 aa, Triticum aestivum
  Clone ID: PAT_TA_47947.pep
LECERLECDTAAGRCRTEFLVGGGCVCKAGYRTMEAEGMEFLLDAVDRFPVREEFADSLEQPDLVSLLYLLQNGGATEGRVEANGESGLAQVDVEGVAADRPHGERRPHAESPMRSAQSTDRVNPQAPGWTKRLRLGSAP

SEQ ID NO: 153530 - protein, 52 aa, Triticum aestivum
  Clone ID: PAT_TA_47948.pep
MMESKGGKKKSSSSSSLFYEAPLGYSIEDVRPNGGIKKFKSSVYSNCSKRPS

SEQ ID NO: 153531 - protein, 133 aa, Triticum aestivum
  unsure (1)..(133): unsure at all Xaa locations
  Clone ID: PAT_TA_47949.pep
HDDGVSRHRRLPLLPHPTPPRRRAVSDRKPGRGTAGSIAWRRKWRENPPTFPPRFPTPPPSPPPARAGXTAPPPPLGVVYPRPPRPRPPRRRTTLPPIPSPPPEHGERLRETGTSTTAVGGGNKQGAPPRGPR

SEQ ID NO: 153532 - protein, 109 aa, Triticum aestivum
  Clone ID: PAT_TA_47950.pep
VKGHKLTLAAAAPPPPISARAAPPLSPASTPARVPAPRSAPPCRPKSPSPHPPIHKRSAHNLSPPPADPPHTQGKRSQTFGDGSRQKGSLGGTRIRRSGGGGGGSGDGG

SEQ ID NO: 153533 - protein, 139 aa, Triticum aestivum
  unsure (1)..(139): unsure at all Xaa locations
  Clone ID: PAT_TA_47951.pep
ALSEGKLDEAVEHLTEAILLNPTSAILYAARAGVFVKMKKPNAAILDAEAALQINPDSAKGYKSRGMAKAMLGKWEDAAHDLHLAAKLDFDEEISSELKKVEPNVHKIEEHKKKYERLRKERDMKKADLERQRXHAEEV

SEQ ID NO: 153534 - protein, 135 aa, Triticum aestivum
  unsure (1)..(135): unsure at all Xaa locations
  Clone ID: PAT_TA_47952.pep
PTRSTGATRDENQDAMDAIMADILADPNDVRAGLMXLHYLPFNPTDMRTVLTYIDSDGNCHRATKGTTKQIITLYDCKEDVHRKVHYDTEKYAERVLGSLAEARQKVPDKSKDPSGGPWQFIDLEPPRDHPSHDI

SEQ ID NO: 153535 - protein, 67 aa, Triticum aestivum
  Clone ID: PAT_TA_47953.pep
LAACQQTCILICVLKLESDVGRDDNIPETIEGTTEGQSHCYYQGCFTSAMSISMAITTLGSSRGLCR

SEQ ID NO: 153536 - protein, 110 aa, Triticum aestivum
  Clone ID: PAT_TA_47954.pep
FAPHTYWPPPPTESESNGYLRVRCNGGLSQQRSAICNAGALSMDSGISSKRSGQIRSRPMVEKTEYRDEPLEHGLMGCSRARCRSSLEGKRAGRRGGEEGGMQGACRPSS

SEQ ID NO: 153537 - protein, 71 aa, Triticum aestivum
  Clone ID: PAT_TA_47955.pep
MRAGFTRFTTLLSLAPFHRNRWPHCSSRVQGSVEAGFVGDEESRASLPSICGRHCHTHVMVGMGLKEYKYW

SEQ ID NO: 153538 - protein, 106 aa, Triticum aestivum
  Clone ID: PAT_TA_47956.pep
MASTSCFLHQSTARLAASARPAPAVGRTQLFVCKAQKNDEAASDAAVVTSRRAALSLLAGAAAIAVKVSPAAAAYGEAANVFGKAKKNTDFVAYSGEGFKLMIPAK

SEQ ID NO: 153539 - protein, 53 aa, Triticum aestivum
  Clone ID: PAT_TA_47957.pep
MTPLSEYDIMRMLDFPTRNPVHRRAHFEILRMADYLELCAPGGGDGPFMSGRE

SEQ ID NO: 153540 - protein, 100 aa, Triticum aestivum
  Clone ID: PAT_TA_47958.pep
TLPGPNHGGNPQSLQNLGFFQLVNHWILAQPIDQGEPVNQAHFPGLPEEAVKGVRAKNPEGRQKGHTLKDTYSERALFVRHLSRFKLGELAELDHHYRQV

SEQ ID NO: 153541 - protein, 72 aa, Triticum aestivum
  Clone ID: PAT_TA_47959.pep
MVSDASKKKAAQRKAVACEKRGAKSSATASTSSSSSAAYKASNGIAFLNLSERTYTCVLATNALSGQCTCCL

SEQ ID NO: 153542 - protein, 97 aa, Triticum aestivum
  Clone ID: PAT_TA_47960.pep
KGIQDQKHVSHLPVKFLYWCQPSLHELRAIIEFSSAGSRLGGGKEKGDEDVLLCLGLRCHISSGRRHLSRSSSSPLLMPGLHQPSSPLSSGLAPSSI

SEQ ID NO: 153543 - protein, 62 aa, Triticum aestivum
  Clone ID: PAT_TA_47961.pep
DYNYREAHDVVHEFDSNFGEDVKSHLLLLPIFQIDLFIVVAFLDLIFIPIKFLTASANGPPN

SEQ ID NO: 153544 - protein, 49 aa, Triticum aestivum
  Clone ID: PAT_TA_47962.pep
MESKGGKKSSSCSSLMYEAPLDYRIEDVRPAGGAKKFSAAYLNWAKKPY

SEQ ID NO: 153545 - protein, 88 aa, Triticum aestivum
  Clone ID: PAT_TA_47963.pep
PRVRGRVGERLEVRNGPGGARAVQTLPPASLYPPTRRLVTCCTSRVGDPHLLLPGVVIEQWTSVPRLHSEIRLLLMLLHTVRTTARLP

SEQ ID NO: 153546 - protein, 156 aa, Triticum aestivum
  unsure (1)..(156): unsure at all Xaa locations
  Clone ID: PAT_TA_47964.pep
PNLPFVYAGDFIKVLWQKHASKSYSNMIIYVEACECGSIFEGLMPQDLNIYVTTAANAEESSWGAYCPGMETPPPEYMTCLLXDDAYNVSWMEDSETHNLQKETIKQQYEVVKARTAPPNDSNIGSHVREYGDKTFKDDKLFLYQGFYPANQASQT

SEQ ID NO: 153547 - protein, 83 aa, Triticum aestivum
  Clone ID: PAT_TA_47965.pep
MRSPKQPAKLVMLLLLALLLLCNGVGNVHCTRIHENSVDLHALLDFKQGINNPEEALSNWSTTTHFCRWNGVICTNDTARVVS

SEQ ID NO: 153548 - protein, 161 aa, Triticum aestivum
  unsure (1)..(161): unsure at all Xaa locations
  Clone ID: PAT_TA_47966.pep
PRVREKELSTVDIFDMSIEACQAFVGCVYGVAMSEEELLVHRSELVVASDKYGVXNLKKVCEESMIVDVSTENLLERLQMAHTYSLPALKRTCVRLLVXFGRMYEIPNDFEEFMKTADQDIVGEIRSTAMLRGRKLEDRHKPSAEKTRRRKSMPSQDSDGG

SEQ ID NO: 153549 - protein, 90 aa, Triticum aestivum
  Clone ID: PAT_TA_47967.pep
MAVLLLVLFAAVSSSSTGKGESWRAEQERHRVPWLPGQAFNASFAHYAGYITCREERGAALLYWFFEAAHYPGSKSLMLWLNGGSGCSSI

SEQ ID NO: 153550 - protein, 50 aa, Triticum aestivum
  Clone ID: PAT_TA_47968.pep
ATTTRMARSKSQVRDGWRRPQGPEMGRTADVFYFPLREFWWVSLIVCQTN

SEQ ID NO: 153551 - protein, 81 aa, Triticum aestivum
  Clone ID: PAT_TA_47969.pep
YTYNSLILYLGKAGKAAEAGKMYEELLAKGWKPNVFTYNALIRGYSVSGSPENAFAAYGRMIVGGCRPNSSTYMQLPNQML

SEQ ID NO: 153552 - protein, 84 aa, Triticum aestivum
  unsure (1)..(84): unsure at all Xaa locations
  Clone ID: PAT_TA_47970.pep
MAPVKLIVATLSWNVTRCVATLEEVVEEYELVHMNLGTDLHTSLNYITCNLFGHLPAHADGDXTSTTSRAISMYACHWTNPQLM

SEQ ID NO: 153553 - protein, 161 aa, Triticum aestivum
  unsure (1)..(161): unsure at all Xaa locations
  Clone ID: PAT_TA_47971.pep
LHLQACSASPLARLSPLSSSTSPTSRAPLSLHLQACSASPLVGLSPLSSSTSPTSRAPWAAACRPCSPTVVPSLPASSRVSISGLDAHDHAQAGVVGRLGRDIRIRRPPASPADGRRTXERSARSSTAWATQLPRPSSVVKPSPTISLACSSGGSSVPRWE

SEQ ID NO: 153554 - protein, 103 aa, Triticum aestivum
  Clone ID: PAT_TA_47972.pep
TAMGRRGGQRCRRSSRANLTSTSTGQRGGKRRRLPPPANSFVSIAESPPDAVLYLIHRTPKETLAYYTTCRCGKAICALRKPSWLGSRKPRSSQVAWIEKGQA

SEQ ID NO: 153555 - protein, 110 aa, Triticum aestivum
  Clone ID: PAT_TA_47973.pep
MDAAAAAAGGHRWTEEVDDLVDAGDVDGAISLLESVVSSLSTAAPSPPPAGADLRLATALGDLAGLHASRGNTLQADAIRSRAIVLLLRAEIEAPRPQALRFVSPSIPSF

SEQ ID NO: 153556 - protein, 109 aa, Triticum aestivum
  Clone ID: PAT_TA_47974.pep
FSATFRRVVRNKSTEEFRWLPYVTTLLYTSLWAFYGFLKPGGLLLITVNAAGAALQVTYVALYLAYAPRDTKVKMAKVVVGVNICFFAAVVLVGLVALHGAVRLFPVGV

SEQ ID NO: 153557 - protein, 115 aa, Triticum aestivum
  Clone ID: PAT_TA_47975.pep
ADRIRYPGAGPHGGGGLRPRCREQEPPPPPSLPPPVSTAPAEAPSSPPRARGGGPFCRPPSPRDPLGGGAERSNKFRSSDALQPPRSMGSLEPFNRLVRLTARAFYDDIFIKGDT

SEQ ID NO: 153558 - protein, 90 aa, Triticum aestivum
  Clone ID: PAT_TA_47976.pep
PCKQSSQNQMVLSFGCRTLHLINLTRRAKEHRVVVVVVAPHNPFQRKCVGPAHLSKAPLGATKSPRLAYICITAFLITVLSPGGGGTFYQ

SEQ ID NO: 153559 - protein, 121 aa, Triticum aestivum
  unsure (1)..(121): unsure at all Xaa locations
  Clone ID: PAT_TA_47977.pep
LVLHPCVVAEXEGGAGVXAHVRQRRAPRRGRPCCPCSSCSVGRLLWRLQVGIHGGVAVGHAVVHLGAELPPHRPAGVDCGIGGKGKKRDGERYRKGSGRGSARLYSYWVWARVAGLSGTQE

SEQ ID NO: 153560 - protein, 146 aa, Triticum aestivum
  Clone ID: PAT_TA_47978.pep
RQCRQMHGYIVRLGYGESTLIMNAVMHMYARCGDVVSSREIFDRMAGKDVISWNTMIMGYAIHGQGRTALEMFSEMKCNGLQPNESTFVSVLTACSVSGLTDEGWTQFNSMQRDYGMVPQIEHYGCMADLLGRAGDLKEVMQFIEK

SEQ ID NO: 153561 - protein, 139 aa, Triticum aestivum
  Clone ID: PAT_TA_47979.pep
HPDLSKADRKRLCRLIDCRKLSPDVRAQAVSNDRMPLRTIVQLLFVEQERTIGAGGSHSVAPPDRASVDAVSRLTATGREDEAAAMDHRSDVHRPRRAGHEERAQGDAAAMTRSLSASTKTAARKDRAVEERGSKLRNK

SEQ ID NO: 153562 - protein, 131 aa, Triticum aestivum
  Clone ID: PAT_TA_47980.pep
AMSTPNHHHTHTLHIIAAIECSAIGGVLFKHPQRLPVALRLLPCCPSTSPQILHHHKSMVGISRGGGAGDGVEGHGAHRTRRRRYNQRVNRLLPATVRGELDGRAARRQRSRRQEMKGEKWIGARRRRQRL

SEQ ID NO: 153563 - protein, 121 aa, Triticum aestivum
  unsure (1)..(121): unsure at all Xaa locations
  Clone ID: PAT_TA_47981.pep
PRVRSPLPRAPKPKTLPRPWPLPRRSRPAPPPPPTAAPPPPXAGRLALPPEPDEPRPAPPXPSSTPTPSSPRTSTTSSSTSSPRSPPRRASPTMKTTKKGRTAASPTGRPPGRPGGAGCSR

SEQ ID NO: 153564 - protein, 131 aa, Triticum aestivum
  Clone ID: PAT_TA_47982.pep
PTRPGDASPFGQENHLVTARFIGRQIYISAEEHVLKQNLAGKTWGGQFEAKDIYIILFSRTSILCLIRPSGETLVCSPENRVLDIKKLHEIMSVKYELAGHFPPHFKCLDDDISLLDATTIDVSSVVQYLP

SEQ ID NO: 153565 - protein, 124 aa, Triticum aestivum
  unsure (1)..(124): unsure at all Xaa locations
  Clone ID: PAT_TA_47983.pep
TKLGGIVLKQKIPVEVHASQVYTRTMFEKFGEALHVCGSYDLVEVKPQLEYIARHIKFQSREKWCKNEFVISLSETANEFRXMIHLKLHELPPKHVLKRWTRDARDILLPEYLRYQKDHGPLKY

SEQ ID NO: 153566 - protein, 123 aa, Triticum aestivum
  unsure (1)..(123): unsure at all Xaa locations
  Clone ID: PAT_TA_47984.pep
PRVRGSLNVLLGLGGAGGYAIRNVSRYTXYETGLALGHKLPDNKPYNDYYEYFTPDDTLNVTPNNIAHYDPHYVLTNLIANLLDLLHELRHAPNEQPHEPPSDTPFHDPDEHEEDHDEPHDDH

SEQ ID NO: 153567 - protein, 115 aa, Triticum aestivum
  Clone ID: PAT_TA_47985.pep
DIPQDKISDALDDELLSKDGKATEPVSNLVQELNEHPIGRVTPTAPRTSYHRNRFTSISRTFGDGSKLWPEDNMSTGSAGGSKKTRTHVSYSVSPRSDELGSKHKGHFRKIQPHN

SEQ ID NO: 153568 - protein, 123 aa, Triticum aestivum
  Clone ID: PAT_TA_47986.pep
WLAYGEIINGRFAMLGAAGAIAPEILGKAGLIPAETALPWFQTGVIPPAGTYTYWADNYTLFVLEMALMGFAEHRRLQDWYNPGSMGKQYFLGLEKGLAGSGNPAYPGGPFFNPLGFGKDEKS

SEQ ID NO: 153569 - protein, 68 aa, Triticum aestivum
  Clone ID: PAT_TA_47987.pep
MEPAANGDKPSDEQQQFDPSRMIGIIKRKALIKDLAAAYHAECVACCKELLELQKKWEEEQCVEAKMP

SEQ ID NO: 153570 - protein, 123 aa, Triticum aestivum
  Clone ID: PAT_TA_47988.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMIGGVGMIAPEALGKVGLVPP

SEQ ID NO: 153571 - protein, 143 aa, Triticum aestivum
  Clone ID: PAT_TA_47989.pep
PRVRTDIPLQPASRPGEIDNRKLVLEETSSGSEDTELQRTLREGEDYTLVPQDVWRKLYDWYKGGPEISRKVICEDPTSRRYIVDVYPLHLTLIDERDNSARTIKLSRKAKVNELYRLVCSLLSVEQSKVHIWDHYQKMKNKK

SEQ ID NO: 153572 - protein, 86 aa, Triticum aestivum
  Clone ID: PAT_TA_47990.pep
LTLREGEDYTFLPQDIWRKLFYWYNRYLKISIKLICDDSTFRLFIVDVYPLHLTLIDERDNISLFHLSKVEVQYLMIFLDWFFNFL

SEQ ID NO: 153573 - protein, 69 aa, Triticum aestivum
  Clone ID: PAT_TA_47991.pep
LFLSQRHERVACTLQAKLFSSLLNPHCLEQCSASPMQMYQTDRPNCKHQQIQFFVAPHRLYDLNTDGVA

SEQ ID NO: 153574 - protein, 48 aa, Triticum aestivum
  Clone ID: PAT_TA_47992.pep
AVIKVSEHASWSGCFYSRIIQAALLAVGAPDNLVHIVTGFAETGQALY

SEQ ID NO: 153575 - protein, 132 aa, Triticum aestivum
  Clone ID: PAT_TA_47993.pep
YLNPQFPLQVPFPGDLVRHNWYSEQPILPTLAPSKQNQQIEAMSQRVEEMNEQNQTMADLMKQLLVEFKDGLDQGAAARKQPGRGAWGRAAGGRPRRSDHSISKGCTGAAHAPAAPASGSCRRRPLPPWACW

SEQ ID NO: 153576 - protein, 111 aa, Triticum aestivum
  Clone ID: PAT_TA_47994.pep
AHHASSPNCCFCSSRSEPSPPLSITFLVPARAVVRSSRGEDENLGIPSWVGRFGNKCWGLRNRSMASAAAMRASTVTAGAAGRCRRRGFPLREQADDSLSLSLLCLVWALG

SEQ ID NO: 153577 - protein, 149 aa, Triticum aestivum
  unsure (1)..(149): unsure at all Xaa locations
  Clone ID: PAT_TA_47995.pep
MLCRDRELMRQAGRXLKDYPDIELPNATELEQLGNRMINEELSYDMETLKXEHKTIISNLNHDQKMAFDAIIESAEREHGKQIFVEGYGGTGKTYQWKAITTKLRSEGKIVLAVASSGIAALLLQGGRTAHSRFHIPINITEEPTCEIK

SEQ ID NO: 153578 - protein, 116 aa, Triticum aestivum
  Clone ID: PAT_TA_47996.pep
GRAPASSMALIVRPESIAHVQKDIDAAKETQWYAESQHQAGLRVLKRSQEETNKLKAVNQQQAEKLEGIKTQLAQVRGENQSWRSGMFSLLTGRPGEEVQSLGGNVLKELSVVMRK

SEQ ID NO: 153579 - protein, 77 aa, Triticum aestivum
  Clone ID: PAT_TA_47997.pep
TKKKVRISATTATATSGRARGSAAPRRASELAIGAGRVGRSIRLPSPSRPTLPGFACGGRGGLVAPQECGGLRWFKW

SEQ ID NO: 153580 - protein, 69 aa, Triticum aestivum
  Clone ID: PAT_TA_47998.pep
PFGFTCSMYSLQREKGDNGRRREKRVFGGGRRAIAGSSEGEESLHGGAPMVHAGPDLQEHDRHPLPQLF

SEQ ID NO: 153581 - protein, 95 aa, Triticum aestivum
  Clone ID: PAT_TA_47999.pep
FKSYREGLMSPQTETKAGVGFKAGVKDYKLTYYTPEYETNDTDILAAFRVSPQPGVPPEEAGAAVAAESSTGTWTTVWTDGLTSLDRYKRRCYHI

SEQ ID NO: 153582 - protein, 74 aa, Triticum aestivum
  Clone ID: PAT_TA_48000.pep
ERASRTLLAAIRYVSGQEQRRLLLFLAYIVPLAWLCLAAPNMLLLRCSCGASSARPSCWQDAEREPRSGPNVLA

SEQ ID NO: 153583 - protein, 85 aa, Triticum aestivum
  Clone ID: PAT_TA_48001.pep
TRDEPRERQGIGGGEGSTEATTHTRQHTPQSAPGSDTGLKITKMFTQLFSQIEMRIVMVILNAGVKTTILYTLKFKEIVTKIVTI

SEQ ID NO: 153584 - protein, 134 aa, Triticum aestivum
  Clone ID: PAT_TA_48002.pep
STNWSAKYKEIVHEAKPVEISSSNSRIFHLQDVPGEKCSKPPKVVLKANADSDFLADGNAGICHTPGLIPLAQLGVQVSTFSPYAFSQHVHNFSVNPSYPLYINTRRNSLGSSSSKAWQVEGALKTYPILVKNP

SEQ ID NO: 153585 - protein, 85 aa, Triticum aestivum
  Clone ID: PAT_TA_48003.pep
LMRPLMRRLRRKPIAIPNANPKTYAITSALPPDSPPEAPHQASGLNDVLRQGGQGGEGARPGLRRGLHQGQDRLRDHQRGYEDGF

SEQ ID NO: 153586 - protein, 115 aa, Triticum aestivum
  Clone ID: PAT_TA_48004.pep
YSFRDSGRRRMLQPMFSSAIKNDVCKIPKGILKPRMASFQEGQDDVTIYAKTTVTRPRNIKVTPMHEKLTVTVPKGKEAGILEAFSYIQIGSMILQISPPQDEVKPNFRTPPKKL

SEQ ID NO: 153587 - protein, 119 aa, Triticum aestivum
  Clone ID: PAT_TA_48005.pep
QLAYFRWNILQDHGTSHLSIVDGERNAVSMTSTVNAYFGSLILSPSTGVLLNNEMDDFSMPANTTANTPPPAPNNFVAPLKRPLSSMCPTIVLKDGKLKAAVGASGGSMIPAGTIEVLL

SEQ ID NO: 153588 - protein, 82 aa, Triticum aestivum
  Clone ID: PAT_TA_48006.pep
QGRPSHTERAAAFCSTVGAHDCTPTNLVGKKLKKQVTSSVNYHGKSSKDNMFTVMAAENIDEKRNTDKWNGLAYDISDDQQD

SEQ ID NO: 153589 - protein, 32 aa, Triticum aestivum
  Clone ID: PAT_TA_48007.pep
ATHDLEIMEIAVYAHMKRKILTLTSECTRVGP

SEQ ID NO: 153590 - protein, 42 aa, Triticum aestivum
  Clone ID: PAT_TA_48008.pep
MNPAAKAAADCLVRLALSKGSGDNISVIVIDLKSRKKTKGKT

SEQ ID NO: 153591 - protein, 113 aa, Triticum aestivum
  Clone ID: PAT_TA_48009.pep
SDLENERTADQASNGAELHVDLASRPALGHFLTELQQLVDELVGKWTAERVVAFERAYGRPPGRHPGPDRAHGQVHAERAPLAAPLRVQLPLGVRSNAPASAARVTAAIRTRG

SEQ ID NO: 153592 - protein, 159 aa, Triticum aestivum
  Clone ID: PAT_TA_48010.pep
LLSPARSAAPEHNHPVPELLLPPMTEATERAPVVPLHSFPRHLPLPLFSFPSLLSSPSISLALYCREAAMDARGPPLRPMPRRPCRSRRLGRPPCPLQELRADPAAWRPPPPIRCREIAESGPFRACLAVLNPSRIFPGAKNLSQPRHKNLASFARNLA

SEQ ID NO: 153593 - protein, 67 aa, Triticum aestivum
  Clone ID: PAT_TA_48011.pep
DDGGDDVRTRRPERAGAAGPAVVVHPRRVPGVPGLHGHLHGRHHFLGAAVAYRHHLNCATTYSTILS

SEQ ID NO: 153594 - protein, 127 aa, Triticum aestivum; identical to SEQ ID NO: 124221
  Clone ID: PAT_TA_48012.pep

SEQ ID NO: 153595 - protein, 91 aa, Triticum aestivum
  Clone ID: PAT_TA_48013.pep
LQQDSWMAPCLLTETGWIGAGPEVGGGKGADCEGRGARRAGRISSGHWLPTGEERRFSSSLRGRLLASGGAQLRGDFGRGGGGRGDVGGSA

SEQ ID NO: 153596 - protein, 47 aa, Triticum aestivum
  unsure (1)..(47): unsure at all Xaa locations
  Clone ID: PAT_TA_48014.pep
DLKATVLGIGHGRIEWIARSLLQPPEEHPSRVSGCDGEVSAMIYXSA

SEQ ID NO: 153597 - protein, 85 aa, Triticum aestivum
  Clone ID: PAT_TA_48015.pep
HASAPLLDKDAEAVREDDGLKLEIAELKSMFIERAQALIHGDLHTGSIMVTPDSTQVIDPEFAFYAPMGYDLGAFLGNLILAYFA

SEQ ID NO: 153598 - protein, 104 aa, Triticum aestivum
  Clone ID: PAT_TA_48016.pep
GEQKTPPRRRPSGSLPARSSSSSPAFPRYAPPTPDPPATPRANPRDCYFARSNSAADPSAPETRMFSPSDGRNLLPRISEVPWRRTALAGAACRRSGSANGGRS

SEQ ID NO: 153599 - protein, 112 aa, Triticum aestivum
  Clone ID: PAT_TA_48017.pep
PRVRPDCQNGSSRSTPVPSPGLGAKADSGVAPDSKTEEANSVLEGPTEAQIADSEQATYASANNDLKGTKSYQEADISGLYNLAMAIIDYRGHRVVAQSIIPGILQGDKSDS

SEQ ID NO: 153600 - protein, 62 aa, Triticum aestivum
  Clone ID: PAT_TA_48018.pep
PLAKQIDTRQLWFASKQSLTYLDGTLPGDFGFDPLGLSDPEGTGGFIEPSWLAYGEIFNGRT

SEQ ID NO: 153601 - protein, 120 aa, Triticum aestivum
  Clone ID: PAT_TA_48019.pep
MASVTSATVAIPSFTGLKASTIKSSATVRIQTAAVASPKLTVKSSLKNFGVAAVAAAASIALAGNAMAIEVLLGGGDGSLAFIPNDFSIAKGEKDVFKNNAGYPHNVVFDEDEIPKGRRR

SEQ ID NO: 153602 - protein, 55 aa, Triticum aestivum
  Clone ID: PAT_TA_48020.pep
HGQQDLRHGDGYIFHRRPSLEHEGVRAGETVNSCCHITVTDTEVITQVLASPLQS

SEQ ID NO: 153603 - protein, 81 aa, Triticum aestivum
  Clone ID: PAT_TA_48021.pep
ERAQAHRPAAGVPQGVERRAPAALLSSRRDKVTPKEKKTRTHKVNIEVVQDCEAGGSWYIYVSLYLVKLILLLFFLAAAMP

SEQ ID NO: 153604 - protein, 74 aa, Triticum aestivum
  Clone ID: PAT_TA_48022.pep
MGCSSSLSANSTGGLGNINNENSATDSKNLKVKLVLLGDSGVGKSCIVLRFVRGQFDPTSKVTIGASFLSQTLA

SEQ ID NO: 153605 - protein, 86 aa, Triticum aestivum
  Clone ID: PAT_TA_48023.pep
CYSEVQMVDSWASRLRQVYAPAHRAPYFNFPIWLKKSRNRRMRRTAERTGGRPVSPHQIWWPAAGQGKVLCSPAAAAAISVEGKER

SEQ ID NO: 153606 - protein, 126 aa, Triticum aestivum
  unsure (1)..(126): unsure at all Xaa locations
  Clone ID: PAT_TA_48024.pep
LCLQDKPEPPPEGRLPDATQGSDHLRQVFSTQMGLSDQDIVALSGGHTLGRCHKERSGFEGAWTANPLIFDNSYFTELLSGEKEGLLXLPTDKTXLTDPAFPPLVDKXAADEGSFFGDYAEAHLKL

SEQ ID NO: 153607 - protein, 75 aa, Triticum aestivum
  Clone ID: PAT_TA_48025.pep
TAGSAASLGLRRQGVIRRRHPTLPTGGCGCYHQPPLHGRTLKFNMLDLQRLMLHDARRNMWFCCESPQRCSRFPD

SEQ ID NO: 153608 - protein, 80 aa, Triticum aestivum
  Clone ID: PAT_TA_48026.pep
VSVACMSGIVTSNASVLMAPSTIIGSALHGAWLDVPLQSSAAVRVDVVRVAVDDVRVELHEFFLHPVQFVHQPCSEGVAR

SEQ ID NO: 153609 - protein, 117 aa, Triticum aestivum
  Clone ID: PAT_TA_48027.pep
MHNNGGCVQRVSGPIGGILYSLCTSPSGLIAVGGTDRAVTIYDPRRWSALSRWVGCSKYEITGLSFSSVDQSFMYVQGVDYEITCGRWRESKRAFSFRGDSNWLGFSKCANTDVVAW

SEQ ID NO: 153610 - protein, 79 aa, Triticum aestivum
  Clone ID: PAT_TA_48028.pep
MATTAADATAAAPKEQPASTGGEQVTRHSEVGHKSLLQSDALYQYILETSVYPREHECMKELREITANHPWNLMTTSAD

SEQ ID NO: 153611 - protein, 95 aa, Triticum aestivum
  unsure (1)..(95): unsure at all Xaa locations
  Clone ID: PAT_TA_48029.pep
RPLPHPRPPPPPSPSRRLHSTSPPPPPPPPPPRAEGLPXGALQDPDLREAPPPAAPLPAVALPVVPDPGPRXPFAAPRPLPPTTAPHAPPXSPSP

SEQ ID NO: 153612 - protein, 152 aa, Triticum aestivum
  Clone ID: PAT_TA_48030.pep
MLLSLAQPRLLPRLPSPATATATTARPRALALALAPRRAHSSAAETAAPGRLRAVVSERAVDGMAPAAAGQEGRPLRVGLVCGGPSAERGISLNSARSVLDHIQGDDSLVSCYYIDCGMNAFAISPAQLYSNTPSDFDFKLESLAQGISTLS

SEQ ID NO: 153613 - protein, 52 aa, Triticum aestivum
  unsure (1)..(52): unsure at all Xaa locations
  Clone ID: PAT_TA_48031.pep
MGRMSCSCGSACSCGSNCTCGMIYPALAEQGXRAAHGVVMVRARVAPENKVG

SEQ ID NO: 153614 - protein, 127 aa, Triticum aestivum
  Clone ID: PAT_TA_48032.pep
MEAAGWPEPVVRVQSLSESGAATIPDRYVKPVHDRPSVHNGTASGGVSIPVVDLSSPEGSAATARAVSEACREWGFFQAVNHGVPGDLLRRARAAWRGFFHLPVEAKQRYANSSATYEGYGSRLGVE

SEQ ID NO: 153615 - protein, 68 aa, Triticum aestivum
  unsure (1)..(68): unsure at all Xaa locations
  Clone ID: PAT_TA_48033.pep
PKLKMADGLDSPPPGLTHAPCPETLAPTPSRHATVVVPTVAPPXGSLHLRGRLGLGPSPRRAPRIHLA

SEQ ID NO: 153616 - protein, 64 aa, Triticum aestivum
  Clone ID: PAT_TA_48034.pep
NGNGCTKFADKLYHVPRVASNQSIIWLRRNKTNEMSGVEIFFQLKVNQYGTYVYIRWYNLRLRV

SEQ ID NO: 153617 - protein, 87 aa, Triticum aestivum
  Clone ID: PAT_TA_48035.pep
MSTAEANWCYATVVAPRARCSTIDASLGTHARSNCCYLRPKLIKNTRVQAGPVAPELMDAAVERLKTGFEKFKTEVYDRKPDCFEPL

SEQ ID NO: 153618 - protein, 82 aa, Triticum aestivum
  Clone ID: PAT_TA_48036.pep
GPERPGRADRRVRQRFYDPQTAIYSCLYGRPSGHRNGCCLLLTGQALATTPPKNVGTKHVDEDPQDVVNHGRNSNPSNFSFM

SEQ ID NO: 153619 - protein, 85 aa, Triticum aestivum
  unsure (1)..(85): unsure at all Xaa locations
  Clone ID: PAT_TA_48037.pep
GHLANGARAARPSWRAXRSFSARGRSRKDDMAAMNGACWGSDSRISERNFSFYYAPAPAPQGIYLFLLMMMNSGKGTASPPLLMK

SEQ ID NO: 153620 - protein, 98 aa, Triticum aestivum
  Clone ID: PAT_TA_48038.pep
TTISTTSYYNIQGRPYRTIWPSGAGAATRPSLLDGALVAALIILRPEAMRIKMPATATNCGCDEIQANLIAGRILHNQHLMPLPTDKAKGATKCRYHI

SEQ ID NO: 153621 - protein, 83 aa, Triticum aestivum
  Clone ID: PAT_TA_48039.pep
MASTALSTASNPTQLCRTRASALCKPVKGLGFGRERVPRNITCMAGSISADRVPDMSKRELMNLLLLGAISLPTFGMLVPYGS

SEQ ID NO: 153622 - protein, 63 aa, Triticum aestivum
  unsure (1)..(63): unsure at all Xaa locations
  Clone ID: PAT_TA_48040.pep
MAAMRSRRTRIPTSARLHSKADXKQKVDFADFSGLKPGSCSVSAAGREASFSDVLGAQLVARG

SEQ ID NO: 153623 - protein, 90 aa, Triticum aestivum
  Clone ID: PAT_TA_48041.pep
LSFFPDTGTHAHGCPAPTHATLRPFLPKSKPHSDRPPSGDADASPPPAGPGPPPPSPHRPTTRVGRRIPTPRGRRRRRRGGRQAPRGRSG

SEQ ID NO: 153624 - protein, 95 aa, Triticum aestivum
  Clone ID: PAT_TA_48042.pep
PRVRPLILGIWGGKGQGKSFQCELVFAKMGINPIMMSAGELESGNAGEPAKLIRQRYREAADMIKKGKVYCVVPTIRPAPACGLVGTRLDSLVIT

SEQ ID NO: 153625 - protein, 94 aa, Triticum aestivum
  Clone ID: PAT_TA_48043.pep
CFYISGHIYLQIKLVIRDVDARLILTHAIIHSSKLLIDLGYHLHISICIIVPVQYIHSFWQCALPVVAVYHVDNEIDDKVLAIDEDHELLVRRR

SEQ ID NO: 153626 - protein, 36 aa, Triticum aestivum
  Clone ID: PAT_TA_48044.pep
QRFRSGVQLYPRPLALRNVLDVSALALALSLPQDKI

SEQ ID NO: 153627 - protein, 140 aa, Triticum aestivum
  Clone ID: PAT_TA_48045.pep
ARLTRPPGSRGTRSPASSGSPASSAPPPVLFLTPAATMRSTSTSLGRRRGTPLLPTQSGRAASRAAAASRRRRGTPPPTKGRAPCVSRRRHRRCLCSTEERNPAADEGRAHCISRRRRCLRKERDPCGGEEERGGRDGDD

SEQ ID NO: 153628 - protein, 106 aa, Triticum aestivum
  Clone ID: PAT_TA_48046.pep
PTRPGWGISPRGAGYTFGQDISEQFNHTNSLKLIARAHQLVMEGFNWAHEQKVVTIFSAPNYCYRCGNMASILEVDDCREHTFIQFEPAPRRGEPDVTRKTPDYFL

SEQ ID NO: 153629 - protein, 129 aa, Triticum aestivum
  Clone ID: PAT_TA_48047.pep
LNLENAGSHLCTAVSKGDSDFIRGALAYGADPNSKDYDHRNPLHIAAAEGLYIMAKLLVEAGASVLATDRRGTTPLDEGHKSGSKPLIMLLEQAKADELSKFPTRGEEVRDKMHTRRCSGFPYHPWDTD

SEQ ID NO: 153630 - protein, 94 aa, Triticum aestivum
  Clone ID: PAT_TA_48048.pep
MAAMATTVFQAGPMEVDVKHVDKSMIPNLARPLMVVAPKETGAYPVIVFLHGWNMLNSWYEQLLTHVASHGFIAVAPQLYWMVSEPDADDIDAT

SEQ ID NO: 153631 - protein, 129 aa, Triticum aestivum
  Clone ID: PAT_TA_48049.pep
CDHRDEFLHELDEAVRLTGGVNLADLYPSSRLVRRLSVAARDMVKCQRNIYRIVQSIIRVRERAGAPEPERDEDLLGVLLKLQKDGGLQFELTTEMITAVILDIFAAGSETSSTTLEWAMSELMKNPRV

SEQ ID NO: 153632 - protein, 49 aa, Triticum aestivum
  Clone ID: PAT_TA_48050.pep
ACHFPLMSLMIMSPFSHVLSDSSFTVSRAGMRASLRRIEFMLSSCSKPH

SEQ ID NO: 153633 - protein, 51 aa, Triticum aestivum
  Clone ID: PAT_TA_48051.pep
KNIMFLKDPMNAFCTHPKCSDYTRMISFIMWVNILYYMIKNSHTLSTFFCA

SEQ ID NO: 153634 - protein, 92 aa, Triticum aestivum
  Clone ID: PAT_TA_48052.pep
TTAMANTTAIVDNNTWDNAHIATSGTAMSCAEKAGGEIFESLNDKYVLGVFGRLVGYPRDDINKLLRMVRILCGESPYIKEPDYLRDGQYRV

SEQ ID NO: 153635 - protein, 54 aa, Triticum aestivum
  Clone ID: PAT_TA_48053.pep
APRKNPPARRNLRNPSPKPDRPIYFSDDERTSEGPTTPGHRPPTDAGATNPRRS

SEQ ID NO: 153636 - protein, 46 aa, Triticum aestivum
  Clone ID: PAT_TA_48054.pep
RYIRYHSPEAVRPIYFSAEERNTQGPMTPGHRPCKDEGARNTWRSR

SEQ ID NO: 153637 - protein, 71 aa, Triticum aestivum
  Clone ID: PAT_TA_48055.pep
WQNSVARGDLQNYVLLDVILWLYVILWLHGKQHAYMHTLSLHDESSCLCIRMVYRDFVRKIQHDVQELTAL

SEQ ID NO: 153638 - protein, 82 aa, Triticum aestivum
  Clone ID: PAT_TA_48056.pep
DGGNRLPKPAPAAPPPPPMSGPRPAAAPNPSSASPSPPPPPPAAVARVAARVREEGEVSSGPSDDEALQSQLLALSNAGKYV

SEQ ID NO: 153639 - protein, 78 aa, Triticum aestivum
  Clone ID: PAT_TA_48057.pep
VCSSHDDGVVGRWWDMAWADQHVLDGQHINVRSRSELDQRTLMSVFNNKDRFLAALDFGAPSRELTVCTLTSNSKRGS

SEQ ID NO: 153640 - protein, 137 aa, Triticum aestivum
  unsure (1)..(137): unsure at all Xaa locations
  Clone ID: PAT_TA_48058.pep
AKLGDFGLARLINDGQISYMTDTAGTMGYIDPESVLAGTASVESDVYSFGVLLLEVACGRRPALVQEDGGAVHLVSWVWDLYSGGSIRAAADERLXGEFDGAEMEGVMVVGLWCAHPDRGMRPSIKPAINVLRFETP

SEQ ID NO: 153641 - protein, 44 aa, Triticum aestivum
  Clone ID: PAT_TA_48059.pep
RTSTPCICSFSSPQWLSVLTFFPLSNGTVIDACIYSFSIRHVPQ

SEQ ID NO: 153642 - protein, 89 aa, Triticum aestivum
  unsure (1)..(89): unsure at all Xaa locations
  Clone ID: PAT_TA_48060.pep
MVYIKNQKTRAFFKRFQIKFKRKRQGNTXYTATVWLSNPGKNTYTTPKYRFFVRYTNKDVTVQQLYATISADILIGAVYSHELPLYFLE

SEQ ID NO: 153643 - protein, 68 aa, Triticum aestivum
  Clone ID: PAT_TA_48061.pep
ASSDAKVTNPNPRKRPVSLPVMILKKIMSPLLHKGLWKVYFAKRRTRPRVVNDICDDALEVLFPATKP

SEQ ID NO: 153644 - protein, 62 aa, Triticum aestivum
  unsure (1)..(62): unsure at all Xaa locations
  Clone ID: PAT_TA_48062.pep
RTEVWAETFYYMAQKTYVWGILXKPSIVTPGAXCKDRATPEEITNFTLKLLQKKIPPFVPGI

SEQ ID NO: 153645 - protein, 68 aa, Triticum aestivum
  Clone ID: PAT_TA_48063.pep
LHLFSILYNKRFTAFHFPVSEEEVPDYRTIVHNPMDMAAVLQRVDSGQYFSQAAFLKDINLIVTNAKV

SEQ ID NO: 153646 - protein, 35 aa, Triticum aestivum
  Clone ID: PAT_TA_48064.pep
PTRPDALARVLMDPNHPTEILSMYQQWAIDLGRLL

SEQ ID NO: 153647 - protein, 39 aa, Triticum aestivum
  Clone ID: PAT_TA_48065.pep
QAIYLHSTYMEGLMDALTETIVRVVFKVVVKYYKLTYYT

SEQ ID NO: 153648 - protein, 43 aa, Triticum aestivum
  Clone ID: PAT_TA_48066.pep
RQVGLISGIRQLETLFYLPSIRTDAFLKQVYYLIRCKWGPCYE

SEQ ID NO: 153649 - protein, 92 aa, Triticum aestivum
  Clone ID: PAT_TA_48067.pep
ATDLDQSLDASAEDKGVTTTQLSGEKRKNVDSVGHTHVNARATLIVVKVDGLLWPGIDRRLSWCVSLRVGRACKSRICYEKDIIYFWLNRDP

SEQ ID NO: 153650 - protein, 85 aa, Triticum aestivum
  Clone ID: PAT_TA_48068.pep
PRVRPPPAPSAAIPRPITGPPPAVTLLPLPIFHVFGFMMVLRSVSMGETAVLMERFDFGAALRAIERYRATLLPAAPPVLVAMIK

SEQ ID NO: 153651 - protein, 77 aa, Triticum aestivum
  Clone ID: PAT_TA_48069.pep
MGSGEDTPGGTGGGVGGIVRGALLKALVGFGGVILIRRLRRSTTRWDHARTVGDALFGEKFSREQARQDPGNYFNLR

SEQ ID NO: 153652 - protein, 125 aa, Triticum aestivum
  Clone ID: PAT_TA_48070.pep
SCCRGQQVGQAPRRRTLCSGGGGPSTGAAAGAQVCCRCSKGGGGGPSTAAAAGAQVCCRCSGAGCGSDSRGSRGLQRRWLEQCPGLPPRYQGGCPSFGAILAALSPLEWDLGENVRACTGLSFGE

SEQ ID NO: 153653 - protein, 40 aa, Triticum aestivum
  Clone ID: PAT_TA_48071.pep
PRSHIQIHSALVPISALDQSYTRLVSMDTVKIKHLSEHSP

SEQ ID NO: 153654 - protein, 102 aa, Triticum aestivum
  Clone ID: PAT_TA_48072.pep
GKPREPRSAADAAKAAAAAPLQRQPREPRSAADAAAAAAAATAAGARACNGDGLKRARVTRLWMRCAAAALVLFWRRSHRWSGIWGKMFARVQGCALVNRRA

SEQ ID NO: 153655 - protein, 117 aa, Triticum aestivum
  Clone ID: PAT_TA_48073.pep
AGPPALTFLLLVLLLPAHQAIATAAGDAHGGPAAGGAAGRRHAPGLEEYGGGRIVDITHVPSDAAAGPLVRLKESMENGSDYNLSELRMPCHMGTHVDAPGHMIQAHFAAGLDVDTL

SEQ ID NO: 153656 - protein, 90 aa, Triticum aestivum
  Clone ID: PAT_TA_48074.pep
DGVSVCLSAPVRARLRILPRTPLFASSPGPALWTGEPPSTNHRFEDGPPLRHWVNRVTGSRRSMAPVLPLPCARTWLLACVLDQLGADAS

SEQ ID NO: 153657 - protein, 72 aa, Triticum aestivum
  Clone ID: PAT_TA_48075.pep
ATSGKGPRAGETEQRRRRGLLVFGAYAVHHVKTRHGEASRHLHLDLPSSPIDRRRGRRDNGISSLNKLLLVY

SEQ ID NO: 153658 - protein, 125 aa, Triticum aestivum
  Clone ID: PAT_TA_48076.pep
MSPQTETKASVGFKAGVKEYKLTYYTPEYETKDTDILAAFRVTPQPGVPPEEAGAAVAAESSTGTWTTVWTDGLTSLDRYKGRCYHIEPVPGEETQFIAYVAYPLDLFEESSVTNMFTSIVGNVF

SEQ ID NO: 153659 - protein, 135 aa, Triticum aestivum
  unsure (1)..(135): unsure at all Xaa locations
  Clone ID: PAT_TA_48077.pep
MSPHTETLAGVGDIAVVVEYIKXSQYTPECDSNDTDLFATFRVYSYTGFPPENTGSXVAGESSTCTCTTFCTDGLTSLDRYKGLCYHIXPVAGEDSQCICYVSYPLYLFEEGSVTNMFTFIEGNDFXFKALPALR

SEQ ID NO: 153660 - protein, 99 aa, Triticum aestivum
  Clone ID: PAT_TA_48078.pep
ASSAGPSLFAPRGDPRAGCSTEPFLVLAVCMAGRLYLSLFQNLIESHPSTTGVYVCPPTGKKAATGQAEKGGQLGSAQLPLWTGEEEGGGERPREEKAS

SEQ ID NO: 153661 - protein, 150 aa, Triticum aestivum
  Clone ID: PAT_TA_48079.pep
KRTTSGIKAETFAGQHDKSNALDSEIQQIHCAATNNQVEACAFLIQASHTTPIEPDHAEKIGMLESDIEDARMATIIREEIEMIVLREFVNEIEIRLHGNEMEYNMKQDICSVIQNEAVAEAVLNLNSALLKFNEERSCSEAVSTLQRQE

SEQ ID NO: 153662 - protein, 55 aa, Triticum aestivum
  unsure (1)..(55): unsure at all Xaa locations
  Clone ID: PAT_TA_48080.pep
MATKQSXLAAAAVCLLLLXPLPAGYAVTDVEYCNKGKNYPVKVSGVEIVPDPVER

SEQ ID NO: 153663 - protein, 91 aa, Triticum aestivum
  Clone ID: PAT_TA_48081.pep
RCPRRWSALAHTCPHASSPWLYSSPACLPALSPSASGNLPLQTSGQACGSVSFPRAANLFHCPAWKIGEVGSAGCYVMQVARNGCLCGRVG

SEQ ID NO: 153664 - protein, 41 aa, Triticum aestivum
  Clone ID: PAT_TA_48082.pep
PKLQHNSHNIDLAIYNHRSKQIDSVAGAQDKGRACSTYCSP

SEQ ID NO: 153665 - protein, 59 aa, Triticum aestivum
  Clone ID: PAT_TA_48083.pep
ALHPLLEPLPGSAAASSSAPLGRHGSDARQRTNLTEASRKFPSVRPCAVGLRWGFASSL

SEQ ID NO: 153666 - protein, 84 aa, Triticum aestivum
  Clone ID: PAT_TA_48084.pep
ELQSLMLERKPVVYTYLRHIEGDLVLRGSRDNATEDNHLGWHCCACHTCYGMRGSHCPEGLSVEPCRCTLADRHRCQFNVQHQH

SEQ ID NO: 153667 - protein, 89 aa, Triticum aestivum
  Clone ID: PAT_TA_48085.pep
SPIHTMGWPVHWYAVPGHPTHLWLHTNQARRSKRTTPWVHKSWPAVHSHPHLVTHWIFPKLPGLLKGTPSPQIANLLNGGQRQSRCLLP

SEQ ID NO: 153668 - protein, 66 aa, Triticum aestivum
  unsure (1)..(66): unsure at all Xaa locations
  Clone ID: PAT_TA_48086.pep
MSTTKVKRRVGKYELGRTIGEGTFAKVRFARNTETGDPVAIKXLDKEKLLKHKMVEQIKREIATMK

SEQ ID NO: 153669 - protein, 90 aa, Triticum aestivum
  Clone ID: PAT_TA_48087.pep
MAATTTSLSSSTLAGKAVKNVPSPALFGEARVTMRKTAAKAKQVSSGSPWYGADRVLYLGPLSGEPPSYLTGEFPGDYGWDTAGLSADPE

SEQ ID NO: 153670 - protein, 112 aa, Triticum aestivum
  Clone ID: PAT_TA_48088.pep
KSGGESTCVRPWSWSAKPRRSETRGHHPHHRRRRSVPALPPPASLRRSPPSPSRLARAGRKGYPIMDAAKDANPSCKLHTRLRLWQFADRYIFEPIDGLADLYLSVSRASGS

SEQ ID NO: 153671 - protein, 72 aa, Triticum aestivum
  Clone ID: PAT_TA_48089.pep
HNLGRILEIVANSRVCTRCSHRRRGGPYVSAGRWCMLCLCVSRVLFVSLAGWRLARRCPVRALIYSTDLQIC

SEQ ID NO: 153672 - protein, 123 aa, Triticum aestivum
  unsure (1)..(123): unsure at all Xaa locations
  Clone ID: PAT_TA_48090.pep
MYSFGKEIIYFFTEEYQTLSSACKSLYQSQTFAMARPSVLNTSFTLLHRSAPRSVASCPSYQPTLPWSPRSVRPRCPSEPPAPPPPVPPPPDAPPPXPPQSAPPVLVGAPNSLPPPLGKWIGV

SEQ ID NO: 153673 - protein, 120 aa, Triticum aestivum
  Clone ID: PAT_TA_48091.pep
AGVTREIVAKIKEKWRTDEVVRVKVNGTPALNMRLFHEILERKTGGLVIWRSGTSVSLYRGVAYDVPETTKGTNRTWQDVGMKSSIRGPPIPSSLPNEKVNSMQDSNGGLVSNTEKEETI

SEQ ID NO: 153674 - protein, 109 aa, Triticum aestivum
  Clone ID: PAT_TA_48092.pep
PSICPVGMLLALMSWWRAIPGEQSWCKYAGPRAEQPKSCQFMSQFITQVDNSILNCNCICSKQDWYFVVVVVVQNYRCPLRRKLLSPAMAMRTPGTCPPPRACFMGLRI

SEQ ID NO: 153675 - protein, 83 aa, Triticum aestivum
  Clone ID: PAT_TA_48093.pep
SSSPSSSSSPHPQTARCASSSAPMAAAEGVRPARRVAAAIISGGGADSWRTEGSGCAPRAPRCAVCGSGAAAPEPWIIFPPLL

SEQ ID NO: 153676 - protein, 61 aa, Triticum aestivum
  Clone ID: PAT_TA_48094.pep
LLPPRAPCSSARYLIVIDDVWTIAAWDAIRSVLPDNNLDSRIMVTTRIEAGAIACSDASGI

SEQ ID NO: 153677 - protein, 72 aa, Triticum aestivum
  Clone ID: PAT_TA_48095.pep
MEESTDLHFLESGSAEDQYTRRTRFSELKEDVRKAFSKDKAVAAIASSTSSSSPRGDGKVSRHGHKKARLSR

SEQ ID NO: 153678 - protein, 50 aa, Triticum aestivum
  unsure (1)..(50): unsure at all Xaa locations
  Clone ID: PAT_TA_48096.pep
RGSSRACTCATAAPXMAPSHFMMIYNTSICCAAVNNFLLINSFLFFNSNT

SEQ ID NO: 153679 - protein, 149 aa, Triticum aestivum
  Clone ID: PAT_TA_48097.pep
ATIAAYTGLPPEAFITVAAVIAGLYMALSGSFARPAPSPPRRREAEDERTLEALPPPVQLGEVTEKELGLYDGSDPKKPLLIAINGQIYDVTQSRIFYGPGGPYALFAGRDVSRALAKMSFELSDLTGDVSGLGPFEVEALQEWEQKFM

SEQ ID NO: 153680 - protein, 90 aa, Triticum aestivum
  Clone ID: PAT_TA_48098.pep
MAAEPAADGQDPPLADAAAASGDDDAAAANALLSAASEQLTLVYQGEVYVFDPVPPQKVQAALLVLGGCEVPPGLVSMAGPTAYGEKSTT

SEQ ID NO: 153681 - protein, 131 aa, Triticum aestivum
  Clone ID: PAT_TA_48099.pep
NNFARGHYTIGMEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNKLV

SEQ ID NO: 153682 - protein, 59 aa, Triticum aestivum
  Clone ID: PAT_TA_48100.pep
HASASCHLPTLAVTTHLVNHGGEFDPWAVMHSNVTNARICTEQPCMFQLRRMHGRNTTP

SEQ ID NO: 153683 - protein, 61 aa, Triticum aestivum
  Clone ID: PAT_TA_48101.pep
PMTQINFLTDPVNSRTCDPVLGQLWTKGWRLIYQRLQACMLYGGKHYISLKTFHLFKFLIC

SEQ ID NO: 153684 - protein, 43 aa, Triticum aestivum
  Clone ID: PAT_TA_48102.pep
GLEDSAVKTAERLTLILSRIQMYKPLLSAWAWLIRKLMSVYLN

SEQ ID NO: 153685 - protein, 84 aa, Triticum aestivum
  Clone ID: PAT_TA_48103.pep
LETYGGLIDMVLSIHDSVEDSLLLLVCYCVQLSSSPVSHRFGLDVWTRTTSVGDPDIRSVALAMTTSVSVQLTYYQNLTYSLHS

SEQ ID NO: 153686 - protein, 145 aa, Triticum aestivum
  Clone ID: PAT_TA_48104.pep
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPRYYDGRYWTMWKLPMFGCTDATQVINEVEEVKKEYPDAY

SEQ ID NO: 153687 - protein, 60 aa, Triticum aestivum
  Clone ID: PAT_TA_48105.pep
TRPKHEDTMFQVLRFNIFWWGRMIIDLLRIRRFNTCVFLCCCTHRRTLRAMQLLTIRCIM

SEQ ID NO: 153688 - protein, 124 aa, Triticum aestivum
  Clone ID: PAT_TA_48106.pep
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSFPGYYDGRYWTMWKLPMFGCT

SEQ ID NO: 153689 - protein, 78 aa, Triticum aestivum
  Clone ID: PAT_TA_48107.pep
PTRPPTRPQLYQTPDHHEFVREQIISQVINSGNLSFVILSFILCFHTFIFRLINNRFQLKSNREAYYGYVPMAYDEFL

SEQ ID NO: 153690 - protein, 113 aa, Triticum aestivum
  Clone ID: PAT_TA_48108.pep
MASFSEAPPGNPDAGAKIFKTKCAQCHTVDAGAGHKQGPNLHGLFGRQSGTTAGYSYSAANKNKAVEWEENTLYDYLLNPKKYIPGTKMVFPGLKKPQDRADLNAYLKKATSS

SEQ ID NO: 153691 - protein, 142 aa, Triticum aestivum
  Clone ID: PAT_TA_48109.pep
DRRGQVARDRPPAPNHISLALSALTLARSPPSCSSPLRPPPAAMVSWSDSESTEGSAAQYISSDDSPVKIPATIDEPSFEGLVDDLNVICEHGNPRRKYVAFEGISIGRGFIACATESVANWGLVQGVDEHWLEHLQNAYHK

SEQ ID NO: 153692 - protein, 150 aa, Triticum aestivum
  Clone ID: PAT_TA_48110.pep
VDRRKRTPLMLAATHGHIDCALALLRAGANILMFDSVNARTCLHHAAYYGHADCLRAILAAARTTPVADSWGFVRFVNVRDEHGATPLHVAARQGRPECVHLLLESGAIVSAPTGSYGFPGSTALHLAARGGSLECVRELVAWAPTACTR

SEQ ID NO: 153693 - protein, 81 aa, Triticum aestivum
  Clone ID: PAT_TA_48111.pep
SGLPISYYLIYLYYINPDIQTDVQSPAIQHIYQSPSSRWRSLLQHSPPPLVASLTRRREASQRARERERGRGRERESNTGR

SEQ ID NO: 153694 - protein, 70 aa, Triticum aestivum
  Clone ID: PAT_TA_48112.pep
NIFSLSMKHTLTNLVFSLADPCITTCQTFRQSYLSMVYSIIYYCHLIPQNNHMNQLSSTTVMTCFWYIML

SEQ ID NO: 153695 - protein, 134 aa, Triticum aestivum
  Clone ID: PAT_TA_48113.pep
FSPLNTIDISENYFTGEFPKFLCQSDKLQFLLALSNNFSGEFPTSYSSCKTLERFRVSQNQFSGSIPHGIWGLPNAVIIDVADNGFIGGISSDIGISATLTQLLVQNNNFSSELPMELGNLPQLKKLVASNNRF

SEQ ID NO: 153696 - protein, 146 aa, Triticum aestivum
  unsure (1)..(146): unsure at all Xaa locations
  Clone ID: PAT_TA_48114.pep
VTENSVRGGHWLKVVSRRRRRICFLGQIRTRXPSAPCSRGVGKIYLCAVCLLVHHMVAPLDQAAPHATLEQDQRDAATATENSGRDHGAADIADADPGEAIGAPGSAPSVTSRISVHKVCSLVGKFNKFKKGLVEEIGFGGMLGIQ

SEQ ID NO: 153697 - protein, 129 aa, Triticum aestivum
  unsure (1)..(129): unsure at all Xaa locations
  Clone ID: PAT_TA_48115.pep
PTRPELGLDSYHNLGPPAVSSFLSSRTKPNEPLPSSSSSSFFFFLRRISSSDHIQAAQAGDETRSLARSTVHNQTRQRAAMAFDKVEELRPGTYGHNXQLRVLSSKPVVLHRPQGGRAGGNMRIXECIV

SEQ ID NO: 153698 - protein, 123 aa, Triticum aestivum
  unsure (1)..(123): unsure at all Xaa locations
  Clone ID: PAT_TA_48116.pep
MASGSGSGEGKAGRAGAVYQQYGTGYDERQWWPWLVPTVLGACVSVFAVEMYLNDCPRHGSPLRGDARCVAGFLRQFSFQPLRENPLLGPSSATLEKMGALDWXKVVHQHQWGRLFSCIWLHA

SEQ ID NO: 153699 - protein, 72 aa, Triticum aestivum
  Clone ID: PAT_TA_48117.pep
MAEEEGTQQLPFVRETVLKKRKDNEEWATKNRERKAAKRQRRRHDAKGAIKRPEDFVKEFRNKELDFLRVRM

SEQ ID NO: 153700 - protein, 143 aa, Triticum aestivum
  Clone ID: PAT_TA_48118.pep
MSPAKVDTTKKADPKAKALKAAKAVKSGQAFKKKDKKIRTKVTFHRPKTLTKPRTGKYPKISATPRNKLDHYQILKYPLTTESAMKKIEDNNTLVFIVDIRADKKKIKDAVKKMYDIQTKKVNTLIRPDGTKKAYVRLTPNYD

SEQ ID NO: 153701 - protein, 113 aa, Triticum aestivum
  unsure (1)..(113): unsure at all Xaa locations
  Clone ID: PAT_TA_48119.pep
MAAALSSTGGAPASTPTNLLGKKLKKQATWAVNYHGTSSKANRFTVMAAENIDEKRNTDKWKGLAYDISDDQQDITRGKGIVDSLFQAPTGDGTHEAXLSSYEYVSQGLKKYD

SEQ ID NO: 153702 - protein, 141 aa, Triticum aestivum
  Clone ID: PAT_TA_48120.pep
MMSITSTAAGTPLCPPRVSGGGRRSSRCAVRAQADEGAADSAEHKSVEIMRKFSEQYARRSSTFFCSDKSVTAVVIKGLADHKDQLGAPLCPCRHYDDKAAEAAQGFWNCPCVPMREKKECHCMLFLTPDNDFAGEDQAIN

SEQ ID NO: 153703 - protein, 80 aa, Triticum aestivum
  unsure (1)..(80): unsure at all Xaa locations
  Clone ID: PAT_TA_48121.pep
MEGMEEDVXLGANRYSEHQPIGPAAQGGGAGEKDYMEPPPAPFFEAGVLTSWSFVRAGYAGVLATFPFLYGVVLAQIGGG

SEQ ID NO: 153704 - protein, 59 aa, Triticum aestivum
  Clone ID: PAT_TA_48122.pep
IRVYACVRKFVAYTCTALILLLLLRLSRLVQQNRPLDSRYIVHMSTCKASSAVTLSSRV

SEQ ID NO: 153705 - protein, 62 aa, Triticum aestivum
  unsure (1)..(62): unsure at all Xaa locations
  Clone ID: PAT_TA_48123.pep
LGTRRVLPVDESSSSXGGPHPRPPRAGQGRFSPTLQWPFSSRTXFISPLTLYFSHRRRRSGP

SEQ ID NO: 153706 - protein, 54 aa, Triticum aestivum
  unsure (1)..(54): unsure at all Xaa locations
  Clone ID: PAT_TA_48124.pep
PTHSDYDALERXMLMTTHKISGPTIYTGRTLFMRNCPKQGHYFAYLKTLQKLLA

SEQ ID NO: 153707 - protein, 38 aa, Triticum aestivum
  unsure (1)..(38): unsure at all Xaa locations
  Clone ID: PAT_TA_48125.pep
PWEEVYSSXQVKPSLSPSGGGIARRCLLIIHSRGNHPT

SEQ ID NO: 153708 - protein, 108 aa, Triticum aestivum
  Clone ID: PAT_TA_48126.pep
FDTPNYSCFLPDPMAAIDLRFHLHPAAFSSVHPSNSSAKPHRHCPPQRVHAAGRRCLLRAKSSNGHPQIGASFSDGVLDAKPSGAGGPAPEQGEHTVSITVVGAFGDL

SEQ ID NO: 153709 - protein, 82 aa, Triticum aestivum
  Clone ID: PAT_TA_48127.pep
SRYPCYCQDMQWVGQDALDFGWAKRVDGGVPMVGDIASKSVSYHMRCRNGKGHDMIAVSMLLPGHAMDKFEKEIAVWVNNEN

SEQ ID NO: 153710 - protein, 50 aa, Triticum aestivum
  Clone ID: PAT_TA_48128.pep
NYMELGSCASIAIPQKNRYDEDYKMTYLKLISISIIEKLHAKKGNINNKK

SEQ ID NO: 153711 - protein, 131 aa, Triticum aestivum
  Clone ID: PAT_TA_48129.pep
MSTAAANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPFY

SEQ ID NO: 153712 - protein, 79 aa, Triticum aestivum
  Clone ID: PAT_TA_48130.pep
IFEVVVGLGHEMRAEEHASQQSGLHPERVDKQDMHNKPQGNYENKEQFPLISVTDRKKSEPFYAFNPRRRLWVNECIFP

SEQ ID NO: 153713 - protein, 95 aa, Triticum aestivum
  Clone ID: PAT_TA_48131.pep
MAMELKLDVKLRHTGRQGSRRGRDMASATLLKSFFMPKMVEWNAARHVARQRVSMSVRTVAYDDELDKTLKTIAKTMRGMLPMNQSNDNCNKRLD

SEQ ID NO: 153714 - protein, 111 aa, Triticum aestivum
  Clone ID: PAT_TA_48132.pep
PRVRSQEQSFSLQQASTMDRRIAPHSSFKIPAGSMTVFTMLAMLVTLFVYDRALVPLARRRTGLDRGISFLHRMGVGFTISVAASLVAGFVERHRKEAAAAGGTTDAGTAP

SEQ ID NO: 153715 - protein, 49 aa, Triticum aestivum
  Clone ID: PAT_TA_48133.pep
MAAKCYPTVSDEYLAAVAKARRKLRGLIAEKNCAPLMLRLAWHSGGTFD

SEQ ID NO: 153716 - protein, 110 aa, Triticum aestivum
  Clone ID: PAT_TA_48134.pep
MGSIAAGADEDACMYALQLVSSSILPMTLKNAIELGLLETLMAAGGKFLTPAEVAAKLPSAANPEAPDMVDRMLRLLASYNVVSGRTEEGKDGPLFRRYGAPPRCKYLTP

SEQ ID NO: 153717 - protein, 97 aa, Triticum aestivum
  Clone ID: PAT_TA_48135.pep
EALREERVAAVSLAAAAAACVTFDTSAAVVISLDIVLPAKPGDRTFCRERLMLQALPRAANERDEEPKTYRYPGWALYMTTAEAGDFYWMVVSVPYA

SEQ ID NO: 153718 - protein, 112 aa, Triticum aestivum
  Clone ID: PAT_TA_48136.pep
MGETVTNVSEYQAIAKQKLPKMAYDYYASGAEDEWTLKENREAFSRILFRPRILIDVSTIDMTTSVLGMKISMPIMISPTAFQKMAHPEGEYATARAASAARTVMTLASGAT

SEQ ID NO: 153719 - protein, 56 aa, Triticum aestivum
  Clone ID: PAT_TA_48137.pep
MARPQQEAIDTFISITGADEAVAIRKLEEHAGDLNQAGNAHFTEGDSTVNPINQSI

SEQ ID NO: 153720 - protein, 125 aa, Triticum aestivum
  Clone ID: PAT_TA_48138.pep
SRGPSQGRVEPYSIGLRSDKVPADSGVRADGFPATSTVYSDVRNLRYDDEPNNWGRRRRAGEALPGTLATGVGLQAGGRGLERRIWSEGREARTVRSSGGVLRGVGGRRKRPVQATPPPSSSWAR

SEQ ID NO: 153721 - protein, 79 aa, Triticum aestivum
  Clone ID: PAT_TA_48139.pep
GAGRGAEGPLESVVVGMVSRIVGDELVAEDVGPLAAHYGRHGGPRRLEAPPIRPPPIAAVLLASAAGVALHLIISLSGR

SEQ ID NO: 153722 - protein, 51 aa, Triticum aestivum
  unsure (1)..(51): unsure at all Xaa locations
  Clone ID: PAT_TA_48140.pep
GVHFFLLGGAGKFLXTKRPHHQWLLGTKNYFIKGWFSMTELGHWSHVPGIW

SEQ ID NO: 153723 - protein, 73 aa, Triticum aestivum
  Clone ID: PAT_TA_48141.pep
WTKWLQHPSLITNAGKDWELVLPKHHQFKIMTQLETLAGCFGWDPNHIMIPWVSSREFHSASVLLVLEMLAAK

SEQ ID NO: 153724 - protein, 74 aa, Triticum aestivum
  unsure (1)..(74): unsure at all Xaa locations
  Clone ID: PAT_TA_48142.pep
VPYLXYHSGYGLQILNIFPDNGSMVVSDILKLGDFNSSSRQGCHVPMANSATKIEPPFXISPLYQNLIFYICAK

SEQ ID NO: 153725 - protein, 39 aa, Triticum aestivum
  Clone ID: PAT_TA_48143.pep
LPAAAVVTVVYPSSFLFLDSSTLVGVGGGGGGVDLDVTG

SEQ ID NO: 153726 - protein, 82 aa, Triticum aestivum
  unsure (1)..(82): unsure at all Xaa locations
  Clone ID: PAT_TA_48144.pep
PRVRENKPKVWGIAVCPSATARVPSRRRPAATTAGPPPRRAHPAEAPPPRXRYRSPATPPAVEQALPPAAPPSLEQPLPSSS

SEQ ID NO: 153727 - protein, 136 aa, Triticum aestivum
  unsure (1)..(136): unsure at all Xaa locations
  Clone ID: PAT_TA_48145.pep
VQTARRVSLCCNGSQERARQRXTRAXEARRAERKRGGRGGDEAEXGAVGEEQRRQRPLQRRAHQHGQELADHHQRIMEAPWINPETEEDADELEAGGRGKWQGDDNGGLGGRGDGLHRAVAKRRRSCQLCKNGAPL

SEQ ID NO: 153728 - protein, 58 aa, Triticum aestivum
  Clone ID: PAT_TA_48146.pep
FLHACLAGTVILELWTPKLILLLIDLFDRFHNQMVLHHLSPDLYLDPSIKPNLILLIV

SEQ ID NO: 153729 - protein, 119 aa, Triticum aestivum
  Clone ID: PAT_TA_48147.pep
MGGGSGDLSPTGIPASPSSSSSDSLPRVSDGDSEGGCICDDPEVEALLYGSQFQHRSLREAKDLIRRYKPGYWIEGVGNTKGGDYLLPETTTLLLVGPRGAGKSTLVNRITRVFDKDDD

SEQ ID NO: 153730 - protein, 69 aa, Triticum aestivum
  unsure (1)..(69): unsure at all Xaa locations
  Clone ID: PAT_TA_48148.pep
TEQLRCLDKAAIVEYDDEGRRGAWRLATLTQVEETKLVVSMVPIWVXTLPFGIRRSGATFFVRGQGWTA

SEQ ID NO: 153731 - protein, 65 aa, Triticum aestivum
  Clone ID: PAT_TA_48149.pep
LRSYYRVITRQAHHKARNIKQSLSWHNEPDSYISHCELHLTDHISVKQTRLDKQGIRSCMSRTRG

SEQ ID NO: 153732 - protein, 35 aa, Triticum aestivum
  Clone ID: PAT_TA_48150.pep
VVRALSIALYSSMCTPARSIENNDMSKIGGAANMN

SEQ ID NO: 153733 - protein, 105 aa, Triticum aestivum
  unsure (1)..(105): unsure at all Xaa locations
  Clone ID: PAT_TA_48151.pep
MGKGGGCVPSKKRQPPATTVAAAPSSSSATAVPRDAPEEALCAPTGESRQTLRLYIVFYSMYGHVEELARHAAXGAGAVEXGVRLSGARDSLEVLERCRRHPRTP

SEQ ID NO: 153734 - protein, 142 aa, Triticum aestivum
  Clone ID: PAT_TA_48152.pep
HSWERQPQSCSYPSSLYSFLRYPLSYRGLLRAPVPHPSGLLHRGELLTQYSLVTMGRLCELVAMVRTPSFSTAAPVPPGDALFLDSDTASGGCCKQRKTALQAGPAPPTTDVIRGRDAATPARGATTVGRWSCTSKTMLDCD

SEQ ID NO: 153735 - protein, 51 aa, Triticum aestivum
  Clone ID: PAT_TA_48153.pep
LPMEYRLLQIPSMPEVKLTNLSLNGFFPLGNIHCSQIKSMDKTREKHRQNA

SEQ ID NO: 153736 - protein, 106 aa, Triticum aestivum
  Clone ID: PAT_TA_48154.pep
MGLVGGILGFGLGLAAACLVYLRFLAPRRRPQDPVIRPLRDLDHETLQTMVQDIPLWVKYPDYERIDWMNKFICDMWPFLDKAICKIIRGVAKPICDQYVGKYGIE

SEQ ID NO: 153737 - protein, 49 aa, Triticum aestivum
  Clone ID: PAT_TA_48155.pep
TDRAKACTPTNFLRKKVKKLVTYDANYHGKSYMVNRFTDMAAEIIGPMR

SEQ ID NO: 153738 - protein, 94 aa, Triticum aestivum
  Clone ID: PAT_TA_48156.pep
KNFAIDFLMGGVSAAVSKTAAAPIERVKLLIQNQDEMIKAGRLSEPYKGIGDCFGRTIKDEGFGSLWRGNTANVIRYFPTQVSICCCFCCAYFH

SEQ ID NO: 153739 - protein, 69 aa, Triticum aestivum
  Clone ID: PAT_TA_48157.pep
LSERGSEHAIYLHKAATAPTWNASAATFEGDSQRLKHTHGHKETHPCNSTSLCSMSIACRIRDKQNSTI

SEQ ID NO: 153740 - protein, 104 aa, Triticum aestivum
  unsure (1)..(104): unsure at all Xaa locations
  Clone ID: PAT_TA_48158.pep
HLTNRAITGSRTKKAVGSRLSAVELSRTDAXERPPLPCRRLPPELPISRTQVAGKEDEGRAPSLTGERVEKRLSREGRVAADAAGFGRREADQLGRGQREWDGR

SEQ ID NO: 153741 - protein, 96 aa, Triticum aestivum
  Clone ID: PAT_TA_48159.pep
MSKEEVIAGGDTADVAAEKAPYWDPPPAPLLDTSELTRWSLYRAVIAEFVATLIFLYVSLATVIGYKSQSAVQPGTGVGYLGVACAFGATIFVLVY

SEQ ID NO: 153742 - protein, 119 aa, Triticum aestivum
  unsure (1)..(119): unsure at all Xaa locations
  Clone ID: PAT_TA_48160.pep
LSISFYSNTLSAALLSFERMGAKKNRSSPAQPMVSSLSVRNLVVREGVLRASRPTSGRGDIGPRRTLLETAPGPPAPWLAAPGRXRPRARPPCARARPPPGRRGRASRGRDRPSIPRKL

SEQ ID NO: 153743 - protein, 140 aa, Triticum aestivum
  unsure (1)..(140): unsure at all Xaa locations
  Clone ID: PAT_TA_48161.pep
MAIRRQSSAAASLLLPPVAALLFLWVFGGGHVMAHNEIRNMTALQKHVSFFDRNKDGIITPSETFEGSVAIGFNVTYAREFATLVHTANGPITSPADAPLPHLSIYIENMQRGMHGSDTGAFDXKGRFVPQKFEEIFIKH

SEQ ID NO: 153744 - protein, 92 aa, Triticum aestivum
  Clone ID: PAT_TA_48162.pep
MRRNLVLFTKDAWSKHHQDERAALPDLHKQVTHAAGHRLDFMMSSSSARTSRLSSSDGRISSAASATITRWLLHRRARKSSTPITLRAGILF

SEQ ID NO: 153745 - protein, 57 aa, Triticum aestivum
  Clone ID: PAT_TA_48163.pep
RVRSSEPRTQTVVGCSTKVSSPPPHKHHGSETQYMISYSVRNLRSARAWVVLIKSRV

SEQ ID NO: 153746 - protein, 104 aa, Triticum aestivum
  unsure (1)..(104): unsure at all Xaa locations
  Clone ID: PAT_TA_48164.pep
MANPRVFFDMTVDRTPAGRIVMELYMDAVADTVENFRALCTAQKGVEKSVKPMHYTVSXMDRVIHHLMRHCRYFTKGFSTGGESIYGEMFGDKXFVHKHTKDRD

SEQ ID NO: 153747 - protein, 113 aa, Triticum aestivum
  Clone ID: PAT_TA_48165.pep
LSTCRLHGVSFLCRPRDVVLCSHHLIRAGLHLVPLDVLRLASELTRSETCIPALLVLAIIASVGGCRPAALTLLHLLPRRGGTNRGSSRARSSEGVPGSSKVQSGRTRWCNWW

SEQ ID NO: 153748 - protein, 84 aa, Triticum aestivum
  Clone ID: PAT_TA_48166.pep
GITHILYQDKGMRNYTYFIPGQGYEELHIFYTRTGIDTMSKLLTYRIEPTRWLFAQNTNHIFQADCQIKVGLRAFLDKLLSSLE

SEQ ID NO: 153749 - protein, 149 aa, Triticum aestivum
  unsure (1)..(149): unsure at all Xaa locations
  Clone ID: PAT_TA_48167.pep
MAASSSLPAAVPALLLALLLAAFAPELAAAASSRRPTHQPPPFPAGLAPLHQRRAASSSGRYAASAAAATDNGTAKPFTAHYFQQELDHXTFTPKRLXLFXHKYXLNDTFWRRKPAAGPLFVYTGNEGDIEWFTTNTGFMFDIAPEFGA

SEQ ID NO: 153750 - protein, 117 aa, Triticum aestivum
  Clone ID: PAT_TA_48168.pep
LWAAAAACASPTLILPTHEQRRQGVLAQRRQGTPIALQRLNPLSARIQRRQGVLAASAGARRSGGGVVAASLYSSPSRITVLLRSQVPNSPTPSLIYTSWRIQPLYRRKPVLKNSSW

SEQ ID NO: 153751 - protein, 127 aa, Triticum aestivum
  Clone ID: PAT_TA_48169.pep
PTRPQNGCAREAIGVFNRMLKPHVCVLPNEKTFSSVISACSQLGNLRFGLWVKSFMGSLGIELDDHLRTALVDLYTKSGRIDSAFDLFKGLRTRDVVSYSAMIVGCGMNGKLNEAIGLFKEMSDANI

SEQ ID NO: 153752 - protein, 109 aa, Triticum aestivum
  Clone ID: PAT_TA_48170.pep
APYHSRSTTRSTARTHREIQRCHSSMPTRYDPFISPYRDLSARVDTTIRHQPWMTEEEWSSTCALEWRRGCQTAVWDRVGLVGDMRWRARGGDGEVYGRGSGGIPLPGA

SEQ ID NO: 153753 - protein, 91 aa, Triticum aestivum
  unsure (1)..(91): unsure at all Xaa locations
  Clone ID: PAT_TA_48171.pep
MAAAAVAADSKIDNLRDAVAKLGEISENEKAGFISLVSRYLSGEAEQIEWSKIQTPTDEVXVPYDTLAPPSEDLDAMKALLDKLVVLKLNG

SEQ ID NO: 153754 - protein, 72 aa, Triticum aestivum
  Clone ID: PAT_TA_48172.pep
IIYITDALSVVPSNRLYLSTPSFATRSTGKTNRAHSCTCCSRTVSMLCSCMNHRIGSPRCELACAVYDGTAP

SEQ ID NO: 153755 - protein, 64 aa, Triticum aestivum
  Clone ID: PAT_TA_48173.pep
LGHPQHLQAARATVSLCPRCTSALPHVVAWEHGAGGAREQHVCEFRGELQRAGRVGRGGNPGFR

SEQ ID NO: 153756 - protein, 94 aa, Triticum aestivum
  unsure (1)..(94): unsure at all Xaa locations
  Clone ID: PAT_TA_48174.pep
MSPQTETKAGVGFKAGVKDYKLTYYTPEYETKDTDILAAFRVSPQPGVPPEEAGAAVACESSTGTWXTVWTDGLTSLDXYKGRCYTSSLCGKTA

SEQ ID NO: 153757 - protein, 88 aa, Triticum aestivum
  Clone ID: PAT_TA_48175.pep
ERWGYRCFWVTTWGTLAAWLHHMLIDKSREHRSECLSISCRMTVRLSDRSSDRKAVSGGANSGTDSSTDSLERETSRYTSISSYHVGR

SEQ ID NO: 153758 - protein, 67 aa, Triticum aestivum
  Clone ID: PAT_TA_48176.pep
DGRYWTMWKLPMFGCTDATQVINEVEEVKKEYPDAYVRIIGFDNMRQVQCVSFIAFKPPGCEESGKA

SEQ ID NO: 153759 - protein, 72 aa, Triticum aestivum
  unsure (1)..(72): unsure at all Xaa locations
  Clone ID: PAT_TA_48177.pep
QLICSLPETLARATIVKSRVIPKKAKWGTTRXVAVPKHTTVCMVERAKPYADELGISVTTMRSTGTGIRDMD

SEQ ID NO: 153760 - protein, 53 aa, Triticum aestivum
  Clone ID: PAT_TA_48178.pep
SVNSLKSSFLPLATSVIAYMVALQERLMQIKADRELIQYMCRDLDWTGQTQMA

SEQ ID NO: 153761 - protein, 63 aa, Triticum aestivum
  Clone ID: PAT_TA_48179.pep
RCKIAEIHYVHKKQSGGSRQIADIIVQFEPIEAGSRYQFNTEITGGAGSKEYLPSVIKVIEQS

SEQ ID NO: 153762 - protein, 64 aa, Triticum aestivum
  Clone ID: PAT_TA_48180.pep
GYAFKLNGHIRWICADINRARNGELYRFICVNNGALVQSEVYEAFGLTVIDAMTCGVATIATCH

SEQ ID NO: 153763 - protein, 77 aa, Triticum aestivum
  unsure (1)..(77): unsure at all Xaa locations
  Clone ID: PAT_TA_48181.pep
MARATIVKSRVIAKNAKWGTTRXVAVPKPTTVCMVERARPYADELGESVKTMRSTGTGVRDMDELDATSGKILAWIG

SEQ ID NO: 153764 - protein, 85 aa, Triticum aestivum
  Clone ID: PAT_TA_48182.pep
SRRAVDGHRRDRSAPRPWAKPRSLYGCFPREQHFSTRQRVCVRALVYRSPRPGRATGACSPTTRRRPVRRKPRHRRGARMPWFRS

SEQ ID NO: 153765 - protein, 52 aa, Triticum aestivum
  Clone ID: PAT_TA_48183.pep
FDRSPCTLSPSLAAGSMAEVTAAAVCLGGGSTTSTLSCRAPEQSHCSFPCGS

SEQ ID NO: 153766 - protein, 63 aa, Triticum aestivum
  unsure (1)..(63): unsure at all Xaa locations
  Clone ID: PAT_TA_48184.pep
MARTTVRKSCFIPKKFXWGFTRXATVPKPATMCMVKPAKPYYNEGVETTKTIKSTATGIIDLD

SEQ ID NO: 153767 - protein, 118 aa, Triticum aestivum
  unsure (1)..(118): unsure at all Xaa locations
  Clone ID: PAT_TA_48185.pep
RQTPSPLCTGKDANSDTTVFEAPTHLRFYKSCTIERINRPAILPSTVDXATGLTSKDVFIYAETRISVHIYLSKLNDTSTKFSVLVYFHGGSIIIGTADSWTYHNYVNALDYGGGVLT

SEQ ID NO: 153768 - protein, 128 aa, Triticum aestivum
  unsure (1)..(128): unsure at all Xaa locations
  Clone ID: PAT_TA_48186.pep
TLQGLSTAGDDHTQVDLTVLYGEREMVTDYKLLGEDDLGCMPPSPRRLPQIEGTFDIAANGIRTVSSQDKGTAEDLNITMRSCGGLFESNIEKTMRAGALLSXKATERTAFIDIRNTXDTTIYSIPKR

SEQ ID NO: 153769 - protein, 49 aa, Triticum aestivum
  Clone ID: PAT_TA_48187.pep
ETGWRTSGPSSWCRVQLLRLFILVPRFSPLSDDLMAAAAACMRGRKRGR

SEQ ID NO: 153770 - protein, 61 aa, Triticum aestivum
  Clone ID: PAT_TA_48188.pep
ATACGQTDRGRLLCLQRSRLSSTAATSAPAMGRNPCDICILMGGAALAFMYIQMPMLCTQD

SEQ ID NO: 153771 - protein, 49 aa, Triticum aestivum
  Clone ID: PAT_TA_48189.pep
TSMLLCILTRQPIFHPSQPMAILKYLQVSESLTIFFPAEILGSTPLILI

SEQ ID NO: 153772 - protein, 63 aa, Triticum aestivum
  Clone ID: PAT_TA_48190.pep
APRRGRRTDPAAGPDKDLTGSCDRLGFFGCIAFVAIPLRPPCCVRGPSSGYRLLVTALPCDRS

SEQ ID NO: 153773 - protein, 44 aa, Triticum aestivum
  Clone ID: PAT_TA_48191.pep
QKRLDSIGLHYTYANLDALPTLLVSFSGLRHYICGAILCKETLY

SEQ ID NO: 153774 - protein, 33 aa, Triticum aestivum
  Clone ID: PAT_TA_48192.pep
WRISQQPSRCWLVDHATTVCMPACSADQPSMTA

SEQ ID NO: 153775 - protein, 65 aa, Triticum aestivum
  Clone ID: PAT_TA_48193.pep
VPGMLPAFSCFTTNSAIIRVLSSVHSADPFRKHIHPKVRVQLPAKRAFRRRWHVVKVGCVRARVG

SEQ ID NO: 153776 - protein, 126 aa, Triticum aestivum
  Clone ID: PAT_TA_48194.pep
GSRLSLPAFQAWHGAPSSSISRMPRCPHRSCSHLLDPSSGQMIRFIIPHIYSNMRVYPPPHLLVDVIILIRPLLTVRVGHLTHGPARSWWIVLPSFAVQTGVRATSIRREQSSRRALCSKARQCGP

SEQ ID NO: 153777 - protein, 68 aa, Triticum aestivum
  Clone ID: PAT_TA_48195.pep
SLRYIRLDLSFVYKPRDARPELPPWLRQSSPRRPGRSCTVVTSQPWRVLCADQIVPLPVSMFPAEHRL

SEQ ID NO: 153778 - protein, 61 aa, Triticum aestivum
  Clone ID: PAT_TA_48196.pep
IFSRKRNMRASMSEQPSAYRLVVRTGAIGFQSSGGYRRQSRSLSGRATTVHTHSHYPRPNA

SEQ ID NO: 153779 - protein, 43 aa, Triticum aestivum
  Clone ID: PAT_TA_48197.pep
PSCKITHISFSSAMSSQRSVPSMILLSARFRTFFSRITGRVNV

SEQ ID NO: 153780 - protein, 63 aa, Triticum aestivum
  Clone ID: PAT_TA_48198.pep
VTYRGALYRQGSQHGGLGLRLGSLIRHNIGKYQPGVLSHPCVVIMQASDLDLTGQFFRRLCCC

SEQ ID NO: 153781 - protein, 103 aa, Triticum aestivum
  unsure (1)..(103): unsure at all Xaa locations
  Clone ID: PAT_TA_48199.pep
RAIEFVALASXVVARRGWAAAATVRAMSFGRSSSVGAIGKRPFAYTRTHVVRSKGSHKVTIVWLHCLGHYGVILSKLFETLPLPNIKGILATAPTMPGAIFGG

SEQ ID NO: 153782 - protein, 65 aa, Triticum aestivum
  Clone ID: PAT_TA_48200.pep
SSSSVLVSLGIVVEQYFLMCRLMARITSSLCSLAQGITCGCMLAHSCSHSWFLSGIIMESIVRML

SEQ ID NO: 153783 - protein, 37 aa, Triticum aestivum
  Clone ID: PAT_TA_48201.pep
LTSALKMQMQRIYQLASTMKETCRLKSRSLEGHRRVS

SEQ ID NO: 153784 - protein, 74 aa, Triticum aestivum
  Clone ID: PAT_TA_48202.pep
GTAPTEPHPISSPIDSRARSILLPYLVKTQILVKTVTGKTITLEVESSDTIDNVQAKIHDKVGISPDQTGLIFA

SEQ ID NO: 153785 - protein, 97 aa, Triticum aestivum
  unsure (1)..(97): unsure at all Xaa locations
  Clone ID: PAT_TA_48203.pep
RSLVWFSTGNNCKRRMAFKTTWMHYESVRSNEITVRILTDLHKNEQVNMELWXEAQMSGDMQLMPLVDYYTLIPLKTVAIXCEGTKLXPAKGIMKTD

SEQ ID NO: 153786 - protein, 97 aa, Triticum aestivum
  unsure (1)..(97): unsure at all Xaa locations
  Clone ID: PAT_TA_48204.pep
MERSSMARHRLLAVLLVGLVAGSWLRHAAGAGRSLAEKLSEPETKRTTYXETMPQPKPQTMPKPVHMPKSQTQTLTICENMPKSETKTMHQHRPMPK

SEQ ID NO: 153787 - protein, 62 aa, Triticum aestivum
  Clone ID: PAT_TA_48205.pep
ARKPNDALDAAAALPTAPRKYLRAPASTLLERAPTAVQPKDEETSAIVAAAVRSLHVRPCVR

SEQ ID NO: 153788 - protein, 83 aa, Triticum aestivum
  Clone ID: PAT_TA_48206.pep
GGEGGLSTYPSFPCRLPWATDDQSLHNTLSKYGKLIDSKIITDRETGRTSRFGFLTFASNDAIRQAIEAMNRQDLDGRNINVN

SEQ ID NO: 153789 - protein, 63 aa, Triticum aestivum
  unsure (1)..(63): unsure at all Xaa locations
  Clone ID: PAT_TA_48207.pep
MASLPDLLNLNLSDWTDTIMTXYLWLGRSTVDITSQARSVNGTITDASQLTMWNYKGYRSCQA

SEQ ID NO: 153790 - protein, 57 aa, Triticum aestivum
  Clone ID: PAT_TA_48208.pep
IKFVDPMDRPCPLLRQLNGQLMLSGLYLQNALAHRRLNRVSRQRLPSQSESRRHGRR

SEQ ID NO: 153791 - protein, 49 aa, Triticum aestivum
  Clone ID: PAT_TA_48209.pep
PPELRQGCVVVVAHLEIVHVSFRRSGSDLRLVPLHHDPVMVGSPSVSQK

SEQ ID NO: 153792 - protein, 74 aa, Triticum aestivum
  Clone ID: PAT_TA_48210.pep
EKNRCHARMRARDAPASPSPDRWPTRACFLRGSSGAPPPHSTRDCRRPTPSFGRTWVLLHPLYAGKLFKVGIRY

SEQ ID NO: 153793 - protein, 90 aa, Triticum aestivum
  unsure (1)..(90): unsure at all Xaa locations
  Clone ID: PAT_TA_48211.pep
DRPRIRPHVLEKRLGQTAIYTASTFMTHGGIPPSTNPACLLKAAIHVINXGYEDKTQWRKEIGRIYRCTPEDILTGSKMHARRWIWIYCM

SEQ ID NO: 153794 - protein, 69 aa, Triticum aestivum
  unsure (1)..(69): unsure at all Xaa locations
  Clone ID: PAT_TA_48212.pep
MANGLIKRDHTVDTNAHCPATQADEAGKADSCAGCANQLICAIVLNGPDPDXTAIAERMATEKHKILLL

SEQ ID NO: 153795 - protein, 52 aa, Triticum aestivum
  Clone ID: PAT_TA_48213.pep
MHTCDQYPADIIYKGEIMRLESFTEDEENALEVVTCFQFLTFWHRPRLSSLT

SEQ ID NO: 153796 - protein, 79 aa, Triticum aestivum
  unsure (1)..(79): unsure at all Xaa locations
  Clone ID: PAT_TA_48214.pep
RQATITAPADKGKKAKTDTDFCYENERINRAMMLSIKRLQEIQDKLXKVNEKTSDNVYEVVHKCSAICRPVYILRCDII

SEQ ID NO: 153797 - protein, 38 aa, Triticum aestivum
  Clone ID: PAT_TA_48215.pep
QTGSKTQATPATNRFRQHLQARDGGVGATHLRIRRPKR

SEQ ID NO: 153798 - protein, 57 aa, Triticum aestivum
  Clone ID: PAT_TA_48216.pep
HAARNCIICYIDEGEHICILCSIMGVIHGKGGSHMSRMYCWHCCTLLLASRIQKLRF

SEQ ID NO: 153799 - protein, 103 aa, Triticum aestivum
  Clone ID: PAT_TA_48217.pep
CLFGDTDLVVMFLCWQDRPIGYVRPPPSLPQDLRRVAHGRLNVFLPACRSSSQCLARSLCQGLVCSRALCYPVVSVCACAVAWPGFLLVLLPEMKNGGPDAWT

SEQ ID NO: 153800 - protein, 41 aa, Triticum aestivum
  Clone ID: PAT_TA_48218.pep
QCTYQVFLMALVVNARCSINPPDIVVFDPILQPPYVRNACA

SEQ ID NO: 153801 - protein, 75 aa, Triticum aestivum
  Clone ID: PAT_TA_48219.pep
YARVGLNEQTVVAQCGTYVAQAVAQVGPLCMAGMGGSRPAVVAWYHHGQRPAHVAEIIMNEPEKDWVSPRIGTGT

SEQ ID NO: 153802 - protein, 56 aa, Triticum aestivum
  Clone ID: PAT_TA_48220.pep
YHESSAPLVVRMRSRRLEVWRPMYDPADSRLAPDIRSSSRQSRRTDKITLSSYVLW

SEQ ID NO: 153803 - protein, 77 aa, Triticum aestivum
  unsure (1)..(77): unsure at all Xaa locations
  Clone ID: PAT_TA_48221.pep
NTQSCMDPNVMKANVVVSSXSHYRTFGSTRVKRVQNDLMIKAAPMMKALXMNTVDDAILRLTRXVVPCMIVTRMDVA

SEQ ID NO: 153804 - protein, 41 aa, Triticum aestivum
  Clone ID: PAT_TA_48222.pep
IRSESQKEIADEIWSATESWCFFQLENQEIPLAVMDGIQRA

SEQ ID NO: 153805 - protein, 68 aa, Triticum aestivum
  Clone ID: PAT_TA_48223.pep
DHAYTHAYDKSEEGSQFCIGFAGIGWYPPLSRWTFASLMILMTTRVHMKTLISNQSITCLIVAPDQSE

SEQ ID NO: 153806 - protein, 53 aa, Triticum aestivum
  unsure (1)..(53): unsure at all Xaa locations
  Clone ID: PAT_TA_48224.pep
KRWADFTHEKTYGRQSASKWIAYWKTFFIXNAELFGYNNREEWMVAHHLFRKN

SEQ ID NO: 153807 - protein, 85 aa, Triticum aestivum
  unsure (1)..(85): unsure at all Xaa locations
  Clone ID: PAT_TA_48225.pep
RAEHVIATLRGVHPEXIQNYDPPAERLNQELGPTVLAYALAHLRGFIHTPCXRYLISHEQGSQKLQLTXRDPAYARGLISPKSVT

SEQ ID NO: 153808 - protein, 58 aa, Triticum aestivum
  unsure (1)..(58): unsure at all Xaa locations
  Clone ID: PAT_TA_48226.pep
CKLYIVALXGYPGDEPPDPSETVDSDPYRAHGERVYRSPSRQSQMRGSLGTTRDGNSV

SEQ ID NO: 153809 - protein, 52 aa, Triticum aestivum
  Clone ID: PAT_TA_48227.pep
TPLYFFVNMSTDTGAYTRADIHPYERKHARLYYMSTTERLRQHIILIFTKTP

SEQ ID NO: 153810 - protein, 47 aa, Triticum aestivum
  Clone ID: PAT_TA_48228.pep
MRNITYTTGLEPERQMLFFPRKAKRDDQFLYALGDMDGAILNMMEKH

SEQ ID NO: 153811 - protein, 96 aa, Triticum aestivum
  unsure (1)..(96): unsure at all Xaa locations
  Clone ID: PAT_TA_48229.pep
MARHRLLAVLMVGLVAVSCFRHAADAGRGLPEKLREPETKTTTYWVTKPERKTETMPKSVRMPKSETKTLTKSEHMPKXETKTMHKPERMPKSEPK

SEQ ID NO: 153812 - protein, 80 aa, Triticum aestivum
  unsure (1)..(80): unsure at all Xaa locations
  Clone ID: PAT_TA_48230.pep
MGLFSSLCGTAVAALSMNXLARARSSLLGAAGKARGSSASFGVRAAALERAMWVPGSTTSAWIDGSLDGDFRSDPWTLRS

SEQ ID NO: 153813 - protein, 74 aa, Triticum aestivum
  Clone ID: PAT_TA_48231.pep
LFDPAALQAELSKQFRFLPSPFMESAGSPVKKNDETSAIAAPPVRSLYVPGCVGRALTSGPVPCWRTRFPYTES

SEQ ID NO: 153814 - protein, 67 aa, Triticum aestivum
  unsure (1)..(67): unsure at all Xaa locations
  Clone ID: PAT_TA_48232.pep
MSSPQCCTNPPGLNSAGXKGKVADRFSGMKAYVSCAKXTKVDRLLICKVYGIEAPHLMKIAGQISYI

SEQ ID NO: 153815 - protein, 49 aa, Triticum aestivum
  Clone ID: PAT_TA_48233.pep
MAEEAPTPVVGPVEAPTPVLGEPIDLVTALHLGMNKSSAHDGLVKGLLK

SEQ ID NO: 153816 - protein, 88 aa, Triticum aestivum
  Clone ID: PAT_TA_48234.pep
RGTNGSGGYSGGRNRTERPLYALKILVCANVLGLLNITLGSPSVHPSWSLIQGLTDLEAVLGLSTTLNINLVGINMTVARALSLVLNN

SEQ ID NO: 153817 - protein, 52 aa, Triticum aestivum
  unsure (1)..(52): unsure at all Xaa locations
  Clone ID: PAT_TA_48235.pep
TSTRTTNRLVVDXATNDYNCFISLHADTMERLQILRRDTFLLKGKKTHDTIC

SEQ ID NO: 153818 - protein, 40 aa, Triticum aestivum
  Clone ID: PAT_TA_48236.pep
NQLFPQQAVAVCKLRIHRIAVWCKSNDLVDCSRVCHHVSR

SEQ ID NO: 153819 - protein, 99 aa, Triticum aestivum
  Clone ID: PAT_TA_48237.pep
VWMVGVVGTNFFIDFSGSSGTTITSVTTVAGYDTVIASVTVWGFFRLFFCNRTLISTTFVPDGAYSPCSSRLVSSTLPMCLLERELQFASGMFALSETS

SEQ ID NO: 153820 - protein, 96 aa, Triticum aestivum
  Clone ID: PAT_TA_48238.pep
RRRLNRSRHRPICSLVINCLCAPLLHSSPYWLGCQGARKPILRVMLRAQRQAIRGCTIATLVTYLSSNHFAPNGVISKRFISDEPAREQMNLIKQL

SEQ ID NO: 153821 - protein, 94 aa, Triticum aestivum
  unsure (1)..(94): unsure at all Xaa locations
  Clone ID: PAT_TA_48239.pep
HVGRGWLLRRHADTNGMIYYRGWYHXFYQYNPNGIGWDYVIMWGHAECLDLLHWRQIPXAVLPDQWYDIQSVLSXCITVLPNRTLMMLYTGATN

SEQ ID NO: 153822 - protein, 42 aa, Triticum aestivum
  Clone ID: PAT_TA_48240.pep
CRLLEGCPKVMLPTATPCSKGYRTTCIGTCSKINNYWDDQQP

SEQ ID NO: 153823 - protein, 98 aa, Triticum aestivum
  Clone ID: PAT_TA_48241.pep
MHRFLVGDHATMAALLARHASMALRARHTARFGPTWTAMHGQLRTYMDTEAPKRFNEDEEKEQLAKELSKHWSALKERSINTLLLTEMVRGKMLTLMH

SEQ ID NO: 153824 - protein, 99 aa, Triticum aestivum
  unsure (1)..(99): unsure at all Xaa locations
  Clone ID: PAT_TA_48242.pep
IGKAVRVPVRGYGYGVAGSPTRTGEWRVLGYLRCMKTKVTEYRTRLDRAGHGMRXYLAYRTMFRRAVPDVVXHAPAAAAAVICTSFPAKRRCGTQNARN

SEQ ID NO: 153825 - protein, 58 aa, Triticum aestivum
  Clone ID: PAT_TA_48243.pep
GIFIFWSLVSPVLLHVSAGAMAGGSMSLTAWRSSGTHDFWGSLQESIVYPSNIFSGVR

SEQ ID NO: 153826 - protein, 88 aa, Triticum aestivum
  Clone ID: PAT_TA_48244.pep
LLNGAALVAREGAKRSSGPNVLRSALLAVTDLRGLTRGTIRSPKAETLLDDCHPEGGDSSRTSWCCEKYYWNDDAPAVKPSLETQRRT

SEQ ID NO: 153827 - protein, 68 aa, Triticum aestivum
  Clone ID: PAT_TA_48245.pep
GLDPSPTTPDGPMVLHSAGAIGDPDPTQRVFYRRSILQARSLVLAPAAVCSIGSLKYQPAVLEFIRTR

SEQ ID NO: 153828 - protein, 63 aa, Triticum aestivum
  Clone ID: PAT_TA_48246.pep
RAAVGLVYPGSAPTVTPSRATRRAAEHVVKVDVVLARSTRHSHRRTCVWHRLSPQQVAGGASV

SEQ ID NO: 153829 - protein, 91 aa, Triticum aestivum
  Clone ID: PAT_TA_48247.pep
RSGHLFASTTAMVTDNVHNLTAALTEEAPPMETPVSVQEATKTGDVPAPTVAILKTTRPQPVEQTIADAPIHDVTEDTKETHPRSHDHPEA

SEQ ID NO: 153830 - protein, 88 aa, Triticum aestivum
  Clone ID: PAT_TA_48248.pep
APTLATTHASTRPDNCRNKRKRPASLIKKQAQAFRMYDGELGRGATEVLRNASGNERWAAAACHGRGRRRRNGYQLMDGQPQQGMLHD

SEQ ID NO: 153831 - protein, 51 aa, Triticum aestivum
  Clone ID: PAT_TA_48249.pep
MDGNEDDMPLGANRYSEHQPIGTTEHRRGAHYKEYKESPPGPFFEAGELTS

SEQ ID NO: 153832 - protein, 82 aa, Triticum aestivum
  Clone ID: PAT_TA_48250.pep
CSEEVRAESTSARRRCCMHEHIVNETFVHEFNTSGRLHSYHGHQGRCSSHLAARESRLTDDLNTRTVELHERMANFGAQDDD

SEQ ID NO: 153833 - protein, 62 aa, Triticum aestivum
  Clone ID: PAT_TA_48251.pep
MSQEHHLRACASVTVCAFSFACIPLVVPPSLIVHSTVAPVSSCCYLQPYLRGTGSRSEEISA

SEQ ID NO: 153834 - protein, 102 aa, Triticum aestivum
  unsure (1)..(102): unsure at all Xaa locations
  Clone ID: PAT_TA_48252.pep
MGQGADSTSARPMARVTSHLCPPTLNMEEVAMLKGSNCHAXGAVPGLNVPFLCACRGIGQPLCLIMMMNPIDSVLHLYDAANTPGATAGHFHINTNAEVRGL

SEQ ID NO: 153835 - protein, 86 aa, Triticum aestivum
  Clone ID: PAT_TA_48253.pep
SLCRASSTVTQAPVLAQALLCLSTCLTSSPSVITYPSGNPRFPCSTMSATCDLCPIYHASPYVLVDLHHQGPIKSRTSRANGNPFQ

SEQ ID NO: 153836 - protein, 65 aa, Triticum aestivum
  Clone ID: PAT_TA_48254.pep
HAMWTGSVSRSTSSVASWSSRGVRGHPHLRLGCLITSGPLPVRLIAQICRSRTMIYDQSPTCGVS

SEQ ID NO: 153837 - protein, 41 aa, Triticum aestivum
  Clone ID: PAT_TA_48255.pep
YMHSQCVCKVHTYTHQCDVTCRHIYLIFLDAHQYRMSTPSR

SEQ ID NO: 153838 - protein, 49 aa, Triticum aestivum
  unsure (1)..(49): unsure at all Xaa locations
  Clone ID: PAT_TA_48256.pep
MGMTIPMAARFLPEGSWLTRSGEEERAVVNTLTRDVXSNVKDGDTRYLM

SEQ ID NO: 153839 - protein, 95 aa, Triticum aestivum
  unsure (1)..(95): unsure at all Xaa locations
  Clone ID: PAT_TA_48257.pep
MAICTVWISLLLALAMLLSAPAATADEAAGSQEAAAAPEAVLTMNADYLDNAMANHAYIVRECYAPWRGHCNSLAPAYEKAVXLKSMHDPTIALA

SEQ ID NO: 153840 - protein, 56 aa, Triticum aestivum
  Clone ID: PAT_TA_48258.pep
IEIHNFFGLEGHETYNYNGPACFLVCHLHRSKTHNYCPRAHILNHWKYYKGPKCHR

SEQ ID NO: 153841 - protein, 61 aa, Triticum aestivum
  Clone ID: PAT_TA_48259.pep
IIPMAFWPPDQCCQDGNPVMSLCRPSPHCSISVALSSSPSLNHLRAQVVSVLRSLLRHTSA

SEQ ID NO: 153842 - protein, 92 aa, Triticum aestivum
  unsure (1)..(92): unsure at all Xaa locations
  Clone ID: PAT_TA_48260.pep
PQGGASVMTNTDRTGSSVSRYYCGNKYIDMVETLSQKRALEAFNLYPENWGANVHTLLCXPDILHVYTVVLMTHDIIMDVDLTDRGHIYHGY

SEQ ID NO: 153843 - protein, 67 aa, Triticum aestivum
  Clone ID: PAT_TA_48261.pep
ASSYAFSYPLYRPLELPRLGARMAVRMRVVMSVNTDVETLVEHCNEYGRGYVHVLQDVLNVQAILHA

SEQ ID NO: 153844 - protein, 80 aa, Triticum aestivum
  Clone ID: PAT_TA_48262.pep
DLTAPVQESDKVIQRCLGTPLAGEAAPAAAHFGRPNNRLVVAGSPTRKEDRVVIFPLKDRYSSIALIVYGSLCRIPDAWT

SEQ ID NO: 153845 - protein, 93 aa, Triticum aestivum
  unsure (1)..(93): unsure at all Xaa locations
  Clone ID: PAT_TA_48263.pep
LMSMHDPTIALAXVDANNDKNKLLAGNYEAQGXPTMNTLTNGGMNIQEYTGPSEADVIAEYLKKLVVPVSKETKAPAYATYLEDCTIHIVRAF

SEQ ID NO: 153846 - protein, 58 aa, Triticum aestivum
  Clone ID: PAT_TA_48264.pep
MEQIISSTAMSREIRPEIASLVGSLWFAHSIVPTLTVTITGSTKDSHTYVHMKCKVCS

SEQ ID NO: 153847 - protein, 40 aa, Triticum aestivum
  Clone ID: PAT_TA_48265.pep
TNNTKTGIPYLNFYYVRDGCLCSTLPIQTLNPYLYFMTWD

SEQ ID NO: 153848 - protein, 95 aa, Triticum aestivum
  unsure (1)..(95): unsure at all Xaa locations
  Clone ID: PAT_TA_48266.pep
SEAIRGQREGGREGGHPAMRDGESTVACFASCTQYSSISTFTYHRRYFFISSDETMLRITSCISPKLTTFSXDDLLEQESMLKGIWLQRKDLEVR

SEQ ID NO: 153849 - protein, 83 aa, Triticum aestivum
  unsure (1)..(83): unsure at all Xaa locations
  Clone ID: PAT_TA_48267.pep
MAGVNTSVVGLKPAETAPKSASPTTAKRVXVAWAKDRRSGLLGLAAVLDVTATCTWSSAACVLNXYIRKSKLNKELNDKKKAA

SEQ ID NO: 153850 - protein, 104 aa, Triticum aestivum
  Clone ID: PAT_TA_48268.pep
THLISPHILSPHISCLLSLPVAAQKTASDGTGLVTVYGTSNNGTVTQLEPKTCSFSVKVGPAQMLRGRVMMDMVNAEQARISNEAGACSVMRVERVPCDIRAQC

SEQ ID NO: 153851 - protein, 48 aa, Triticum aestivum
  Clone ID: PAT_TA_48269.pep
KGSCRTQPIGEKKRCFNTNLTRVSTKILTAYNTRGTYWGNELRTPIRS

SEQ ID NO: 153852 - protein, 29 aa, Triticum aestivum
  Clone ID: PAT_TA_48270.pep
ARVGPRVRTSVSCRYLTYHYKTYRQGLML

SEQ ID NO: 153853 - protein, 56 aa, Triticum aestivum
  Clone ID: PAT_TA_48271.pep
CALSWMAPRDQNVPALHVQQDVQHWMTWNYGKMDVLWPWTLGLIVGVHEIGHILRC

SEQ ID NO: 153854 - protein, 76 aa, Triticum aestivum
  Clone ID: PAT_TA_48272.pep
PVLQMALAWIAHVIMQSPHKQCTSNKAWCFLPGFYFLSGVLSLSGSHRFMSVVVSSKATVYCSSPVFVARRVIKYA

SEQ ID NO: 153855 - protein, 67 aa, Triticum aestivum
  Clone ID: PAT_TA_48273.pep
GSAFRHRERAATATDTRWAVGLHADGVTEDATRQHMPGPRHPVWSRRSQNAVFRLMPAYSGRRAVVS

SEQ ID NO: 153856 - protein, 75 aa, Triticum aestivum
  unsure (1)..(75): unsure at all Xaa locations
  Clone ID: PAT_TA_48274.pep
MATNRTKADKKIGSDQNLWQLLEEYTKVLTTRADNVCSKHLQEIRTGIRXDSIALMGKNTLIRRWINVHSENTSN

SEQ ID NO: 153857 - protein, 95 aa, Triticum aestivum
  Clone ID: PAT_TA_48275.pep
KLRPTSSFHTKTTTTNSRQAVWNDNEALTISSCGPILIEDYHLLEKIGHLARERIPEGVVDAPSTLRNGFLEGTHDVTGLTWAELLRLPGGCTPG

SEQ ID NO: 153858 - protein, 37 aa, Triticum aestivum
  unsure (1)..(37): unsure at all Xaa locations
  Clone ID: PAT_TA_48276.pep
PRIRPRIRMNSTMKPHCYPRYFYYSAAMTWKXDACNS

SEQ ID NO: 153859 - protein, 68 aa, Triticum aestivum
  unsure (1)..(68): unsure at all Xaa locations
  Clone ID: PAT_TA_48277.pep
MGTINIGINGFXRIARLVSRVALHSDYVQLACANYPCITTEYMTYMSKSYTFHTHWQHCVIKLKDHKT

SEQ ID NO: 153860 - protein, 73 aa, Triticum aestivum
  Clone ID: PAT_TA_48278.pep
PPCRHASADRVTHLRPGFRDTIHPPPPPLCCLDASLPTSPPTSMVLYKNHVLNNHTVGRNTCYYYRQTMPLRL

SEQ ID NO: 153861 - protein, 86 aa, Triticum aestivum
  Clone ID: PAT_TA_48279.pep
VSIIELAPPCRLFHRLPIAAGPIVSHLSLSSASISPCFVPTLSSQCLRLPDGSSLRSAPVEGSVSAARCSRRRKARTSRSAARKKS

SEQ ID NO: 153862 - protein, 46 aa, Triticum aestivum
  Clone ID: PAT_TA_48280.pep
ESNSMIPYQSEEIPWHYTMPTANDDLKFYLPSFEYVTLIYQDVSAS

SEQ ID NO: 153863 - protein, 64 aa, Triticum aestivum
  Clone ID: PAT_TA_48281.pep
FIKNGCTCARVFSTYRSTMGPDHTCVRSENDTRIHVWAYTHNNWAQRAGSNTNILGCRWQMMCV

SEQ ID NO: 153864 - protein, 105 aa, Triticum aestivum
  Clone ID: PAT_TA_48282.pep
AQWPDARSACRPPCFRCQISTTPSMIPRPAPPQTLSGPPDHTPSERVCVSGTDAWTKHVHLRERRVCASQRLRRRERIREPWPRRWPCPWPRPRRQVALARIRIV

SEQ ID NO: 153865 - protein, 81 aa, Triticum aestivum
  Clone ID: PAT_TA_48283.pep
HDRPVAGRAFTRPGRQARQQVHREGVVRSAFSQVVHAGTVAAIKVGPTTPICGGLPGTDNSDEARDFHLHLKNRFYLQTMP

SEQ ID NO: 153866 - protein, 75 aa, Triticum aestivum
  unsure (1)..(75): unsure at all Xaa locations
  Clone ID: PAT_TA_48284.pep
MVKHINGILNGHFKKHRQNYVKTXLIQTGRMQRRCIALHKKVVKILRSATFGTITSIEQRQTGNNIMNARAGRCF

SEQ ID NO: 153867 - protein, 118 aa, Triticum aestivum
  unsure (1)..(118): unsure at all Xaa locations
  Clone ID: PAT_TA_48285.pep
TNKVDFILNHKDRNNGQYDETNLKIPTPVPXDQVSQVYTGVLEPDNSXRNLVCRVVKSQALFLSSVYFAPAPITSKTVAGPVNKNAQVWGKRAXMPGPPAKKFCDWDAATPTEILDEG

SEQ ID NO: 153868 - protein, 103 aa, Triticum aestivum
  Clone ID: PAT_TA_48286.pep
FAHHTLVPSFPFEASIPNPVHPLISKLIHHRGTDHASIYHQFVDASCTARSELGRRRPRRPGRGRGRRQAGHRWSASARSRCGRHTSLSLFQRSTAGFARVVA

SEQ ID NO: 153869 - protein, 112 aa, Triticum aestivum
  Clone ID: PAT_TA_48287.pep
KVKGLALGLPELGEQPLIGLLRGVGAHARGLQLRPQQPHVRLQVGVPAPQHQGLGRRFAVGRRGPGFPLALPGAARGPAGDPYGRRPWAEIEMQIAGDICSDRIACTTGCNV

SEQ ID NO: 153870 - protein, 37 aa, Triticum aestivum
  Clone ID: PAT_TA_48288.pep
NMVKTMTDGGLNHSGKCGKLRPRAKSEIVSDRPVWEK

SEQ ID NO: 153871 - protein, 62 aa, Triticum aestivum
  unsure (1)..(62): unsure at all Xaa locations
  Clone ID: PAT_TA_48289.pep
PSTHTTGATTDTLKYFTGLRISXTEQTYFNYHVPSSLSLPERLTYFRITESRATPKLFNRKL

SEQ ID NO: 153872 - protein, 76 aa, Triticum aestivum
  Clone ID: PAT_TA_48290.pep
MTSECKGHQPQDDRWVATFAATTFYMVSDPATDALVCWGGACNTFFVLDTASFSDLVVSSYFKNRNFCRLVPQINT

SEQ ID NO: 153873 - protein, 68 aa, Triticum aestivum
  Clone ID: PAT_TA_48291.pep
ECIPISHDRCVLERIHISIYRWTRTMTLRTTRIRTNHDMNSVAHQRSFNGEPWSILSFDDATILHRPV

SEQ ID NO: 153874 - protein, 103 aa, Triticum aestivum
  Clone ID: PAT_TA_48292.pep
MRSSSTRRLPSKDPYRCCCSVCVSIHLPAVMAEQKENILMGKYEMGKMLGPWTFAKVYHARNMKTSQSVTINVTDKENVMNGGLTDQIKRAISRMKLVKHPNI

SEQ ID NO: 153875 - protein, 110 aa, Triticum aestivum
  unsure (1)..(110): unsure at all Xaa locations
  Clone ID: PAT_TA_48293.pep
MTLVTLFDTLALHSWNPLRXFVWTTASRGSDVCMSRDTTGLADTYIESRXTAAAYMLRARLPAGMTKEDVKVAANDDCKVLVIARQPSLWRAAKNHACQHFKSQRTTFLG

SEQ ID NO: 153876 - protein, 75 aa, Triticum aestivum
  Clone ID: PAT_TA_48294.pep
FPIRRGTPFCNSFFPPFYTYVLYSIVILRHVCHSETRFFHAQFHYRMLVNGSTVSHLKIFLCSQFLLHYKVFLHS

SEQ ID NO: 153877 - protein, 70 aa, Triticum aestivum
  Clone ID: PAT_TA_48295.pep
TAPTDKIQQDYDCGARLLNPKVDMTDTTGTYIAMLITWLSRMDSVSVVKVVQNPECAIPVSHAGLELVTT

SEQ ID NO: 153878 - protein, 40 aa, Triticum aestivum
  unsure (1)..(40): unsure at all Xaa locations
  Clone ID: PAT_TA_48296.pep
MARGTVELKRIKNKINRXVTFSKRRNCLIKKGYXLSVLCD

SEQ ID NO: 153879 - protein, 87 aa, Triticum aestivum
  Clone ID: PAT_TA_48297.pep
SCHVFQPQHSDWQQCCVYSKMNVAHHKIKCHYHCHGLLHLPQSAQLVFFDFAAHNLYWVQYLNRDQYMPFERLRPQPKHARVAVRVA

SEQ ID NO: 153880 - protein, 100 aa, Triticum aestivum
  unsure (1)..(100): unsure at all Xaa locations
  Clone ID: PAT_TA_48298.pep
GEDYPKLQLADEWTLTNIAXGTLDNTKVVDEFGAVPMFVNLLSCPSEDVREHGCKGSGEXVAGDSAKCRDLVLGSGGLISLLXQMKDHALLSMLRNATWT

SEQ ID NO: 153881 - protein, 69 aa, Triticum aestivum
  Clone ID: PAT_TA_48299.pep
RSSPAAVITCRAAVAWGPAQALEMEDVEVAPPGPLEIRAKVSCTSMCRTDVTHRQSTAQPDLWPKTFGH

SEQ ID NO: 153882 - protein, 61 aa, Triticum aestivum
  Clone ID: PAT_TA_48300.pep
GGQAVGDGVPVTQGRRRAEQGGRLVVGPVVSSPGWCIHGGCRPGLVLPLVAAAAMILSPVR

SEQ ID NO: 153883 - protein, 74 aa, Triticum aestivum
  Clone ID: PAT_TA_48301.pep
IRAGLNSADGMGRTAAHVGQACASHWFLHVTGYGVHLALARSALDGTRDFFRLPVTTKESVRRSPANVEGYFSG

SEQ ID NO: 153884 - protein, 60 aa, Triticum aestivum
  unsure (1)..(60): unsure at all Xaa locations
  Clone ID: PAT_TA_48302.pep
WYRMGSCQSCLTATTSSMSIIRXSHFSAFICTMIVALGPIQMGLTCGFSSSTYAGIIRDL

SEQ ID NO: 153885 - protein, 103 aa, Triticum aestivum
  unsure (1)..(103): unsure at all Xaa locations
  Clone ID: PAT_TA_48303.pep
VRRANRGGYTIEVAHRLRMLVNQILQWRCINALTDATFMVHSLTDEKTLHMAWKERSNLRDNVKYKRCKLXLQKQKLKLIAILMGEMTYLEEWSHVEKHHSSS

SEQ ID NO: 153886 - protein, 71 aa, Triticum aestivum
  Clone ID: PAT_TA_48304.pep
YGLNSIEREFVSRPSAITEAVRAAATASFLSVVGHSRRNRLNGQVQLHLVRSALTISSPVSPACRMFFPTT

SEQ ID NO: 153887 - protein, 86 aa, Triticum aestivum
  Clone ID: PAT_TA_48305.pep
QKQNADHLGSTDVCSARRYYINTIMLHCCRGPKGGGRYMRNGINTEPKIYLEYSSYEHIYLCGRCARRKRWSLCYLHLMPKRYMMS

SEQ ID NO: 153888 - protein, 114 aa, Triticum aestivum
  unsure (1)..(114): unsure at all Xaa locations
  Clone ID: PAT_TA_48306.pep
TKSINALSNLANPVNSPGMAEPVPVSRSDDDIDARSGRPYPGDDATXEEDVXMLRWKMDSAGIDAAVMGQPNREPCVVIQTVSEDDILEDGYGTRIYGQTADARNPDARSCYIC

SEQ ID NO: 153889 - protein, 75 aa, Triticum aestivum
  unsure (1)..(75): unsure at all Xaa locations
  Clone ID: PAT_TA_48307.pep
SAQWPPASTESRSALAERRSALTVSRARPAERAPLIVKVRAWQXRAAFDRSARHTDMFNQDQCRVTVICAFTEHT

SEQ ID NO: 153890 - protein, 84 aa, Triticum aestivum
  unsure (1)..(84): unsure at all Xaa locations
  Clone ID: PAT_TA_48308.pep
MDMHTWFHGTDNVPGGMVPCRSEVGQRLRSFQDAISRIISLLSSPKIVQXFNTDKQYNLHMLQERHQIGPDQIKAVYHYTKFQY

SEQ ID NO: 153891 - protein, 71 aa, Triticum aestivum
  unsure (1)..(71): unsure at all Xaa locations
  Clone ID: PAT_TA_48309.pep
SAASMTEGCIIEGFVRVKMVHGSVVILTXSGSHSFDPSHINDCYYVTTLLFGKKLLSKMVNELKRLFAYVG

SEQ ID NO: 153892 - protein, 91 aa, Triticum aestivum
  Clone ID: PAT_TA_48310.pep
ENVRRMTFMLVQSSTIDESPPSTFTAVPWIHVVSFGRYSVQSFWKFDILLPMVMIEPHLFVDYRFHVAARLAGIVFSCVSPGTETHYLLCV

SEQ ID NO: 153893 - protein, 103 aa, Triticum aestivum
  Clone ID: PAT_TA_48311.pep
MATAAAPTARPIVYSYCCTSCFYRVRITLNLKCMDYEYNAENLLKGDQTDPVSMKLNTMKFVTASVDRDAVMTDSYTIPLYSEDMYRKRPILPQDPKKKALYI

SEQ ID NO: 153894 - protein, 62 aa, Triticum aestivum
  Clone ID: PAT_TA_48312.pep
PDPFLPVDNNVIARLFPSILDLDRSRRFQYVQSPVICYVPTVPCYCSSPRSVRYVSKIGIKT

SEQ ID NO: 153895 - protein, 70 aa, Triticum aestivum
  Clone ID: PAT_TA_48313.pep
PAHRPGKRQIWTATSDMAWPLLQLQLLLIDGAGTTAAAACSTTTTDGSAPSSEQFHAELLTNLTNVSIAS

SEQ ID NO: 153896 - protein, 51 aa, Triticum aestivum
  Clone ID: PAT_TA_48314.pep
SMITDRQALLLHEYLASLTRRKALSYRLQMDTTLSTRHRGDLHHMALDESA

SEQ ID NO: 153897 - protein, 83 aa, Triticum aestivum
  Clone ID: PAT_TA_48315.pep
HVPVVVLFFLVVVVVHLVHVPRRGRGLSGAGAARWERCFPATSGSPGRMPRRDLRSWPGPSMHASAKQRSSPSLGGSMAAKVC

SEQ ID NO: 153898 - protein, 67 aa, Triticum aestivum
  Clone ID: PAT_TA_48316.pep
ACTYPTDWDYAWLMAACDTVGDMLLCDMVHIIGLVAMQEAVHPSEFCDVGTTTSHMSVQGLRAGMMF

SEQ ID NO: 153899 - protein, 50 aa, Triticum aestivum
  unsure (1)..(50): unsure at all Xaa locations
  Clone ID: PAT_TA_48317.pep
MACTIMGASSGTVVAKTPFLSGQCXAXRTTQLRYITAGGNGRITMGNDLW

SEQ ID NO: 153900 - protein, 97 aa, Triticum aestivum
  Clone ID: PAT_TA_48318.pep
MAAHGLISAWHLLVTPLQSSISRSYCSRKFAFKMTAWCSPPAKQNDYTQLTVPCKQTLTYLDGTLPSDFGFDPLWLSDPEGTGGFIKPRRLAYGEIF

SEQ ID NO: 153901 - protein, 116 aa, Triticum aestivum
  Clone ID: PAT_TA_48319.pep
KEADHVGTAHLKGKGTRRAHPVQAARSGACVCGFSRPQRQGCVRLCQHRPVTLGWPTPHLPVLFLSLYSSSPSIFLSLSSSPSLADQIKLILHCSLRAVPAAAGSVRVRRPQASDP

SEQ ID NO: 153902 - protein, 109 aa, Triticum aestivum
  Clone ID: PAT_TA_48320.pep
RNMHHTRHGRVASMACVNTLQSCCMYKGAKADARTGKATGSRSSGCRSSTFMDGSGLRLGLDQNTDAIISTKWSENFSILSYNNLRTYLQTLQKQQQEPPCHAAYQHPG

SEQ ID NO: 153903 - protein, 66 aa, Triticum aestivum
  Clone ID: PAT_TA_48321.pep
LMLPRSMLQSSNHINQIPVMVMRLENSCHHAVQEPAFGLARMHLSPAYKNRESTHVPWRERGEGTT

SEQ ID NO: 153904 - protein, 111 aa, Triticum aestivum
  unsure (1)..(111): unsure at all Xaa locations
  Clone ID: PAT_TA_48322.pep
DGSFCVPSHRATWQRDCKPGPTLMPRKIGGRACSARPLAHVSRAFCVDTCARMTXCVPTDIRXVACKCADVAXMAGLLVPTCGLLVCGASAYRAPNTLTLKEIHSKTYMEV

SEQ ID NO: 153905 - protein, 73 aa, Triticum aestivum
  unsure (1)..(73): unsure at all Xaa locations
  Clone ID: PAT_TA_48323.pep
SVYAYMSIIALVVCISTVIIAERPKLLNHGXADAIANGGMTKTISALFWVGMPYHMYNQLTTNTWNGVAPLTH

SEQ ID NO: 153906 - protein, 103 aa, Triticum aestivum
  Clone ID: PAT_TA_48324.pep
YSVLFNKTLTVILWKYHKFPKRECEKAPTVMGTDPRARREPLGKGSSRNCKVTLHRMITRMLSRTTRLHLGPTLLHQGHTLLSTAQAPATISRRSLTTSCMQL

SEQ ID NO: 153907 - protein, 56 aa, Triticum aestivum
  Clone ID: PAT_TA_48325.pep
VRDLDTLKRNARNSSRAAAAEGRQRYPRCQVASAIASVTLNASNRPVVGHLCGREG

SEQ ID NO: 153908 - protein, 52 aa, Triticum aestivum
  Clone ID: PAT_TA_48326.pep
PPQDHYTLGVRVCTRAQHGMVKMRTTVYCLHNMHVITYILTAHGTQCYRQTK

SEQ ID NO: 153909 - protein, 75 aa, Triticum aestivum
  Clone ID: PAT_TA_48327.pep
HCVSFEARVLASPAAIESTCTTRTNCMNATVQTPYQLSVCHIASNIKLCSQLPNTGTVSYGKDAQDLECHQSGLG

SEQ ID NO: 153910 - protein, 89 aa, Triticum aestivum
  Clone ID: PAT_TA_48328.pep
MQRWLHGRPTSTQMAVALSSTAGGPACTTSNFLGKTLKKHVTSTGNYHGKSYKANRCTVLTTGNIFATRYTDTWKEFADDMSYYHHYIT

SEQ ID NO: 153911 - protein, 59 aa, Triticum aestivum
  unsure (1)..(59): unsure at all Xaa locations
  Clone ID: PAT_TA_48329.pep
LMRDDVTEPLIVDVEHFXHPAWPESSMXYKHNPVTTMETNAIVTLNXLGLGTRVGAGIL

SEQ ID NO: 153912 - protein, 122 aa, Triticum aestivum
  Clone ID: PAT_TA_48330.pep
ERPSTCDHSSPWCGANRVLYLRPISGDTTSYSTGELPGDYGRDTTTLSADRYTFAKNRELHVNHCRRDMLGALGCILPKLLARNGVKKCEAVWVKATCQIFTEGGLKYLGNLRHAHAQSMLA

SEQ ID NO: 153913 - protein, 59 aa, Triticum aestivum
  Clone ID: PAT_TA_48331.pep
NTSPQGMEHADMPHRQGGSTDISITYGRGAHHREALQLPLGTLSAISPSSAADTDSFLT

SEQ ID NO: 153914 - protein, 87 aa, Triticum aestivum
  Clone ID: PAT_TA_48332.pep
GLRWDAAAARASLHPASPSGTRRKKPACLKVNLIARTFLPQSVTFCSNIPVFIPFTFRLCFAYYCLDLTTVRAMEVEGYEEGRPIDR

SEQ ID NO: 153915 - protein, 85 aa, Triticum aestivum
  unsure (1)..(85): unsure at all Xaa locations
  Clone ID: PAT_TA_48333.pep
MSGVKKVTDVAGKACXAIDWDGLSKMLFSDEARTEFTNFRRTFEDINHQLHTNFSQERXAIEWEFYTKGIVSKVVDMYMEALDII

SEQ ID NO: 153916 - protein, 63 aa, Triticum aestivum
  Clone ID: PAT_TA_48334.pep
MGMSADTGKNADEPAPAPIRSTRIGWDAMFTDDDCPNGSCQYHASMVDTYTTSNWLQRISISC

SEQ ID NO: 153917 - protein, 65 aa, Triticum aestivum
  unsure (1)..(65): unsure at all Xaa locations
  Clone ID: PAT_TA_48335.pep
NSTAVAAEATIGINLFGGSRNMRTKRVAPKSNDVYLRLLRKLYRLLLWRSYSXSNAIILKMLCMS

SEQ ID NO: 153918 - protein, 122 aa, Triticum aestivum
  unsure (1)..(122): unsure at all Xaa locations
  Clone ID: PAT_TA_48336.pep
NGFGRIGRNFLWSWHGRGDSXALEVIAINDTASVKXASHMLTYDSTLSMLYADVKPVGDNAMSVDGKAIKVASDRYDLQPDXREMGIDVVIDGTCVLVERAGALNMVSTSTSSKGVTLVLSN

SEQ ID NO: 153919 - protein, 99 aa, Triticum aestivum
  unsure (1)..(99): unsure at all Xaa locations
  Clone ID: PAT_TA_48337.pep
GAGIHDDCKLRLEELKCKTMQRLMTYKLENQKEVIVDQTGEREATYEDLTKTVPDNDCRLTVQDSDFTISDDVPKSKMLYIXWPTDTAKVKSKMTYAST

SEQ ID NO: 153920 - protein, 55 aa, Triticum aestivum
  Clone ID: PAT_TA_48338.pep
LRAFCDAATNELNAILDVCDEPLVSVNCRCSYVCYTIYAWLSMVMANNMVTVIRV

SEQ ID NO: 153921 - protein, 99 aa, Triticum aestivum
  unsure (1)..(99): unsure at all Xaa locations
  Clone ID: PAT_TA_48339.pep
MAASLQAGATLMPGKIGGRACSARTLAHVARAFCVDTCARITXCVQTDIREVASKCADVAXMAGLRVPTCALLXAAASANGARNTLTLNEIQSKTYMEV

SEQ ID NO: 153922 - protein, 103 aa, Triticum aestivum
  unsure (1)..(103): unsure at all Xaa locations
  Clone ID: PAT_TA_48340.pep
MAIRAWWRIASAWAPAHLCLWMALIATTLVLPQGKKSNLSEVTHKDYFDIENYGKPVGLKVMRLLENAVHKTEEYFTALCTXKTGMGNSRKPFHYKGSTVDTI

SEQ ID NO: 153923 - protein, 41 aa, Triticum aestivum
  Clone ID: PAT_TA_48341.pep
YLQPGVLGLTLVPSTSNMKTRRSSSFEKHRENTKPYHCKDK

SEQ ID NO: 153924 - protein, 69 aa, Triticum aestivum
  Clone ID: PAT_TA_48342.pep
PLTPDLTPSHSRIAPRISARPIPHQMQHQIEPEIALNVSANASGYDSGSNYSLIEYFSEFYWDFHRGLI

SEQ ID NO: 153925 - protein, 58 aa, Triticum aestivum
  Clone ID: PAT_TA_48343.pep
VKELKNGSLAMFSMFRFFVPAIVTQNGLVDNLFGHVTGAVNNHVWAFAPTFAPGSLMC

SEQ ID NO: 153926 - protein, 98 aa, Triticum aestivum
  unsure (1)..(98): unsure at all Xaa locations
  Clone ID: PAT_TA_48344.pep
MSPQTETNVGVGSTAGVKDHKLTYYTPEYETNDTDVLAALRVSPQPVVTSVQARAALAALSYTGTWTTAWTDGLTSLDRYKGXCYDIEPVAEDDSQWI

SEQ ID NO: 153927 - protein, 111 aa, Triticum aestivum
  unsure (1)..(111): unsure at all Xaa locations
  Clone ID: PAT_TA_48345.pep
FPRPMVGRDRVVGFFGEFMGSVSPDLRLVIDDICSEDPSGGRVTXTLEWNGTPVTFTRGCSFYRXSPTRRLRSTXQIEYGHDCVEPSTKPRELSLAVIRGVTCIVERFTRL

SEQ ID NO: 153928 - protein, 116 aa, Triticum aestivum
  unsure (1)..(116): unsure at all Xaa locations
  Clone ID: PAT_TA_48346.pep
MGSSEADDDQLLKSSLAEGNXADRNNKVLRILGCFKINPCEHLKMTIESSEDEVNKQYRKLSLLRHPDKCKHTHAQEALRDMTKAQXLLLDPQERGYILDQVTSGKEELVATRKKE

SEQ ID NO: 153929 - protein, 100 aa, Triticum aestivum
  unsure (1)..(100): unsure at all Xaa locations
  Clone ID: PAT_TA_48347.pep
MALTVMGSWATSVFPLEGLKSTVGLPRSRRFNGTSLCRGSHGGTIRCMQPXLLGASKNVRPCNTWRRIRTDAILNQVYYLIRLKXAPSLTFNKVGSILRE

SEQ ID NO: 153930 - protein, 104 aa, Triticum aestivum
  unsure (1)..(104): unsure at all Xaa locations
  Clone ID: PAT_TA_48348.pep
IRLEEYGTNLTKLANDGKLDPVVGREPQIEPVVHILGKRTKNNPCLIGEPLVXKQLLHTGLLXRMCSGYLPVTIYGKMVITLDMGLIDAGTNYRGEFDERMKKL

SEQ ID NO: 153931 - protein, 109 aa, Triticum aestivum
  Clone ID: PAT_TA_48349.pep
DGLPELFSLAVTKAYRARLPDPTIGERNMIRSSNGWFVTADARCKLHFLNPATWEQVALPSVATIKQVSPILDCKGIIERHDLCMHGDDPHIYGADELRRVLYLNAVLC

SEQ ID NO: 153932 - protein, 96 aa, Triticum aestivum
  unsure (1)..(96): unsure at all Xaa locations
  Clone ID: PAT_TA_48350.pep
QLRRTCSTLRGGTCASGLEGNVDDLPLWANSCSACTTIASAALGCKYYDSKESTTAPIFEPXVAQXWYFYHSSISALMNTLMFMYVTIIKTMGSFG

SEQ ID NO: 153933 - protein, 94 aa, Triticum aestivum
  Clone ID: PAT_TA_48351.pep
RKDPAPSALAVGRLICAGPPSSAATDRGWSHGLGRSDCCRCSPSSTLAWSWVTMLHLACIRLLDDHSHTGHFDNDQDAAYLGLGYVKPETISWK

SEQ ID NO: 153934 - protein, 32 aa, Triticum aestivum
  Clone ID: PAT_TA_48352.pep
FSWVKRIFVGAIALVASVYRSDDRRALSSPNV

SEQ ID NO: 153935 - protein, 105 aa, Triticum aestivum
  Clone ID: PAT_TA_48353.pep
GHAFTRYGDGAMTACDVLLFHHEDMGMPWSIAKLGVQHGMWGCVKRIEPGLPSYQTERADSQPISKCATMAHANTTSVGNELTASENNTGAGSTRNNAYAEKPKH

SEQ ID NO: 153936 - protein, 104 aa, Triticum aestivum
  Clone ID: PAT_TA_48354.pep
GAISSGPNPTIAVGTGGYTGIGFEVCRQLATHGVAVVLTARYEPWGSDAVYKLRSLGLTQVILHHLDVTDTPSIATLTVLLTTRFGKLDIMVNNAILSGDEYLQ

SEQ ID NO: 153937 - protein, 120 aa, Triticum aestivum
  unsure (1)..(120): unsure at all Xaa locations
  Clone ID: PAT_TA_48355.pep
SLYATCGYATELMMGVNALLQGKIDATKCSLFGSVLSNLLLRLGTSIFCDDIXNLGADQPYYRKQADVSTGLFTLGALCQSLTMLLRNALSCWEHAVATDTTWLELSKACCFIMLLGYVS

SEQ ID NO: 153938 - protein, 125 aa, Triticum aestivum
  unsure (1)..(125): unsure at all Xaa locations
  Clone ID: PAT_TA_48356.pep
TATRTEEQIKGDGVAHEDANIDCGIGLLACTDERSCLQLYECISRSTQQVMRDEWEKFLLGKAELFGLHEKKXKRSHQPQGLGIPDGECPTGSNEYEIARPVSISMLETNALLADVSGVNHLTNE

SEQ ID NO: 153939 - protein, 85 aa, Triticum aestivum
  Clone ID: PAT_TA_48357.pep
EQVSVVQAKDLTKGDIRQPPSCKLVSHVAASVSRCMAGNRLGLQQVKWGGRLASHRQVANRRTSRYWDLPMAAEETEPGQPHGKR

SEQ ID NO: 153940 - protein, 73 aa, Triticum aestivum
  Clone ID: PAT_TA_48358.pep
TLTSLCRCTRRNTNILERGTLDLLIIGLTDFNDEQIHNVKKSITLLETNLVLMMPKGDHDYYELLSIELDDII

SEQ ID NO: 153941 - protein, 109 aa, Triticum aestivum
  Clone ID: PAT_TA_48359.pep
ISSTAASDISWSLQLWSGVVHLHPQLICRVRSESSPIYMVRSPQVMIGPVCSCTPPPERLCRRGQPPASGLIIPQPSTCYMSIAASAKQVQQSHIRFWQPCFLSARFIS

SEQ ID NO: 153942 - protein, 109 aa, Triticum aestivum
  unsure (1)..(109): unsure at all Xaa locations
  Clone ID: PAT_TA_48360.pep
MLAVAVTQLWNYSXAMRLEWRPYTMSKRFREQGIHGPSYRXLKGWNEDVWSMKDETDRLVLEDSNYKYLLWIDKHYLKWMTLYGEPLLYCLGRQARICISDYELARQMM

SEQ ID NO: 153943 - protein, 51 aa, Triticum aestivum
  Clone ID: PAT_TA_48361.pep
YADDRLQNSILVHRSAKAPDQSGEQHHPIAEVITVIVHRDHRVIVCTDLQT

SEQ ID NO: 153944 - protein, 98 aa, Triticum aestivum
  unsure (1)..(98): unsure at all Xaa locations
  Clone ID: PAT_TA_48362.pep
MGDSQCCLCLTTLSSSGKLEQIEHALTEVGSGQTSLGIKTGNGVDIATDKKLPSILVDETSVQKTEAXTPNIGVVYREMGTDFSVLVRKSRKQAHDAL

SEQ ID NO: 153945 - protein, 122 aa, Triticum aestivum
  unsure (1)..(122): unsure at all Xaa locations
  Clone ID: PAT_TA_48363.pep
MALRLSAVGSVAAPLCHLRLCRLVSCMARATVCTTSALDSMRSTENVSGEFLGDHRRMDXTSCTWMAPEVFKRVDDQSGAAEXPTCDVIMTNVLKVSIFCTTCSMHTDKPTEDIMKVQNTFT

SEQ ID NO: 153946 - protein, 111 aa, Triticum aestivum
  unsure (1)..(111): unsure at all Xaa locations
  Clone ID: PAT_TA_48364.pep
MECAMELSLLKPAMHYLGIAGKTASHVSVLRARRGAVLFRVRDAAGATSAPGGKSGWRXKRRTTAVNESMITPSCYTTDLNKMEQMMNAEIYKQMNQDEFDTLMXEFTTDY

SEQ ID NO: 153947 - protein, 106 aa, Triticum aestivum
  Clone ID: PAT_TA_48365.pep
CEFEHMHTQSSCSVLSMIPSFLRASSVHAFGSVSTVASLQNPVQCPCVVSSVLRISSSHKDELGNAFSSIPCKEGRSLFISYFVVHPSYHQSRTSMTSPNPAIAAL

SEQ ID NO: 153948 - protein, 57 aa, Triticum aestivum
  Clone ID: PAT_TA_48366.pep
TGFLMERTHLPETMPNPRNWSANESKQHHLMMIEQVSMEFTLLSSCMIHLCQMIINN

SEQ ID NO: 153949 - protein, 73 aa, Triticum aestivum
  unsure (1)..(73): unsure at all Xaa locations
  Clone ID: PAT_TA_48367.pep
MHAQRADPIVVGRVIRYVVDPLARTVALRVSYASTDMANRCELRPSAITYPPCVQVXWPIMHTLYTLMMRDPN

SEQ ID NO: 153950 - protein, 77 aa, Triticum aestivum
  Clone ID: PAT_TA_48368.pep
RHHGLVMQPIGTYVDPCWFGHSELHFWATDYDRVKGFEFDRIISTRIEDIRESLMPANDSYGGTYSIGRWTMTRHIL

SEQ ID NO: 153951 - protein, 101 aa, Triticum aestivum
  unsure (1)..(101): unsure at all Xaa locations
  Clone ID: PAT_TA_48369.pep
METITELVVGGTGYLGRRIVNAXCLPQGHQTCVLMRPXIGLNINKLQMLMSFKAHGARFLEASIDDHRGLVACAKHTDVAASAMCRVHLRRXNLLLQMKLV

SEQ ID NO: 153952 - protein, 97 aa, Triticum aestivum
  Clone ID: PAT_TA_48370.pep
TTVLTEFLVPSDEGSIKISLDELASPGTTTTSATQCSTGVHAERPWVTHCDTVAHAVRLSRACVVTGVDDIDCHMGDSWVSLCESYGGSVLHIERFT

SEQ ID NO: 153953 - protein, 100 aa, Triticum aestivum
  unsure (1)..(100): unsure at all Xaa locations
  Clone ID: PAT_TA_48371.pep
RWCRYVDEKRKGLMESGLRRTLGPDGAISASKYCCMGSYDAYSYVWTXHIFSIPLLGTHSDAYVRSYMSLDEIPYWTLRNKDGSKICTEFMRLMNDWLCK

SEQ ID NO: 153954 - protein, 72 aa, Triticum aestivum
  Clone ID: PAT_TA_48372.pep
PPQRQHCSHMVTHAIEYDDATCYKQLVRPDRSISLQRKHQHKVHTLTHGRSRPNVSPTPPARPSRSYAWTYA

SEQ ID NO: 153955 - protein, 65 aa, Triticum aestivum
  Clone ID: PAT_TA_48373.pep
FDLGRVFCSLRQYLMSCAMRVPGDSYCLLPAGMSELSSPACRLMVHWQLKYVPGDCSLADDVCAP

SEQ ID NO: 153956 - protein, 109 aa, Triticum aestivum
  Clone ID: PAT_TA_48374.pep
RTLSHPHQRNIGGVRVGQSRPCPGRALAMLARRRPPRVAQRWGACSAAAILPHGCPTGCCYIRAWAQPFILQDIRMRMWRLVTLYSDIDGADYSLRMFTDDRQYLVAFR

SEQ ID NO: 153957 - protein, 68 aa, Triticum aestivum
  Clone ID: PAT_TA_48375.pep
SAVARSAPSPFLSGCRPCSSLLITPPRPWSVEAGSTPDQICRATASPTKSNISKSAAGRRLLFCSVRV

SEQ ID NO: 153958 - protein, 46 aa, Triticum aestivum
  Clone ID: PAT_TA_48376.pep
MVKETAYYETLGVSINACPCCINKAYFVQARLVHADKNICNRDTER

SEQ ID NO: 153959 - protein, 82 aa, Triticum aestivum
  unsure (1)..(82): unsure at all Xaa locations
  Clone ID: PAT_TA_48377.pep
GRFSLHVIHCLWXMLGALGCIFPKLLARNGVKICEARWFKATSQILSEGMLNYLWNSSLVHAHSMLAIWACHVALIGSAESY

SEQ ID NO: 153960 - protein, 61 aa, Triticum aestivum
  Clone ID: PAT_TA_48378.pep
SMNLQKFQAPIAYAFKSSLTLYFLSSNQFCETLLPLQCLNRHYSSIPVMLVKSPFPDTRPL

SEQ ID NO: 153961 - protein, 65 aa, Triticum aestivum
  Clone ID: PAT_TA_48379.pep
FPGYVLQDCHSLVRIGHVLQPLPGQNARCSAVRPLRPGSGAGVCRWWIHRTAGRKGLGLCPHRMW

SEQ ID NO: 153962 - protein, 128 aa, Triticum aestivum
  unsure (1)..(128): unsure at all Xaa locations
  Clone ID: PAT_TA_48380.pep
MAALSCVAASGPSFGGKGATPMRRRRMAARASLGKKAGSAAVAVTASTMLLGGTAMAQDVLLGTNGGRLVXHQTNXTVKCGETMSCKNNTGCRHNVTFDEDSMPSGVDVYKISYEEYLNAPGETFSTT

SEQ ID NO: 153963 - protein, 44 aa, Triticum aestivum
  Clone ID: PAT_TA_48381.pep
ECTVIWFTNFLSISLPTVVVWCEHIYSRCPPYHLAFKYEILSQS

SEQ ID NO: 153964 - protein, 92 aa, Triticum aestivum
  Clone ID: PAT_TA_48382.pep
RITPRSIQARIRAAPLISRRPLAATNSPPSRTARPRSIRARARARSIIDPDLCVSLSRPASASVLCVCVVRFGFRFVVMYSEGSTLLLRSLV

SEQ ID NO: 153965 - protein, 100 aa, Triticum aestivum
  unsure (1)..(100): unsure at all Xaa locations
  Clone ID: PAT_TA_48383.pep
SNIIYPTGRLLSTPLLGDPGAKSDSSYTHXRCSGSVRGWTVTGLPGPGRRDRHRRRRTXGGGASGCPRWRRFLPRCXGSAXKHYYTVLGVMPDAARKQIM

SEQ ID NO: 153966 - protein, 70 aa, Triticum aestivum
  unsure (1)..(70): unsure at all Xaa locations
  Clone ID: PAT_TA_48384.pep
VPHRISLLYPRVPLSSTPSFSSCLLFLLRRWWGLGPRRGRDPIGLAVYVKLHALFFTSLTHTXRRYPHPF

SEQ ID NO: 153967 - protein, 88 aa, Triticum aestivum
  unsure (1)..(88): unsure at all Xaa locations
  Clone ID: PAT_TA_48385.pep
MEGQVLSAGSGMETSIRVTMDVGAHGMPLITIXNTGLKALNPMMMHGLTEKYSDAADLDDKNAIALTXTAGKLCMRLDMNDLSKVDET

SEQ ID NO: 153968 - protein, 66 aa, Triticum aestivum
  Clone ID: PAT_TA_48386.pep
EHPLVLAMGTGIDRVGSSLLSADCCGGIYGGAEGTYLAASCSRGGYRSRIEIHYKRLITKDTCYSM

SEQ ID NO: 153969 - protein, 98 aa, Triticum aestivum
  unsure (1)..(98): unsure at all Xaa locations
  Clone ID: PAT_TA_48387.pep
MGACLQAAATLMPGKIGWRACSARTLSHVSRAFCVDTCARITXCVQTDIRXVACKCADVAXMAGCRVPTCGLIVXASSANRAPNTLTLNEIQSKTYME

SEQ ID NO: 153970 - protein, 50 aa, Triticum aestivum
  Clone ID: PAT_TA_48388.pep
GDVRLLYITLCIRFSSVIHILLGLCLSVIISHSSKEAVSVLRFSAQMPNV

SEQ ID NO: 153971 - protein, 90 aa, Triticum aestivum
  Clone ID: PAT_TA_48389.pep
RTPPHSVRGTAPEPPYFLPSHPCSTAVLLYARPALQSRTITRTRAPRACPICEKSRTRVSPGLRDAKAAGATRCRLFSTTSSYTEVDHTY

SEQ ID NO: 153972 - protein, 84 aa, Triticum aestivum
  unsure (1)..(84): unsure at all Xaa locations
  Clone ID: PAT_TA_48390.pep
MSTILPNLCDTYVTTWSWKGRMMHVVYAMEAAKHASNCVSLXCATNSVLDTSNRSANXLSSHQCKVLRVAYHAGVYLACFIASG

SEQ ID NO: 153973 - protein, 74 aa, Triticum aestivum
  Clone ID: PAT_TA_48391.pep
MLHYYPYLTTSDMELDLASTKLTGGRRPHGGMPSMQAGSTWIDHCHGGSPQISAELFNREAIMHGSATHYGMNY

SEQ ID NO: 153974 - protein, 40 aa, Triticum aestivum
  Clone ID: PAT_TA_48392.pep
ISGIDRRIGSIRILSRFLGGILQIFFGYLPVSNNDTYRVS

SEQ ID NO: 153975 - protein, 47 aa, Triticum aestivum
  Clone ID: PAT_TA_48393.pep
VAQPRHGAGIFRSELRMQHRHLHLLTRVRARAPRNSNRYVQRVQLTY

SEQ ID NO: 153976 - protein, 110 aa, Triticum aestivum
  Clone ID: PAT_TA_48394.pep
RMNILGHLYLYKAALVFPLTKKWRSCSISMNGRCWWHQYLPSDMIFCTLMGMEGPMLCWPITHASLPAALVINSLIKCGQIGTAFWGAVSKYTNITRLVAPISQASSKNF

SEQ ID NO: 153977 - protein, 52 aa, Triticum aestivum
  Clone ID: PAT_TA_48395.pep
MDNAIDRHRVLLRHLLRCAWSQTELSTSACSAGDSTAYQRISCLRDNVGIGD

SEQ ID NO: 153978 - protein, 65 aa, Triticum aestivum
  Clone ID: PAT_TA_48396.pep
MGTGGIGGAVAAADLTNSDSTRGLVRVVKRIRMNDGTGVGTGLNGRLGMGILGTVLKQVKELNVQ

SEQ ID NO: 153979 - protein, 97 aa, Triticum aestivum
  Clone ID: PAT_TA_48397.pep
ALSHCFLSCPCCWKWMPASVVCRFLALWCRYMLLNLIRRAECPSVHPRSAARRASGQPVWPEEEQGRGRGRDGPRRGCEGLRFVFLYPQGTDLARKR

SEQ ID NO: 153980 - protein, 61 aa, Triticum aestivum
  Clone ID: PAT_TA_48398.pep
TSANGRSPLQLSICAVAAGASTDTSTAASAAAATTTRTMLISLALSSVGGRMTVVAAQQCQ

SEQ ID NO: 153981 - protein, 136 aa, Triticum aestivum
  Clone ID: PAT_TA_48399.pep
LKIPFEKSKTHPAALTTSKYGQSSWESFKAVMSREQLLMKRNSFIYIFKVSQLIILGLMAMTVFLRTEMPHGQISDGAKFFGALTFSLITILFNGFAELQLTIKILPTFYKQRDFLFFPPWTFGLENIILKVPVSF

SEQ ID NO: 153982 - protein, 138 aa, Triticum aestivum
  Clone ID: PAT_TA_48400.pep
PRVREKITEGYNPATWMLEVSSPLAEARLNVNFAEIYANSDLYRKNQELIKELSIPPPGYEDLSFPTKYSQNFYNQCVANFWKQYKSYWKNPPHNAMRFLMTMIYGLVFGTVFWQKGTKIDSPQDLYNLLGATYAGVF

SEQ ID NO: 153983 - protein, 73 aa, Triticum aestivum
  Clone ID: PAT_TA_48401.pep
PTRPSTHKRGHHSAHPRAQAAAGREGAKAKALTHSSAMAAEALPRAAAPARRPSVAVASASRLLLGHRPFLAP

SEQ ID NO: 153984 - protein, 161 aa, Triticum aestivum
  Clone ID: PAT_TA_48402.pep
DVSAAVGRRPFTALSQEEADLALARVLQEQERAYMMLSAHGGDDSEYDASDAGSYEYYDEEEEGIEGDEGSDYEEEGNEDEEVGDAEGPELDPARYEDDEAYARALQDAEEREVAQRLMALAGITDLREEMEHDVEDGEYEEDGDSAQEAWEDVDPEEYSY

SEQ ID NO: 153985 - protein, 110 aa, Triticum aestivum
  unsure (1)..(110): unsure at all Xaa locations
  Clone ID: PAT_TA_48403.pep
NAVRTVIEAMYTAPMFVGINSCAPVQPIASIGRTAFYRERAAGMYSALAYAIADDVMEIPYVCVQTXYYTLIVYSMMSFQWTGVKLLCVFFRHYFILLYFTYYRMMTASI

SEQ ID NO: 153986 - protein, 99 aa, Triticum aestivum
  unsure (1)..(99): unsure at all Xaa locations
  Clone ID: PAT_TA_48404.pep
KSLRDSWHHTHTPPPTQPERKRMASQGVASMFALALLLGAFASIPQSDSPSFSLSLSLSLXLSLSLSLSPNDWVQFFFMQVVQGVCLEDGNTYVNLSFH

SEQ ID NO: 153987 - protein, 69 aa, Triticum aestivum
  Clone ID: PAT_TA_48405.pep
ASHLRPHLPCSSPASWKSTFWSDPVKKKSSHNYYHGCLRVFKQKAETAEIALHISPRKGFEKHAYHTCQ

SEQ ID NO: 153988 - protein, 73 aa, Triticum aestivum
  Clone ID: PAT_TA_48406.pep
FLLCACLSTWSLVINQSSHASIHLYLVVQLARSWRSISLASNNPKVGENSIPLYQIERETQHPASATSAGNGS

SEQ ID NO: 153989 - protein, 132 aa, Triticum aestivum
  Clone ID: PAT_TA_48407.pep
VIVKSAKQICRFFHNHNNLHDSMRKNVGGELIKPNATRFGTVFMLLESYLEKKDHFRKLMVYDDWKNSFLKNDADHVFAEELLSSNMWGTALEWVLGLLEPIYVALMICLVTNRIALFSCLQERLMDDLPIP

SEQ ID NO: 153990 - protein, 105 aa, Triticum aestivum
  Clone ID: PAT_TA_48408.pep
GHAMPLIHLACLLLGRRLASAVTFFTTPRIAPFIRAGLAGAGGGAAVVELTFPFEQDAPHSTDELPSSTSLVDLVTVGAGLQPAFADALAKIEPRPVLLVHDCFL

SEQ ID NO: 153991 - protein, 91 aa, Triticum aestivum
  Clone ID: PAT_TA_48409.pep
MASKTLLLLGLFAFLFIVSEMAAAGTVKSESEETVKPEQHGGGFGDNGGGRYQGGGGHGGHGGGGYQGGGGRYQGGGGRQGRRGRYCRHKP

SEQ ID NO: 153992 - protein, 137 aa, Triticum aestivum
  Clone ID: PAT_TA_48410.pep
GGTACGAEIVSNISSWASTISAAATAARTGDGAANQQLNTRVNPHLKHAASCSESSGSSRAVVARAVPRPVTETVPDLQEDPIDEWRTNGVINEDLAYGVYDGHHAYDQGQEKRAFWEDVSEEVQEADHSKGLQALI

SEQ ID NO: 153993 - protein, 92 aa, Triticum aestivum
  Clone ID: PAT_TA_48411.pep
PASSGAPPSRPPSPPPPSSPRRRTPRRPPPPPRGRGRRRGSSWPPRPPRRRIRPWRRSRRPPGSRGRGGRPFGMGASRRSVPAACTVGADAW

SEQ ID NO: 153994 - protein, 48 aa, Triticum aestivum
  Clone ID: PAT_TA_48412.pep
HWQFLVNHPMATFLNPCPMSIVLGSMNIILSINEASSMVTTALPNHQT

SEQ ID NO: 153995 - protein, 140 aa, Triticum aestivum
  Clone ID: PAT_TA_48413.pep
SELSEHNDKADHVNSPAADEHDLSTRMLNSYQAQLSALQKDKSDRLHKVLKYVNEVHSLCGVLGIDFAKTVNGIHPSLHQNGVEQSRNISNGTLEGLDSTISNLKAERKSRIDKMRDTMESLCHLLEVMDSSEVEKRQFN

SEQ ID NO: 153996 - protein, 110 aa, Triticum aestivum
  Clone ID: PAT_TA_48414.pep
PEWWWWWWLRCCEMTRVSMAPSRKLQIEPSPSGSTPDEQIETHRSAKGFAPPSQIDSALLSSVPNRFCDASARTFRSDEPPAGGERVEGDRRMEPREAAWRTDLAAAAAA

SEQ ID NO: 153997 - protein, 85 aa, Triticum aestivum
  Clone ID: PAT_TA_48415.pep
MDDGARPAPNHKRHLPLQEAGGELVELLWQDGAIVAQAQAQTPHRRCPQSGAASGVTAEDASAWLIPDGGCGGRDLYSLLLHGVA

SEQ ID NO: 153998 - protein, 78 aa, Triticum aestivum
  Clone ID: PAT_TA_48416.pep
PRVRPRVRPRVRLSISAATTNEGALSDGRHRLRHLGLAHLALLRTPVRYLALAPRRAFLEGWRGAMASRVKEDLKIRA

SEQ ID NO: 153999 - protein, 122 aa, Triticum aestivum
  Clone ID: PAT_TA_48417.pep
VELVAVNDPFITTEYMTYMFKYDTVHGHWKHSDIKLKDDKTLLFGEKPVTVFGVRNPEEIPWGEAGADYVVESTGVFTDKDKVVAHLKGGAKKVVIYALSKDASMFVAEVYEDNAHIYSLTL

SEQ ID NO: 154000 - protein, 77 aa, Triticum aestivum
  Clone ID: PAT_TA_48418.pep
LSRCFDEGQTRAVTQHLCGSQGYLAPEFYRGHIAFASDIYSLGVIIMEILTGAKGYFEEENFFTAKTLLHQQNKPGR

SEQ ID NO: 154001 - protein, 91 aa, Triticum aestivum
  Clone ID: PAT_TA_48419.pep
GRRRRRSGGRRASSARRGAAAGPAAAAAATAAPAGTTRLEMELAATTQKLRPGVGAERESGAMVSSWQTRAKMGSSRNKTMQLPRPRDQLI

SEQ ID NO: 154002 - protein, 121 aa, Triticum aestivum
  Clone ID: PAT_TA_48420.pep
RRRWRRGGDLEIGSVREVNVKTGLPATTSTERLEQLDDDEHILSVKFVGGDHRLRNYSSIITVHPQSIDGRPGTLVIESFVVDVPDGNTKDETCYFVEAVIKCNLTSLAEVSERLAVQSPT

SEQ ID NO: 154003 - protein, 159 aa, Triticum aestivum
  Clone ID: PAT_TA_48421.pep
RTRGLTGGVSGRTHRAARYSLVCCPCSWESSPGCLRRTVQVRCLPFYMVHTTVTWYKQLTLWRHAKIVMGVRAEEARCAARVAEGPPSTSDKMRRRKPRARRRQFCQLTPQPSGWKWQTPVGRGNIIPRLATDDAREQCRLTMEAEHLMADEQLMTKQA

SEQ ID NO: 154004 - protein, 155 aa, Triticum aestivum
  Clone ID: PAT_TA_48422.pep
YPVPEEIVKQRQIFREVSSRLSDLEATLDAGTQHRNKALESVGSQLWRWILMVKKEKAVYDTLNMLNFDVTKKCLVGEGWCPIFAKSQIEDVLQRATLHSNSQVGIIFHEMDTIDSPPTYFRTDKFTNAFQEIVDAYGVGRYEEINPAVYSVITF

SEQ ID NO: 154005 - protein, 80 aa, Triticum aestivum
  Clone ID: PAT_TA_48423.pep
FKGRDFQFLPFGTGRRICPGMGFGLATVEVMLANLVYCFDWELPDGMQEEDVDMADMFGVTMRRKEKLVLVPRIPQDANI

SEQ ID NO: 154006 - protein, 152 aa, Triticum aestivum
  Clone ID: PAT_TA_48424.pep
KQKTTRKNPEELKLRGASSSSAPLLQPLPAKGDGQRRGARVAREWWDESKRLWRIVGPAIFQRVALYGINVVSQAFIGHIGDLELAAFSIASTVIAGFNFGFLLGMASALETLCGQAFGARKHHMLGIYLQRSWIVLFLFALALTPNYVFTE

SEQ ID NO: 154007 - protein, 158 aa, Triticum aestivum
  unsure (1)..(158): unsure at all Xaa locations
  Clone ID: PAT_TA_48425.pep
CAPLHSAPHPTPAHAAAMVALASLSSLCLCGSARRRSASAPTSISCCVLATPSGRGSHESRIPRRRFRRTEGATKSMEDSVKRKMEQFYEGVDGPPLRVLPIGGLGEIXYDEFGVQKIIPDTTFIKKWSHKIEAVIITHGHEDHIGXPALDSTTPIFA

SEQ ID NO: 154008 - protein, 45 aa, Triticum aestivum
  Clone ID: PAT_TA_48426.pep
MQKWRGGLQVPKCCSELPPRREANCRSLARVRNGRRTRCMLSSSI

SEQ ID NO: 154009 - protein, 116 aa, Triticum aestivum
  Clone ID: PAT_TA_48427.pep
GSKQLQKWHETLTRRQRNSDGISNSRFIQRYGTDHIKQHGERGGRGSTGGPGRAGAELEVKERGRTGAELEVEEHNRRHLRHLAPVPARGRGRGARSASGRVPPPSPTAEEPCPTC

SEQ ID NO: 154010 - protein, 147 aa, Triticum aestivum
  unsure (1)..(147): unsure at all Xaa locations
  Clone ID: PAT_TA_48428.pep
PRVRRFKGDEEKLREFIKRHVARLLKADKLSVLGELERQEEVDLSVKMFRIIQKEDWYKPDVYMYKDLIIALAKCKKMDEXAMDIWGNMKEENLVPDLQTYAEVIRGFLRYGSSSDAMNIYEDMKRSPDPPEEVPFRVLLKGLLPDS

SEQ ID NO: 154011 - protein, 159 aa, Triticum aestivum
  Clone ID: PAT_TA_48429.pep
TMQTAVGVFGGGNYTDGASASPLMVEGAGNSGRQPISSLNCPPFLAVEACREHLGVHPCDKRSSITKYRTLFPAIDFSLIENDEDVLWEPDVRETNESVALRGMKFFDWLWTREEKEIAIVSHSGFLYHTLNMYGKECHPTIAEELGKHFANCELRSMV

SEQ ID NO: 154012 - protein, 122 aa, Triticum aestivum
  Clone ID: PAT_TA_48430.pep
MQTDTQFSSAAMKRTSDWIRSQEFPSDITIQVGGSSFNLHKLPLASKCGYIRKLVSGANGSRVTHLEITGMPGDAKAFDLVIKFCYGVNFEITADNVAMLRCAAEHLEMTEECKPGNLVGRT

SEQ ID NO: 154013 - protein, 138 aa, Triticum aestivum
  Clone ID: PAT_TA_48431.pep
MAPAARLRLLASCRLFSALSGTVPRCRRGLRGLSTLSSTLGSGAGEDEIERIRREFEDAKRNYLSIPAAIKDMPKMDPQGIYVNKNVKLDDLQVYGFDYDYTLSHYSDHLQCLIYDLAKKHLVNELKYPESCLQYDYD

SEQ ID NO: 154014 - protein, 110 aa, Triticum aestivum
  Clone ID: PAT_TA_48432.pep
MLWSRAIVREFAMRFHEHGAESQVSSDAPLKPSMDIFSLGCVLAELFLEGQPLFELSQLLAYRRGQYDPTHTLEKIQDAGIQDMVLHMIQVDPKERLSCKSYLQKYATGV

SEQ ID NO: 154015 - protein, 147 aa, Triticum aestivum
  Clone ID: PAT_TA_48433.pep
ERVNQCLEMFLRCAVHDTPTKWHAWLPLAEFWYNTNFHSALECSPFKALYGYEPTYGVFPTLLQSDNIDVEQWLRDHQTHTAVLKAHLLKAQAKMKHYADKNRTPRVFSVGEAVYLKLQPYAQHSVVNRPCAKLAYKYYGPFEILEQ

SEQ ID NO: 154016 - protein, 116 aa, Triticum aestivum
  unsure (1)..(116): unsure at all Xaa locations
  Clone ID: PAT_TA_48434.pep
LTGRGGPARARCISSYASETQDAAPLRGRGSCDKLWMXTKNKAWTLPSAFDNKGNYVISLSQSVRWMPVKAEKLGVEVYPGVAGSEILYDENQIVAGVATNDXVGFAKDGRKTGNF

SEQ ID NO: 154017 - protein, 134 aa, Triticum aestivum
  Clone ID: PAT_TA_48435.pep
HASAHASGAIGTQLNFRIQAPPTTATFRLPLPAALRVGRRLPPRRAAVLARADGEGGEVEEAAGGGGGRGEGVRGGRGARPVEVVVAEQPAGAHGPSPPAPPPQPHPGSRRRRRGRVPPRPRHPPRQQVVPGMD

SEQ ID NO: 154018 - protein, 134 aa, Triticum aestivum
  Clone ID: PAT_TA_48436.pep
AASLHNLVFPYDDLDKMIRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFKGNIWDFDNRPKVMN

SEQ ID NO: 154019 - protein, 60 aa, Triticum aestivum
  Clone ID: PAT_TA_48437.pep
DLYLVFLVAYCRLLHLLYVDDLLAAVRRECCQIYIPGRASYDDLFTETFRQLHLEADGRA

SEQ ID NO: 154020 - protein, 143 aa, Triticum aestivum
  unsure (1)..(143): unsure at all Xaa locations
  Clone ID: PAT_TA_48438.pep
MDSPLLVAALSSLLLLLALYLLGGKRRRRSYPPVAGAMLQQLLHWGRLPEYMTELSRRYGTFRMLTLTCNWVYTVDPANVEHILRTNFANYGKGPMTHGVLGDLLGDGIFNVDGAKWRHQRKVASXEFTTRALREYSSGVFRD

SEQ ID NO: 154021 - protein, 119 aa, Triticum aestivum
  unsure (1)..(119): unsure at all Xaa locations
  Clone ID: PAT_TA_48439.pep
MSPQTETKAGVGFKAGVKDYKLTYYTPEYETKDTDILAAFRVSPQPGVPPEEAGAAVAAESSTGTWTTVWTDGLTSLDRYKGRCYHIXPVAGEDSQCICYVAYPLNLFGEGSGSNMFTS

SEQ ID NO: 154022 - protein, 52 aa, Triticum aestivum
  unsure (1)..(52): unsure at all Xaa locations
  Clone ID: PAT_TA_48440.pep
MSLACGLPLLECVYCLGCARWAWKRFVHSVHHDSATWGHAGVGDXEPVPRMC

SEQ ID NO: 154023 - protein, 84 aa, Triticum aestivum
  unsure (1)..(84): unsure at all Xaa locations
  Clone ID: PAT_TA_48441.pep
MAFGGGGFAVSYPAAAELAKAIDGCLDRYSQFYGSDQRVQACLSELGVPLTREPGLHQVDITSDAYGMLXAHHMVHIISLNHLD

SEQ ID NO: 154024 - protein, 77 aa, Triticum aestivum
  Clone ID: PAT_TA_48442.pep
MSGRKKTREPKEENVTLGPAVREGEHVFGVAHIFASFNDTFIHVTDLSGRETLVRITGNPIYSYANLYEQAVVADVY

SEQ ID NO: 154025 - protein, 43 aa, Triticum aestivum
  Clone ID: PAT_TA_48443.pep
VRGWLSSLLIPLEDAVALAALHIPLAAFCGESTTGIRSGLTSG

SEQ ID NO: 154026 - protein, 56 aa, Triticum aestivum
  unsure (1)..(56): unsure at all Xaa locations
  Clone ID: PAT_TA_48444.pep
SAHASLAATRIPTSARLHSRAGSSQRVDFAYXIQLRPLSCSYSXPAREAFFSYVLG

SEQ ID NO: 154027 - protein, 75 aa, Triticum aestivum
  Clone ID: PAT_TA_48445.pep
ETNTANRPTATGDRCIVAPPLTHFRTSGSSGSPDPTGDALDRRPIGSIDEPPRDGFVPACVCCLLQKTSCARGAP

SEQ ID NO: 154028 - protein, 59 aa, Triticum aestivum
  unsure (1)..(59): unsure at all Xaa locations
  Clone ID: PAT_TA_48446.pep
TIGTRREKVTERGRESRGGERVGEETLTNPIHKLEIIEKGMXKSPPGERRGDETSSGLH

SEQ ID NO: 154029 - protein, 155 aa, Triticum aestivum
  Clone ID: PAT_TA_48447.pep
LSDPVFFNSSSPLSLELHSRDTFVASQHKDYKSLTLSRLERDSSRVAGIVAKIRFAVEGVDRSDLKPVYNEDTRYQTEDLTTPVVSGASQGSGEYFSRIGVGTPAKEMYLVLDTGSDVNWIQCEPCADCYQQSDPVFNPTSSSTYKSLTCSAPQC

SEQ ID NO: 154030 - protein, 136 aa, Triticum aestivum
  Clone ID: PAT_TA_48448.pep
QPILVKPQRRDHLAPAAPPPSGPRGRLQDPKPEHHEPQLQLLAELRHSAATTPAIRHHTGRNPCAARLTPHLRAKGARRGALTPPAALGGRAPPPLPASAAAAAREARGKGLAGLGFWPPEPPARATREEEGEREG

SEQ ID NO: 154031 - protein, 94 aa, Triticum aestivum
  Clone ID: PAT_TA_48449.pep
MPSVSRAVCLQRPTTSGGGRSREAARSVASPRARHAKSKTMIHPARGRHCSPPNAVAAPMPATKKRVFHFGKGKSEGNKAMEDLLGWKGANLAE

SEQ ID NO: 154032 - protein, 62 aa, Triticum aestivum
  Clone ID: PAT_TA_48450.pep
VVAFLLQTDGFIFSQKKAGLVSFKKKIFQNRVPIEMAWKTEMVAACILKLELPLGEYQVAEM

SEQ ID NO: 154033 - protein, 148 aa, Triticum aestivum
  Clone ID: PAT_TA_48451.pep
MALLALRLGHSSLLPAPPLRRQRQRLVVSCSAVSGGGAAVVWFKHDLRLDDHPGLVAACAEPRRPVVPLYVFDSRILAGYSDTRLQLLLFALKDLKLALKSQRSDLLIGLGNAEDAVLKLANEVQAGVIYTEEEVEHSVRSVLANVES

SEQ ID NO: 154034 - protein, 101 aa, Triticum aestivum
  unsure (1)..(101): unsure at all Xaa locations
  Clone ID: PAT_TA_48452.pep
AIAASAQGPAVAPAAPTTPTTPAAPAPAAGTTNITGVLAKAGQFNTFIRLLKSTGVAVHIDNQLNNSFGSGMTVFAPTDNAFTSLCSGTLNXLSDSQKNAL

SEQ ID NO: 154035 - protein, 143 aa, Triticum aestivum
  Clone ID: PAT_TA_48453.pep
YYYPPVQQPQPPPQTLRRRPRPAARWVKQWIPQDLASPGSKCALFKWVREDVYKNLKENGGVGQEPEAQPRKVEPATEILFLCSYDNCGKTFVDVAVLRKHAHVHGERQYVCQEPGLGKKFGDSSKLKRHHLTHTGQKGFGCP

SEQ ID NO: 154036 - protein, 86 aa, Triticum aestivum
  unsure (1)..(86): unsure at all Xaa locations
  Clone ID: PAT_TA_48454.pep
MLVYQDKLSGDELLSDSFPYRELENGVLWEVDGHWVVQGAVDVDIXANPSAWGGGDYSGVDDQAXKVVDIVDTFRLQEQPAFDKEQ

SEQ ID NO: 154037 - protein, 72 aa, Triticum aestivum
  Clone ID: PAT_TA_48455.pep
QRVRGAEETINPTPPPVRGERSILRRAVDTLARPHTLDPPTGSVAFFGRSNTLLSREWHRFEHQSPLVFSHY

SEQ ID NO: 154038 - protein, 144 aa, Triticum aestivum
  Clone ID: PAT_TA_48456.pep
HLKGDRKDFDFVKTSLAAKGFNVVYDINGREATEVSPILEALPNLEQFIYCSSAGVYLKSDLLPHFETDAVDPKSRHKGKLETESLLETSGVNWTSIRPVYIYGPLNYNPVEEWFFHRLKAGRPIPIPNAGNQITQLGHVKDLA

SEQ ID NO: 154039 - protein, 56 aa, Triticum aestivum
  Clone ID: PAT_TA_48457.pep
LLWWFFFLLIRAILPNIKGIIPGLTTLESSFIGIHGPSSTESSWLSSSSLSSSSTL

SEQ ID NO: 154040 - protein, 94 aa, Triticum aestivum
  Clone ID: PAT_TA_48458.pep
DINDEPPNPDQPISKPSMAPKPKPWEKQGQQSSGLDLKAHTSNPSESSSGVQTDGTSQATGSNNSSGHGNLMLTAEPATGSEAPVDGVATSPKQ

SEQ ID NO: 154041 - protein, 131 aa, Triticum aestivum
  Clone ID: PAT_TA_48459.pep
NKISPPPPPRVGPPLATRGRPCHAVAPLPPSHPVSPPPEEAAGKGRARSGEGGGEALLLLRVSSVSSEEGPRDASDWIGRAASEAGGGGACRRRPGVPASQSRPPVCSSSSLLARALTGQGAGADLGLPFQ

SEQ ID NO: 154042 - protein, 76 aa, Triticum aestivum
  Clone ID: PAT_TA_48460.pep
ALLTGASHVRSTNGTSHREKCRWHSSARRSRYAPPAVIGLVATGALDIEGEAPVVECPVGWVAVNWWWVWARKKAC

SEQ ID NO: 154043 - protein, 73 aa, Triticum aestivum
  Clone ID: PAT_TA_48461.pep
IRPLLLAALFLPAPPSPLQHSAQFRHCTESPHGPRSPSFTAPLTTSTTTNFRRLRTHSTPFHGRRCLAGDGWL

SEQ ID NO: 154044 - protein, 54 aa, Triticum aestivum
  Clone ID: PAT_TA_48462.pep
PRVRPRVRGEGTFVKVKFARNGLAGENVAIKILFKGKGLKHKMIAQIKGGNLHH

SEQ ID NO: 154045 - protein, 64 aa, Triticum aestivum
  Clone ID: PAT_TA_48463.pep
HRMAGASAQPAWAHALAAAVLLAAYHGGSISTQLVPLDTVPLPCLLTVFDLCRFRLSNTTRYLQ

SEQ ID NO: 154046 - protein, 143 aa, Triticum aestivum
  Clone ID: PAT_TA_48464.pep
YYIDHELSIDDFLHGSNPDGLNNQPEHQQFNLPLDLQHSNSSYADANNSVQSTGDVFFHMSDLLTTVSPSPSQYLGPKCALWDCGRPVRGSEECQDYCNPYHAGLALNDDGLLGTMGTRPVMRPRGNDLKDGPLFDALCAKVQ

SEQ ID NO: 154047 - protein, 81 aa, Triticum aestivum
  Clone ID: PAT_TA_48465.pep
SSQPMVRRRSKVSDPSRWDEATGKRVMSRAGPNATAPWRAYTSTAWIRSKPEDLVPRNADYIGTRHLGRLRTRRGKRGSSS

SEQ ID NO: 154048 - protein, 113 aa, Triticum aestivum
  Clone ID: PAT_TA_48466.pep
ERRTRREASRSVSGEGNSGGQNRSKRPRSRSRLPYNFPHEPLVNPLMDALGDTKSSRKSSLMYEAPLDYSIEYILPDVGPNKCSAAYSNCSKNPSWYPFWHPLSDAYDVYADL

SEQ ID NO: 154049 - protein, 150 aa, Triticum aestivum
  unsure (1)..(150): unsure at all Xaa locations
  Clone ID: PAT_TA_48467.pep
LNVVQAMAAVLMVLVTTRALWYVLWRPYAMASWFRRQGIRGPTYNLLVGSLPECQKMIVAVRAKDLDTIFHDCITTGQPFLQKWAYMYGKTFLYXLVPTPALCSTDMELVKKVLTDRTDMFQKDYSNANLEAVLGNGVYLQRTRWKRGAN

SEQ ID NO: 154050 - protein, 154 aa, Triticum aestivum
  Clone ID: PAT_TA_48468.pep
PRVREKLKLLSTPEERARRLKEEPEIHADPAMDPNYESPEEPEEDAERSSFSRPRGSFSRKDINPVSPGKGEGRNAARDSRTNWESNRNTWSSTQLESPHGRRSTFSSHGESAGYTGKSESPNVSTQKVNVEATAANTPHGPSVISSQTLTANL

SEQ ID NO: 154051 - protein, 121 aa, Triticum aestivum
  Clone ID: PAT_TA_48469.pep
GHRHLACWPLWLAGVGGDRRIGLAGTSAPRLLPPLPTTSDNVDAARCLSEPLRPSKDFFQAPPLMGWAWAALRSGVPRWRRAQNPSTSSSWVSSIGLIIRSSQPYSAAPSPSHGGGEEWDR

SEQ ID NO: 154052 - protein, 54 aa, Triticum aestivum
  unsure (1)..(54): unsure at all Xaa locations
  Clone ID: PAT_TA_48470.pep
LLLGLXNRLLILPLIHPSRSYLDQSDFPHSSTEQGEYRSHSDTPADMSPQLFLR

SEQ ID NO: 154053 - protein, 147 aa, Triticum aestivum
  Clone ID: PAT_TA_48471.pep
LPCCPLPNHHRVIRIPPGTPPPPVSLLGTLRLLLALSPSSAFLILEAARRVGLETADDRVAPPPEELALNPPDDDDGLLISLASDRFLDAFTLSLRRASRSRPAPGAAASPVPLSVSLQGPAGLLLPCGGFLTGCDLRGVGAASLAA

SEQ ID NO: 154054 - protein, 120 aa, Triticum aestivum
  Clone ID: PAT_TA_48472.pep
MKAGTTPPASRAAGLRTLVVHVLAVAATALVLFWCIGFRGGLAFRSSDKQRIFNVHPPLMLIGLVVIAGEAILAYRTFPASVSRDARKKAHLALHAAGPAVGFVGVLPVFKFHAEAAIPN

SEQ ID NO: 154055 - protein, 105 aa, Triticum aestivum
  Clone ID: PAT_TA_48473.pep
SLHRCKEIWGLDVDEFNPMRFEKGISRAAKNMHTLWAFSYGPRGCPGRSYAMVQVQTVMAMVLRRFSFSLSSRYVHMPMYYITLVPRYGLPLIVQNLVDDETNDM

SEQ ID NO: 154056 - protein, 125 aa, Triticum aestivum
  Clone ID: PAT_TA_48474.pep
VVASRPRRAGPADADGRRRHGRPGERPASEGGEARGAKRSRRRGGSFFFPGGHGEKVACGLPRIVSRKRRRTEKCCRRRWRGQRTRRVGRAYMLGSISPHEGTMAQKRPWIVLSPLQFSSFLNKY

SEQ ID NO: 154057 - protein, 152 aa, Triticum aestivum
  Clone ID: PAT_TA_48475.pep
SDASPSESKLFPTPEAMTVSVFFSAYLLKIFSRTLISTCGRLVGACPPVPSWSSRALEKHVSQLTALNWAWTRSPPRKCCLNLAVLSALHHPHRQCSSQWSCRLEFGWFLLPVRNRHRQDLVEEIPVNWRTPPPPSPWPMAVSFLTCVGRVG

SEQ ID NO: 154058 - protein, 69 aa, Triticum aestivum
  Clone ID: PAT_TA_48476.pep
AILSCTRSKNTYTSSTLHTLRIYNSYIVDAHQHNSKSNYNLFTKYDRPRSYRTYWSLENLQFVDGYLSD

SEQ ID NO: 154059 - protein, 44 aa, Triticum aestivum
  Clone ID: PAT_TA_48477.pep
PHLSSGRVDRALEVMALWSIARARPDIKGHARMSRSLYPHGACL

SEQ ID NO: 154060 - protein, 78 aa, Triticum aestivum
  unsure (1)..(78): unsure at all Xaa locations
  Clone ID: PAT_TA_48478.pep
PLAKIKGYPVWGNPNTVEPFLDEKAAPPPACPSIVNAKQLGLPSSKXAEADAEMDESLLLLLLLGRSYICMNALILME

SEQ ID NO: 154061 - protein, 106 aa, Triticum aestivum
  Clone ID: PAT_TA_48479.pep
DDLCSRGRRHDPRQREAQVDEGKRHDAEDEGEAHERRRHDDDPRRRGRRWRRGQHRDDDLLRLGRRRRRRGQHHDDGQRHRSVRETLAPGSCSPSEEAEWLGCAAK

SEQ ID NO: 154062 - protein, 40 aa, Triticum aestivum
  Clone ID: PAT_TA_48480.pep
MLSVTMSTRPVVSRRPHLPGRADELSPCSSPATETRGARP

SEQ ID NO: 154063 - protein, 110 aa, Triticum aestivum
  unsure (1)..(110): unsure at all Xaa locations
  Clone ID: PAT_TA_48481.pep
MAAAAVAARAYEAAARSALAALERNLLPDAVTRRLTRFLLAQRLRLGYLPSAPLQLQDLLLFAHSLEGMPIAIEMDTAKTQHYELPTTFFKLVLGKNPKYSSCYXPDDSS

SEQ ID NO: 154064 - protein, 64 aa, Triticum aestivum
  Clone ID: PAT_TA_48482.pep
MGEAVAAAEDTLKRGAVVVPAPHPSKGVASWAVDLLERLAVRLGHDKAKPLHWLSGNFAPVRDE

SEQ ID NO: 154065 - protein, 119 aa, Triticum aestivum
  Clone ID: PAT_TA_48483.pep
HASAVKYGADTITSMGNSLCRMYCKSGDLESGLRAFKGTPEKNVITWTTMISSCAEDENYLELGLSLFLDMLEGGVTPNEFTLTSVMSLCGARLDMSLGKQVQAFCYKVGCEANLSVKN

SEQ ID NO: 154066 - protein, 127 aa, Triticum aestivum
  unsure (1)..(127): unsure at all Xaa locations
  Clone ID: PAT_TA_48484.pep
LKAIEVFRQMPKKGCYPDSVTYSTLIDGLAKTGNMEQSLELLNEMGNKGFNSEVKYELLAEFLDEDDKVEEAIQVVHKLQDTGISPHAVLYNTILLGLCRNGKTDYAXDIFAXMGPDXCMPDDSTYT

SEQ ID NO: 154067 - protein, 80 aa, Triticum aestivum
  Clone ID: PAT_TA_48485.pep
GRLRCHPLTSGRGVGFKAGVKDYKLTYYTPEYETNDTDILSALEAAVRSFYYNTDVYAYGQDPAPHPPPPCPVAVDGAYS

SEQ ID NO: 154068 - protein, 123 aa, Triticum aestivum
  Clone ID: PAT_TA_48486.pep
PTRPPTRPGELTPLHQQKHRNGNCNINFYGGGRCRRKRHHVKKPRIETMCSEPSFSERTKTRGNTLPRVVICTSIWIITTYSCDQPLLSVFIRKMYVYIMPDFCLSAFWISCWQYKTVDQGSE

SEQ ID NO: 154069 - protein, 113 aa, Triticum aestivum
  Clone ID: PAT_TA_48487.pep
RTCSSVGLKFSVKSTAPRAPQNDQPHAGRRRRRRRRRGPRPDLLLPRRGLAGDGGSGGIERAGEAAAEGAAGRGGGHPGGLEHGEIARPADWGIEEEAAGGVPERCGCESSAR

SEQ ID NO: 154070 - protein, 107 aa, Triticum aestivum
  unsure (1)..(107): unsure at all Xaa locations
  Clone ID: PAT_TA_48488.pep
PTRPYSLLLLPASPPRSLPAPATGVSEKASRCALPRCSCRSASITWPRCSPPPSSCSSSSPATSSSPLXPPPSPPSSPPPSPQPAPLGAAASVQRSTPSAPASGRLL

SEQ ID NO: 154071 - protein, 137 aa, Triticum aestivum
  unsure (1)..(137): unsure at all Xaa locations
  Clone ID: PAT_TA_48489.pep
HASGTGAWTAGRTDGLTSLGRYKGRCYHIEPDAGEDSQWICYVAHPLDLFEEGSVTNMFTYIVGNVFGLKALRALRLEDLRIPPTYSKTFHGPPDGIHVERDKWNTYGRSSLRCTMKPXLGLSAKNYGRACHECLRG

SEQ ID NO: 154072 - protein, 99 aa, Triticum aestivum
  Clone ID: PAT_TA_48490.pep
VTSYREGLMSPRTETAAGVGSKAGVQDYKLTDYTPECETYDTDMVAAFRVSTHAGVTPEESWAALAAESSTGTWTTVGTDVTTSLDRYKGRCYHIYHCC

SEQ ID NO: 154073 - protein, 90 aa, Triticum aestivum
  Clone ID: PAT_TA_48491.pep
RRLARLKLQSRQGRLSLASVADFCSDCSCVQCTSWLASYSAMADHQRQRIHPVDLEAGQPRPSAPLVPPGSSFRSDKGDPAAAPDRRPSH

SEQ ID NO: 154074 - protein, 83 aa, Triticum aestivum
  Clone ID: PAT_TA_48492.pep
DAISIPTLIPTRSLGIHLPRGELRSRRRAVSPPSLVVTHPSCRPLLHSPSRSARPLYLPPARQPATAVQPPPAPPDAAPAPYP

SEQ ID NO: 154075 - protein, 90 aa, Triticum aestivum
  Clone ID: PAT_TA_48493.pep
YPATHCSARFWTCESSNYNGKPYVAAHNMLLSHAVADDNYKKNYQTTHGGSIGIAIAMKWAEPLTDTTEDILAARRASRLEVDWEVEPIL

SEQ ID NO: 154076 - protein, 39 aa, Triticum aestivum
  Clone ID: PAT_TA_48494.pep
SYSPSSLPVHNSADMPSVSVAMPIRMEMECIVQFSRTCG

SEQ ID NO: 154077 - protein, 125 aa, Triticum aestivum
  Clone ID: PAT_TA_48495.pep
LSVVHDYKKMIMNEPGALEKLACMLKKGTPRGRKDAVMALFNLSTHAESSARMLESSAVVALIESLRNDTVSEEAAGALALLMKQPSVVHLVGSSETVISSLVGLMRRGTPKGKENAVSALYEIC

SEQ ID NO: 154078 - protein, 94 aa, Triticum aestivum
  Clone ID: PAT_TA_48496.pep
GKLIHPYQYVHTRTATALANEFISHAGTVKSTKMDRHCSMRWTLPRLYAMYRRSRQWNSAHFYYCIYKDPTAGNSRASEVLSVYSDKSCKHFLI

SEQ ID NO: 154079 - protein, 101 aa, Triticum aestivum
  Clone ID: PAT_TA_48497.pep
GGGSLEKAERTTLLLVGEEAPAACGSAERITALQSAMVMDTTDPGYWLNWRFLLCATWVYSCMALACYLIWKYEGPSSPAGNDEGVDREEARPKIGPGVVY

SEQ ID NO: 154080 - protein, 90 aa, Triticum aestivum
  Clone ID: PAT_TA_48498.pep
KKKTKGPHFFFIFRDHKGSNSSTPLNLTKKPNLWATPRVPSPPVFLDKAQPLLSPQFGQRAPPLQTQWNAPLVPVCKCQLFNPPPLGLPA

SEQ ID NO: 154081 - protein, 59 aa, Triticum aestivum
  Clone ID: PAT_TA_48499.pep
PTRILANSKPCPKCKRPIEKNQGCMHITCTPPCKFEFCLLCLGSWSEHGERTGGFYACN

SEQ ID NO: 154082 - protein, 58 aa, Triticum aestivum
  Clone ID: PAT_TA_48500.pep
KLLYALTNALTNLVDFSGGSFSNWLIYSLLQHILQHDKVRASGCTSLYQPLYLHKRLT

SEQ ID NO: 154083 - protein, 137 aa, Triticum aestivum
  Clone ID: PAT_TA_48501.pep
RTRGRTLKPLAATTLLHLQATPSTRSPSPKSFRSPRSSSTYSSAPLPDRAATSLPIPSWISPSASHRPANRPHPSSQCVHGQVEERGAVQVQEPVAGGEQAVVIVLQLLQQPPLHVRQGRRRRPTQRGDDRGGVGSG

SEQ ID NO: 154084 - protein, 115 aa, Triticum aestivum
  unsure (1)..(115): unsure at all Xaa locations
  Clone ID: PAT_TA_48502.pep
PTRTDAGPLLKPMLVRGVLPCIGATSLDEFRKYIEIDPALERRFEHVPADQPTVEDPVXLLRRLHERYELHHGVRILDSAVVAADLLSDRHIRGRFSPDKAIDSVDESAAEMTLE

SEQ ID NO: 154085 - protein, 122 aa, Triticum aestivum
  Clone ID: PAT_TA_48503.pep
MASPFGGASTCGLKGATPSGFATRKQLSLVSPPLVSLPQRARPGRKCSFRVNAAKELYFNKDGSAIKKLQTGVNKLADLVGVTLGPKGRNVVLESKYGSPRIGNDGVTVAKRGEAEDPVENI

SEQ ID NO: 154086 - protein, 117 aa, Triticum aestivum
  Clone ID: PAT_TA_48504.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQ

SEQ ID NO: 154087 - protein, 66 aa, Triticum aestivum
  Clone ID: PAT_TA_48505.pep
GQKIGEGAGYRGLQSEVQSVSRKHVPIGDKMLIGQYVRRSACLDHLPLRRHCLENWPGRAGRPKRP

SEQ ID NO: 154088 - protein, 130 aa, Triticum aestivum
  unsure (1)..(130): unsure at all Xaa locations
  Clone ID: PAT_TA_48506.pep
THSRRPLPPSDLDPPPPPNPPPXDDPHRRRGAVAPRPGRPERPTLXPSSPPGSYSTAPPDTRPXTGRRRAPPPPGRAVHVVQGRAPXRPPRAXGPHRHHLAPDPPPPPQGGSRQVRLRRGHGQAAASGGG

SEQ ID NO: 154089 - protein, 110 aa, Triticum aestivum
  Clone ID: PAT_TA_48507.pep
GLVAAANVVAVALEYRLAPEHPLPAAYDDSWEGLKWVASHATAGAAGTEPWLVDHGDFSRVFLAGGSAGGTIAHVMAVRAGEQGALPGVGIKGIIVVHPYFNGAGGDRQG

SEQ ID NO: 154090 - protein, 94 aa, Triticum aestivum
  unsure (1)..(94): unsure at all Xaa locations
  Clone ID: PAT_TA_48508.pep
KSYREGLMAPLTEPQAGAGSRAGVKDDEXAYYTPDYETKDAAIVAAFRASSQAGAPPEEAGAAAAAASSTGSWTAAWTDGLTSRDPYIGRCYRL

SEQ ID NO: 154091 - protein, 77 aa, Triticum aestivum
  Clone ID: PAT_TA_48509.pep
PTHADHTPPADVHADYGAPRGGQHRRQHRSLRYRPEHRQGRLCLSPTLTTTENCGTCMLPASSCEPSIAMGGLPRQL

SEQ ID NO: 154092 - protein, 134 aa, Triticum aestivum
  Clone ID: PAT_TA_48510.pep
NAKLLINPSSVSSPSIPSFYFVDWHFVPMINILVPYLCNLCLHLGIAATESFQRPRGRYSVGSSPSGSSTWLTPPPSCADESITRRRKKNIGEVVDAPDVGLGFVDAPDSPEDRTQSSGEKRSRRGRRRRGNRG

SEQ ID NO: 154093 - protein, 104 aa, Triticum aestivum
  unsure (1)..(104): unsure at all Xaa locations
  Clone ID: PAT_TA_48511.pep
RPKPVNLTQADADPTIKAGAIANPGRPEALQVPQVEDLPAPGDGQVLLAVAAPGVNRSLTVQRHGRYPSSAGAXPLTGPXCFGTILALGANLPPRLAVGHQVCA

SEQ ID NO: 154094 - protein, 143 aa, Triticum aestivum
  Clone ID: PAT_TA_48512.pep
ASPSGQKFGQRVWVHIQVEDPSFVSDNKTAAVNLNQPQESNITNTSSLPQESNITNTSSLPQESNMTNTSNLIDVNMEPANQVLDEHVNGTRMELLEPLIYHEAAEPKKSPSAFSAAPPYPMVDVPSSSENAAAFVPSVNVLA

SEQ ID NO: 154095 - protein, 114 aa, Triticum aestivum
  Clone ID: PAT_TA_48513.pep
NIHMATAGAVVDRLLRRLASDARRSELPSGVDEHVAHLWRTLAGLQDVLVSVERYFRVRTEVQDWMAKINQIVYDTEHLLDEFEDQNGIGSERTGCITKATSLCSSCPFFLYDT

SEQ ID NO: 154096 - protein, 61 aa, Triticum aestivum
  Clone ID: PAT_TA_48514.pep
PACVTSPCSTIPCYRLSWNTATHCQRLKPQDVHREEYHPVCSGHTRTHAFSFAWPDRSLNI

SEQ ID NO: 154097 - protein, 99 aa, Triticum aestivum
  Clone ID: PAT_TA_48515.pep
MAPAIEAVEKVKVASTPVKPPVLNERILSSMTRRPGSAHSWHDLEIGPDAPTIFNCVIEIPRGSKVKYELDKKTGLIMVDRVLYSSVVYPHNYGFIPRT

SEQ ID NO: 154098 - protein, 88 aa, Triticum aestivum
  Clone ID: PAT_TA_48516.pep
HDERRQEILLPLCLLVAAPAEGEVRLLERSHVGGRGCPPRPPGSSGYYYRWGSRLVESGGEWMCAARPEMCRVWIGRRRPGALDYFPP

SEQ ID NO: 154099 - protein, 95 aa, Triticum aestivum
  Clone ID: PAT_TA_48517.pep
HYYYPFSTAGMEASGTSNMKFAMNGCILIGTLDGANVEIREEVGEENFFLFGAHAPEIAGLRQERAEGKFVPDPRFEEVRNTSSASLDSTMMIDG

SEQ ID NO: 154100 - protein, 105 aa, Triticum aestivum
  Clone ID: PAT_TA_48518.pep
TPAKKPPPNFAKLPRGLGAIVGVIGHGYPEDGKTIFQDIGASKAPQSNCPAAPAGSQSDCSAWPAAGCRLHQLAGCRLQPDSTPTRHRRDGRTRALLTCHPRHHV

SEQ ID NO: 154101 - protein, 147 aa, Triticum aestivum
  Clone ID: PAT_TA_48519.pep
PTRPAPPTTCSTRASCCRCTCRRASPWCARCCSRRPPPPPPPPPTPPPPPTPPATPTAAPPPPSPPTARRSCSRTPPPHPPAPAPPPTTTATPTCSREPPPTPGSRRPSAPASSTSRPSPLASPPSSSTAAPRRPPRSRPTSRSPRR

SEQ ID NO: 154102 - protein, 73 aa, Triticum aestivum
  unsure (1)..(73): unsure at all Xaa locations
  Clone ID: PAT_TA_48520.pep
PHGDAXLTVHMIIIYTYGGWGAHGGGAFSYXDPTKVDLSGPYIAWHAVKSIIASCLARRCIVXIFYAIGEPEP

SEQ ID NO: 154103 - protein, 128 aa, Triticum aestivum
  Clone ID: PAT_TA_48521.pep
ESLPRSRAPEQELCAHAPIQRRRRTNHGHASLFLPPSLPCSLSMSRRHMGTAKAARQRSGQRWRRLDRAPLCSMARKARRRSSGVRWRMGRRRWLGTWIPAGRVQIQSRTGRPAVPVTRAGRVGGRVG

SEQ ID NO: 154104 - protein, 49 aa, Triticum aestivum
  Clone ID: PAT_TA_48522.pep
EAAVSSFTPVCSRLGYYARPGSGHLTKSATVADRCVWIILKCYVIPFSC

SEQ ID NO: 154105 - protein, 113 aa, Triticum aestivum
  Clone ID: PAT_TA_48523.pep
TLWFIYWFIEHLTARVGASPRAAPTEVRTQMVHCNDQNNDEAAPDTSVVTRLCVVLCVLAGAVNVSVNVSAYGDAYSESGNAISNANINTYFVEYIKQVIKLMIHAKKDRKKD

SEQ ID NO: 154106 - protein, 119 aa, Triticum aestivum
  Clone ID: PAT_TA_48524.pep
ALSPRALMATNRYVCEICGKGFQRDQNLQLHRRGHNLPWKLKQRNPNEVVRKKVYVCPEPGCVHHDRSRALGDLTGIKKHFSRKHGEKKWKCDKCAKRYAVQSDWKAHSKVCGTREYRC

SEQ ID NO: 154107 - protein, 109 aa, Triticum aestivum
  Clone ID: PAT_TA_48525.pep
PRVRGRVGAAAPSMTPCPNRISAFEKAVRCFAEKPASNVLGTTFDSLGKACDFYNLYSWEKGFGIRYGKRRLNVEWVKCMQEIVCGCSGKAAVDFYRQKTMEDQQGPGG

SEQ ID NO: 154108 - protein, 145 aa, Triticum aestivum
  Clone ID: PAT_TA_48526.pep
IKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIID

SEQ ID NO: 154109 - protein, 94 aa, Triticum aestivum
  Clone ID: PAT_TA_48527.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLIS

SEQ ID NO: 154110 - protein, 109 aa, Triticum aestivum
  Clone ID: PAT_TA_48528.pep
HAFAHAFAKYQHDDCLLSRPDAYQERPLGRAWNRCNSIRRCLTYSCILPAAEPFLDGSEPAGRDVYSLQVYLKGRTVIQTSPYSVRAAHADAGFFMEIYYAEAGVNPLF

SEQ ID NO: 154111 - protein, 64 aa, Triticum aestivum
  Clone ID: PAT_TA_48529.pep
RCGRRSGIRTLIPPSRCICVDEDDNVVYYLPNRWHTTCQLSLLCFQLYVNADTVAEHGGYRLIR

SEQ ID NO: 154112 - protein, 91 aa, Triticum aestivum
  Clone ID: PAT_TA_48530.pep
YSSVKPGKWCALSVTVLPHKSMCPQPLANSDHSNFLLLSYNSSFLLSKYACAQLKFNNWAESRSRRVNVIKDNGPALMLRTGLKQCHQTPS

SEQ ID NO: 154113 - protein, 143 aa, Triticum aestivum
  Clone ID: PAT_TA_48531.pep
NTLARCSLVKDLEMLPYGDCTQIGERGVNLSGGQKQRVQLARALYQNADIYLLDDPFSAVDAHTATSLFNEYVMSALSDKTVLLVTHQVDFLPVFDSILLMSDGEVIRSAPYQDLLADCEEFKDLVNAHKDTIGVSDVSNNIT

SEQ ID NO: 154114 - protein, 118 aa, Triticum aestivum
  unsure (1)..(118): unsure at all Xaa locations
  Clone ID: PAT_TA_48532.pep
HASAHASAHASEEERASSAVFTFLHRHRAACCIGTAARGGGGAGQHPSSTPTQRLDHPLQRILARATFEMYRRSTISMCLTEMVSSGTLSPLXTLAIQVLFQLDKXSVYMTEALENQV

SEQ ID NO: 154115 - protein, 97 aa, Triticum aestivum
  Clone ID: PAT_TA_48533.pep
ARDRERDQDPPLRFRSSPPATGETARPLSLRCSATTLRLSNDRDVCCPYAAPSPDLPSASNFLSPPATATATVPRSNSTYFDLRPGAKFTHRLYISY

SEQ ID NO: 154116 - protein, 57 aa, Triticum aestivum
  unsure (1)..(57): unsure at all Xaa locations
  Clone ID: PAT_TA_48534.pep
GTDHQALQNAFSKFGDVIDCKIITDRETGHSRGFGFDTFTXDEAMRQAIEAMNGQHL

SEQ ID NO: 154117 - protein, 82 aa, Triticum aestivum
  unsure (1)..(82): unsure at all Xaa locations
  Clone ID: PAT_TA_48535.pep
MSYREGLMSPQTETKACVGFKAGVKDYKLTYYTPXYETTDTDILASFRVSSQPGVPPEXAGAAAAAEYXTGTWTSVCTDGLT

SEQ ID NO: 154118 - protein, 133 aa, Triticum aestivum
  Clone ID: PAT_TA_48536.pep
GRVGGGAGSKAWCSVASAMGFLGSGQRSGPTSTATASSSAPAMAALLHLAGYGGTVPSSGLWRRHVFAVACFGDPSSASDFCRQRSGVPGFIDLGESKRENSGDQAIMVTRGGSKTKNKARRRLSHYISPKGG

SEQ ID NO: 154119 - protein, 40 aa, Triticum aestivum
  Clone ID: PAT_TA_48537.pep
WHQQSYQQCPQLGPSCGHFRCHISCDIPCVKRSGMSGRIS

SEQ ID NO: 154120 - protein, 118 aa, Triticum aestivum
  Clone ID: PAT_TA_48538.pep
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEMIKAG

SEQ ID NO: 154121 - protein, 119 aa, Triticum aestivum
  Clone ID: PAT_TA_48539.pep
MAASTMALSSPAFAGKAVKLSPAASEVLGSGRVTMRKTVAKPKGPSGSPWYGSDRVKYLGPFSGESPSYLTGEFPGDYGWDTAGLSADPETFARNRELEVIHSRWAMLGALGCVFPELL

SEQ ID NO: 154122 - protein, 56 aa, Triticum aestivum
  Clone ID: PAT_TA_48540.pep
LGLITRVVAGSSFDQVVHTGTHMNIKVIPYPAFYKGLRECLQPFEHYLYSLDKVII

SEQ ID NO: 154123 - protein, 127 aa, Triticum aestivum
  Clone ID: PAT_TA_48541.pep
IYLSLQIAVRRSASAPRFLPFRISLIREDNKPSGRGRGHDAGGQILPRLALPAQLLRPGLRLGVPPQRQQAPRAGRLRRGRHGGGRRPARQREAQQVVFPAAAHAGHHREPRLQPPCLPKQQRRWGA

SEQ ID NO: 154124 - protein, 81 aa, Triticum aestivum
  Clone ID: PAT_TA_48542.pep
LRPFLPPCLLWRKSSTAMAEEAGRRRPAAVVVLGDIGRSPRMQYHSLCLANQGGMEVDIVANGGSDPHLSLRENPSIHIHE

SEQ ID NO: 154125 - protein, 115 aa, Triticum aestivum
  Clone ID: PAT_TA_48543.pep
AEASKSRPHGSTSRLSDNGVSILSPGTRDEAGQPVQGYEGSDKGAAAEPANECSLPISPTKDGNHGAVDSADPAPNDSGNLVQECHAACDVHPDEVPQGNADEVPHGNPVPLTSA

SEQ ID NO: 154126 - protein, 78 aa, Triticum aestivum
  unsure (1)..(78): unsure at all Xaa locations
  Clone ID: PAT_TA_48544.pep
MAASMITSPIVAPTSVLSLSRRGSSFALICSGGKKIXVDKPLGLGGGLTVDIYSYGWKVGKKVVYQFVDKYGANFYGF

SEQ ID NO: 154127 - protein, 77 aa, Triticum aestivum
  Clone ID: PAT_TA_48545.pep
PRVRRSAERSLNYHTDDPTTATIATYIADHTTEPADLTADGQSLAYEYTGAATAHVVASAGSLTERLAEYQRDNGKI

SEQ ID NO: 154128 - protein, 45 aa, Triticum aestivum
  Clone ID: PAT_TA_48546.pep
RVEAHLLGPAEQALAVGRVVGACMKMEIGSMYRPHPMSAANFYRY

SEQ ID NO: 154129 - protein, 138 aa, Triticum aestivum
  Clone ID: PAT_TA_48547.pep
LGGQMCLLLLSRLRLPLDVVSCALLLPNAAAALAVAAISPASVPIALHQAALLAIAVLTAFWFTLLPEWTTWALLVAMAVYDLGAVLIPGGPLRVLLELAIERNEEIPALVYGARAGGSQARPELAALEGEGAATPPG

SEQ ID NO: 154130 - protein, 143 aa, Triticum aestivum
  unsure (1)..(143): unsure at all Xaa locations
  Clone ID: PAT_TA_48548.pep
LNTVSNVAASASGKLSVPSGAITAIFYNSIYKGSLPAPSKANALEHLLVYSPSGHVIQHELLPSSGSESSDNSPTVGPGSHLQLQDDELHVTAEPVQWXWDVCRRTNWPERDQDIANVVFHNQLNRMMTPDTSDCEDSDHSDF

SEQ ID NO: 154131 - protein, 104 aa, Triticum aestivum
  Clone ID: PAT_TA_48549.pep
MEEPPPSAAALRQVVLKAKANTRSPCSVQDSGVGCVLVGGRSGPSPRLGVCGIACLLCNCNGSASRVRKAKARQSKERKGWPCRGAWRRTWWTWCGRCSPGWVS

SEQ ID NO: 154132 - protein, 110 aa, Triticum aestivum
  Clone ID: PAT_TA_48550.pep
MAYQYHHQDHALGMDPAAAAGNPGGGFAPGLGAGGWEREKAAIEAHPLYERLLEAHVACLRVATPVDQLLRIDPQVAGRALKHVLSYIKLYRMYFKEESDWISWLKKAQT

SEQ ID NO: 154133 - protein, 148 aa, Triticum aestivum
  Clone ID: PAT_TA_48551.pep
WSSFYDAVSQDFKSESLNCFSVIKAVWDVLDNRGSTEAGLLEVSKTFRACKTVRFPSSLSNWLWTAFTYTAMVDYPTPANFMMNLPAYPVKEMCKIIDSFPAGADVVEKAFAAASLYYNYTGDQKCFEMEGGDDPHGLSGWGWQACTE

SEQ ID NO: 154134 - protein, 55 aa, Triticum aestivum
  unsure (1)..(55): unsure at all Xaa locations
  Clone ID: PAT_TA_48552.pep
AGDPNIHFVEAGALKPPEVTFDLAMQQQHKADLAVEGXQPLADDDDDLIEYEERI

SEQ ID NO: 154135 - protein, 98 aa, Triticum aestivum
  Clone ID: PAT_TA_48553.pep
RSLPFSLRNYAMRNLSRCKDEAQRAACQTMIQQITSKAISNGTLLTKNWDTEPLIPLPENLLTMTETSANNSSSLPTSSTPKRRLKSRWEPVPEEKVL

SEQ ID NO: 154136 - protein, 136 aa, Triticum aestivum
  Clone ID: PAT_TA_48554.pep
MASPSSEKGGELPPSEHIAGELPRDALYDILLRLPAKDVCRLRAVSPSWRSLTLDPIFVKAHAARHPGPLLATTFADGESRGVSIGDLLSGDVIKRIRTSGPDLRVPRTRLDRVCLVGRRHPLGGPGTPVDPATGA

SEQ ID NO: 154137 - protein, 111 aa, Triticum aestivum
  Clone ID: PAT_TA_48555.pep
LKHSKRIHVYYLRMVINYSRRIEAQTYKNMMMRNFVVTRQRLLDGCLLCEAKRTDMERHITTKQFPCYSISASRWKSMANKIKNACSSYKCARTNFRFTPWMYSPLLLHNF

SEQ ID NO: 154138 - protein, 146 aa, Triticum aestivum
  Clone ID: PAT_TA_48556.pep
PRVRPRVRGRVGAFFSSDFAPESSFFFIPVLVRPSLHAPSSTSAQALMAAAIDMYKYNTSTHQIGSAASASDQELMKALEPFITIASSSSSHYPYHYYSSPSMTQDSYMATPSSSSYASSFAASPLPNHRPASPSFSQLPPLYSLQ

SEQ ID NO: 154139 - protein, 45 aa, Triticum aestivum
  Clone ID: PAT_TA_48557.pep
RTRGRTRVQRGKCILSAPTCLAKPTAAAVDGEAVPAAQAVVTRPA

SEQ ID NO: 154140 - protein, 91 aa, Triticum aestivum
  Clone ID: PAT_TA_48558.pep
MDVAAERQAAPAGVHGVSSSRLIAGFILGALTGLFVLAGALSGAVTVALAGGAFDSGVLRGARSGAITCAVLFIVVLQASRAFCCSDRLGA

SEQ ID NO: 154141 - protein, 141 aa, Triticum aestivum
  unsure (1)..(141): unsure at all Xaa locations
  Clone ID: PAT_TA_48559.pep
MAAAFSSTVGAPASTPTNFLGKKLKKQVTSAVNYHGKSSKANRFTVMAAENLDVKRNTDKWKGLAYDISDDQQDITRGKGIVDSLFQAPTGDGTHEAVLSFYEDVSQGLKKYDFDNTMGGFYIAPAFMDXLVVHLFKKLMT

SEQ ID NO: 154142 - protein, 83 aa, Triticum aestivum
  Clone ID: PAT_TA_48560.pep
LYCRAASPTSPVLDWADVQIRVWGGSASSIDSPPPRSGGGTYAKRRESSTKVARRITTASSTHHEWEIRKLLPPFHFGSSILK

SEQ ID NO: 154143 - protein, 111 aa, Triticum aestivum
  Clone ID: PAT_TA_48561.pep
MGSCMECSSDESSELSDTDIDDYADKAYTDLKSGKLVARFGADRFRCPFCPGKKKQDYRYNELLQHAIGVGASNRAAKVKANHQALASHLKTDHADAAGSLPPRQAEALIN

SEQ ID NO: 154144 - protein, 87 aa, Triticum aestivum
  Clone ID: PAT_TA_48562.pep
MDPPRKRRSGLPPRHQRTPSRRTPPDLPPQPLPHTNPSPPSPGRRLRSASSSHAASSRSRSAPPAGARLAVQHSPPPSGSPVRGPRV

SEQ ID NO: 154145 - protein, 86 aa, Triticum aestivum
  Clone ID: PAT_TA_48563.pep
EGWGGDHESLSMSWGGHPCRAGRRIRGAGGAGVLVIHDGRVCLDRQIDGGSGGCAARIVRSTTANSAKAAVAYPQERGGADWDLAR

SEQ ID NO: 154146 - protein, 81 aa, Triticum aestivum
  Clone ID: PAT_TA_48564.pep
SIAHRYRKLTTLALMRERAKSDGHHAAVLRHDHRRGPRRIPLLMSYTRTARVELYKTYAVSEEKTRVLLRATNLSTTMAAL

SEQ ID NO: 154147 - protein, 160 aa, Triticum aestivum
  Clone ID: PAT_TA_48565.pep
MIQSRMSSASTPTAVAVARPAGRYAVYVAAVPLRAPQGPAQALMSSAYSLGLWDLQHFMVLLRPDPARTPTRAQEQEQEPSLVFDFQPRHPEDALAAFSVLSRSKIPGVVRRRRLRRIPDRRSWFVGLSDGDGDAADAAERFSERWPTDPVVGNHDCRDY

SEQ ID NO: 154148 - protein, 100 aa, Triticum aestivum
  Clone ID: PAT_TA_48566.pep
KAGGILQRSGSSSSSSSSEDDGMGGRKKKGIKDKIKEKLPGGHGDQQQTAGTYGQQGHTGTAGTGGTYGQPGHTGMAGTDSTGEKKGIMDKIKEKLPGQH

SEQ ID NO: 154149 - protein, 63 aa, Triticum aestivum
  Clone ID: PAT_TA_48567.pep
LRFSDIVPMACPDSQWISYVAHASYLFEEGSVTNMCTCIVGYAFGFKALRAVLLEDLPIPPTF

SEQ ID NO: 154150 - protein, 93 aa, Triticum aestivum
  Clone ID: PAT_TA_48568.pep
LPRLGLEEEGADGKLHVHRGRGREIPENVGGGGCGTENTMRMLCSDLAEAWGAHARFVGLAAALSQAVVELHVTTAAALLGRSIAGIRGTAWP

SEQ ID NO: 154151 - protein, 74 aa, Triticum aestivum
  unsure (1)..(74): unsure at all Xaa locations
  Clone ID: PAT_TA_48569.pep
YGFDAVDPWSSSHGSSRPEVTSLLSFFIEKFGRSISPRLDPVLQVYHLFRSSFSIRANIDLCXTRPSKSXNKSG

SEQ ID NO: 154152 - protein, 49 aa, Triticum aestivum
  unsure (1)..(49): unsure at all Xaa locations
  Clone ID: PAT_TA_48570.pep
MCGGSGDLVQVVQALCTMLVXSLEVPIHSGLRVARMFNPYSPSLTSLHP

SEQ ID NO: 154153 - protein, 132 aa, Triticum aestivum
  unsure (1)..(132): unsure at all Xaa locations
  Clone ID: PAT_TA_48571.pep
MPPMAVDKQRLLPLFVLALVTPACLASGGEEPARFQIPRDGSVVELDEGNFEAAVAAXXFLFVDFHAPWCGHCKRLSPQLDEAAPVLAGLSTPIVVAKVNAEKYKKLRSKYGVDGFPTLMLFDHGVPTEYTG

SEQ ID NO: 154154 - protein, 106 aa, Triticum aestivum
  unsure (1)..(106): unsure at all Xaa locations
  Clone ID: PAT_TA_48572.pep
MGNASARAVENGHAAAPMEQVAVGPVGGSSAEAAAPPDAVMRELPPAVPYVFXPQVPVAPLQIPNEFSPVFNHSWMNGSDESTNNNPPEIEIPTLITWSQGGNEVF

SEQ ID NO: 154155 - protein, 104 aa, Triticum aestivum
  unsure (1)..(104): unsure at all Xaa locations
  Clone ID: PAT_TA_48573.pep
PPSCRAYSRAGTPSAAPASPPSRRPPRRPRPRPSAARSAPSASPSPGPSAPPPSPRTSPSSHSSPPSPTLPRPAPPXXSPLLDPSLSRSTPPTRACSPACDTPS

SEQ ID NO: 154156 - protein, 92 aa, Triticum aestivum
  unsure (1)..(92): unsure at all Xaa locations
  Clone ID: PAT_TA_48574.pep
LTKFAAELTTCSIVRMEAPNHSSPDSDGEENGYADRFGAPVSSXGLSERLTLIRTLQRPLPXPSNLPERPAARVALFKVILDVTHCLTNDRT

SEQ ID NO: 154157 - protein, 160 aa, Triticum aestivum
  Clone ID: PAT_TA_48575.pep
LWGSCVIDGKCDLSEDSTTIDSQDTKAFSLFGSGVSTDLQTSYAARIMAISVLPFIVVQIPQILKLKSGHRLTLLLGLIVAVLLLLTYCLYQIFQPWIQRRKLEYSKLKHVMSGLLKHAQMHTFGHLIDDDGTPNVSVIEKLFHKIDLDNDGRIGRGELQ

SEQ ID NO: 154158 - protein, 45 aa, Triticum aestivum
  unsure (1)..(45): unsure at all Xaa locations
  Clone ID: PAT_TA_48576.pep
MXQPNKRRLSLFKGIIIAKHKSGVHTTIRVRRIIASVRSCESNLT

SEQ ID NO: 154159 - protein, 131 aa, Triticum aestivum
  Clone ID: PAT_TA_48577.pep
LCALPALAGTTVPDPRIRTPATTSSHGSSTHRRRCSTLPHLSDMYSSVYLHFPCSRWTRRLLVLAARMWTEKEEIQPWSWTLCSCCSWPGHRRRGRRVRSLALELALAHLVRCGSPWPAVVRCGCDPVSSC

SEQ ID NO: 154160 - protein, 94 aa, Triticum aestivum
  unsure (1)..(94): unsure at all Xaa locations
  Clone ID: PAT_TA_48578.pep
TASWWEMGTKAYSXHXQKEKKTADLTSAALTSEXXXPHPPPPPRSADELLRPRCWYCCWCSAAGDGEDGRSGRRDSSSSPASRSAPMVIGGDPV

SEQ ID NO: 154161 - protein, 66 aa, Triticum aestivum
  Clone ID: PAT_TA_48579.pep
PRVRCRLKKIIESFGEKVQPTLCQRTCDACKHPNQVSSRLEDLRRVPNCRFNTVQQVFVSFPQFCL

SEQ ID NO: 154162 - protein, 143 aa, Triticum aestivum
  Clone ID: PAT_TA_48580.pep
PTRPRTRGIFATLVLRFGSRSSDTARHETRAPCTCLPAQLTGEEYLKHTITTHKLRPSSCSRHPPPLEPSPHQRGRGQKRIRTCLAFQLVIQVAVRLLARLPDDTDRPLTASADRLAAMARAFGVGAAVLVVVSAFFAPALVT

SEQ ID NO: 154163 - protein, 91 aa, Triticum aestivum
  Clone ID: PAT_TA_48581.pep
GGRNEASPAGCPFVPARSTSRCTPASRSPALLPSPLVSIPHQNLDARRTSRLRPDAAPFLSRPPTLAALPASGCAPAPCCFHAGAGHGDQS

SEQ ID NO: 154164 - protein, 94 aa, Triticum aestivum
  Clone ID: PAT_TA_48582.pep
ARRPVGNPKSRRSPPPLPSPSLAAARGRGWAKPSRRRRRRGLIVLLLGRCWRGPAPRVGAWSCAGRHGGAAGRGRSYLLMLLLDRRTGVGACSA

SEQ ID NO: 154165 - protein, 113 aa, Triticum aestivum
  unsure (1)..(113): unsure at all Xaa locations
  Clone ID: PAT_TA_48583.pep
PSRTILSSKSINRYSILHEISQHSLDGKSVALHQXKRQGTRGHSTQRQSSLPAPVTSQATGIRLSLSATARSGLAGGRSKNSCSNARSPPRSEWLGRSARTKSLGNPRTCAPF

SEQ ID NO: 154166 - protein, 161 aa, Triticum aestivum
  unsure (1)..(161): unsure at all Xaa locations
  Clone ID: PAT_TA_48584.pep
AETNGLNGMVTGFHRGMLRLAMEPSVLGQAIMEGGPDRKIKLDHIPGLDELYIEGYLQAMLDVMYKQEYLRVRVIDDLVFLKNLPPNSALINEIVENVKGFLVSKALLKGDASTVRSWRRLRNXPEWKIAPTVLTLCEHLFVSFAVRLLHQEATKAVAEVT

SEQ ID NO: 154167 - protein, 140 aa, Triticum aestivum
  unsure (1)..(140): unsure at all Xaa locations
  Clone ID: PAT_TA_48585.pep
CSGELSGCLGIGERKAPNKYYPPDFYPAKIPRQKQPNNQQIQTYLGIQIFRFXFSCTRXSTEITFKTDPQNSDYTVESGASRNSEPWRKDIEVVDKEKRKRKVEEMGDAMRLLENRANDSKQDMDVIAALEEMRSMKSRH

SEQ ID NO: 154168 - protein, 121 aa, Triticum aestivum
  unsure (1)..(121): unsure at all Xaa locations
  Clone ID: PAT_TA_48586.pep
MAKLLAVLALVAAAAPFLGVAGQEGEGGSELLPFXXDPAPEGCDVGQGEWVYDEAAAPAYEEAXCPXIPAELTCQAHGRPDKAYQHWRWQPRGCSLPSFNATVMLEMLRGMRMLFVGDALN

SEQ ID NO: 154169 - protein, 116 aa, Triticum aestivum
  unsure (1)..(116): unsure at all Xaa locations
  Clone ID: PAT_TA_48587.pep
MEKPRAMLALAAALALLLSCSGVVVRGQDTERIXGSAGDVLEDDPVGRLKVXDVYELPTKYNKKMASTPAGLYGRLNRTSTRAFLAYVAAGAVCAAVLACFVVFSADPAAAPNGAP

SEQ ID NO: 154170 - protein, 54 aa, Triticum aestivum
  unsure (1)..(54): unsure at all Xaa locations
  Clone ID: PAT_TA_48588.pep
SERSSEHTLAMIPSMTTVLISNVVSNVTSNVGLKMDVLXEEVLHTSHRPSKRRR

SEQ ID NO: 154171 - protein, 136 aa, Triticum aestivum
  unsure (1)..(136): unsure at all Xaa locations
  Clone ID: PAT_TA_48589.pep
LQIRLIRXLCAKLSRDQADGDVKKTMDYFAELKQSDPEFTYTVXVDNESRVRTLIWTTGKSKLQYHYFGDVVTFDTTYRTNLYNMSFGLFVGVNNHCQSVIYXGVLMRDEKVESFNWVFRVCQVDGREETNYHSNW

SEQ ID NO: 154172 - protein, 88 aa, Triticum aestivum
  Clone ID: PAT_TA_48590.pep
SWLERQHTCPTCRAPIVPPDNGRTVSAQQHGAQPGVQLAAGIGAPGSEGATSENMNRRQAKLEAAASAASIYGRSFAYPPTNTLNSKL

SEQ ID NO: 154173 - protein, 131 aa, Triticum aestivum
  Clone ID: PAT_TA_48591.pep
PSPIQAQSWPIALKGSDIVAVAKTGSGKTLGYLLPGFILVKNLRHNSRDGPTVLVLSPTRELATQIQDEAIKFGRSSRISSTCLYGGAPKGPQLRDLERGADIVVATPGRLNDILEMGKVSLRQVAYLVLD

SEQ ID NO: 154174 - protein, 129 aa, Triticum aestivum
  Clone ID: PAT_TA_48592.pep
PSRARSRPRAPPAGPATGGAGRSRPPVAPGAHAGPPPARPAAAPPRAPPRPWPSAVPPGWPSASPCAAYRPRPGAGPAAPGRPAGRPGERRARTPSSTCTRRRIPPWVALGRSLRRVHGRMDGLVLVLL

SEQ ID NO: 154175 - protein, 135 aa, Triticum aestivum
  Clone ID: PAT_TA_48593.pep
ALALTDSPARAELSSPSGTAAPMHDESLAAGSDESACTDLLSSVKRSLQPSVPVSLTTVATTGSGLSRFRFSAPVRSSSTAPLSVGSAPHLVSRCLAPCGWSSAWYLLSKVAGGRREKEAMDSPRVRARVGERVG

SEQ ID NO: 154176 - protein, 143 aa, Triticum aestivum
  Clone ID: PAT_TA_48594.pep
LDSALQVFERLQGGRDVASWNSVISGCMQNGMFLKALNLFRGMQRAGLSMNSYTTVGVLQICTELAQLNLGRELHAAILKCGSQVNIQRNALLVMYTKCGHVYSAHRVFREINEKDYISWNSMLSCYVQNGLYAEAIKFIGEM

SEQ ID NO: 154177 - protein, 94 aa, Triticum aestivum
  Clone ID: PAT_TA_48595.pep
MAAATAMAMLAALAILAPTARGLDRAEFPPGFLFGAATSSYQIEGAYLEDGKGLSNWDVFTHTQSREINDGRNGDVADDHYHRYMGDVEIMHDL

SEQ ID NO: 154178 - protein, 101 aa, Triticum aestivum
  Clone ID: PAT_TA_48596.pep
MASVNVFGHPMLTNVVRVLLFLEEVDAEYELVPMDFVDREHKMPLHVQVNTVAKMPGFQDGDLVLSESRAIVKYILRTYGGTACLDLLGKNSGIQELAMAD

SEQ ID NO: 154179 - protein, 81 aa, Triticum aestivum
  unsure (1)..(81): unsure at all Xaa locations
  Clone ID: PAT_TA_48597.pep
MATDTILDTIKPRLSPLLEDLPVTNGGATNGRKVDLSGMRRRVSLTLSLSLQPXSSSSSAAFRHARSMAPIKALAAADAVQ

SEQ ID NO: 154180 - protein, 88 aa, Triticum aestivum
  unsure (1)..(88): unsure at all Xaa locations
  Clone ID: PAT_TA_48598.pep
EADNCDCRPGFQVCXSIRGGTRSGVVTPLISKITADVPDRTMLTVSALMSPKVADAGVAPYNAALXVHQVVENAADFMRPDTHAMYDM

SEQ ID NO: 154181 - protein, 87 aa, Triticum aestivum
  unsure (1)..(87): unsure at all Xaa locations
  Clone ID: PAT_TA_48599.pep
STPEAGSTSRDGSCFAAGQGHXRARRGAPEVSRHSRDGSHLVPSQDHGPRQRGVTEVSGASQRRRLPSYRLSTPPLRAAKRAGDRWR

SEQ ID NO: 154182 - protein, 60 aa, Triticum aestivum
  Clone ID: PAT_TA_48600.pep
LAVRYMVRYPIILGENYGLFHHYSVLCRRSDKDGPFPALVGRLNEYRLMFFLTSATSGRH

SEQ ID NO: 154183 - protein, 109 aa, Triticum aestivum
  unsure (1)..(109): unsure at all Xaa locations
  Clone ID: PAT_TA_48601.pep
GRKPATVPACRLQRLSLVRNHRSSKQRLLARVAFSWAPQHRSARKAGETRRRAERWTRRPCSVGYGGGXGENGGRAGGDGGHGAAAVAATCGGGGGCGVGAGRTERLPA

SEQ ID NO: 154184 - protein, 65 aa, Triticum aestivum
  Clone ID: PAT_TA_48602.pep
EDGGDEADGVNAEPADGDGHADAPDALGLLPRHARSLPHGAHRRRVGTHRPSLGRPACRLQPKWS

SEQ ID NO: 154185 - protein, 136 aa, Triticum aestivum
  Clone ID: PAT_TA_48603.pep
KKRAVLFGGVVDMEVEADVLMSMFMNELYGFQLDNHRWYPLELRKDKPAKNKTKDIKRKETANDSESNIGNEDDDTMDCSEEATDVQSEVGGVSNHLTKSLTLNKVGSSQNSDVMSDSTEHEATPEAIKPIGRINA

SEQ ID NO: 154186 - protein, 118 aa, Triticum aestivum
  unsure (1)..(118): unsure at all Xaa locations
  Clone ID: PAT_TA_48604.pep
RGAIVLEHGFITAHSDWNHLEPDLVDDYQVVLFDTMGAGXSNPDYFDFYRYATLEGYALDLLAILEDLGIASCIYFIHSVSVEIGVLSYICRPDLFYKLVLLSAYAMXLNDVDYYGGY

SEQ ID NO: 154187 - protein, 91 aa, Triticum aestivum
  Clone ID: PAT_TA_48605.pep
MAAAFSSTVGAPASTPTNFLGKKLKKQVTSAVNYHGKSSKANKFTGMAAENIDEKRNTDKWKGLAYDICDDQHDLNRGKGIVGSSYKRPRA

SEQ ID NO: 154188 - protein, 131 aa, Triticum aestivum
  Clone ID: PAT_TA_48606.pep
MDDWSEFDPISCRIQAKIPFFFSSFLPSESKWPPQLCREGPWRSTADVSPCCPRSAAPTCWCSSSADPGRGTNPSATTAATTPAPGATTSAPHGNGIELGERNPMHPRWAHVRKARIPLCKNVTRGLPDTH

SEQ ID NO: 154189 - protein, 93 aa, Triticum aestivum
  unsure (1)..(93): unsure at all Xaa locations
  Clone ID: PAT_TA_48607.pep
VIHAIDIVKVNIQFGDGSDTSVTKNILDNEGAGCFYNGLSAGLLMHASYTSAXLVSFRVLTNYRCLSNEGIPLPLFHIAAIDLTAGSIGACFF

SEQ ID NO: 154190 - protein, 149 aa, Triticum aestivum
  unsure (1)..(149): unsure at all Xaa locations
  Clone ID: PAT_TA_48608.pep
EERAIIHGRRRHAHRRVGLPLRLRRVCFSPLSYLNNVFFFFFCFVCLLFFFILLLPFYVFYIVLXIFFSFLIILLFVFFLIFFFYNVLCCFIFVYXITLFDMLISFFLFLFLIFFILFFFFFSFFIYCFSFILFIFTVFLYFFSFFYDV

SEQ ID NO: 154191 - protein, 90 aa, Triticum aestivum
  Clone ID: PAT_TA_48609.pep
MGTRGLAVLLLAAVLLQALLPASEAEGLVRIALKKHAIDRNSRVAKSLSDREEGPLLGGGAANTLRSEEEGDIVSLKNYMNAQHLGEITI

SEQ ID NO: 154192 - protein, 55 aa, Triticum aestivum
  Clone ID: PAT_TA_48610.pep
PRLRHPIHFIIHERLRDTRRSARCSTSCKKDRATVAGHMLSDMLLAGLLAGLVVN

SEQ ID NO: 154193 - protein, 137 aa, Triticum aestivum
  Clone ID: PAT_TA_48611.pep
PTRTSHSMLKGGRRDRVGSGAEPTSAGALLMGMATCTFYAHPLSLKPQVGPRPHRLHLARLPRLRYHRRLFAGGREAPGEAPAKPQEVAARGAVRERGGETRPPITEVLDVLRAIQDDCLGHKDRGSKGQEGLGRAL

SEQ ID NO: 154194 - protein, 55 aa, Triticum aestivum
  Clone ID: PAT_TA_48612.pep
GTFRIDRLDPLVRPRVRTSAIGKPAKQASLTQSRPILYLKCLPQHTSQDAQPALR

SEQ ID NO: 154195 - protein, 52 aa, Triticum aestivum
  unsure (1)..(52): unsure at all Xaa locations
  Clone ID: PAT_TA_48613.pep
GSLTVDIDANILMVGTKGVYQFGDKNGXPNVDGYNPIYTPDEWYESGDQYAI

SEQ ID NO: 154196 - protein, 44 aa, Triticum aestivum
  Clone ID: PAT_TA_48614.pep
RCLCQTGQELWMEHSAAIRGWVPTLASLPARRSTQMEGKQGPPL

SEQ ID NO: 154197 - protein, 48 aa, Triticum aestivum
  Clone ID: PAT_TA_48615.pep
ASSNNHLVEWSGVVQLLMASDYDRLGALKAFDDTKAGVIGLVDAVVTT

SEQ ID NO: 154198 - protein, 84 aa, Triticum aestivum
  Clone ID: PAT_TA_48616.pep
SITKMCFIMFQNSSSCVMINSSSCHVLPFQSITKMCFISQNNGTAIASRAAAAVASRAIAAALFPAHGRRAHLPRLTAVVADAW

SEQ ID NO: 154199 - protein, 134 aa, Triticum aestivum
  unsure (1)..(134): unsure at all Xaa locations
  Clone ID: PAT_TA_48617.pep
MALVSLSLSPPCAPAASSSSSHLLTPPSIAGGSGSIRRGGPRGNAGLALTLPAGRRGREWRAPVSSFYSFLPSFLTGSKKKEEEDAKKAATLKEELLAAIAPXDRGAEATPEDKDRVYQIAQQLEEVNPAKEPL

SEQ ID NO: 154200 - protein, 82 aa, Triticum aestivum
  Clone ID: PAT_TA_48618.pep
AGDEFGIGIVGGSSLAHIGSPAMQSTMVRRRLDTAIESSASLPSTQESVQGEEAEFVEDSAPIATPIISRKDTATQTSPDLS

SEQ ID NO: 154201 - protein, 52 aa, Triticum aestivum
  Clone ID: PAT_TA_48619.pep
MSKWPAATTKRLKRALWPPEEDEMLRNDVAHHGYGCWSSATKTAGLERCRKT

SEQ ID NO: 154202 - protein, 79 aa, Triticum aestivum
  Clone ID: PAT_TA_48620.pep
HAYAKSIKPRPRSTRSSSRSNGGPRRPLRLPDPPHPLHLRLLLLTVMLMPFPTSRRLRVAPPAWLKQSDAQTLQVWVEH

SEQ ID NO: 154203 - protein, 133 aa, Triticum aestivum
  Clone ID: PAT_TA_48621.pep
TISISRGALADCCSFLLLEFSVVCAAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYRVESTGVLMTRSR

SEQ ID NO: 154204 - protein, 153 aa, Triticum aestivum
  Clone ID: PAT_TA_48622.pep
NLLLSAQVAVRGDGPELHHVPQAHPRLLHAAPPPQFLQKELPIRIARRALELESLPFGLSAKPAILKVRDWYLDSFRDIRYFPEVRNRDDELAFTQMIKMIKVRHNNVVPTMALGVQQLKNEQFSSRKLPPGFDEIHGFLDRFYMSRIVFACS

SEQ ID NO: 154205 - protein, 62 aa, Triticum aestivum
  Clone ID: PAT_TA_48623.pep
TSRTGAASSYRPKCRSTMSKCSSKPWSLAMGIDGVVVSRACSQSTVNIHTCLHLLAQNRTTP

SEQ ID NO: 154206 - protein, 114 aa, Triticum aestivum
  Clone ID: PAT_TA_48624.pep
RLDVSGNRFVGPFPAALLSLPSMEYLSIAGNRFTGRLSGNASCGENLRFVDLSSNLLTGSLPGCLLAAPGKTVLFSANCLSTGDDSQSQHPSPFCRNQALAVGIVPEQGRKKSG

SEQ ID NO: 154207 - protein, 122 aa, Triticum aestivum
  Clone ID: PAT_TA_48625.pep
PRVREIQVPALVLRVGVDEALGSGDSVAAAVARGVGIVVLEAGEEGGGRAYEAARALKAAVGDRAYLLIAERVDVASAVGASGVVLADDGIPAIVARSMMMKSNSDSIYLPLVARTIRSSDS

SEQ ID NO: 154208 - protein, 98 aa, Triticum aestivum
  Clone ID: PAT_TA_48626.pep
MDWAAVAYTAAALLCAAAATVITLGHIYRHLLHYAEPIFQRFIVRIIFMVPVYAVMSFISLILPDNAIYFTSIREIYDAWVIYNFFSLCLAWVGGPGA

SEQ ID NO: 154209 - protein, 39 aa, Triticum aestivum
  Clone ID: PAT_TA_48627.pep
MDAAISAAHEAPPAVVLVSAGASHSVALLAGNVLCTWGK

SEQ ID NO: 154210 - protein, 53 aa, Triticum aestivum
  Clone ID: PAT_TA_48628.pep
MELQNVHVIKICKGILMCAFCSAFSFTFLHFSVSIFYVLPWLCCTFALIYSRV

SEQ ID NO: 154211 - protein, 142 aa, Triticum aestivum
  unsure (1)..(142): unsure at all Xaa locations
  Clone ID: PAT_TA_48629.pep
HYLHHNSQVTSMAMKQAKYQFLFSSSATVLHLRRSELKLLSSPSFLSSTSSAPISSLHQGHLRLVPSASPTEQVLLPDDSHSTTPNGTSSNGNRNKGRRRSRRKXQETAKEEKERVPSAEECPSEWLRPMKVVTPLGGRSWA

SEQ ID NO: 154212 - protein, 90 aa, Triticum aestivum
  Clone ID: PAT_TA_48630.pep
WLVYSSMLSTITLDHSSALLLVNIVSQLIDRRLPTCIHPPWSSQQATGPTISPSNRGRRSCRIEQCLTAALGIERSSTTHQFHHQCKSAC

SEQ ID NO: 154213 - protein, 64 aa, Triticum aestivum
  Clone ID: PAT_TA_48631.pep
MRRKTILVALKKYLFGGRISYMVSIVPSYKQYLLKKQHVSLNRSEKVKDAKIARKILPCITQNN

SEQ ID NO: 154214 - protein, 157 aa, Triticum aestivum
  Clone ID: PAT_TA_48632.pep
SWFNAVLGRHYNDWENEFYRLHNMESTMDFDLGWSDMVSCYGLHGNRHIASLFASRKLWASPYLRGHFLAGLAALPGISKIKDFIQRLLSAQTCLSCFIEQVAVVVDYKDQAGEQQIVQQNSENTILKTAAPVEGHAAAVFTPYAFYKLQDELVEAA

SEQ ID NO: 154215 - protein, 151 aa, Triticum aestivum
  unsure (1)..(151): unsure at all Xaa locations
  Clone ID: PAT_TA_48633.pep
DIELVSNMCHNKGALLCIDSTFASPINQKALTLGADIVVHSATKYIAGHNDVIGGCISGRDELVSKVRIYHHVVGGVLNPNASYLILRGMKTLHLRVQCQNSTALRMAQFLEEHPKIARVYYPGLPSHPEHHIAKSQMTGFGXVCSFEVDG

SEQ ID NO: 154216 - protein, 128 aa, Triticum aestivum
  unsure (1)..(128): unsure at all Xaa locations
  Clone ID: PAT_TA_48634.pep
SNPPPFLQISAHSLPNSARFPIHMELQLTPLRSLPLHYRTTTKATATATANTVSACSVESQALKPRPQLPRQAPFHSRRRSSPVHXPXLCAAIERLVTEGRHREACDALRDARAGAPFVALPASTYDA

SEQ ID NO: 154217 - protein, 100 aa, Triticum aestivum
  Clone ID: PAT_TA_48635.pep
MAAANGGKGFEVPELDIKFTKLFINGQFVDAASGKTFETRDPRTGEVIARIAEGDKADIDLAVKAAREAFDNGPWPRMPRCARARIMHKFADLVDQHVEE

SEQ ID NO: 154218 - protein, 71 aa, Triticum aestivum
  Clone ID: PAT_TA_48636.pep
RPLCLLRSLHLLRPREGPTSSERGYCVSTANGGKGFVPGLTGLSALSLSYPEVRVDTASCKTFETRDPPHP

SEQ ID NO: 154219 - protein, 111 aa, Triticum aestivum
  Clone ID: PAT_TA_48637.pep
TTGKCRCGVPASGSNREASTISSGHLPDDVLGAVVSLLPTKDGARTQVLSRRWRPLWRLSAAPLNLSIDRRFCAGGTRLDVTSVSRILSDHPGLARRFSVRQAFTTGPDRP

SEQ ID NO: 154220 - protein, 64 aa, Triticum aestivum
  unsure (1)..(64): unsure at all Xaa locations
  Clone ID: PAT_TA_48638.pep
MDSSSSSTASSFQAQAQPDFDYLFKLLLIGDSGVGKSILLLRFTWDSFXDLSSTIGVYFIVKIG

SEQ ID NO: 154221 - protein, 41 aa, Triticum aestivum
  Clone ID: PAT_TA_48639.pep
ELETDRYMSSAAVCPRSYRGIKSKVMSICAVETLPASVLRN

SEQ ID NO: 154222 - protein, 141 aa, Triticum aestivum
  unsure (1)..(141): unsure at all Xaa locations
  Clone ID: PAT_TA_48640.pep
DTSVAAVGMDAPHDELMELIRETPQGQQPMELKVISLVGFGGIGKTLLTKHVYNTTESEYKARAWVCAAEKGSRDVLKEILWQLGMHSTISSSSGSACNPCRLSNNMLCASLRECLGTKRFXIVFDDFRRDFWVDLKEVFP

SEQ ID NO: 154223 - protein, 149 aa, Triticum aestivum
  Clone ID: PAT_TA_48641.pep
CDAGGKAAATVAFAARAPLFAAPRLLHSSSLPAGDRAAVITGSPARDSETTAAYAMSPTSVLDASAAFGSTVDAGGGKRRPWCDGCAGPHGLADVLHCAHEAQRRKSVLRSTVRAQAPALVRSCSLDRGVEFGVKNKSSWLPLRAARAG

SEQ ID NO: 154224 - protein, 69 aa, Triticum aestivum
  unsure (1)..(69): unsure at all Xaa locations
  Clone ID: PAT_TA_48642.pep
MASRALAASVHPAXRLGGSASALGRPAVRVSARPPRRRRSMVVRAGGPPSTNVLILAFVLPLSLFVGTL

SEQ ID NO: 154225 - protein, 58 aa, Triticum aestivum
  Clone ID: PAT_TA_48643.pep
QSSPLFFPHIHPLFQPPFHSLLRTFYYMSYNIVIFYCILLKPIMVTPSSYFNYTSTPN

SEQ ID NO: 154226 - protein, 106 aa, Triticum aestivum
  Clone ID: PAT_TA_48644.pep
LHLLHHLPIHTSTSRCHLPTTCLCKCPAVTRSPVYQSSCLQTTGRKHNLNGGRPAQCATSHDGAFISHANGAPKDSPSPDSLLRDARILYCAFSAMGHNKEALSRI

SEQ ID NO: 154227 - protein, 152 aa, Triticum aestivum
  Clone ID: PAT_TA_48645.pep
AHPPSGIESALAARAERRQRAQLEGTKSTAQRAIKGLRFISGNTKASNNAWIEVQRNFDRLALDGRLSRADFPQCIGMMESKEFAMELFDTLCRRREMQSDHINREELREILSQITDNSFDSRLQIFFDMVDKDADGHITDAEVKEIIMLSA

SEQ ID NO: 154228 - protein, 112 aa, Triticum aestivum
  Clone ID: PAT_TA_48646.pep
EDLMEHLDGADELQTTSILGRSGYLSQQEIKSDILKATQSLRKAKGESNGNEENADASGADKYPLVSVPDDMLTPEQLKEKKKQILLKTTTEGMLRAKHRRAEEASLKEKHE

SEQ ID NO: 154229 - protein, 58 aa, Triticum aestivum
  Clone ID: PAT_TA_48647.pep
MHTLKTGGAFKSYSRLRGYCVMIDPHVMTTWILLYQIHKCQQKIGILDLPLETRASIL

SEQ ID NO: 154230 - protein, 43 aa, Triticum aestivum
  unsure (1)..(43): unsure at all Xaa locations
  Clone ID: PAT_TA_48648.pep
KSDRHEDFRLLESXLALKLAMMEQLDCPVTLNDGTAVLEDELR

SEQ ID NO: 154231 - protein, 81 aa, Triticum aestivum
  Clone ID: PAT_TA_48649.pep
RPSMRFHWPSPTAYHGRHLPLSRATGNSPAVSQVTPHQEPRSLNRHHQGSYTYTEHPGEGKGPLDAYAKNADRCAGRTIKS

SEQ ID NO: 154232 - protein, 62 aa, Triticum aestivum
  Clone ID: PAT_TA_48650.pep
RSSFMRKANPEMIAVYLKISHGDFRGLIVVIYGRNLFMNRLQSREEIEESFTRVAEAESYLT

SEQ ID NO: 154233 - protein, 58 aa, Triticum aestivum
  Clone ID: PAT_TA_48651.pep
QKWVLVLPVFPLYVGAVIVACLYGFSLRHTPLSLEFECAFVRTSARTRVSNCGISYVA

SEQ ID NO: 154234 - protein, 30 aa, Triticum aestivum
  Clone ID: PAT_TA_48652.pep
PHVRAYALLRQVACLREYLAANSGLTPDYP

SEQ ID NO: 154235 - protein, 53 aa, Triticum aestivum
  Clone ID: PAT_TA_48653.pep
GNNAGGYANTGGYGNNTGYGNTGVGYGNNTGGCQHSVGYGNNTGGCQHGGDTE

SEQ ID NO: 154236 - protein, 50 aa, Triticum aestivum
  Clone ID: PAT_TA_48654.pep
RLLLDLIEISINTLNFIVFTSQNTSKLNVNSSPGSSEYNHLLVPQNMQIP

SEQ ID NO: 154237 - protein, 78 aa, Triticum aestivum
  Clone ID: PAT_TA_48655.pep
SVCPQSYRLCSFMLKASGCTFSVSSHRSTVYVPCIPHSVSLAPFSVYPVCLSLTALIASSVTVYSHPQILSGSCLRKI

SEQ ID NO: 154238 - protein, 48 aa, Triticum aestivum
  Clone ID: PAT_TA_48656.pep
LSIVPLTSAAVLPLLCSCLYSCSTTARVPSLAPLDPSPFSISRNSSFR

SEQ ID NO: 154239 - protein, 66 aa, Triticum aestivum
  Clone ID: PAT_TA_48657.pep
ILPRSVHTSDDQCAHSHDKSPASLADDARGWLDLRGTPCGTLAITTETYRPSLIVQYQHYENASHF

SEQ ID NO: 154240 - protein, 72 aa, Triticum aestivum
  Clone ID: PAT_TA_48658.pep
MAHAIEAHREGAEVYHRASLGARKAVRLLAATNMPLGLLALADIHEVGYNRASGFVWLRLKKALTHTVNQIG

SEQ ID NO: 154241 - protein, 95 aa, Triticum aestivum
  unsure (1)..(95): unsure at all Xaa locations
  Clone ID: PAT_TA_48659.pep
RPRVRSRVRTRVRLTSIFSTEKDRVNWPIYFKICAXRHGDRXCCLYNKWTVSPTLLLWNMYHRANMITPGVDTQGNPIDTRTIQGDLEDFDEDII

SEQ ID NO: 154242 - protein, 64 aa, Triticum aestivum
  Clone ID: PAT_TA_48660.pep
GGVKPKVPPLMVQSRGKGGASQSQHEVRRQVRKTSPGPFPIVGWVTFSFLADASIARRLPPSRC

SEQ ID NO: 154243 - protein, 44 aa, Triticum aestivum
  Clone ID: PAT_TA_48661.pep
LCHDSNNIAQAVSTLSSLSSSPLTKLSFTISSVIDYQCTSACVH

SEQ ID NO: 154244 - protein, 55 aa, Triticum aestivum
  Clone ID: PAT_TA_48662.pep
MRHTHSDAPKTKSEARRASYHHENPNLKQRQHHRDYASDARGMRIDIGAPIQWHA

SEQ ID NO: 154245 - protein, 99 aa, Triticum aestivum
  Clone ID: PAT_TA_48663.pep
FPFQSIFTFCQLEIGPHTVMRAPASCQCRNRQALVMTVVLAQARGHQEVGPGATWGRISCCPRRRGRYDRCLWPSIPSRRCSCFRPGAPLGLSFLSCTS

SEQ ID NO: 154246 - protein, 59 aa, Triticum aestivum
  unsure (1)..(59): unsure at all Xaa locations
  Clone ID: PAT_TA_48664.pep
SAILYEWVETIMGIEATSGLRVXAINIXGRLLSNRDXSVRHVALNILMRAITLYSQAVQ

SEQ ID NO: 154247 - protein, 74 aa, Triticum aestivum
  unsure (1)..(74): unsure at all Xaa locations
  Clone ID: PAT_TA_48665.pep
MSRLFYRRHLGAVAGVXRSRDVLACRWMHTLAYATVYCKEICGSSPSGVQNGVQGKWLKTANWNWIVDPLNGQK

SEQ ID NO: 154248 - protein, 74 aa, Triticum aestivum
  unsure (1)..(74): unsure at all Xaa locations
  Clone ID: PAT_TA_48666.pep
YMGRRIVWSSLPHRHLTFILMRSXIGLKINELLLLMPFKANGALFVEAXMEDHRSLVASANHADLVVSTMCRRY

SEQ ID NO: 154249 - protein, 63 aa, Triticum aestivum
  Clone ID: PAT_TA_48667.pep
WQVQPCTRSPAWRGRPCEWLPIWPSWEGSVISEEPLLPLFLDSSRSGATLVFDAPCICSPRVL

SEQ ID NO: 154250 - protein, 63 aa, Triticum aestivum
  Clone ID: PAT_TA_48668.pep
MRLNLHPINRVGVFKLRYNHIPSRCYINRANYYTAMVYEEGQVVYRNGKTKGCSRRYEKDNNV

SEQ ID NO: 154251 - protein, 70 aa, Triticum aestivum
  Clone ID: PAT_TA_48669.pep
MARHRLLAVLMAGLVVGSGFRQAAGASPGLCQKLRQPEPKPMPHWVTMPEPKPQTMPKCVPMPKCETQTL

SEQ ID NO: 154252 - protein, 59 aa, Triticum aestivum
  Clone ID: PAT_TA_48670.pep
SNCLYGRPLLVRYVDTLKRNPRNSSRGAEAEGRQRHRWDLASAMAYVTLKAGNGPVVCP

SEQ ID NO: 154253 - protein, 96 aa, Triticum aestivum
  Clone ID: PAT_TA_48671.pep
SDEDALSSYEYARRGLKTYDLHNTTGGLYIAPATMGTLAAHISKNFMTLANIKIPVISCIWRGKGQGKSLQRELVLPKMGNSPIMIECRKAIKRQR

SEQ ID NO: 154254 - protein, 77 aa, Triticum aestivum
  unsure (1)..(77): unsure at all Xaa locations
  Clone ID: PAT_TA_48672.pep
TAVLKNVLSNAKDMDVESQILAXSLGLRTLKRALKGGLHIDNAVEAESLADKLLNQVLVAKLTAPQTYVVGKVYLWE

SEQ ID NO: 154255 - protein, 41 aa, Triticum aestivum
  Clone ID: PAT_TA_48673.pep
MGGLEEIRNEAVNLENIRIEDVFEQMKCTRQGLTSYEGAQR

SEQ ID NO: 154256 - protein, 47 aa, Triticum aestivum
  Clone ID: PAT_TA_48674.pep
MPSSCSCRSRRDRSFFCAETQKRCRTLAMRPAPTAQATIHRTRGSRA

SEQ ID NO: 154257 - protein, 32 aa, Triticum aestivum
  Clone ID: PAT_TA_48675.pep
MLSFNIHDWFLEAIARTNRSGLLRQADNYNLC

SEQ ID NO: 154258 - protein, 95 aa, Triticum aestivum
  unsure (1)..(95): unsure at all Xaa locations
  Clone ID: PAT_TA_48676.pep
AVQASSKNRFTGPVWALCEANQGNTDKTRKTLKIVHAVNCRDPVILQPLALVEYKXAYPKVARGLYKKAYHIDPRHQPXWIARRWMDCKEGNERT

SEQ ID NO: 154259 - protein, 71 aa, Triticum aestivum
  Clone ID: PAT_TA_48677.pep
IFNPTDGTYHGHCQHDRWALSRGLARMRVLLVLMIHVNAPAADADIPCKQSGPTCATACDAYGPYCGTTVC

SEQ ID NO: 154260 - protein, 91 aa, Triticum aestivum
  Clone ID: PAT_TA_48678.pep
AHLHTRIHTHIRTYMLTHIHTRVALSANASTLIPLKGIHTIEAIHRAKENYHMLHLLNHRILAILIDDEPSDDQGSIMHDCRADQQRALRG

SEQ ID NO: 154261 - protein, 47 aa, Triticum aestivum
  Clone ID: PAT_TA_48679.pep
GLVLLTRALLPVRCTFIISDASVYVSGRFMDGIGVLHEPRVCWQRGD

SEQ ID NO: 154262 - protein, 68 aa, Triticum aestivum
  Clone ID: PAT_TA_48680.pep
CFTTHAPLTFMMWKLKYRFPCYFVNVENSMPTLFASRKIVSPYFPADRISCSIGLSFSMTCRQNMPLF

SEQ ID NO: 154263 - protein, 43 aa, Triticum aestivum
  Clone ID: PAT_TA_48681.pep
TMQHLYEMGAVIYAGSFSKEVRWIFRSVRLTVGLCWRFASREI

SEQ ID NO: 154264 - protein, 77 aa, Triticum aestivum
  Clone ID: PAT_TA_48682.pep
SYAPCSGSTVAFWQRLSRGSAWFLPPGLSVRLPCPPPSSPPHSTALKGAVEAASNGYRRSNAPRRQRRRHQQRGVPA

SEQ ID NO: 154265 - protein, 77 aa, Triticum aestivum
  Clone ID: PAT_TA_48683.pep
RPNQATAIQTCYRVFLGGETNRTALLSLPISDYHRRPEDNSLLTMTGTLVLPAALETTFAGRTSRRYCKSYGTSRTP

SEQ ID NO: 154266 - protein, 84 aa, Triticum aestivum
  Clone ID: PAT_TA_48684.pep
FFAPLAQTSRAVCHSRALHNPSRTNAQDRSRGVDGRHPTSLSGSTPPAPADRLRRCDATAVAQSYRASAALGRATPVLEYSSNF

SEQ ID NO: 154267 - protein, 82 aa, Triticum aestivum
  unsure (1)..(82): unsure at all Xaa locations
  Clone ID: PAT_TA_48685.pep
HPHVRPRVRERRHLATATGTNNKKKAPAASRXXHVAGNTDETQHVDSGSVSGDTIHPPLPTPVGDNEHTPESAAITNAEHAA

SEQ ID NO: 154268 - protein, 63 aa, Triticum aestivum
  Clone ID: PAT_TA_48686.pep
RPLVVVAAKLDHDNHSRPEQARALFTAAADSGLHPLQPLDICVHSSPVPPCLAQPVSRKVAGF

SEQ ID NO: 154269 - protein, 68 aa, Triticum aestivum
  Clone ID: PAT_TA_48687.pep
GVTLRFLMGRGVSSPLYYQTTEGGVHGLGGNHAVADITISMETSAGQDDTRFTACRDRISIAIRGIIS

SEQ ID NO: 154270 - protein, 56 aa, Triticum aestivum
  Clone ID: PAT_TA_48688.pep
GHINYYVTSTEEEDLAVFTGDTLLIAGCARFFEGTGEQMYQSLCVTLGSMLRKYGY

SEQ ID NO: 154271 - protein, 58 aa, Triticum aestivum
  Clone ID: PAT_TA_48689.pep
PGCASQLGEQLHWTIGAPALAHSVADRGATHPHDGSGTSYRPLQRRLHLVRSFLCECS

SEQ ID NO: 154272 - protein, 97 aa, Triticum aestivum
  Clone ID: PAT_TA_48690.pep
MATAGASSAQGGLPEEIEIWEILVRLAAKGVLRCRAVSRAWRSTTFSRDFLAAHKASKADLANLFQEYHGGQRLLSYDNRSAATTQVRKVAETDDYS

SEQ ID NO: 154273 - protein, 78 aa, Triticum aestivum
  Clone ID: PAT_TA_48691.pep
MYAKTLTGKNINLWEDSYRTVHNVKGRKQDKDGLPPGQQPLIGGGKQVEDGRNLCWYDIRRGSNLHCVLHLEGGLHIF

SEQ ID NO: 154274 - protein, 53 aa, Triticum aestivum
  Clone ID: PAT_TA_48692.pep
HCQHSGSPAGSIRLAVTTCLFGLQKLYSRAAGRTKVPVMVTSKLSQASDQSPK

SEQ ID NO: 154275 - protein, 57 aa, Triticum aestivum
  Clone ID: PAT_TA_48693.pep
CAFMHTESIMLDILYEPTARIDGCPYSCSSAINAMHGWLLCTLALVQEKESRAHAYA

SEQ ID NO: 154276 - protein, 51 aa, Triticum aestivum
  Clone ID: PAT_TA_48694.pep
CFRAQTYLCLVKHSSTTMFCTGMNSKCAFVHTRSILLDLLYEPSGRIDGRP

SEQ ID NO: 154277 - protein, 95 aa, Triticum aestivum
  Clone ID: PAT_TA_48695.pep
AHAYSYAFGRMQVDQLLRLGVEATIYCGQVLKKHPPSLLCPTSRSVRVLCNSKTQGCTHLLPAVRRLVLYVRCDCLELYAARGTHVSKSIKIPDM

SEQ ID NO: 154278 - protein, 68 aa, Triticum aestivum
  Clone ID: PAT_TA_48696.pep
PPIKIDLNEQLADHPHKAKRLVCTTPNESQLCLYHLYKQENAVPVKTVQAGHLLDMDDQANWHAFKDG

SEQ ID NO: 154279 - protein, 40 aa, Triticum aestivum
  Clone ID: PAT_TA_48697.pep
YDYIGKLYTCRTTPESHARSTHTITRASLVITLYLNWHFV

SEQ ID NO: 154280 - protein, 85 aa, Triticum aestivum
  unsure (1)..(85): unsure at all Xaa locations
  Clone ID: PAT_TA_48698.pep
MVGPTLEKRSCKCAAVSREEAQRMHVSFKKRVAARSAEREKXARSNVSESAADARASCYRSSRASEGALLVQQAPPMATAGGEIR

SEQ ID NO: 154281 - protein, 88 aa, Triticum aestivum
  unsure (1)..(88): unsure at all Xaa locations
  Clone ID: PAT_TA_48699.pep
MKRLLDPNGTKMSVGTLREGDHKGXKDFVRGGFNGEVGDPENITEHTRIRPSIHNIKYLLEKVDKDILVSHLERXKGDTRKFSLKPKG

SEQ ID NO: 154282 - protein, 76 aa, Triticum aestivum
  Clone ID: PAT_TA_48700.pep
ASALDSAQDEGGIKNKLRAEKTWLPHSSVNNSDYICCHYHATCSSEPGRGTDDAEQQRKASEIAGDVDTKLLMTSS

SEQ ID NO: 154283 - protein, 104 aa, Triticum aestivum
  unsure (1)..(104): unsure at all Xaa locations
  Clone ID: PAT_TA_48701.pep
MAAVLGRAVTTASGGFGRDHKEISLGGRGPNAVMVPSETRAAPQEGSLERSAWSXETPVSWIVSGLMAFKTFYSLMKLASTXVIMRTAXKSNILSSAMTNKVLE

SEQ ID NO: 154284 - protein, 85 aa, Triticum aestivum
  Clone ID: PAT_TA_48702.pep
MALTVMASGATVVAHLQGLKSTGGLSVSRRSSSAAGLCSGSNCRGIRSMQAWPIERIKTFETLCYMPPICTEALLKQVDYLIRSK

SEQ ID NO: 154285 - protein, 40 aa, Triticum aestivum
  Clone ID: PAT_TA_48703.pep
PALTERFAGKRTSGFYNQRRQEKRRYLYPGWREEENRVRV

SEQ ID NO: 154286 - protein, 79 aa, Triticum aestivum
  Clone ID: PAT_TA_48704.pep
RIKREDALANAGIRTLGRTTHGRHVVLAHAWLQATVRHGSRAGVVQHTGAIRRRVCRDQVGYPHQAVQRLLQLTSTGGG

SEQ ID NO: 154287 - protein, 67 aa, Triticum aestivum
  Clone ID: PAT_TA_48705.pep
CQKVTIRLWAAGQKVYNMYTTPRIGTRDRAYKIEDSDSKKSTEANDDEDLGGLHKPLDLGAIMMQLR

SEQ ID NO: 154288 - protein, 48 aa, Triticum aestivum
  Clone ID: PAT_TA_48706.pep
GLESKSPLAVVRNVDRLAFVSAHASTQSHVSKHILRGKVWWLGSTLIF

SEQ ID NO: 154289 - protein, 70 aa, Triticum aestivum
  Clone ID: PAT_TA_48707.pep
AVAVLGRNAIRARMLLFSGAGSASEVPIIVLGVPHTGQEMGARSSHLVLIDVCVRLQACPHRPMRERYVQ

SEQ ID NO: 154290 - protein, 83 aa, Triticum aestivum
  unsure (1)..(83): unsure at all Xaa locations
  Clone ID: PAT_TA_48708.pep
MTAGKALRAYTQQWRHSTPALNPAVMRSXSGPESKNDQSWVWTQIKGXGSLXTDAESAIGSLIYATVLSYPTIERSLSFYLGN

SEQ ID NO: 154291 - protein, 82 aa, Triticum aestivum
  unsure (1)..(82): unsure at all Xaa locations
  Clone ID: PAT_TA_48709.pep
MAFCAPHSTTFVRCPCTTISNSGFTQSRVILCTTRGTMRSNTRHGARTLQVXCAAEQAIEIALGADSGCGKCSLMRRLTSVF

SEQ ID NO: 154292 - protein, 87 aa, Triticum aestivum
  unsure (1)..(87): unsure at all Xaa locations
  Clone ID: PAT_TA_48710.pep
RNEAFDFNVALTDQQKYVKREQDKETCSQEANDSXIDMHPSVNTRLTEGETIMINVNNMPXTXSGMLYFAGLCGGATGQPKASMLLA

SEQ ID NO: 154293 - protein, 57 aa, Triticum aestivum
  Clone ID: PAT_TA_48711.pep
ARLTMLTLVGATWRDKPHSAFLDRKQDFTRVPTCHVISSSSSYHTRRPAIDLKLKCA

SEQ ID NO: 154294 - protein, 93 aa, Triticum aestivum
  Clone ID: PAT_TA_48712.pep
MARLNSKAVVAAAVLAAVVLMMAGRDASAALSCGQVDSKLAPCVAYVTARASCISKECCSGVHGLNGMGRIRSYRTKSSTCLKSLATSIKSIN

SEQ ID NO: 154295 - protein, 88 aa, Triticum aestivum
  Clone ID: PAT_TA_48713.pep
PQHCVDARPLSAPARRGCQLRSAPLQGAQSPTAGPTKGPEETIPLSPRGVGGIIIHPAKRPIRHPPSGQGTDYSSSTRLSKVGVRKQR

SEQ ID NO: 154296 - protein, 27 aa, Triticum aestivum
  Clone ID: PAT_TA_48714.pep
RYIVRKYSPVREIYTKRTGSTELKVGI

SEQ ID NO: 154297 - protein, 99 aa, Triticum aestivum
  Clone ID: PAT_TA_48715.pep
PMRNAELAFDISNVERPDDVTYILLIVRLRADVDPPDTSVGSQPALDLHQPRRRHSTESRHGSAEAKQRLLPTELCILDQSLASARVYCSGTSGSPAYP

SEQ ID NO: 154298 - protein, 50 aa, Triticum aestivum
  Clone ID: PAT_TA_48716.pep
KKMSDEPGAPHNDNVAGVGSYDHLLSCPHRQPSPSPILDRDEDGCAPLVR

SEQ ID NO: 154299 - protein, 37 aa, Triticum aestivum
  Clone ID: PAT_TA_48717.pep
MVSTEYNSCRNHRIKSICIGSFAAIEPHAYIFLHAHS

SEQ ID NO: 154300 - protein, 42 aa, Triticum aestivum
  unsure (1)..(42): unsure at all Xaa locations
  Clone ID: PAT_TA_48718.pep
MAPTKGKGPAIGIDLSTTYXCVGMRQDNRVQIIAYDQGNRST

SEQ ID NO: 154301 - protein, 81 aa, Triticum aestivum
  unsure (1)..(81): unsure at all Xaa locations
  Clone ID: PAT_TA_48719.pep
GSAWSTPGEGGEILTRNTRLRRKYLYPKSLAGNERHYYKKKLCVPKALAGGXPIATELTYEELTLQRESDLYDQNPAVPRC

SEQ ID NO: 154302 - protein, 80 aa, Triticum aestivum
  Clone ID: PAT_TA_48720.pep
RDPYSVRPRAGPRRFADQVPVPRLDDCLPPSRARTLKTDRASTTEMCLATRTSREITDRRNWDIAEEHKHWYMEDAEIIH

SEQ ID NO: 154303 - protein, 70 aa, Triticum aestivum
  Clone ID: PAT_TA_48721.pep
IGLCSGQCGSVNQSSQFSMCHYKISHRLKPYFLWWQHISIVSFIIWRVVRQLKFHTTSCSTTTYISYRQR

SEQ ID NO: 154304 - protein, 81 aa, Triticum aestivum
  Clone ID: PAT_TA_48722.pep
FSFFFFFFYFFFFFFCFFRAGNGFFYKFWLTNRGVFWGNFDSFQELTLFALGHSLNFHCLLYAPDFWGVFFGGCLINNFHH

SEQ ID NO: 154305 - protein, 103 aa, Triticum aestivum
  Clone ID: PAT_TA_48723.pep
SLHERAPYFCCRAHLVPDWRQGRRHRAPFLQRSRTSARDELFHGERELRPKISAMTASEGCWNRPVPGLRPVLQLAASGARPGKGLCWVCPFFEHMQHQCYHR

SEQ ID NO: 154306 - protein, 71 aa, Triticum aestivum
  Clone ID: PAT_TA_48724.pep
NSKARGNKFGPLKRPPPFFCFYFYLFFLSYFFVTISFFYSFFCFFVVFFFFLFFFFFMFFFFVANTLFIPS

SEQ ID NO: 154307 - protein, 157 aa, Triticum aestivum
  unsure (1)..(157): unsure at all Xaa locations
  Clone ID: PAT_TA_48725.pep
MAPAVMASSATTVAPLQGLKSTAGLPVGRRSSGXLSSVSNGGRIRCMHVWPIEGIKKFETLSYLPPLFTEALLKQVDYLIRSKWVPCLEFSKVGFVLREHNSSPGYYDGRYWTMWKLXMFGCTDATQVLNEVEEVKKEYPDAYVRVIGFDNLRQVQC

SEQ ID NO: 154308 - protein, 147 aa, Triticum aestivum
  Clone ID: PAT_TA_48726.pep
PTRPYSPPYDLAVKSFRSKRSEGSIVLLLKMQIFVKTLTGKTITLEVESSDTIYNVKAKIQDKEGIPPDQQRLIFAGKQLEDGRTLADYNIQKESTLHLVLRLRGGMQIFVKTLTGKTITLEVESSDTIDNVKAKIQDMDGMPPDQQ

SEQ ID NO: 154309 - protein, 153 aa, Triticum aestivum
  Clone ID: PAT_TA_48727.pep
AAVPLLFSSTNSSSSPPQHDSHTAQIRRRLLPPPLLAAAACTACSSPPRPPPSQLATPGTRSRTRGSSTFPAASQLLEPSRAAAARTTADPPPRARTQPPFSPDPAGPHRRLSGEGLRRHRRRLARYHVESGDGYLHTAASFLSCFLRECVSQ

SEQ ID NO: 154310 - protein, 60 aa, Triticum aestivum
  Clone ID: PAT_TA_48728.pep
IYDCKFYAVNVYIIFSSEIIKTAVFVRDKKLPCQGNLPSTATCCSSFKETNKNQSSLGTS

SEQ ID NO: 154311 - protein, 42 aa, Triticum aestivum
  Clone ID: PAT_TA_48729.pep
MVSGSGVCAKRVVVDARHHMLGLLALIVAKELLNGQLVVVVC

SEQ ID NO: 154312 - protein, 162 aa, Triticum aestivum
  Clone ID: PAT_TA_48730.pep
PRVRSNPSEDTTGRSILRLSPSAIRGAGREMLPWAATASSSAAAALLHASPRPASHRAALPHYRPSPSLPPPLSIAFRAPARVLPRGGDAFWEEPDDGSGSDYEDNGKQATVQRSSPFPSPLPLSRLVARRQQEREEQELRREIELLLTPEEEAILDQNETA

SEQ ID NO: 154313 - protein, 100 aa, Triticum aestivum
  Clone ID: PAT_TA_48731.pep
QTHLKEVVLKYFNGYEQHIDFARFVVLNAKVVNKIEFHVREDHYSNEFVARQHTLLEAENRASPDAQFEFRKTCGSIDYHVSKHIHDLSVADPFADRVDA

SEQ ID NO: 154314 - protein, 132 aa, Triticum aestivum
  Clone ID: PAT_TA_48732.pep
MARSNPGLLLGLLLLRLNWCLGVDGGGAEEGGGVFPVVVSTWPFREAVRAAWDVVKTGGAGGSAVDAVVAGCSACEELRCDGTVGPGGSPDEDGETTLDALIMNGVKATLTTQATVYADVYDTTFMVDVIEH

SEQ ID NO: 154315 - protein, 134 aa, Triticum aestivum
  Clone ID: PAT_TA_48733.pep
MAAAAATTRRRSTAFLFGNEGTGLSQKECEVCDFFVYIPQYGGGTASLNVTVAASIVLHHFGVWAGFPERSREGSKFVVAEKPKGQSRGLYCSDSIEDVIEERKARRENACDIFEENGSSHPQESNGLGMMFTD

SEQ ID NO: 154316 - protein, 104 aa, Triticum aestivum
  unsure (1)..(104): unsure at all Xaa locations
  Clone ID: PAT_TA_48734.pep
VIQKNEPTALQKTKLMTRITYTLDQMEGPLEVXAYCTLMLQEKDXIYYSVDTVQLPGWSSVPFLXTVKQVVHTLTPDSLRHPLLVPLFNXPSLLDPKGRGVSTG

SEQ ID NO: 154317 - protein, 144 aa, Triticum aestivum
  Clone ID: PAT_TA_48735.pep
PHTETNAGVGLKAGVKDYKWTYYTPQHETKDTDILAAFRVSPHPGVPSEEARAAVAAESCTGTWTTVCTDGLTSLDRYRGRRYHMLPDAAEDSQWICYVAYPLDLFEEGSGTNMFTHIVCHGFGLKALRTLRLEDLRIPTTYSK

SEQ ID NO: 154318 - protein, 102 aa, Triticum aestivum
  Clone ID: PAT_TA_48736.pep
HPLDSAFLGAWPCLRRFVHMNVTQRLRQSLRLRHALWRALSGPVSSARSRVRPPVAHRSAYGAAFQGVVQGPLARDGCSHRCIRRQLRPILSTNLSVKARVA

SEQ ID NO: 154319 - protein, 109 aa, Triticum aestivum
  Clone ID: PAT_TA_48737.pep
MSPQTETKAGVGFKAGVKDYKLTYYTQEYETKDTDILAAFRVSPQPAVPTEEAGAAVAAVSYTGTWTTVWTDGLTSLDRHKGRCYHIVPVAEEDSQRICYVTYPLDLSE

SEQ ID NO: 154320 - protein, 107 aa, Triticum aestivum
  unsure (1)..(107): unsure at all Xaa locations
  Clone ID: PAT_TA_48738.pep
MSPQTESKAGAEFKAVVNDHKATDYTPXYETNDTDVXAAFRVSANAGVTTXEAGAAVAAESYTATWTTGTTDGLTNLDRYNRLCYHIEPVAVEDSQWICYVPYPLDI

SEQ ID NO: 154321 - protein, 163 aa, Triticum aestivum
  Clone ID: PAT_TA_48739.pep
FVLALDKPLENRLFNIFSGVSIPMPTTTMVDGDARYIRVEAAALSGSPVLDPPYNYTIGAIARIEGSELSGIALWDPSKEHWTGIDWDLIRSQSLDIHDVVYSNGSFYFLNSYENMERIGAHPNREGVPPRLEIYVEKDWEIYDEEHPENLTVQRYLVNLGGM

SEQ ID NO: 154322 - protein, 73 aa, Triticum aestivum
  unsure (1)..(73): unsure at all Xaa locations
  Clone ID: PAT_TA_48740.pep
MGKKHWGRLSPSDSLIPTGGCHFTEKTDXPLGSINAASWGSDWSVPIAYTYIARMGSKGXLTAAAKNAILNAN

SEQ ID NO: 154323 - protein, 139 aa, Triticum aestivum
  unsure (1)..(139): unsure at all Xaa locations
  Clone ID: PAT_TA_48741.pep
DGGVLREITMHDLLETIHICETDHLAIDVSXDSLPPLYVGYKDPGDRLHVGDARQLLRNSPEGKYDAINCDSSDPIGPAQELVEKPFFQTIAWASKPGRVLHNIAESMMVYTHVIQDMLSICREGFMAGLPYAWASVTT

SEQ ID NO: 154324 - protein, 53 aa, Triticum aestivum
  Clone ID: PAT_TA_48742.pep
WPTEYRCPSVYGQAYSVFPIGRQNPKVPPQLADVWVQKIHQHRQERYLTNDPS

SEQ ID NO: 154325 - protein, 104 aa, Triticum aestivum
  unsure (1)..(104): unsure at all Xaa locations
  Clone ID: PAT_TA_48743.pep
MANPRVFXIDMTVGGAPAGRIVMELHKDAVPRTVVNFRALCTDEKGVRTSGKPLHYKGSSFHRVIPDYMCQGGDYTRGNCTCGESMYGEKLADEKVVHKHTKPG

SEQ ID NO: 154326 - protein, 134 aa, Triticum aestivum
  Clone ID: PAT_TA_48744.pep
AVPLRFRARRRSQRWPLVTLGLLVTAVPIRPRDRRRRHQRLPVVDLGLLVTAVTLANRAGRRGQRWPLVDLRLLVAAVPLRLRDRRRGQRWPLVDLGLLDRLTNRFVRSHGPRSSGASGLVLPPRLLVGGGRLR

SEQ ID NO: 154327 - protein, 144 aa, Triticum aestivum
  Clone ID: PAT_TA_48745.pep
MLQVMETYPLAKLISLAFLLVLLPPGMALVPSLEEQAGALLAWKDTLESSPAQLQSWGRENNNSWPCSWHGIQCSKHRARHQEVITGISIQGLQLRGKLESLNFTALRTLTSIQLSNNQIRGSFPPALASSLPNLRHLMLQENE

SEQ ID NO: 154328 - protein, 98 aa, Triticum aestivum
  Clone ID: PAT_TA_48746.pep
GSGSYRAGWRERRRWQMATELAQIPHPTRRPRIRRHGCASTLCTALPSRHRPSLHGSGLDPWLAVGPSSRQRGPSMGSYQHHLLHAVAGGSAAWAKRD

SEQ ID NO: 154329 - protein, 54 aa, Triticum aestivum
  Clone ID: PAT_TA_48747.pep
TRWRRSTTVAWGREGDGRVGLEAGAGAVAEAGGGTRWRWGWCVGAGRRGATWLL

SEQ ID NO: 154330 - protein, 149 aa, Triticum aestivum
  unsure (1)..(149): unsure at all Xaa locations
  Clone ID: PAT_TA_48748.pep
HASAHASDDHSLVLFSSFCIIEGPETIQDFIQMQSQEIQDNIKSRRSKIFLLMEEVRRLRVQQRIRAAESRCSSSEENEMPEMPSTIPFLPXYVVTKDNEAIYLTSFSFISGIIIFGGLIAPILELKLGLGGTSYEXFIRNMYLPLQLR

SEQ ID NO: 154331 - protein, 74 aa, Triticum aestivum
  Clone ID: PAT_TA_48749.pep
AARSRSPCRRHCLRSRRGARPGGRTRPARRRAPWRRPAHPGRRPPAPPAPSPWPAARPAPSPASSRPPCPAHQV

SEQ ID NO: 154332 - protein, 100 aa, Triticum aestivum
  unsure (1)..(100): unsure at all Xaa locations
  Clone ID: PAT_TA_48750.pep
GIDYPTAAWLSRDCGYTAYAVSSVDDLYNPFASMYFGAAYLGWLSRYEGRERSHEFIVQAYLXGPDKVNLQETGPYWKKFLEAXIHYEDPKKDQTSCCIL

SEQ ID NO: 154333 - protein, 50 aa, Triticum aestivum
  Clone ID: PAT_TA_48751.pep
AICKWWYKSGRTKDLLWRPSQLNGLIKLLTENEEEIFDALHDYMDTHWTE

SEQ ID NO: 154334 - protein, 79 aa, Triticum aestivum
  Clone ID: PAT_TA_48752.pep
HASDGPLYCKNKYAGVGSAIEYARCALMVEDIGVIGHSRCGGIKALLSLKDGAYDSFHFVEDWVRIDFPANKKVHTECA

SEQ ID NO: 154335 - protein, 75 aa, Triticum aestivum
  unsure (1)..(75): unsure at all Xaa locations
  Clone ID: PAT_TA_48753.pep
RAPFSLRAVAPPAPRVALAPAALSLAVVKQVRXARLRAQATYKVKLVTPEVEVELEAPDDCYILDQADEEGIVLP

SEQ ID NO: 154336 - protein, 134 aa, Triticum aestivum
  unsure (1)..(134): unsure at all Xaa locations
  Clone ID: PAT_TA_48754.pep
FLKVITMEKSYIPTSLAYSSSADLLWTVMGASNMPNQAASQLLTRVRIILRFQKELSASADHDPAILEDSEVPHGEKLLLALQGSLDASKQEEVLAAVLAXLRVSMHKMLVKKNYSEERREQRKRGRNDKKIKK

SEQ ID NO: 154337 - protein, 50 aa, Triticum aestivum
  Clone ID: PAT_TA_48755.pep
ILSFILWGVVSQIIIFNTSFKSTFWFVCIMSPPKSHGSLLFLRSLACPVV

SEQ ID NO: 154338 - protein, 147 aa, Triticum aestivum
  Clone ID: PAT_TA_48756.pep
PSRIGHLGLQLLDGAHDREPGLVVLATKLAVVAVRRTRRRERRRGVAEYIGTIAAVASGSSSASTSAIAFGERVVVLLLLLSSCLALGVALACASAMATALLLYLELLPPTRMRSPNTATASFTDRKGRAVSTSTRSEAMDVLGRVG

SEQ ID NO: 154339 - protein, 113 aa, Triticum aestivum
  Clone ID: PAT_TA_48757.pep
RPHCSWCFSGAQIGVACCATSLARKTSLVHPESSISYWSKLFGIQQRDSCILAGTDIWGHLQSLIGTSFSFDAAIFENIIVMSCCVMVVCVNQNSELTQVDKCECLRYSQGAA

SEQ ID NO: 154340 - protein, 67 aa, Triticum aestivum
  Clone ID: PAT_TA_48758.pep
KQFNFNRVKGLTLLSLKQTTVQAKRTNKQQRLRGLTTHRTGQAGPRLRLRAGPPGIWSGEEGRGHGD

SEQ ID NO: 154341 - protein, 114 aa, Triticum aestivum
  Clone ID: PAT_TA_48759.pep
EYIHECIHAQIRDQIPHRSTERQIESPPVSHANTQANTPAIDSEKNSEETTGGCSGGCCWCRSCFRLTTVLRSSRCSCSCWSSYRSASRAVHVLLHSLLELWWYFSCYMPGWSL

SEQ ID NO: 154342 - protein, 36 aa, Triticum aestivum
  Clone ID: PAT_TA_48760.pep
MTDLNLPCILAPLVCLVFSAMAMTCLFFYVQKNKIV

SEQ ID NO: 154343 - protein, 72 aa, Triticum aestivum
  Clone ID: PAT_TA_48761.pep
TRLAQSLKVPGQYCMVSPMPSALAWSDSYFKNCLSFDTDLEASPPGLSLSYLPSLLSTLVLAARRWVYEDLL

SEQ ID NO: 154344 - protein, 93 aa, Triticum aestivum
  unsure (1)..(93): unsure at all Xaa locations
  Clone ID: PAT_TA_48762.pep
PIGAPTSLPTISRQGSSFAVVCSGGKKIKVDKPFGLAGCSTVDINTNGTKVGKNGVYQFVDKYGANVNGYSQIYTPHXWTESGDRYSSGTTGL

SEQ ID NO: 154345 - protein, 138 aa, Triticum aestivum
  unsure (1)..(138): unsure at all Xaa locations
  Clone ID: PAT_TA_48763.pep
MSPQTETKAGVGFKAGVKDYKLTYYTPEYETKDTDILAAFRVSPQPGVPPEEAGAAVAAESSTGTWTTVWTDGLTSLDRYKGRCYHIXPVAGEDSQWICYVAYPLDLFEEGSVTNMFTSIGGNVFGFKALRALRLEDL

SEQ ID NO: 154346 - protein, 85 aa, Triticum aestivum
  Clone ID: PAT_TA_48764.pep
MATMVALNSFAVVGRSAARSPVAAPRRRTLVVRAQTEPGMDSTKETTSASTSSSPSTSPTPTPIPAAPKPMAKKANPSVWDALAF

SEQ ID NO: 154347 - protein, 121 aa, Triticum aestivum
  Clone ID: PAT_TA_48765.pep
PTRPPTRPLLLLPPIPNQGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVG

SEQ ID NO: 154348 - protein, 58 aa, Triticum aestivum
  Clone ID: PAT_TA_48766.pep
VGQSISPSMCPCNSRKFVRYSSPWLYGRNHSLRANLPCCQYLRIHSFRRSGAVSHLIL

SEQ ID NO: 154349 - protein, 78 aa, Triticum aestivum
  Clone ID: PAT_TA_48767.pep
MMSGNNQQQQSAAEEEQELARKHAAAVATSRQWSSQTESRIVRVSRVFGGKDRHSKVKTVKGLRDRRVALSVQTAIQL

SEQ ID NO: 154350 - protein, 155 aa, Triticum aestivum
  Clone ID: PAT_TA_48768.pep
QGGTRREEGKGREEEITEPSARTGQQAPRSRTGAEMGLTFTKLFSRLFAKKEMRILMVGLDAAGKTTILYKLKLGEIVTTIPTIGFNVETVEYKNISFTVWDVGGQDMIRPLWRHYFQNTQGLIFVVDSNDRERVVEARDELQRMLNEDELRDAV

SEQ ID NO: 154351 - protein, 39 aa, Triticum aestivum
  Clone ID: PAT_TA_48769.pep
VCMENDQSVEGTSLHRILARITQSCLENVLTVEGTGRVG

SEQ ID NO: 154352 - protein, 92 aa, Triticum aestivum
  Clone ID: PAT_TA_48770.pep
PEQTPAASMAKPRLLLCLLVAAAALLLVASAKKSGDVSALQIGVKVRALSLLPLVPSVDTACARSELCVFLLRVSPGGSIHPEGNRLDAVQS

SEQ ID NO: 154353 - protein, 111 aa, Triticum aestivum
  Clone ID: PAT_TA_48771.pep
VLPPLANRRDKSYGLVLLLFSSVFFRFDPEFKCLLILKVSSVSTGIGMNCMQYQVLVPFPLNYLECYPVNLGCNFVRLICDSCGGSAEISSLRIQGAPPWPSTLASIFGTE

SEQ ID NO: 154354 - protein, 134 aa, Triticum aestivum
  unsure (1)..(134): unsure at all Xaa locations
  Clone ID: PAT_TA_48772.pep
PRVRGEQAGISAVIPGWFSEISPMWPGEAHSLKVEKVLFQGKSDYQDVLVFQSSTYGKVLVLDGVIQVTERDECAYQEMITHLPLCSIKDPKKVXGVLREVSRHSSVEQIDICEIDKMVGDCVQQFFPHFAPGF

SEQ ID NO: 154355 - protein, 75 aa, Triticum aestivum
  Clone ID: PAT_TA_48773.pep
MSCNCGSGCSCGSDCKCGKMYPDLTEQGSAAAHVAAVVVLGVAPENKAGQFEVAAGQSGEGCSCGDNCKCNPCNC

SEQ ID NO: 154356 - protein, 147 aa, Triticum aestivum
  Clone ID: PAT_TA_48774.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKT

SEQ ID NO: 154357 - protein, 100 aa, Triticum aestivum
  Clone ID: PAT_TA_48775.pep
WSLMGKQSEAIQEAAHTFATQRMPRPYTHHLQLYIQFFVVLLPFIYNISFLSVDTFHLQYFLVSCIYPKLYDLPIKSRDGNPYIKARLIKGVDNRATITR

SEQ ID NO: 154358 - protein, 95 aa, Triticum aestivum
  unsure (1)..(95): unsure at all Xaa locations
  Clone ID: PAT_TA_48776.pep
PGKCYPTVSDEYLAAVAKAKRKLRGFIGEKNCAPLMLRLAWHXAGTFDVATKTGGPFGTMKCPAELAHGANAGLDIDVRLLEPIKEQFPILFYAD

SEQ ID NO: 154359 - protein, 95 aa, Triticum aestivum
  Clone ID: PAT_TA_48777.pep
KSSSIRRIRRGDSCKSTRGETKREKKVGGGVLDFTGALFLGPNFTETKNRPLRGPLSATGFTRKVLRKVLTEEATAEGTSDRVYKSSSMGTVRPE

SEQ ID NO: 154360 - protein, 89 aa, Triticum aestivum
  unsure (1)..(89): unsure at all Xaa locations
  Clone ID: PAT_TA_48778.pep
EARSDVPASVASSVSTFLSTLLGTRVADNGPMNGRIVSRLKLAPKKDATEKANTHRTMXLPVSLARAHVHESLVGKFGFDYCFHRLPLE

SEQ ID NO: 154361 - protein, 128 aa, Triticum aestivum
  Clone ID: PAT_TA_48779.pep
YNNLSGAIDGTHITNLRNLVVLHLGWNNFSGKIPVSIGQLKKLEELHLAYNNMSGELPSALSNCTNLITIDLKSNHFSGKLTKVNFSNLPNLRILDLWLNNFTGEVPESIYSCSNLIALRLSSNNLHG

SEQ ID NO: 154362 - protein, 48 aa, Triticum aestivum
  Clone ID: PAT_TA_48780.pep
PPFFFFFLVRHKLTRHDWLTYFPVHGLASEEACHVMYKGSSRRLRKEA

SEQ ID NO: 154363 - protein, 85 aa, Triticum aestivum
  unsure (1)..(85): unsure at all Xaa locations
  Clone ID: PAT_TA_48781.pep
MSTAEATREENVYMAKLAEQAERYEEMVEFMEKVAKTADVGELTVEERNLLSVAYKNVIGARRAXWRIISSIEQKEESRGNEAYV

SEQ ID NO: 154364 - protein, 75 aa, Triticum aestivum
  Clone ID: PAT_TA_48782.pep
QQPRACIHRMVNWLQVLRKHLVASLATYAGLKLHTVVAYDANSDIKIWLADNDNAPDRKHMQRKKHHAVVLVHGF

SEQ ID NO: 154365 - protein, 68 aa, Triticum aestivum
  Clone ID: PAT_TA_48783.pep
FATRPYSLYLQQPRSCIHGVANWIHALINHLVARLATYAGLMLNAVAAYDAISVINIWIPDIDYAPDR

SEQ ID NO: 154366 - protein, 122 aa, Triticum aestivum
  Clone ID: PAT_TA_48784.pep
GVPSAIAPLPPSPNTNHSAASSSPESRAEQIQSQGGEWERRGRREMAGVGVGTGAMNSLLGKLTALLGDEYNLLKKVRKEIQFLERELTGMRVLLERLTGMEEKLDIMAKGWRDRVRDLSYD

SEQ ID NO: 154367 - protein, 41 aa, Triticum aestivum
  Clone ID: PAT_TA_48785.pep
CRANGANYSGAFLQETFIFLCLIQFRRQSLVFWARAPAELD

SEQ ID NO: 154368 - protein, 134 aa, Triticum aestivum
  Clone ID: PAT_TA_48786.pep
MAASNGLEGVLLGMGNPLLDISAVVDEAFLAKYDVKLNNAILAEDKHLPMYDELSSKGNVEYIAGGATQNSIRVAQWMLQTPGATSYMGCIGKDKYGEEMKSAAKAAGVTAHYYEDEAAPTGTCAVCVVAVKGI

SEQ ID NO: 154369 - protein, 55 aa, Triticum aestivum
  Clone ID: PAT_TA_48787.pep
KYSIENSVIKPTYMLTSEGATELMYMNLEQEEELRILQEAASIYAQWRHSQYGST

SEQ ID NO: 154370 - protein, 122 aa, Triticum aestivum
  Clone ID: PAT_TA_48788.pep
HASAHACADAWAVGGTNHRHATKDLTDSIAVGNYPEWTFYIQTIYPDHEERFDFDPLDVTKTWPEDVVPLQPVGRMVLNRNIDNFFAENEQLAFCPGIIVPGVYYSDDKLLQTRILSYSDTQ

SEQ ID NO: 154371 - protein, 48 aa, Triticum aestivum
  Clone ID: PAT_TA_48789.pep
PCGPSWRRASWPGRPSRSPSRPWPQRPSPSSPRSSSALDLLNLLGLCD

SEQ ID NO: 154372 - protein, 53 aa, Triticum aestivum
  Clone ID: PAT_TA_48790.pep
MASPSIFGGIAQGPEDPIRQATASYNKDPTLLKVNIWRRPYRTKECKPILLHV

SEQ ID NO: 154373 - protein, 77 aa, Triticum aestivum
  Clone ID: PAT_TA_48791.pep
MGHTSAAASAVPALGLTKANAVELPQVAFTGKDIEFSDWKGDILAVAVTEKDLSKGSDSKFENAVLKKLDAQLSGLL

SEQ ID NO: 154374 - protein, 64 aa, Triticum aestivum
  Clone ID: PAT_TA_48792.pep
MAALSSAGASVPSLGGTAMRMRRRTMAVRASLGKTACCAAVAIAASTMLLGGTAMAQDVLLGTN

SEQ ID NO: 154375 - protein, 49 aa, Triticum aestivum
  Clone ID: PAT_TA_48793.pep
CECHIMSWVRVVRSPHYRVRDCLHRRACWCRVEFARSCPNLRLGPGSPR

SEQ ID NO: 154376 - protein, 52 aa, Triticum aestivum
  unsure (1)..(52): unsure at all Xaa locations
  Clone ID: PAT_TA_48794.pep
GDALSGLRRRMRDSGSVLHSWNSTVIDTCTXFHVIWDRENRVTLLDLGYLNL

SEQ ID NO: 154377 - protein, 120 aa, Triticum aestivum
  unsure (1)..(120): unsure at all Xaa locations
  Clone ID: PAT_TA_48795.pep
STTHACEWPSLWKDRVWGKTHILWIYILGPDDELADDGLAPNEENLSLHRAEEGVSWIARAVRGXCQSALGCALSLMSRHGSMVSHGKALVDPLVTLFGRVPEKMPVAMGSMRSTLVPNF

SEQ ID NO: 154378 - protein, 83 aa, Triticum aestivum
  Clone ID: PAT_TA_48796.pep
RKHLKLASKPDVLQTEGHTFRFAAAKLATNIASSIGDDKVHLHKYHLLSKRSRAPILVASSNEEGNAEVNISDIPGGAAAFEI

SEQ ID NO: 154379 - protein, 98 aa, Triticum aestivum
  unsure (1)..(98): unsure at all Xaa locations
  Clone ID: PAT_TA_48797.pep
MPPLLTSPACISSSAAGCEFTQFGTACFWGLELVFHPVPGVTMTEVSYTHGAFHDPTXKDVCTGATGHNWVARIQYDPAGCKNDDLLDIFWARHDPTT

SEQ ID NO: 154380 - protein, 71 aa, Triticum aestivum
  Clone ID: PAT_TA_48798.pep
MATAAAAGSVDKRNARFFSISAHGHIKPMLQLAKLLKRSHGFRVTFVHTEHNRWRVLRSCGPGALDRVCGF

SEQ ID NO: 154381 - protein, 58 aa, Triticum aestivum
  Clone ID: PAT_TA_48799.pep
VYISVCTVETRRATSGMFCMSSTARCAGCIICRWQTMCCHNRLSLRIVLVFICPMSNR

SEQ ID NO: 154382 - protein, 64 aa, Triticum aestivum
  unsure (1)..(64): unsure at all Xaa locations
  Clone ID: PAT_TA_48800.pep
MSCCGGNCGCGSRCTRGISWGGSKMYPPMDXAVNTTWETLIMGAAPFKGTPCVEATCYNRGCKC

SEQ ID NO: 154383 - protein, 84 aa, Triticum aestivum
  Clone ID: PAT_TA_48801.pep
RPLASGTGSLLRGISRGNRGAGKTASRNQFAYKTISIHWKATMGADFLTYEVQIQDRMLSLQIWETDGPERQKSVGDAFNRRAE

SEQ ID NO: 154384 - protein, 96 aa, Triticum aestivum
  unsure (1)..(96): unsure at all Xaa locations
  Clone ID: PAT_TA_48802.pep
MLPSYIRYIGQPWPSLVMGSRATSVSPLHGLKTTVGLAVRRRFNGSSLCRGSNWGRIRCMQAWPTEDIXKRKTLSYLSTIMTDAIVKHVYYLIRSK

SEQ ID NO: 154385 - protein, 98 aa, Triticum aestivum
  Clone ID: PAT_TA_48803.pep
RPAVPHPYLSILPTRTSTQAANNVREDLAKIGVKIHRCYWKDRRGDIPLPHERPERTDALMKGYAALHLCNYATIYCAGTREKRLEFLCTHHWAGYTL

SEQ ID NO: 154386 - protein, 94 aa, Triticum aestivum
  unsure (1)..(94): unsure at all Xaa locations
  Clone ID: PAT_TA_48804.pep
QAGVRHLERRLPELDRAPDRKGAKLDCTLILGTEIXQPITTTLLDSRLLYGGAYEMHIIPIDQDISITYYYSSPMIADDAMTEKVLEPSKSDDM

SEQ ID NO: 154387 - protein, 65 aa, Triticum aestivum
  Clone ID: PAT_TA_48805.pep
FYQPYLVPHTIGLCFQGLFTLCIYVLTGVSSALVCSRYTKLRAGLATQITLVPGGAFNSAKPCML

SEQ ID NO: 154388 - protein, 60 aa, Triticum aestivum
  Clone ID: PAT_TA_48806.pep
RANAAHVKAYGARAGFAWRHRTAAEAVPAPAHKRLSILTTCRHLTITYTGSCLAFCTPRS

SEQ ID NO: 154389 - protein, 130 aa, Triticum aestivum
  Clone ID: PAT_TA_48807.pep
TGGRLLSRLVQRSSSAPEQKGKDTLGCRPAGLPCDSVACSSLHRVLLFSDAKFLRCSGIRYRNGATLIGMFIDHGGDSDSDDDDDSGDYDYNHGDDGYSITFEPSSGTRYRLRCGLLIHKIRIEVLVWDP

SEQ ID NO: 154390 - protein, 116 aa, Triticum aestivum
  unsure (1)..(116): unsure at all Xaa locations
  Clone ID: PAT_TA_48808.pep
RSRVRCNVTNDGGNMSAEFTLLWEKHEPSTYPTRCRLPXLAITLNELTPGLKEILATSDSRLTPDHRLLEYGECHGASCDKLRMVTRRQMARXTQAHGSEPSWLDRDTENRASHCT

SEQ ID NO: 154391 - protein, 81 aa, Triticum aestivum
  Clone ID: PAT_TA_48809.pep
SAGDNKKSAGSKPPSAGLISGDDAGEGGMTTTLSPSPSRACVITVYDSVAGVRYYSSSSDSSFTVVEGVSGRFGIGGSVAS

SEQ ID NO: 154392 - protein, 111 aa, Triticum aestivum
  unsure (1)..(111): unsure at all Xaa locations
  Clone ID: PAT_TA_48810.pep
MHCTITTLITSDALYSYIVYTTWFSXEHKCMRDLCLITDTNPWCYMHSSXDEAHLLRMLITMARANKMIEVGVFTGYSVMGTALALTEDGXRWSSTPDRSATXVGRPFIEK

SEQ ID NO: 154393 - protein, 70 aa, Triticum aestivum
  unsure (1)..(70): unsure at all Xaa locations
  Clone ID: PAT_TA_48811.pep
MGEANDTKVYEEDLEDYDEEVENAVDRTVTNHSTDXAKRVTCESTADGXRDMIVKPELLREIQDLWTEHA

SEQ ID NO: 154394 - protein, 47 aa, Triticum aestivum
  Clone ID: PAT_TA_48812.pep
ALTARTWYALEHSVCQCIFGCLECDVPQLELMMLSTLGLSSEAPPRV

SEQ ID NO: 154395 - protein, 33 aa, Triticum aestivum
  Clone ID: PAT_TA_48813.pep
KARPSVFSVVVTASIVIILRRSHRIRCSHQFGW

SEQ ID NO: 154396 - protein, 60 aa, Triticum aestivum
  Clone ID: PAT_TA_48814.pep
PRRRARSRAATQPETLSGAPGVYTQGPEHDPSSPAPRYSSSPILAGNLLPELASWGGEPN

SEQ ID NO: 154397 - protein, 78 aa, Triticum aestivum
  Clone ID: PAT_TA_48815.pep
QHPVVDTSVRGREATTRSAPRGMKIDDSLDFEGDNDPMLTGRRIAKRKTVIALDDLSKHYLNSGKDELKATAAKTKAR

SEQ ID NO: 154398 - protein, 82 aa, Triticum aestivum
  Clone ID: PAT_TA_48816.pep
TGRFAGSLATMVKIFSRVSFRAGQRCAKRCRQGVVTLAPNMGTGVTDPGADSGYSPYSILGGLWIKPEERTVEAVNLVQSMK

SEQ ID NO: 154399 - protein, 59 aa, Triticum aestivum
  Clone ID: PAT_TA_48817.pep
SQGVRCHRAQFRWRITASLAFPTLPTKPLCSGWPMSDWASERAYPMVSRSPISCRTARH

SEQ ID NO: 154400 - protein, 117 aa, Triticum aestivum
  unsure (1)..(117): unsure at all Xaa locations
  Clone ID: PAT_TA_48818.pep
VMASRATSVSPLEGLKTTVGLPVRRRFNGSSLCRCSHSRTIRSMQVWLIXTSKHXKTLSYMSTISTDAIVNLVYYLIRSKXFSCITYNMVGTMMAEHEQCAGYYXGRCRTLYKLSML

SEQ ID NO: 154401 - protein, 56 aa, Triticum aestivum
  Clone ID: PAT_TA_48819.pep
FGYISTSVNMDRSGRLSCLTYCNGKQAIHLAPDCDLAQAIHHDQIRLNCSFKAWLI

SEQ ID NO: 154402 - protein, 95 aa, Triticum aestivum
  Clone ID: PAT_TA_48820.pep
ANTLFRAPSASHPWPLPAALVFSPWPARPCPCTSWPAWATCPWLPPSSKNLVLRIAPANLRRRSEDSEHKYEGETRVEAKQRRPSIILGRQPLGV

SEQ ID NO: 154403 - protein, 46 aa, Triticum aestivum
  Clone ID: PAT_TA_48821.pep
SRQFFDSSVALSLSAVGAIQSSMSLILRIQPCIDQLFLAFQTFSCT

SEQ ID NO: 154404 - protein, 109 aa, Triticum aestivum
  Clone ID: PAT_TA_48822.pep
QPVPLDRAQLWYSLSVLARHGPRWSVAARAVVTVVSMAVHVALNWPIHTVLITSSTGGRYRANNLLQGLEKLAERQLSAPHDIYVHATAGWTLYTATRDGWLHRMHPNR

SEQ ID NO: 154405 - protein, 39 aa, Triticum aestivum
  unsure (1)..(39): unsure at all Xaa locations
  Clone ID: PAT_TA_48823.pep
RIVAPASIAPTNILRTQLNXVVSYRKSTASPTAGTQNMV

SEQ ID NO: 154406 - protein, 76 aa, Triticum aestivum
  Clone ID: PAT_TA_48824.pep
AALARSDLATTTPTTTSACDNNPPRPSERAPPPAWSAVGTGPSDFTEGRSCTATAFANLRRWPSYTSTGLEKVWRR

SEQ ID NO: 154407 - protein, 93 aa, Triticum aestivum
  unsure (1)..(93): unsure at all Xaa locations
  Clone ID: PAT_TA_48825.pep
MDRATMATGAYSALRSCNAVGVPSLFAPSSRSGRSGLSLCAYSTTSGRVTMSTXRVPGQASPGHIDWSSLGDCQFNHLGSAARLGKRRTYATQ

SEQ ID NO: 154408 - protein, 76 aa, Triticum aestivum
  Clone ID: PAT_TA_48826.pep
CSLAAPNTSPIMSINSFVSIGLSGNRQLYSLVLRESLLVLFLQEPGAGLVSAPLAGWRLSRVLLTDLVLILALDRV

SEQ ID NO: 154409 - protein, 31 aa, Triticum aestivum
  Clone ID: PAT_TA_48827.pep
GDVASQYHPLRYMNGFTGASDVPHALLTSSM

SEQ ID NO: 154410 - protein, 81 aa, Triticum aestivum
  Clone ID: PAT_TA_48828.pep
HGHGPHGYSRACACSMRPRTTSIALSSTTACTQKTAAPHTAGSCRRPRRSRSTLASNVPWPIHYLRRYCFAPRMRLLAKAC

SEQ ID NO: 154411 - protein, 78 aa, Triticum aestivum
  unsure (1)..(78): unsure at all Xaa locations
  Clone ID: PAT_TA_48829.pep
MSCCAGNCGCGARCKCSNRXRGCKMLWDLEATARTGAMVMPTASHKASSGSCQTASETRGCDCTTCNCSNACRCSCCS

SEQ ID NO: 154412 - protein, 57 aa, Triticum aestivum
  unsure (1)..(57): unsure at all Xaa locations
  Clone ID: PAT_TA_48830.pep
PGITNLIDDGITPHYVNYGWESNAKLAEYGLTRTGIGTLEXSKRNVAVDTWLTQVSY

SEQ ID NO: 154413 - protein, 46 aa, Triticum aestivum
  Clone ID: PAT_TA_48831.pep
RYLQLSSGFAKTRLGDVLGALNENTLHWEGFTLCEDRRTGRIIHVL

SEQ ID NO: 154414 - protein, 115 aa, Triticum aestivum
  Clone ID: PAT_TA_48832.pep
PSVDAYARSMVCEASVSNSRLSPRGIAMQCLTVSFAARNACMANKFVCPNKPACEKQWIPARALSYWTAYTNSSRRYKVATGECPDRPDDGRRSHWRSFASSLNLKNGPAPSSST

SEQ ID NO: 154415 - protein, 57 aa, Triticum aestivum
  Clone ID: PAT_TA_48833.pep
MGETVTNVSEYHAITKHTLPKTGYHYYASGADDEWTFKENRYGLSRILFRCRILIDE

SEQ ID NO: 154416 - protein, 66 aa, Triticum aestivum
  unsure (1)..(66): unsure at all Xaa locations
  Clone ID: PAT_TA_48834.pep
MSSKDKRTLXGLRMTTRKRNMQAPRDIWTMLDAMDQMHLDYAGDLELADVSVALSXLNFSRDGDTI

SEQ ID NO: 154417 - protein, 50 aa, Triticum aestivum
  Clone ID: PAT_TA_48835.pep
PIDRLIDTYGTTYRLLAGRLRELAWLCAVDGSLEQQGCGEPRGPASVVLM

SEQ ID NO: 154418 - protein, 53 aa, Triticum aestivum
  Clone ID: PAT_TA_48836.pep
RSTGRDHQICVGMARYSLRHPRVYEHHAGLLACIMRVVSGHRCVLHQRSSRRI

SEQ ID NO: 154419 - protein, 94 aa, Triticum aestivum
  Clone ID: PAT_TA_48837.pep
ARQHVDDLQHAEPDAAAHTAKGEGERGGPHGQRPPPRMQMLQRLIDAKHLHAGAGHGCHLADCLPLWQVTIDSEADAIDREHRLEGDAHGARVH

SEQ ID NO: 154420 - protein, 76 aa, Triticum aestivum
  Clone ID: PAT_TA_48838.pep
TMNYQVDPRVRADRRGKNSKRMMMGAAAGPVIANAGFCRISAHEHHHLLSNVDAPEQLPMLHQHPKLGAPDASRAC

SEQ ID NO: 154421 - protein, 130 aa, Triticum aestivum
  Clone ID: PAT_TA_48839.pep
SKQLNNYGDKAGAEVVDGPLQRRPGVAAVGLDAVEKGLDGHRSRPTQERPTSRGTGTRRSSPGSPAASQSVLRRSPPSGAQRAPPPPAHGSGWSPSITITICRLGLVDPEACLFGCLGGSSIVRVCVCVC

SEQ ID NO: 154422 - protein, 111 aa, Triticum aestivum
  Clone ID: PAT_TA_48840.pep
MARRVERESPLEMAQTMAYMTGLCQGVRLPGRTGRRASRFTVRASSADAEAAGRRAVLGLMASAVVRSAFSQVVHAGTVAAIIVGPPTPICGGLPGSDNFNEARDFHLPLE

SEQ ID NO: 154423 - protein, 63 aa, Triticum aestivum
  Clone ID: PAT_TA_48841.pep
THTTKQERAAHQVGDHGRLGGYHDLAADAGDRAPCYCHSGRGRGRRLLGHRDRHLLAGAGPGR

SEQ ID NO: 154424 - protein, 44 aa, Triticum aestivum
  Clone ID: PAT_TA_48842.pep
RTSSCNKHTLMRYSLVRLTKANPLSMAGADSWRWPLSALICFGA

SEQ ID NO: 154425 - protein, 60 aa, Triticum aestivum
  Clone ID: PAT_TA_48843.pep
HNGDLLRTFGRPWRRSTTSWYLRTCRQDGGARATEVQVRTEQLRRRLLTHERRRTAAGTL

SEQ ID NO: 154426 - protein, 55 aa, Triticum aestivum
  Clone ID: PAT_TA_48844.pep
STGSRSRSRPTLSCLWTYMRRYRCTPWYIRVCVRGSTMPGRACRRASPSTSSRWV

SEQ ID NO: 154427 - protein, 76 aa, Triticum aestivum
  Clone ID: PAT_TA_48845.pep
KRLYISNPGSVSTRSRPSALCRKGYDPAIRPTAQRLCARPPAPQRRRQRASTCPPTTLDSRLQHVRSRVNARTRWV

SEQ ID NO: 154428 - protein, 117 aa, Triticum aestivum
  unsure (1)..(117): unsure at all Xaa locations
  Clone ID: PAT_TA_48846.pep
RSFLATAVVKGIIVLGNPFYNVRHGTVVEILLDRTPIYAESGGQGGDNGLLYVYGEEGGKHNAGIXMNDVAQFLGNMFGHKGTIKLGSIEDXKKMHTVIVGILMHGATVYNTATHLL

SEQ ID NO: 154429 - protein, 60 aa, Triticum aestivum
  Clone ID: PAT_TA_48847.pep
IPHGPDGEAIRAAARPPWLGDAARSCAGWCPARHRYLDTAAGRAERSPTCADRAIAPRAP

SEQ ID NO: 154430 - protein, 63 aa, Triticum aestivum
  Clone ID: PAT_TA_48848.pep
RSPAPKKAPRRADFRTKDGAGHSPPASFLVAATDQTRMLTRIYRTPPSGGRGKYSQIPRRREL

SEQ ID NO: 154431 - protein, 46 aa, Triticum aestivum
  Clone ID: PAT_TA_48849.pep
WRGRPASSGSVTMWGVVVCYRAEHQRRRCWHSGLVPTPVIVAFEFS

SEQ ID NO: 154432 - protein, 51 aa, Triticum aestivum
  Clone ID: PAT_TA_48850.pep
SPYICMMLSRGHSSSVISASVVSDFICDFRKCPACFMSRSPSPNVPPCVLE

SEQ ID NO: 154433 - protein, 69 aa, Triticum aestivum
  Clone ID: PAT_TA_48851.pep
IARTQSLCTIRKSCCVRSLRDYTVGCSDSRQKAVKRVVEQYETHVLVIIFLLCNLCLHHSLSSRYPGPP

SEQ ID NO: 154434 - protein, 84 aa, Triticum aestivum
  Clone ID: PAT_TA_48852.pep
EVLQPEAKHIIQSGQDIIIISYTILSCRHTAIDVHRSMQKPRDIRLSKEKRISRLKSHLSVESMRSGHGIEHAWIDTLASDPTC

SEQ ID NO: 154435 - protein, 53 aa, Triticum aestivum
  Clone ID: PAT_TA_48853.pep
PISPYPTACARWADIVRPPDAPVCGEREAVGAVHVRIQSGSFSVLPKRREYLD

SEQ ID NO: 154436 - protein, 74 aa, Triticum aestivum
  Clone ID: PAT_TA_48854.pep
RDWHPPNSAIQVGLVRWRGLQTWGAPTLTAFPTLPAAGELFHSCRTVRWRGLRTWGAPTLSVFQTLPQTDGLRH

SEQ ID NO: 154437 - protein, 89 aa, Triticum aestivum
  Clone ID: PAT_TA_48855.pep
TQSLGLPTPLHMTNCQTALAGGADQMLHVLRKSEQQQVTSVDGMMTKTRLLFGKDVVKHTYWGVTHHVETKVTGRVSTSVGVSLMVNIE

SEQ ID NO: 154438 - protein, 60 aa, Triticum aestivum
  Clone ID: PAT_TA_48856.pep
ATMLAMKTTITIINVLQEEYTVFYIQTNKREHVTDHTHTFRILCRLTDTENRILYHTDKL

SEQ ID NO: 154439 - protein, 122 aa, Triticum aestivum
  unsure (1)..(122): unsure at all Xaa locations
  Clone ID: PAT_TA_48857.pep
GSAWRKRLPGRRCWAANRGALLSALASKLNPCAIYVSIRLKCISRQGRDCTLMELXDGTRLMSKAVLGWDGVNSPTARRLGFSEPRYTLHMQSRGLTDYTCTHPVXSKVNYMYCRRVRTGLF

SEQ ID NO: 154440 - protein, 64 aa, Triticum aestivum
  Clone ID: PAT_TA_48858.pep
VSCPCTYRSLILGASQAFLYLTLVRYESGDRYGRDTGRCTRIDALLGADDDGVSGVNGRYHCAC

SEQ ID NO: 154441 - protein, 70 aa, Triticum aestivum
  unsure (1)..(70): unsure at all Xaa locations
  Clone ID: PAT_TA_48859.pep
TAVANWCYSTVASGARCSTIVASFGTSASXTSSSMRRKLIRNRWTQAGRVSRALMDTAGERLTTGCEMFK

SEQ ID NO: 154442 - protein, 34 aa, Triticum aestivum
  Clone ID: PAT_TA_48860.pep
SYETVLVMKHESMVDCYGLLTLNRQRVLVLAATN

SEQ ID NO: 154443 - protein, 92 aa, Triticum aestivum
  Clone ID: PAT_TA_48861.pep
RPYPAQQMAPLKVTVAMCVVLVLMIHLTAPAADHDIPCEQSGPRCAQACNAHGPYCCNTVCYIYPTLCNYSLLIQSGLSITECAYLCRVNCE

SEQ ID NO: 154444 - protein, 76 aa, Triticum aestivum
  unsure (1)..(76): unsure at all Xaa locations
  Clone ID: PAT_TA_48862.pep
GGRRLTTCYITRRPRTCRLYLNGADPHTATRPIRSCQPPGKTARTHGAPRRDSTTRTRSLSAIREQPXAETSASTT

SEQ ID NO: 154445 - protein, 31 aa, Triticum aestivum
  Clone ID: PAT_TA_48863.pep
QLTIPSCFMTSIVSYECVGHPRNVRNGTAAV

SEQ ID NO: 154446 - protein, 98 aa, Triticum aestivum
  Clone ID: PAT_TA_48864.pep
GSADSASFFAYHSLLLMLISMTRYADGRHNLTLKTISTGKGRTQIQNHFEENRQIQTVKHCRDDYQTYRRTRYARLKLIQKRYHCSRNKPGPKLKHFE

SEQ ID NO: 154447 - protein, 104 aa, Triticum aestivum
  unsure (1)..(104): unsure at all Xaa locations
  Clone ID: PAT_TA_48865.pep
ASPHRTRPVTASLTLSTSPSNSKEDAMKLHQAXKGFGSETTTVANTLAHRDSLQRGYIXHEYYTMNSEELTRKLWPELIGNHMKRHALWIIDPVGRDATVLKEA

SEQ ID NO: 154448 - protein, 129 aa, Triticum aestivum
  Clone ID: PAT_TA_48866.pep
YPTRSRSTPPCNEPEMEARKVTRDLTFVQALLEASVSATESQAASEASTQTATPTENTIEDTNAVSGATCGCTSDYARASVIAKSNAKGEAKVLYGVLAFKKTPKKSQMMNDTMKATETPEEAMTEAIT

SEQ ID NO: 154449 - protein, 36 aa, Triticum aestivum
  Clone ID: PAT_TA_48867.pep
SVMRSDRVAFVSRSSLPPVYAPRSLLAPTSRSYVST

SEQ ID NO: 154450 - protein, 119 aa, Triticum aestivum
  Clone ID: PAT_TA_48868.pep
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIGRFSTGVHERASPETMRDI

SEQ ID NO: 154451 - protein, 102 aa, Triticum aestivum
  Clone ID: PAT_TA_48869.pep
MPPGGGEASQHGRTGKEQSDPPEIRRRDDSRPAPPFPVVASQKRRQTQPASEVVSVPEGPLVEILARLPYRSLCRFKCVSKQWRVLCSDPSIVKRATQTLSG

SEQ ID NO: 154452 - protein, 144 aa, Triticum aestivum
  Clone ID: PAT_TA_48870.pep
LSFSARARNAELSLGNRDTIKKWRDVANDSRKELHEKEKEVSDLKQEVIGLKLSLSEANDQCTLLFNEVQKAWRVSSTLQTDLKSENLMLADKHKIEKEQNNQLRDQISRLLEVEQEQKIKMHERDLTIQSLQAKLKSIESQLN

SEQ ID NO: 154453 - protein, 109 aa, Triticum aestivum
  Clone ID: PAT_TA_48871.pep
KLLVVATSNIEFEPSDFKHYKLAVLTIYGFQPGDMFMQYMRRVMEAAVNLEEISLHDHWCEECDFYPLTRYPKTDQDRELIREEINRGRPSPMRTIQVLFSDNKYRTDD

SEQ ID NO: 154454 - protein, 109 aa, Triticum aestivum
  Clone ID: PAT_TA_48872.pep
VAPSAASKTRLRPAPLVADQHDATGQRRTVCTRRKTAASPARACHEQPRSWTEEKPPELLPHSLRSNPRKIKEVEYRGRGGISPLTSPTGAAGTGVEDGYGVGLGGLGR

SEQ ID NO: 154455 - protein, 106 aa, Triticum aestivum
  Clone ID: PAT_TA_48873.pep
MPLLPPAAPPLPLSSHRLGLPFLTLPSPAGRPLRRGDLAIRMGGGPRTFPGGVSKWQWKRMQARKAKQLLKARLARERQLYEMRKRAELRDAVVHLERPWDPDSAP

SEQ ID NO: 154456 - protein, 126 aa, Triticum aestivum
  Clone ID: PAT_TA_48874.pep
PRVRGRVGEDSHSPHSSQPLLVESVAEVPEDPLKLGMVVGCGAKADAEARDSSPSDRRAWKSCIATSAPGAFLSISPVGGSHNPLMCPALPRYGSSAAVAGPLQVQAGAIRKSIPHFSFHICLLLI

SEQ ID NO: 154457 - protein, 96 aa, Triticum aestivum
  Clone ID: PAT_TA_48875.pep
AQQHRRHRHPQKYLRPLSGADRAERRSRSRSAWFSFMFLHASIDCLIALPAGSTRVRPCVQELHNSGRYLSFTHYKGCRSESRRSCTAHPRSDDRT

SEQ ID NO: 154458 - protein, 115 aa, Triticum aestivum
  Clone ID: PAT_TA_48876.pep
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQN

SEQ ID NO: 154459 - protein, 136 aa, Triticum aestivum
  Clone ID: PAT_TA_48877.pep
RGDRTDEEQLTNGFMDMAVDWAPGLSKHMRLKDFPSFLRTTDRDDTLLTFQLHQVERAEAADAVIINTMDQLEQPALDAMRAIIPAIYTIGPLNSLADQTIPRGDPLRTVSSSLWKEDDVCLPWLDGKRARSVVYV

SEQ ID NO: 154460 - protein, 57 aa, Triticum aestivum
  Clone ID: PAT_TA_48878.pep
SQWHTLGDRTHRCMRTAPHSNRSCHVHGAPEEELRHAGELGNVTAASNIDANINGTH

SEQ ID NO: 154461 - protein, 83 aa, Triticum aestivum
  unsure (1)..(83): unsure at all Xaa locations
  Clone ID: PAT_TA_48879.pep
SSSHLDPEPEXQEATDTSDCHQTALPGDLPAVPYVVSKEMRANAKSLIRVNWWHKLLQLITLCPLLSLVFMAPEVTQCQGDQS

SEQ ID NO: 154462 - protein, 65 aa, Triticum aestivum
  Clone ID: PAT_TA_48880.pep
MALSPASVGPVIAEVEMNAGADQGATTVRATVVQACSVFYDTPATLDKAERLIVEAAGYGSQVVL

SEQ ID NO: 154463 - protein, 69 aa, Triticum aestivum
  Clone ID: PAT_TA_48881.pep
VQGFGQTYGNTYEHAHELSHWKANFKGTLRHEMLDQMVEHGVKKGFNMISDVIRGKFLGIMTSRKTILR

SEQ ID NO: 154464 - protein, 137 aa, Triticum aestivum
  Clone ID: PAT_TA_48882.pep
MESHAVPSEQPAYKPLPSTANEDAHEHQGGGVRWRACAAVLAASAVVLVAATTLGRGARVDEDAGGFPWSNEMLQWQRAAFHFQPEKNFMSDPNGLVYYRGWYHLFYQYNPKGIAWAFGILWGHAASRDLVHWRQLP

SEQ ID NO: 154465 - protein, 113 aa, Triticum aestivum
  Clone ID: PAT_TA_48883.pep
TKASGQNLPTKAGQVDVPPPRSARAERRGGKQIDWRRSKISPAGDQIASHNNPRKLAGPTSSSPLAVSPWRRRPSDRSTSPRFSGDAEDGGFQAPTLLQLPALLYFAACERNT

SEQ ID NO: 154466 - protein, 152 aa, Triticum aestivum
  Clone ID: PAT_TA_48884.pep
KLSITGYNSLSLPDWFVGIRQYLPNLCVIKLRNFPKCKNLPPLGQLPNLQELCLRGMPCLEEWNMAYTSGEKFANELMFPKLQRLDIRKCAKLRIKLCLCRAMILFIVDCDNVLSSWGEILSHNSASSSSPITNLNVSDSKLFHHLPAPHSL

SEQ ID NO: 154467 - protein, 73 aa, Triticum aestivum
  Clone ID: PAT_TA_48885.pep
MLRAVARCCGHWPPGAAAADGMLWQTELRPHAAGEFSMAAAQANLVMEDQAQVLASPSATLVGVYDGHGGPDA

SEQ ID NO: 154468 - protein, 61 aa, Triticum aestivum
  Clone ID: PAT_TA_48886.pep
MRRVRVSSHHSPVQKLGDSDMKLTPRFRLAGTTSPSSTEPEQQPPWETPLIPGLPDDAALN

SEQ ID NO: 154469 - protein, 117 aa, Triticum aestivum
  Clone ID: PAT_TA_48887.pep
LAACLPTTTSLHLKVQARNTNATRRRVTAPKCARDRRGAADPSCTRPPDRPVQPGYTGPPDRPLPRDLPCRPARRLPAHRPRHRRDPDKAGVHGHLRDPGRAAVRRDLESEARPPVR

SEQ ID NO: 154470 - protein, 36 aa, Triticum aestivum
  unsure (1)..(36): unsure at all Xaa locations
  Clone ID: PAT_TA_48888.pep
XFXILXHSXPTQTLLIHLQPLSLRLQQPQTLISHLL

SEQ ID NO: 154471 - protein, 111 aa, Triticum aestivum
  Clone ID: PAT_TA_48889.pep
TLRAMPNSSSMLPLCDSESPPSSPHAPSSFPGARAPPSAPESPGLTLLRLPNPSVDLRIDVATALPHQIWRGPLKSPNQAPLPYVGRARCLVMRGLHPSSEIGGKGRRRER

SEQ ID NO: 154472 - protein, 87 aa, Triticum aestivum
  Clone ID: PAT_TA_48890.pep
FPTCRLADVLIGDHGLRRLVLNCLLLDIQLVGHETVHPLGHELREPQLAVIMDPSSGRSVSHCRARDGRGKEGGGGWIAGGGESCVG

SEQ ID NO: 154473 - protein, 107 aa, Triticum aestivum
  Clone ID: PAT_TA_48891.pep
GAHCLRVSSRRVLSPRLLHSYGPLLVVVEEDSARWGGRLGVQGKESGEGEAGDAWRPHARREADKNGKRFPVVVAWGQETPEEEECVAAVTGDWWMVAAHLPVSCLP

SEQ ID NO: 154474 - protein, 128 aa, Triticum aestivum
  Clone ID: PAT_TA_48892.pep
RYTAQTPLGLTVMAYSATSDAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLSMF

SEQ ID NO: 154475 - protein, 76 aa, Triticum aestivum
  unsure (1)..(76): unsure at all Xaa locations
  Clone ID: PAT_TA_48893.pep
MEQPEAGDGAPQQRHKKSSAAKKAKKGRATRSGSGGAWPAVKPKKDLLVNRLKGTQLLTVPDFLTFGXAKAFVDLA

SEQ ID NO: 154476 - protein, 129 aa, Triticum aestivum
  Clone ID: PAT_TA_48894.pep
EAPVHLAVQLHHQQPEVKPRRQLIRRPTPRLPIRSRRCASTASGATRPPEALAQPVVHPDVSPWRWTTSPSICAGASPTAISPPKGFLYPVLPSTTKEQHKPLHPEVPASRPSSTSGDGSPIPPCPALL

SEQ ID NO: 154477 - protein, 39 aa, Triticum aestivum
  Clone ID: PAT_TA_48895.pep
WGRCSQHSLWYSMMSKQPIMGQREGRVDVSRKDAPPTDI

SEQ ID NO: 154478 - protein, 66 aa, Triticum aestivum
  Clone ID: PAT_TA_48896.pep
VGSLLLYVACARSLSARKFATVSGSAVLDQLHRHATAARADGRSRPKHAQVGAYRSPRVGDNLLGF

SEQ ID NO: 154479 - protein, 62 aa, Triticum aestivum
  Clone ID: PAT_TA_48897.pep
YEPHRTEVIGDEPHHESNHKFRSEFPRGNKNKIARKITNRMQQRNSVSVTFDIPGKPLRTST

SEQ ID NO: 154480 - protein, 148 aa, Triticum aestivum
  Clone ID: PAT_TA_48898.pep
EPLTKEDLVAYLASGCKPKENWRIGTEHEKFGFDVETLRPITYDQISAILNGLSERFEWDKIMEENHVIGLKQGKQNISLEPGGQFELSGAPLETLHQTCAEVNSHLYQVKAVGEELGVGFLGMGFQPKWALADIPIMPKGRYEIMRN

SEQ ID NO: 154481 - protein, 62 aa, Triticum aestivum
  Clone ID: PAT_TA_48899.pep
MVSAGQAGADGPSTSDIRGTGNGAVENGHALKANEDKEWRGGSKEEDWPSTHSAPPGLDEHK

SEQ ID NO: 154482 - protein, 144 aa, Triticum aestivum
  Clone ID: PAT_TA_48900.pep
DAWAGFTGKYVIREALKFLPPNASPLRTLALAGRSRERVAAALSWAASPGPVPDVPILVADTSDPASLAVVTARARVLLSCAGPFRLHGRQVAAACAEAGAHCLDISGEPEFMERVEADLHEVAAKNGSLIVSACGFASTVADL

SEQ ID NO: 154483 - protein, 150 aa, Triticum aestivum
  Clone ID: PAT_TA_48901.pep
MHGSAISASIQRANSSFIHDVMGESSSRDDEQTMHSQYGSAYQEVSRQHGTPAEGIVVNEQQNGDRASPVLGSQSSLCVSSPPRSPPHVSHDEMDVSGDSPALPTSADGYRTVVSDNDQAASTLDAANISRIATSSTASHMEDDEWPSEH

SEQ ID NO: 154484 - protein, 93 aa, Triticum aestivum
  Clone ID: PAT_TA_48902.pep
AHVLDIKEDRPDNALAITGFAIKSTIQCSSTWEAAASGAIRTRCLLSVSSPCCDQRLCRSMLLLSSSTTARSVAHASGRPRYQFRNFLAVALS

SEQ ID NO: 154485 - protein, 57 aa, Triticum aestivum
  Clone ID: PAT_TA_48903.pep
GLYEILSLSGSYNLNEGQQNQTDGISVTLCSPERHVIGGVLGGALVAASTVQVTAIY

SEQ ID NO: 154486 - protein, 139 aa, Triticum aestivum
  Clone ID: PAT_TA_48904.pep
NDWSNQANLFTGEHLNLLPNLLQKQISLPNSPMSSLLFSQQQQRLAQLQPSHHQNYLNLPPHLFYHHHPPEIPGRFESATSLPSSRDKRSRSGRGKHSLRFSQPPSDTTGSQNGESGGLKFRSKYMSSEEIESILRMQH

SEQ ID NO: 154487 - protein, 140 aa, Triticum aestivum
  Clone ID: PAT_TA_48905.pep
HASARAEQSRASMGSSSGEEGEEQWVPPSRRPELADVAPLPQADGPCPVVSIAYRDDFREVMDYFRALYAAGERSPRALRLTADAIHLNPGNYTVWHFRRVVLEALDADLLLEMHFVDQIAESNPKNYQVWHHKRWLAEK

SEQ ID NO: 154488 - protein, 41 aa, Triticum aestivum
  Clone ID: PAT_TA_48906.pep
IHVTVNTYGKHIEALVHMTISFKDIKEGVFYPILKTSPEPA

SEQ ID NO: 154489 - protein, 127 aa, Triticum aestivum
  Clone ID: PAT_TA_48907.pep
MATTANPTTDLFSRLSFRRAVSPSPLRLPSLPTPSPRVSVAIVALHKRNPKRLKYDSQRQFTRGDGGMLRVQVEPSGEDFWKLDPVVDLINSGAVGVIPTDTVEQGNAPCALHFSLQLMLATPLFVI

SEQ ID NO: 154490 - protein, 134 aa, Triticum aestivum
  Clone ID: PAT_TA_48908.pep
MARAPLLLLLVPLLAAVCLASLAPGANAAGRKMVGVYELSMGDFSAKVTNWGATVTSVVFPDSKGNLGDVVLGYDTIAEYVNGSSYFGALVGRVANRVAKARFVLDGKVYHLYANDGKNALHGGHRGFSKVIWT

SEQ ID NO: 154491 - protein, 35 aa, Triticum aestivum
  Clone ID: PAT_TA_48909.pep
IRSWAIGVGDKCTVALETSALHLYQLPDSPRRVIL

SEQ ID NO: 154492 - protein, 152 aa, Triticum aestivum
  Clone ID: PAT_TA_48910.pep
PTRPLRIPVPVGTVVRRKKGSVLADLAHPGDEVLVARGGQGGISLIDAPDYKRVKAMALSPNVMRDVTDKILTHGQPGEEISLELILRVVADVGLVGLPNAGKSTLLSAITLARPDIADYPFTTLMPNLGRLGGDPTLGAMQFSSGATLADL

SEQ ID NO: 154493 - protein, 58 aa, Triticum aestivum
  Clone ID: PAT_TA_48911.pep
PTRARTRPQTRRLARPQTHEVARAKDIEAATPNDMYAAKDYWDHAAKDFFDPEELTMW

SEQ ID NO: 154494 - protein, 134 aa, Triticum aestivum
  unsure (1)..(134): unsure at all Xaa locations
  Clone ID: PAT_TA_48912.pep
VSVANIQYLPDVVPWTYAGVLYQLDVHYEDPDLFNEFEDDNPMDTSEGGGGSGTRDDNAESNEDKALRPSGQSENADSTPVGLSSTVPTTTLQLGSLGAFSAPPRLSSVKAGPPSPRLRLCVGRXVDHTDEVGQ

SEQ ID NO: 154495 - protein, 135 aa, Triticum aestivum
  unsure (1)..(135): unsure at all Xaa locations
  Clone ID: PAT_TA_48913.pep
MSPQAETKAGGGFKAGVKDYKLTYYTPEYETKDTGILAAFRVSPQPGVPPEEAGAAVAAESSTGTWTTVWTDGLTSLDRYKGRCYHIXPVAGEDSQWICYVAYPLDLFEEGSVTNMFTXIVSNVFGFKALRALRL

SEQ ID NO: 154496 - protein, 58 aa, Triticum aestivum
  Clone ID: PAT_TA_48914.pep
SKLWGIFKTARGAVLVYLLIYYGHKNNPYSYIYGYMGGNFENKVNKACGRIWLLQRIR

SEQ ID NO: 154497 - protein, 68 aa, Triticum aestivum
  Clone ID: PAT_TA_48915.pep
LSSSLIIFPWLSFIILCNMKDFHTGVLINLYAYAYFIILSFYFNLPLDIFYASLIIYGHLLNSYPNHH

SEQ ID NO: 154498 - protein, 113 aa, Triticum aestivum
  unsure (1)..(113): unsure at all Xaa locations
  Clone ID: PAT_TA_48916.pep
MNILPSFDKGGPPSFLELRVPQLGPIYSEVWELGRPPPGVDAHCLQTDPEGGLRGLWEGLCIPFQAQMNEIXWKGGPRDFDGIWAPWWYERGHTSTGLSKSRGYPMTFAFAFY

SEQ ID NO: 154499 - protein, 139 aa, Triticum aestivum
  unsure (1)..(139): unsure at all Xaa locations
  Clone ID: PAT_TA_48917.pep
GGRTHTSPRSPSRRSLLLRASAISGAGVDTEDLRHVNRGLLALRALISSKGCAPIMLXRLSWHDSGTYDVNTRTGGANGAIIYEEEYTHGSNAGVKICIDLLXPIKAKHPKITYAYLYQLCGVFSVXNTRGPTVEVIPG

SEQ ID NO: 154500 - protein, 105 aa, Triticum aestivum
  unsure (1)..(105): unsure at all Xaa locations
  Clone ID: PAT_TA_48918.pep
MVLLPERRRLAAGSGHLRPGGAGIRWSRVPEVRAPRRPAVAAGXRVVVVRDWQXTWNGDGRIQGRSDFSGVTPKGEAXGRTSRLMVLGDFFYAWFTRPVGRARRT

SEQ ID NO: 154501 - protein, 85 aa, Triticum aestivum
  unsure (1)..(85): unsure at all Xaa locations
  Clone ID: PAT_TA_48919.pep
MGITNVTECXAIGXQXVPRXIXEGDGSXAXDXXTLXENREGFXRILVRPAILIGGSKIDMATTILGVXVSIAIMVSPTGMQKMGH

SEQ ID NO: 154502 - protein, 72 aa, Triticum aestivum
  Clone ID: PAT_TA_48920.pep
SEPTIINNARCFGRGPDLRPSDEAPEHPLELKGNIPLAQVSLEVALPRVLCLASTFILRLGLCPLAASLFFR

SEQ ID NO: 154503 - protein, 55 aa, Triticum aestivum
  unsure (1)..(55): unsure at all Xaa locations
  Clone ID: PAT_TA_48921.pep
LXSTYFXGDNRAMIFYANGWIGLNDNFGKVGSWDNNEGGYSTLVGDLIRHMHRTK

SEQ ID NO: 154504 - protein, 131 aa, Triticum aestivum
  unsure (1)..(131): unsure at all Xaa locations
  Clone ID: PAT_TA_48922.pep
PQTGGKTSLGCKAGGKNYKLAYYTPECXTNGTDILAGFQVSPHPGVPTEQARAGVXAKSSTGTWTTGWTDGLTNLDRYKGRCYHIEASTGEDSQLIYYVSYTLDLFEEGSVSNMVTSIGGDGFGFKGLPAL

SEQ ID NO: 154505 - protein, 63 aa, Triticum aestivum
  unsure (1)..(63): unsure at all Xaa locations
  Clone ID: PAT_TA_48923.pep
GGGPXXSLLLPLLPSNIMMTLSELCGARAPFXVCPIRIRQRSIPYSGLGTGDSRGCFSFTIGS

SEQ ID NO: 154506 - protein, 74 aa, Triticum aestivum
  unsure (1)..(74): unsure at all Xaa locations
  Clone ID: PAT_TA_48924.pep
NPACSPPPPNHAFSSPAAASXSYLFLFYYWFFPPPCYNVTSSGFLQSYKLDGYSQPSFISEQSSVYFGSSLFLG

SEQ ID NO: 154507 - protein, 98 aa, Triticum aestivum
  unsure (1)..(98): unsure at all Xaa locations
  Clone ID: PAT_TA_48925.pep
SSYSFFQSLXRIXLPIPELVSLGQIKLNIXYXIKHFHYNILTXFPNSLHLIPFHSYHFKNITLLFTKNFPXDASLPYTSSYDHSIIFIITNFLYSIYT

SEQ ID NO: 154508 - protein, 85 aa, Triticum aestivum
  unsure (1)..(85): unsure at all Xaa locations
  Clone ID: PAT_TA_48926.pep
NSLVGGAYSHSCANANRHTLLELAQHLILRGHLGGGRANYPSLPLRAGPLLRRPLQSWLHDHWPHGRRTLMGLHXLNNLQLLHSR

SEQ ID NO: 154509 - protein, 61 aa, Triticum aestivum
  Clone ID: PAT_TA_48927.pep
SERSVLDVERLEFMEEKWKNVEGLAPLEYSYHPLKINEEKDVIVDWYVEYEGGCVGTHPNV

SEQ ID NO: 154510 - protein, 110 aa, Triticum aestivum
  Clone ID: PAT_TA_48928.pep
MAGQGLLWGGRLLGRPLHSSISRSSSSRKAPFGGRASSSPPGKQNDNRQLWFASKQSLTYLDGTLPCDFGFYPLGLSYPEGTGWFIEPRWLSYCEIFNGRTAIIGVGGMI

SEQ ID NO: 154511 - protein, 108 aa, Triticum aestivum
  unsure (1)..(108): unsure at all Xaa locations
  Clone ID: PAT_TA_48929.pep
TNSFFLFKPFFKDYKLTYYTPXYXTNYTFIFSSFLIIPHSLFSFLINIFFIIFXSSTITLTSFFTYLLTILDLYKIPFYHIYPVIFKYNLFIXYLSYPYKPILIFFFF

SEQ ID NO: 154512 - protein, 148 aa, Triticum aestivum
  unsure (1)..(148): unsure at all Xaa locations
  Clone ID: PAT_TA_48930.pep
FKSYREGLMSPQTGSKSVVXLKLGGRDYKFTYYTPYYXTNDTDIFATFLVSPHPGVPSEXTCASLSSESSTGTWTTVXTDGLTSLDLYKGRYYHIQPVSVENSQWIXYLSYPLHLFXEVSCTNMFTSIVGNLFCFKTLHSLSFEDLQI

SEQ ID NO: 154513 - protein, 61 aa, Triticum aestivum
  unsure (1)..(61): unsure at all Xaa locations
  Clone ID: PAT_TA_48931.pep
CXRDSIEPHGCREMLKGKIDLFLNTYXPKSHXRLVNLKPGDLLFLVCSXTSLVDATTWNLT

SEQ ID NO: 154514 - protein, 92 aa, Triticum aestivum
  unsure (1)..(92): unsure at all Xaa locations
  Clone ID: PAT_TA_48932.pep
MGAADAIRTGIGVIGNGTGLVLFLSPGPAVIQIWKKKTGEXYSAGPDLATLLNCMMGGLYGRPVGHPHRMLGITINGTGMRIELTYLGLFLT

SEQ ID NO: 154515 - protein, 84 aa, Triticum aestivum
  unsure (1)..(84): unsure at all Xaa locations
  Clone ID: PAT_TA_48933.pep
NXTQXTGRLEGVHKGGNXPNGDIKVPGTGXWGPSIKGXIXNGVXXNGTLIFSGGRYXGXIXXYLXXLXGSGXGGLSRGTRXXSF

SEQ ID NO: 154516 - protein, 43 aa, Triticum aestivum
  Clone ID: PAT_TA_48934.pep
TLVTFLLWRKENSGAEFIFKGVHSYYTNLNGSYITNFYRCHPF

SEQ ID NO: 154517 - protein, 41 aa, Triticum aestivum
  Clone ID: PAT_TA_48935.pep
SLLLNRTLSQGQAYRWTWSALYVSISFFSSIIYIPSSLISF

SEQ ID NO: 154518 - protein, 108 aa, Triticum aestivum
  unsure (1)..(108): unsure at all Xaa locations
  Clone ID: PAT_TA_48936.pep
MEAAAEXGHLLVCXFLFXXAXWMXAXXITDVAMGALWPGQDQGSLGIYLTGLEQGITGLGAVGGXPVIGNLSDRYGRKALVCLPGTLAIGPLGIMGFNQTRAYFYGFY

SEQ ID NO: 154519 - protein, 70 aa, Triticum aestivum
  unsure (1)..(70): unsure at all Xaa locations
  Clone ID: PAT_TA_48937.pep
MHIFVNTLAGNTITLXGDMIYTIYNVKGNIQDNGGIPPYQQRVIFCGKEVEYWPTLSYYNIQKEATLHFV

SEQ ID NO: 154520 - protein, 54 aa, Triticum aestivum
  unsure (1)..(54): unsure at all Xaa locations
  Clone ID: PAT_TA_48938.pep
LSLIPLCTHSSSHSSSHSSSDSXVSPYLYHWRGXRKVCGTDLLXALRMLSFRAI

SEQ ID NO: 154521 - protein, 126 aa, Triticum aestivum
  unsure (1)..(126): unsure at all Xaa locations
  Clone ID: PAT_TA_48939.pep
PSLPIRYSGGGRTRPRNLDFSEASITLDRTHALMGRLSSSCSLLLIFYLFSSGSHLITAFTAXSCGRALFFCLSTSIGYTKSHLNLMDPFVSRYYSKAFTLLQGLLLTLFITTVXSWLLTWHLLLN

SEQ ID NO: 154522 - protein, 104 aa, Triticum aestivum
  Clone ID: PAT_TA_48940.pep
TAPEAHNARLSSTTWPSRLLESCSSSSPSPCLSCDILRRPAPLRSGSDGGRRHLPPSPRGLPLVGHLHLLGSVPHRALRSLAGAHGPVLLVRLGRVPGVGVFSP

SEQ ID NO: 154523 - protein, 114 aa, Triticum aestivum
  unsure (1)..(114): unsure at all Xaa locations
  Clone ID: PAT_TA_48941.pep
ADTPLASLRNPSLGSTNKMGGSNLQGLLLAIGNPLVDICDLLDQGXLPKHDLKPNNPILPEGKHLPIHHEVATKDNGEHIRGGATQNSITGSQSMLQTSCTTNYMGCIRNDILW

SEQ ID NO: 154524 - protein, 69 aa, Triticum aestivum
  Clone ID: PAT_TA_48942.pep
TVDVRHEVADDQRVLHLERHVEMRTACAKTQSRSSGSSPRPRPFRHRCRRRAPPRRAPRRRPAPWSPTC

SEQ ID NO: 154525 - protein, 59 aa, Triticum aestivum
  Clone ID: PAT_TA_48943.pep
GCDPYGGPSVIGEHPLKVIIFFAQFPSRMWLKNCYSGILISFYYSFSLHNIPLISLLSF

SEQ ID NO: 154526 - protein, 82 aa, Triticum aestivum
  Clone ID: PAT_TA_48944.pep
IFTLFGGGETHPLYACADSFAIEVAKEAVCGGGSPMPHGGGIESDYEVFRNLYSVINSSPWISLTGPIYTPHDLLWERWGVA

SEQ ID NO: 154527 - protein, 127 aa, Triticum aestivum
  unsure (1)..(127): unsure at all Xaa locations
  Clone ID: PAT_TA_48945.pep
PAGPDSQLGGGATRPDAYTLRHHPHPDASSVGFGMAGASTVMRVARAGRSXAATGSLFGRLGGRAGLSTKGGAGGWHAPTLGSHRAGSGDLGLDRPPGGGPPPGMTGPGSQTLSYLKGQTAEGKGEF

SEQ ID NO: 154528 - protein, 105 aa, Triticum aestivum
  unsure (1)..(105): unsure at all Xaa locations
  Clone ID: PAT_TA_48946.pep
PTTSGATGPPTPAPTRPPRCSSAGSPPPWPGPGQRPAVIGSARLGPAPGPAPGPPRGXTSGATAPPTRLSPTGPAMARGPTAAPPPDAPGPPGGGGPSTWGGTPP

SEQ ID NO: 154529 - protein, 97 aa, Triticum aestivum
  Clone ID: PAT_TA_48947.pep
MEHKETGWQSREGPILCVNNCGFFGSAATMNMCSKGHKGMAMKQEQAKLAGFSFDSIGNGGDAAKEHLGGGNTGGAGGHVEAKTLITGQASDIGGAS

SEQ ID NO: 154530 - protein, 113 aa, Triticum aestivum
  unsure (1)..(113): unsure at all Xaa locations
  Clone ID: PAT_TA_48948.pep
FPKFPCGPTRTPLVLHRSLTFRDKLLIQCGGFHRRVGGTYFTYYHAIGKQNLSKMIYDYYGCCSXDYWTLHENIDAFGRILVRPRILIDVSKIDIATSILGFNVSMRIIISPT

SEQ ID NO: 154531 - protein, 145 aa, Triticum aestivum
  Clone ID: PAT_TA_48949.pep
PTRPKDPWRSMSYVLRDVLVVLGLAAAAARADSWLVWPLYWAAQGTMFWALFVLGHDCGHGSFSSNPKLNSVVGHILHSSILVPYNGWRISHRTHHQNHGHVEKDESWHPLPQRLYNSLDNMTKKLRFSMPFPMLAFPLYLFARS

SEQ ID NO: 154532 - protein, 64 aa, Triticum aestivum
  Clone ID: PAT_TA_48950.pep
PADAHIQDHRWAPRTASATFVRYTAGILLHIQPLLGAYIDMNYVINASKTPCDIDATSGHERSR

SEQ ID NO: 154533 - protein, 122 aa, Triticum aestivum
  Clone ID: PAT_TA_48951.pep
RPREVVMEGEANGESGESGNCIGHGADIQMRKHQETKSEIEVSNKRGQVAALISASVDTKLEMGETDGMKENMLSEIQLEGTYSGTQSATEIVRADICSLLSRFSNEGHGAESRTEADDYRL

SEQ ID NO: 154534 - protein, 152 aa, Triticum aestivum
  Clone ID: PAT_TA_48952.pep
NTYVDVTYCSVYSLHKSIVGNFHSCCHFFYYSDELRGLEWNTRYKIIRGICEGLHHLHNEKKIYHMDLKPDNILLDNDMVPKITDFGLSRLDEKSKTMSEERHGSLGYCAPEYLHQGNMSFKSDMYSLGAIIIELVTGEKAIRSGNNNVLRR

SEQ ID NO: 154535 - protein, 82 aa, Triticum aestivum
  Clone ID: PAT_TA_48953.pep
MRWWESVKSLFADGGNLGCLSCVGRKAPEDLHSYPMEPAKRKRSRGAAPAAEEEPGAIEVPAVALREVNELTGSFDREKLIG

SEQ ID NO: 154536 - protein, 88 aa, Triticum aestivum
  Clone ID: PAT_TA_48954.pep
MSSEDSLKSLSLDYLNLLINGQAFSDVAFSVEGRLVHAHRCVLAARSLFFRKLFCGLDPSHQPPPPPLNWPNAGGGSGGGGGGGSRGG

SEQ ID NO: 154537 - protein, 140 aa, Triticum aestivum
  Clone ID: PAT_TA_48955.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAE

SEQ ID NO: 154538 - protein, 87 aa, Triticum aestivum
  Clone ID: PAT_TA_48956.pep
GGGAVGREGDPSHSPPFRSLAAGYKARLCSSSAAALTPTGGWRAPPWPWPTRWRHHDWPTPCHTALSTLPTASPHSPQSPSHSPPLS

SEQ ID NO: 154539 - protein, 89 aa, Triticum aestivum
  Clone ID: PAT_TA_48957.pep
MASSSTTAAAAPALIPIAEHLHRSNFLVWRAQAIAAIRGAQLVAYINPDREEPAPKLMDKEGKPTDAPNPAYEIARAQDSQVLSFLFNS

SEQ ID NO: 154540 - protein, 71 aa, Triticum aestivum
  unsure (1)..(71): unsure at all Xaa locations
  Clone ID: PAT_TA_48958.pep
MSWERMVRAIIARHILLAVLLVGTDVAYGFSQADNAGRGLAXSSPMPDPYPMPDQEPYPDPKPEPMPIPDP

SEQ ID NO: 154541 - protein, 48 aa, Triticum aestivum
  Clone ID: PAT_TA_48959.pep
HAYDHPGHEPQYDLKDPVAVRDDTIITVGITGIEVDGDCFSAIDITLH

SEQ ID NO: 154542 - protein, 48 aa, Triticum aestivum
  Clone ID: PAT_TA_48960.pep
HATALSGLLPHSLLKDSGDGREATALSVCFTGLAVDCEILGANKTRPH

SEQ ID NO: 154543 - protein, 134 aa, Triticum aestivum
  Clone ID: PAT_TA_48961.pep
SVKLDRSKSLQGGDSDGRSSRRRFTGDGDASSGRRQDRESVDPRKKSFERNRGAQRDRGGDQGRGERLATNDSAEEFTGLVGKGMVGDVKNSNDGQRKVEEYVQRRIVRGERSRIGDSSDTDDRKQFPSASYVK

SEQ ID NO: 154544 - protein, 51 aa, Triticum aestivum
  Clone ID: PAT_TA_48962.pep
SEEPVCGGLKDDRAQNMQLTRLQNGGSFRCATMAMRRRMCPTPCACTDVAW

SEQ ID NO: 154545 - protein, 79 aa, Triticum aestivum
  unsure (1)..(79): unsure at all Xaa locations
  Clone ID: PAT_TA_48963.pep
MALVMHLGRDNKNAFKALIAAQICGVNGELTNNLEMNVXNKTSDFIKMYTIIKAPVMETADDTADESNAIRRYVARSKG

SEQ ID NO: 154546 - protein, 126 aa, Triticum aestivum
  Clone ID: PAT_TA_48964.pep
PTRPAEVHTNVDSSQFTVEGGHHKVDGETDGDYELSDEPASAPIVGTNNALESPGKEMEDSVPASKGTHFGLDDSDEDQLDGDYEVEELSGKETELFDYAALAELLRAANRSPAHGKAKVFPVETS

SEQ ID NO: 154547 - protein, 64 aa, Triticum aestivum
  Clone ID: PAT_TA_48965.pep
GALRGLFACRDATERLVNAHGTEDVLCDSNQNAYPHADGGAGRAGVHDQRPDAHVHADHPRPPR

SEQ ID NO: 154548 - protein, 138 aa, Triticum aestivum
  Clone ID: PAT_TA_48966.pep
VERERERLPPRLRRAAHGGERGRIGGVGSLGAEEVKRQEKKKEGDTMVIASGVIDRGHLSSFGGPPPDSSSSFFSEDLVPTERQVGFWKSESMVDQRGSKPAFASPLEKIHPMGANPEGGLEQTGGQVFKGLDALRVS

SEQ ID NO: 154549 - protein, 134 aa, Triticum aestivum
  Clone ID: PAT_TA_48967.pep
CFSSALIGICIDHGSSLCLFSGLGLWFDRSFWLGLPVLLSIIDARSYLLGLQVFPVGSRCLSLDIEWHGGLFCHPCLHGGAVSLPLGMPLLSARTWGSGHHRWTLRSCMQGYARTARAWLPSASASVIRVAVRA

SEQ ID NO: 154550 - protein, 130 aa, Triticum aestivum
  unsure (1)..(130): unsure at all Xaa locations
  Clone ID: PAT_TA_48968.pep
SHSTQSIVYGLKTQTIDLAYLLMNAALPKXSPIXIMNLDVYFNGRVIDETILAYPEACAAPEYEKAASTTYPINNVDRTARCRTSCITAKKPGDAGSERQLNITVTISAGQPLGCCLTNGMNVPLRREAN

SEQ ID NO: 154551 - protein, 72 aa, Triticum aestivum
  Clone ID: PAT_TA_48969.pep
GQPPPPPPIAAPPGPKVPRSQPRTERQHRRRGPPAGPAEAGCRAREVRRSKARARSCPYLFFSRTRGGTRGR

SEQ ID NO: 154552 - protein, 151 aa, Triticum aestivum
  Clone ID: PAT_TA_48970.pep
RRRCTDRPTHPVAAVGIRRGLTHLQHHSHRLQLSQPLSRIATPKNNLPCLGSRRLLYDDAYAPDDEPATPCAAASAATPPTAPTAVGIDVLNDELKRRLEAYYKVEDELELSPVAMAVLERNPAYAHSDTDDELMEELRDKPLAQVHDRDI

SEQ ID NO: 154553 - protein, 132 aa, Triticum aestivum
  Clone ID: PAT_TA_48971.pep
LISSKPYFKHSDERQSAMTWLMEDSPLDANLSELDVQDAVDIFYNTILFYLEPQFHPLIREGQKDFLIKVAHQFVFAEETNSCKPLEPESRDFPGHLQPYASSYIHTMKVQSKVFTGQEQFRRHQEVDRYLA

SEQ ID NO: 154554 - protein, 76 aa, Triticum aestivum
  Clone ID: PAT_TA_48972.pep
MEAATGEAIPPRHPASAAAEQERPAPPYLPRLVAGVLSGVLTGLFAVAGGLTGAVTGALAGRGFDSSVLRGAGLGA

SEQ ID NO: 154555 - protein, 158 aa, Triticum aestivum
  Clone ID: PAT_TA_48973.pep
WIADVESGEARPLFKSPDIYLNAIFDSFVWVDNSTLLVCTIPVSRGALPQKPSVPSGPKIQSNETKNVVQVRTFQDLLKDEYDADLFDYYATSQLMLVSLDGTVKPMGPPAVYTSIDPSPDDKYLMLSSIHRPYSYIVPCGRFPKRVELWTADGKFII

SEQ ID NO: 154556 - protein, 98 aa, Triticum aestivum
  unsure (1)..(98): unsure at all Xaa locations
  Clone ID: PAT_TA_48974.pep
KLMTRVTYTIDEMESPLEVVTDGTLKSEEKDGINYAVVTCQLPECKRVPLLFTAKQLVATGMPESSSGPFLEPSYRGSSLLDHKGXGGCTDYDNDVAL

SEQ ID NO: 154557 - protein, 75 aa, Triticum aestivum
  Clone ID: PAT_TA_48975.pep
VSESRRFPGSAWLACCPFVRLCVATTIINGATTVVLSVSGSDVHELDKSLLLSTSNIVNDTYRSNLYHTLFSRAS

SEQ ID NO: 154558 - protein, 135 aa, Triticum aestivum
  Clone ID: PAT_TA_48976.pep
METEPPKVFASLTLLLLLATATAVALAPVPGEQARALLVWKASLSNQSQHTLRSWENMSAPCSWLGVRCTAHRRWRRTVISGISLRGMWLRGTLESLNFSALTTLTCLDLSHNYLAGAFPPGIVVLRELQALLLQ

SEQ ID NO: 154559 - protein, 98 aa, Triticum aestivum
  Clone ID: PAT_TA_48977.pep
VRRPKSMPLRTLSVAEQTFCTPIRFGLTSWRLHPTDCTAICYSPRSLGQWLYCSRFPPDLPGRPEPENATMATPARNRLMRDVKRLMQDAAAGISGTP

SEQ ID NO: 154560 - protein, 122 aa, Triticum aestivum
  Clone ID: PAT_TA_48978.pep
DGGYGGYYSHGGLRGSNTMLGWQLTGYHFQAEKNYQNDPNGAVYYIGWYHLLYQHIQGGTPWGIISWRHAQWRDMHHWRHLPVAIHAELWYDIEGDLTGSMTRLLDRSVMLLYTANTRTVAH

SEQ ID NO: 154561 - protein, 80 aa, Triticum aestivum
  Clone ID: PAT_TA_48979.pep
FIIIHSGQVVVHDHATRSPCPGALCCRRQQTSFVAPFTAPAQVIDPTPQTRFLCVWRQPNGDLLIARTTAAYNFSVRVGV

SEQ ID NO: 154562 - protein, 88 aa, Triticum aestivum
  Clone ID: PAT_TA_48980.pep
MVVALSSTDGAPGCTPTNFLGKKLKKHVTLAVNYHGKSCNVNRFTVMAEVNIDEKRNTDKWKGLAYDIYDDQQDISRRNGMGDSVFQA

SEQ ID NO: 154563 - protein, 70 aa, Triticum aestivum
  Clone ID: PAT_TA_48981.pep
HGGGISYQYQMHAWALIQSEACRVPCSGHGPWSRTYQPMDPPLATLSMTYMKLQLVRLLGLLKNARVKRP

SEQ ID NO: 154564 - protein, 67 aa, Triticum aestivum
  Clone ID: PAT_TA_48982.pep
THYRISVSTTRTRTRISVLTQTNKHAWCFSVHGHNRKLAHIGAHATCYPNQAVKDGIEQTWRSLEVH

SEQ ID NO: 154565 - protein, 86 aa, Triticum aestivum
  unsure (1)..(86): unsure at all Xaa locations
  Clone ID: PAT_TA_48983.pep
SDKCATGVVIKVLADHKDQLEAPALPXKHYNDKAAVAVQGLXNCRRVRMPKRKERHWMLYVTPDNDFAGEDHDIRLQEIKEATGYY

SEQ ID NO: 154566 - protein, 86 aa, Triticum aestivum
  Clone ID: PAT_TA_48984.pep
AETLVADLENGAGLLLENPGFYKEEDKNDPKIAQKLASLAHLVGNDACITAHRAHAWTEGVTKLLTPFDGGFLLQNELDYLYGAVA

SEQ ID NO: 154567 - protein, 87 aa, Triticum aestivum
  Clone ID: PAT_TA_48985.pep
TSILTHTPTLACQLVKAHTIAKDIKAAPPDGEYGDKDYSDPPAAPLLDVEELTKWSLYRAVIAEFVATLLFLYITVGTDIGYKQHED

SEQ ID NO: 154568 - protein, 105 aa, Triticum aestivum
  unsure (1)..(105): unsure at all Xaa locations
  Clone ID: PAT_TA_48986.pep
MTYMGKKQGVADLMLVLEALAAAPDAAHAGCQAXHLAGCAWAILFRAKPSGXCCGNLRXHQPCFWQYPKDPTYGLFIRSQDARDTLEYCGLARAHCYAPVGPWRT

SEQ ID NO: 154569 - protein, 111 aa, Triticum aestivum
  Clone ID: PAT_TA_48987.pep
TTHYRISCPPRVPPPACGSTPGLLAVYTCECWRRRKISLRIKQSEKWKHELLHTLRTTVIRRKPYPRPSHYLLLTGDRPYARPSPSPSPTLRARCRQTEIWTARSSTCASA

SEQ ID NO: 154570 - protein, 121 aa, Triticum aestivum
  unsure (1)..(121): unsure at all Xaa locations
  Clone ID: PAT_TA_48988.pep
TRHAYGADILALMASDAVWLTKGPFWELTLGRHDRIVSISNETNQLPPATVNLNELTQIFDGKNLDSNDLVVLYDRHTIGTWHCFCLSHRLYNLTGRVNPHXDIEHTLEREHMANLTNKGT

SEQ ID NO: 154571 - protein, 82 aa, Triticum aestivum
  Clone ID: PAT_TA_48989.pep
HQIPSFHVYMLVWIQRNQIILVRLRATQINLESCHCHVADPFGVKSCAHSSIDFCSCMCLCFALKGKMAFLPFPCGFGWVSA

SEQ ID NO: 154572 - protein, 91 aa, Triticum aestivum
  Clone ID: PAT_TA_48990.pep
TCSSVLGNAPIWFRILHLILYLHAYHSALQSSYICFHPSIIHTPSVPNSSSHAYSLRSELHVARMHVSRCILVLETTISVASNLNREGRVR

SEQ ID NO: 154573 - protein, 118 aa, Triticum aestivum
  unsure (1)..(118): unsure at all Xaa locations
  Clone ID: PAT_TA_48991.pep
MGRVIRAXRKGAGSVFKCYTHHRKVPVRVTXLDFGERNGYLKGVLTDVIHDPERGAPLSNVTFRHPFRYKHHNELLVVDEGMYTGQFVYCRRLATLSRRIVLPLRYVLGGDVICNVVH

SEQ ID NO: 154574 - protein, 94 aa, Triticum aestivum
  Clone ID: PAT_TA_48992.pep
YTSDREGLMSPQTETKAGAEFNAGGNDYKWTYYTREYETKDADLQAAFRVSRYCCVATEETRAAVSAESCTGTWTTVWTDGLTNMDRYKGRCSH

SEQ ID NO: 154575 - protein, 75 aa, Triticum aestivum
  Clone ID: PAT_TA_48993.pep
GMLLLLAVPTTVDDTLKKHPAGARTCGRVFTSLSRSGTLCENTCQPLTYHVGAGACAQQTRGNTSQRHGAYAWRV

SEQ ID NO: 154576 - protein, 121 aa, Triticum aestivum
  unsure (1)..(121): unsure at all Xaa locations
  Clone ID: PAT_TA_48994.pep
MATAYAPAMASHVMKSCLLSCKPRDLDRASLTKTPRFVLNVTKYDKGTYHVGQPIYRDPFIGSLETHGTSSHLVAXYLCNLHAYRTVVSLLLRGIQDGLEHGYLLVRRFALTRLFRNTPFH

SEQ ID NO: 154577 - protein, 119 aa, Triticum aestivum
  unsure (1)..(119): unsure at all Xaa locations
  Clone ID: PAT_TA_48995.pep
ALQTVQPEVGFSGRNSTARGAVYGADLTSPSLFSIALRLPAQAVVAGGGAXLTICQLMPEQYKHMLGGPSLKVDPHTGATVEGGLTLHMTCAXLCIIVKGHLNRIVKTGMLSVYTDSLD

SEQ ID NO: 154578 - protein, 57 aa, Triticum aestivum
  Clone ID: PAT_TA_48996.pep
VTKNYHLGTKFHFRPGKFLITSKRQGMHHCLQVCLAGWSAAFRYLSFLGIVGMEYYD

SEQ ID NO: 154579 - protein, 50 aa, Triticum aestivum
  Clone ID: PAT_TA_48997.pep
ASPHPLPSKPQPLLPFPPAHAVTQAMAKQKLGVRDASSPSSSMSLLLRPS

SEQ ID NO: 154580 - protein, 104 aa, Triticum aestivum
  Clone ID: PAT_TA_48998.pep
MAATKLSSGHEMPAVGLGVWRMDSAAVRGLIHSALRAGYRHFDCAADYKNEAEVGDALAEAFQTGLVKREDLFITTKLWNSDHGHVVEACKDSLKKLQLDNLDL

SEQ ID NO: 154581 - protein, 138 aa, Triticum aestivum
  unsure (1)..(138): unsure at all Xaa locations
  Clone ID: PAT_TA_48999.pep
IHHSKDIIATGGIDTNAVLFDRPSGQVLCTLTDHSKKITSLKFVPRDELLITGSADKTVRVWQGNEDGSYGCRHTMRDHGAEVEAVTVHASQKYFATAFRDNTWCFYDIXTGSCLTQVGEAYGQDAYTXAAFHPGGPI

SEQ ID NO: 154582 - protein, 55 aa, Triticum aestivum
  unsure (1)..(55): unsure at all Xaa locations
  Clone ID: PAT_TA_49000.pep
IVDSNYLHSPHEKGYLNCHADGNFNKSKIYNIASTLVXLDTLGNKNYEKLHHTNH

SEQ ID NO: 154583 - protein, 133 aa, Triticum aestivum
  Clone ID: PAT_TA_49001.pep
PPDPPPPSTSRRRLRDPPSRATPQPAAARHPQLAAARHPATPSPGAGQRPAPSPWRRPPTAPVPPWRRPQFTPCPPLAPAAVQPPSSPSAGRHPLHPHMAPAAPSSPGVGHRQIFCCGATSLGRQGGDSDDFN

SEQ ID NO: 154584 - protein, 140 aa, Triticum aestivum
  Clone ID: PAT_TA_49002.pep
HVLNNKREFPLASGVEDLLVISIGSGEGEQRPAVGTGGASTSEIVRIAAEGVSDMVDQAVAMAFGHNRTSNYTRIQAMGSPRGGRCAAAAAKGCVAAEEMLSQKNVESVLFRGKKLAEQTNAEKLGRFAHELVKEHDPPR

SEQ ID NO: 154585 - protein, 95 aa, Triticum aestivum
  Clone ID: PAT_TA_49003.pep
ISAMDAASLMGSSSTDARTDGEHRMGITIMGVCYDGGVLAADTQDQHRYPPPSRIQQQRLGQGRRWRIGHPIPPVVDQTEGVIKSSRSGGRDFYC

SEQ ID NO: 154586 - protein, 104 aa, Triticum aestivum
  Clone ID: PAT_TA_49004.pep
MGLDYYKILGVDKAASDDDLKKAYRKLAMKWHPDKNPTSKKEAESKFKQISEAYEVLSDSQKRAVYDQYGEEGLKGQVPPPGAGGGAGGPRGATFFSTGADGPT

SEQ ID NO: 154587 - protein, 99 aa, Triticum aestivum
  Clone ID: PAT_TA_49005.pep
MAAGALGLALVAAFALALAGANSEGDALSALRRSLRDPGGVLQSWDPTLVNPCTWFHVTCDRDNRVTRLDLGNLNLSGHLVPELGKLEHLQYLELYKNN

SEQ ID NO: 154588 - protein, 133 aa, Triticum aestivum
  unsure (1)..(133): unsure at all Xaa locations
  Clone ID: PAT_TA_49006.pep
STSIRILLLTSPDPNRARESKGRKKEISPSATPNPPWPRQRRPSSPPPSRPPRPPPSSPPPRTPPPPPSPPRTRPPRAPXWAVSTTPPSAPSRAPAPGPSSWTAPCSRARTSSPTPPPDFARTSPTYVLTTPR

SEQ ID NO: 154589 - protein, 88 aa, Triticum aestivum
  Clone ID: PAT_TA_49007.pep
MTEGRIQCVRAQQAPMHMVLGVKHRSALYSASEEAPDGDGSLKSALSVFNGNEEHIARKILGVRDTDFVQVDRVQEQSKRLALMRQEL

SEQ ID NO: 154590 - protein, 110 aa, Triticum aestivum
  Clone ID: PAT_TA_49008.pep
MAVLVARQERELQRYSASTGGRIVVGRIQYRVRHGGGEDEVQLEVLVIRSQKGHGMMFHKGGWELHEYMDDARRREALEDARLRGEIGNVLGCWHYQNRRCHTIYEGIMY

SEQ ID NO: 154591 - protein, 125 aa, Triticum aestivum
  Clone ID: PAT_TA_49009.pep
MLCRGGSPGRTEWWCGVTAPPYTTAARVAVSTYPGPTAAASSAPVRTLPPGRTDASCRAPVVVYSPPLTRAAGRGHAKVDRCGRFCRRRAGRELALMVSYAGCLGGADGVRHFNRRGRARREPVY

SEQ ID NO: 154592 - protein, 96 aa, Triticum aestivum
  Clone ID: PAT_TA_49010.pep
SITRIRHPSSIPGGHVMSSSIYSRRLANLGNIIACHPYANCSAAVPALQRPPRHDRAPGIGCAALQRDRVCSLCMHAAPRHFLPPITAVVVIFRSL

SEQ ID NO: 154593 - protein, 104 aa, Triticum aestivum
  Clone ID: PAT_TA_49011.pep
EKSSSQARRVVIESFKLITAFGRQRSKANQTKQRGAAMPGLILNTGGRLANPSSLRPGFACSRHRHRCRAGGFSSSASNSSGCGLRSSWATYYNLYELVGGEPL

SEQ ID NO: 154594 - protein, 76 aa, Triticum aestivum
  Clone ID: PAT_TA_49012.pep
AYEARITCGGNCRSHGEGARVSRGCRPRRKRLGRGPEDEALMVEHRTMEAECYCNGCGTGRKDQIIGYFKWACWSQ

SEQ ID NO: 154595 - protein, 115 aa, Triticum aestivum
  Clone ID: PAT_TA_49013.pep
MSPQTETKAGVGFKADVKDYKWTYYTPEYETKDTDILAAFRVSPHPGVPPEETGAAVAGESCTGTWTTVWTDGLTSLDRYKGRCYHIEPVAGEDMQWICHVAYALHLLEEGCRTN

SEQ ID NO: 154596 - protein, 76 aa, Triticum aestivum
  Clone ID: PAT_TA_49014.pep
RPRVRPRVRTESRGNPSTPACGAPEPESGRDGRRGGRRRPPRAPQGPTRRQGASVRARWRLPRTCSRRLTGRRGTA

SEQ ID NO: 154597 - protein, 98 aa, Triticum aestivum
  unsure (1)..(98): unsure at all Xaa locations
  Clone ID: PAT_TA_49015.pep
MYYFCYCGWAGHTLYTTLGGRVRCEREIKRRTFMVGAGYVPDERDGMSFLNEVKDPRATHNXXAYKVGEHLRYNDDRGPCSTTGKPIYCAIHFMWHRY

SEQ ID NO: 154598 - protein, 96 aa, Triticum aestivum
  Clone ID: PAT_TA_49016.pep
MSPQTETKAGVGFNAGVNDYKWTYYTREYETKDTDLLAAFRVSRYPGVAPEETGAAVSAESCTGTWTTAWTDGHTSLDRYKGRCYHMEPAAGEDSQ

SEQ ID NO: 154599 - protein, 129 aa, Triticum aestivum
  unsure (1)..(129): unsure at all Xaa locations
  Clone ID: PAT_TA_49017.pep
RLTTGYACRPTCTPTRMPYATHGMFPAQDLSHSRDVTXTALSLLPAITGDCYDAAPRELWLLREAPSACTEDSELXQDQGICNNVTRTQARDPTPSVMSPVNELTILARMGEEQQYSRGTSEEDGAHRV

SEQ ID NO: 154600 - protein, 122 aa, Triticum aestivum
  unsure (1)..(122): unsure at all Xaa locations
  Clone ID: PAT_TA_49018.pep
RTEHSTRRDREPNATENTSGMSSYNCNGGKKPEPFGGRGGIQTLTDMNRGPYGYPGAGERGSDCDEPHEYYTGGEKSAMLVQDPTRENNVDXICDQARVMGAQKVSLSYIEGQSSSSTSFAG

SEQ ID NO: 154601 - protein, 63 aa, Triticum aestivum
  Clone ID: PAT_TA_49019.pep
DRIHCLSTLSKWIESMVQLTIPSQLYPLLPVITFSFNGYLSGPPTMSPTAWNIVFAYVTQSKA

SEQ ID NO: 154602 - protein, 123 aa, Triticum aestivum
  Clone ID: PAT_TA_49020.pep
MPPPYSNLSSAHEFALSSPMARANAISTASIVRSLCYQGRPRRSMNGRSSRVVVRADPTEIAFDQKCRAELHAGVEKLASAAGVTLGPRGKNVVLDEYGNPKVLNDGGTIARAIELGNPMENA

SEQ ID NO: 154603 - protein, 104 aa, Triticum aestivum
  Clone ID: PAT_TA_49021.pep
AAVLTAQSNIRKLCVDNEKIGVLMLNLGGPKTLDDVQPFLFNLFADPDIIRVPRACCFLHNPLAQFIFVARAPNSTEGYACISGGSPLRQITDAQGETLMEALC

SEQ ID NO: 154604 - protein, 105 aa, Triticum aestivum
  unsure (1)..(105): unsure at all Xaa locations
  Clone ID: PAT_TA_49022.pep
CCANPPDLNPAVVEGKVVDRFGGIKAYVAGPHDSNDGVLLICDVFRCEAPNLMKIVHKVASSGYFDGVPNFLHGDPCGPENADXRPISMWIKEHTPRKAFEDAKP

SEQ ID NO: 154605 - protein, 123 aa, Triticum aestivum
  Clone ID: PAT_TA_49023.pep
MSDTDEHHFESKADYGASKTYPQQAGAIRKGGHIVIKARPCRVAEVYTCKTGKHGHAKCHFDAIDIFNGKKLEDIGPSYHNCDGRHVDRQDYQLIDITDDGYVSLVTESGNTKDDLKLSTDDV

SEQ ID NO: 154606 - protein, 124 aa, Triticum aestivum
  unsure (1)..(124): unsure at all Xaa locations
  Clone ID: PAT_TA_49024.pep
LCSTLGYPLADSLVDRLLAGCCSSRKLSQVKVLRVDRLFKSDIIRDRIILSENLDKLGEQVKAQDVAGWDSIXCYVNGGRFVPKITIEPWIVDAIRTETDLDXDVHLKIEEPEHGIDDFINASA

SEQ ID NO: 154607 - protein, 95 aa, Triticum aestivum
  Clone ID: PAT_TA_49025.pep
FEYAAYNFWAPPAGRTSSMLYRRGASYIMALLVLSFGAPFDSSSAFTIGCWQTWYGNADHERVCLFPVRSPEFPVSLHRSRALPTSASLSVVHLI

SEQ ID NO: 154608 - protein, 72 aa, Triticum aestivum
  Clone ID: PAT_TA_49026.pep
YRTRIQMLINSKLLHVLKFRSEDAPGYDGNPVCRILYRPPYHCKWDASTRHNLMGNGANINVCANHCVVTCL

SEQ ID NO: 154609 - protein, 98 aa, Triticum aestivum
  Clone ID: PAT_TA_49027.pep
QILHSGLQCQCSDINVSAKILAVTYACHNTRITTYVHVGPISHQIVADDHPIYNDMVACRAFVRQESHRIQEHLQTRSSARVGACFDQHCNTGAVRLG

SEQ ID NO: 154610 - protein, 44 aa, Triticum aestivum
  Clone ID: PAT_TA_49028.pep
PLKALWAIRLIADKGAVVTERVSCRRRGSHGLSRLLRSRESRFE

SEQ ID NO: 154611 - protein, 119 aa, Triticum aestivum
  unsure (1)..(119): unsure at all Xaa locations
  Clone ID: PAT_TA_49029.pep
MSPQTETKAGAGFKAGVNDYKWTYYTREYETKDADLLAAFRVSPXPGVPPEEAGAAVAAESCTGTWTTVWTDGLTSLDRYKGRCYHIERWAGEXDSQWICDGAYPLHLFEEGCSTNMCT

SEQ ID NO: 154612 - protein, 90 aa, Triticum aestivum
  Clone ID: PAT_TA_49030.pep
CCSFRPPFSPLAYSLQLPGGYCMVASIPSATACADSDIRNCRSPPPALLSLFSHYFSVFFSFFSFFSPFLFFFFFFFFFYCNIRRFRTRG

SEQ ID NO: 154613 - protein, 79 aa, Triticum aestivum
  Clone ID: PAT_TA_49031.pep
TIVYGVSTAGGIEVTLLIYTRHSETNATVSLPPFKDWLQTRAAPELARGAVSEVCYTAPWTPARADALTSSHVVQGTTP

SEQ ID NO: 154614 - protein, 107 aa, Triticum aestivum
  Clone ID: PAT_TA_49032.pep
SCTTQAFGCCLCYHIQRHREGLMLPLTVTIVSGVSTAEGIDLKMLFYTQHYETNDTVVLPPLKVRLQSVATLVLARAQLAGLFYIRTWTPAKADGLTWSVRFKGHML

SEQ ID NO: 154615 - protein, 54 aa, Triticum aestivum
  unsure (1)..(54): unsure at all Xaa locations
  Clone ID: PAT_TA_49033.pep
SCTGTCSTGWTDXLTNMDRCKGRCSHMERCGSKNTAMTSGLMLCMTPIGRGMQL

SEQ ID NO: 154616 - protein, 92 aa, Triticum aestivum
  Clone ID: PAT_TA_49034.pep
GLAGLPPLLVRSTSWPIAVGAKKIVLGHRGTAEQHAFVPREARGAILLLGKGVAPLHPNEGHDGATHDSEAMAASYSNAVGRPWILAAVRLG

SEQ ID NO: 154617 - protein, 72 aa, Triticum aestivum
  unsure (1)..(72): unsure at all Xaa locations
  Clone ID: PAT_TA_49035.pep
MTVGLQIGVIGDVTLSTACXDAIVICNKGIISTLGYPFDTTFTSWHLMMTYCTLTCGTTRTSTGAYRKRWTY

SEQ ID NO: 154618 - protein, 92 aa, Triticum aestivum
  Clone ID: PAT_TA_49036.pep
MMSRKALNYQELNENVKNVLHAVHGELYLRAFHLQKEGMTIIFTNVDNRHALHQNPLTLPRHVVALCHDLFLLDDPNVGLIFPADCIERANH

SEQ ID NO: 154619 - protein, 59 aa, Triticum aestivum
  Clone ID: PAT_TA_49037.pep
FHLRIQALERQLPLTYLKLRSTAGRYEHKNMTCCQYHEAYMTVMLKMYRVGLHLEVPFI

SEQ ID NO: 154620 - protein, 52 aa, Triticum aestivum
  Clone ID: PAT_TA_49038.pep
QREQPSNDQEHARVTRYEGIKNVETLDEWSAVFTEAILKLVSYLSRLQGGQH

SEQ ID NO: 154621 - protein, 47 aa, Triticum aestivum
  unsure (1)..(47): unsure at all Xaa locations
  Clone ID: PAT_TA_49039.pep
PHALNLKPLMLPXHVVALCHDISLIDDGNVSFIFSDYCMGWTIHLLL

SEQ ID NO: 154622 - protein, 58 aa, Triticum aestivum
  Clone ID: PAT_TA_49040.pep
LTSERRPTVWLLTIGKAPHPVTAVCRNVKTILTCLVSRPTNMIHLLVHENTFALILTF

SEQ ID NO: 154623 - protein, 82 aa, Triticum aestivum
  Clone ID: PAT_TA_49041.pep
KGGRNPPGYGVDERAACISLGVRRGGGNPSPSRTRSGRSGSLRRAAGKGSPSRRWCYRKRKQKRESKVSYACAYAWVDTLTL

SEQ ID NO: 154624 - protein, 84 aa, Triticum aestivum
  Clone ID: PAT_TA_49042.pep
SMCPSSPALHVRASCLCTCHMLESKSVQPVEHVLVQDVATAASPTFLWSQHNSSISFIMLAVEKHLKFHTLSCSKTTYNSYCQR

SEQ ID NO: 154625 - protein, 75 aa, Triticum aestivum
  Clone ID: PAT_TA_49043.pep
SGDMFHEHCIHCSIYVVVSWPKRFKFAPYFPLVAVSVCCKVASGCSQHPVISLPPLCLACINLSVIAVLAAFKPC

SEQ ID NO: 154626 - protein, 73 aa, Triticum aestivum
  Clone ID: PAT_TA_49044.pep
SVICHITVIFLISVPSHESPSHAFGPPICVCAQYLGCVDILHAPLSRECALSTISLSSVKTPKRKIPIFLYSS

SEQ ID NO: 154627 - protein, 56 aa, Triticum aestivum
  Clone ID: PAT_TA_49045.pep
GLRPDDLAVPLTFLLTRLTHKWRGGYSFRGAQLIIYMVPTVAFLVTGADLFPIAID

SEQ ID NO: 154628 - protein, 57 aa, Triticum aestivum
  Clone ID: PAT_TA_49046.pep
STPGYKRHGRTEFHSKEALPVKDDVPQDFFGFHREPDAFVFSFIGARHCTSISMHGW

SEQ ID NO: 154629 - protein, 89 aa, Triticum aestivum
  Clone ID: PAT_TA_49047.pep
ANTTRYGVSGSAHAYAKNVHPWDRHIRIYHTNQTPPDLHRKTYSHGSRDATGSRLPGLPALYLLAYPIAAYATAVRVLQEEPRYRRQPN

SEQ ID NO: 154630 - protein, 41 aa, Triticum aestivum
  Clone ID: PAT_TA_49048.pep
VIVPFHTHIYIVGCQCKILNTCYSIRIFDHGYKVQKHDSPQ

SEQ ID NO: 154631 - protein, 116 aa, Triticum aestivum
  unsure (1)..(116): unsure at all Xaa locations
  Clone ID: PAT_TA_49049.pep
NLGYIAPLIKTQILVYTLTGKNINLGDDSYGTIHNPRGKIHHHDGLRPGXHRWIGGDKHLAAGLALPYYNIQGXSNLDLVLKLEGGLHIFGNTVTGKNINLDDESYHTVHNAGGRI

SEQ ID NO: 154632 - protein, 144 aa, Triticum aestivum
  Clone ID: PAT_TA_49050.pep
MDPTVMAFLDTYVAPCQGLKATVGLTISRRYSSAGLSSVSNGGRIRCMQVWPIEGIKKLATLSYLPPLYTEALLKHVDYLIRCKWVPCLELNTVGFVFREHNNYRGYYDGRYWTMWKLPMFGCTDTTQVLNEVEEVKKEYPDAY

SEQ ID NO: 154633 - protein, 107 aa, Triticum aestivum
  Clone ID: PAT_TA_49051.pep
DAWACLLYLSTYPEGYLFLKEDLVKQWVAEGFICANEGEDMEEVAKRYFDELVSMGLIQLMDINCNYELFSYSVHQLVLDLITYKSIEENFITVVDYSQTTIPLNDK

SEQ ID NO: 154634 - protein, 64 aa, Triticum aestivum
  unsure (1)..(64): unsure at all Xaa locations
  Clone ID: PAT_TA_49052.pep
MAQTRPDDHTGEGLPGPFDAFAADNITYLHEHSGVIGHISASSTLXNEMMPTPQTYCHGDCWAK

SEQ ID NO: 154635 - protein, 65 aa, Triticum aestivum
  Clone ID: PAT_TA_49053.pep
DLEVHVSPVEEEERRAAPQQRTAQLLLNGGWWADDAPLSRTALLLMRAEGRNARGLRCIGMRGPA

SEQ ID NO: 154636 - protein, 73 aa, Triticum aestivum
  Clone ID: PAT_TA_49054.pep
SSGRSTRLHSVSCRSNNVLSQSTSCTSSNYLDGSQSLHFVVPCCSSSRQSSIMLPLYHTDSHNRAMKNAPSIP

SEQ ID NO: 154637 - protein, 107 aa, Triticum aestivum
  Clone ID: PAT_TA_49055.pep
MRSPVPAMLTGPSAAAAGDKPLPVARCNTTAAALHATVDSNRRDVIADTGVEAALLLPLWPHRTRAASDDEYLADTTEVIGKVRATINMDKTDPTVADAVTELREMC

SEQ ID NO: 154638 - protein, 67 aa, Triticum aestivum
  Clone ID: PAT_TA_49056.pep
TRTRTRTPTRTNARYNAEKITIDRAVQSMLYESSWMLLMNTMCKQVNTPQGRINGGNQDLTLSCNAC

SEQ ID NO: 154639 - protein, 72 aa, Triticum aestivum
  Clone ID: PAT_TA_49057.pep
FLSILSHSSSGCFVHGTSFESSLLSTCYFNRVTSVVSSCFQSMHFNKFILFSSGQHQQCHLGYFHFTLSMTP

SEQ ID NO: 154640 - protein, 88 aa, Triticum aestivum
  unsure (1)..(88): unsure at all Xaa locations
  Clone ID: PAT_TA_49058.pep
MVTHNIMLRAIQAIGSHXRVLKFVCLLHITGAKPDILPVEFPSLMLISPAXIEVRGFESSTVVDIVYCKRKNACGLXLWNTTHHTVYD

SEQ ID NO: 154641 - protein, 124 aa, Triticum aestivum
  Clone ID: PAT_TA_49059.pep
TRETLTLVAAPNAAGRLVWTRPHASGCLLSSRTHPFPTRRIMTTSALPHHLYQHHHSLTRSYIHTTVSPRRLLSTPRSCRGKSCEYRVLGLSPTQYIVARSTVTPASYCRTADRDARCSTQHGS

SEQ ID NO: 154642 - protein, 62 aa, Triticum aestivum
  Clone ID: PAT_TA_49060.pep
TLRQPYYNKLQYTYTPLILYADIDLCSFKNTLMYLNIICSEWDLLSESYSLAPVFNDNITFY

SEQ ID NO: 154643 - protein, 101 aa, Triticum aestivum
  Clone ID: PAT_TA_49061.pep
DSNLHPAVPARAAPSQSSCATFGRLRLKGYGRCHAPQPLLPLCTLPVLTLWVRLAAARMLSSHGHSPTSRCLYGCMVSDLQAEQHAKTWSCYLLAPWTRGR

SEQ ID NO: 154644 - protein, 100 aa, Triticum aestivum
  Clone ID: PAT_TA_49062.pep
LGRHPLHLGRIALPHMPPSSSSQLTPATPVVLSAHDTDETDTAGVAGYTVCRKGKRRSTAAVEKWKARARRRPSHVGITSFADALACGSRYLRILPSMRA

SEQ ID NO: 154645 - protein, 109 aa, Triticum aestivum
  unsure (1)..(109): unsure at all Xaa locations
  Clone ID: PAT_TA_49063.pep
FKSHREGLMSPQTETNVGGGSKAGGIDYKLPYYTPHYETNDTDMLPPFKVSLQPVVTLVLARAQLAALFYTATWTTAKTDGLTSLDRFKXTCYDIWPDVVDDTQWIRVQ

SEQ ID NO: 154646 - protein, 59 aa, Triticum aestivum
  Clone ID: PAT_TA_49064.pep
SQRPWMSMLSVDHSASAFDPDNQPKCAITIFQGNEVLVYLHQSMIACFIIGLIVFCSAF

SEQ ID NO: 154647 - protein, 109 aa, Triticum aestivum
  unsure (1)..(109): unsure at all Xaa locations
  Clone ID: PAT_TA_49065.pep
MLPQTETNVGGVFKAGVKDYKLTYYTPDYETKDTDILAAFQVSLAAVVTPVQARAAVAAQFYTGTWTTAKTDGLTCLDRXYKGQCYDIWPVAMEYSQWIWYVAHTFDLF

SEQ ID NO: 154648 - protein, 71 aa, Triticum aestivum
  Clone ID: PAT_TA_49066.pep
YYTQSHYRLCGPPTVPDPPGRPAPPIRPHMRTVGGDEPAGDVILEEHWLDHLHDVTGPLLTEVTCTRSHSG

SEQ ID NO: 154649 - protein, 69 aa, Triticum aestivum
  unsure (1)..(69): unsure at all Xaa locations
  Clone ID: PAT_TA_49067.pep
MACGIFPLIVLNADSLFTGSYCVHCPRMKVLSLTLIYTILIAELICIASHPXIDLPLLFDKACNGSFLL

SEQ ID NO: 154650 - protein, 86 aa, Triticum aestivum
  Clone ID: PAT_TA_49068.pep
VPELHDRSMRWVRHTPRNITAWGELRGKGNNGNVEGVRVCHVDERDPDDVVHVGGKGIVQSSRHHFLGHGVQQPPAFQDKHVLIYE

SEQ ID NO: 154651 - protein, 109 aa, Triticum aestivum
  unsure (1)..(109): unsure at all Xaa locations
  Clone ID: PAT_TA_49069.pep
GGPISRGDGRPPTDIIKTACANTHPIFTNNKLTVTHFGXPQGLPINSMSYGTRXSKKLKEPCSKEIKNGRMAKPPETDAWIQAEDTGTDPINNLFSHLVDPSHANIWRS

SEQ ID NO: 154652 - protein, 96 aa, Triticum aestivum
  unsure (1)..(96): unsure at all Xaa locations
  Clone ID: PAT_TA_49070.pep
MARFNSKAXMAAAVLPSVVLMMAGWAASSALSCGPVHSKLAPCVTYATARASSFTKECXSGVHGLYGMGPIRSYRTISCTCIKSLATSIKSINMGK

SEQ ID NO: 154653 - protein, 68 aa, Triticum aestivum
  Clone ID: PAT_TA_49071.pep
TNPSGDCCNRVTKLLDLARCTVYTQASCTSLTSVFGGLNPNKAARIPSNCWTSVPYTNRSFVDCFNIH

SEQ ID NO: 154654 - protein, 63 aa, Triticum aestivum
  unsure (1)..(63): unsure at all Xaa locations
  Clone ID: PAT_TA_49072.pep
DVLSYKALRXAIQKQDLPILTTYTKTEQGPTHGIQLERDKLYNHGRALSGRTMKPQVIRFYKN

SEQ ID NO: 154655 - protein, 67 aa, Triticum aestivum
  Clone ID: PAT_TA_49073.pep
MAHPAMGSWAHTVSPLDGLKSTAGLPFGLGYRSSPCRVSHGGGLRSMRPWPTWDIYTLRTLCHMAGA

SEQ ID NO: 154656 - protein, 80 aa, Triticum aestivum
  Clone ID: PAT_TA_49074.pep
RRGVPTQNTRLDLRVHDEDLGSIAGRATTIHTMVLIQADHFLQDVANTCKRVTEQAYQHVQPEHIERIREAQHEKIVSEV

SEQ ID NO: 154657 - protein, 38 aa, Triticum aestivum
  Clone ID: PAT_TA_49075.pep
MRPTHSYNLTEYAQTPGFCWGQIKMNCAGSFRAPNLQT

SEQ ID NO: 154658 - protein, 83 aa, Triticum aestivum
  Clone ID: PAT_TA_49076.pep
MAMNNCCITMKFPNTPPMPGLGVLSCPEDGQDRNASLTCSRPNAVSATDQSTPEPAIPHHTKHTHDSDAPYYVALPKFEDCFL

SEQ ID NO: 154659 - protein, 76 aa, Triticum aestivum
  Clone ID: PAT_TA_49077.pep
PMRSAKHLKGLHAPLSLYTAARALVMIRWHRCVATAHHEDGRHVGRPPPVTAPRKGKYEYADDVGERIKRFHARCQ

SEQ ID NO: 154660 - protein, 51 aa, Triticum aestivum
  Clone ID: PAT_TA_49078.pep
ADVARRSYEYCEFDQGVSASKVTGNQAIQSMYDVSQSCCIHIPQDAPLAGQ

SEQ ID NO: 154661 - protein, 49 aa, Triticum aestivum
  Clone ID: PAT_TA_49079.pep
TIGKAGGPTRTDNQIPGSSHTCVETHSTNIGGDHRLGWGETMVYITALF

SEQ ID NO: 154662 - protein, 92 aa, Triticum aestivum
  unsure (1)..(92): unsure at all Xaa locations
  Clone ID: PAT_TA_49080.pep
RTDCNGSAWHRDGTTLRMREDRCYYVINNAYLNLALEHDLHIHGYRERNEXKMTDLHETTSIXQFSWGEKNRGWSIHAGRETDAKGNMYPED

SEQ ID NO: 154663 - protein, 53 aa, Triticum aestivum
  Clone ID: PAT_TA_49081.pep
RAHVGWHSGGGTSKRWIAKLTSDMTLKVSMVNHVSYLPNAYPYGTLYDESIDA

SEQ ID NO: 154664 - protein, 41 aa, Triticum aestivum
  Clone ID: PAT_TA_49082.pep
SQFETASHASSDTSRTSHILAHDMSHSISIGFHQTAIIALA

SEQ ID NO: 154665 - protein, 109 aa, Triticum aestivum
  unsure (1)..(109): unsure at all Xaa locations
  Clone ID: PAT_TA_49083.pep
MAGEKHQPHLLHLTKEGEDFHPAPDRGVHMYGYSTNTGVTATGNKGKYTRITXEGKHHTHTEHLGYMGTTRGRTFRLYHTHAAKKDPWPAHKPKIEEDVAATRTIRTSR

SEQ ID NO: 154666 - protein, 62 aa, Triticum aestivum
  Clone ID: PAT_TA_49084.pep
MARHGTCKIPVIGATRYMGTHLCPSSATLGHPTLALGRYSRPSNTGTAHLLKTFYDSTVTLL

SEQ ID NO: 154667 - protein, 107 aa, Triticum aestivum
  Clone ID: PAT_TA_49085.pep
KLNPRARSLPAQMNSRGGPTNASTLFHGTTYSSSQHGEQTSACCLPRMSGGESILPPYHMQLSRTRTPRAEAPLASSAGACCSTAAALSSTLLIDCNSLLLNTLKDG

SEQ ID NO: 154668 - protein, 61 aa, Triticum aestivum
  Clone ID: PAT_TA_49086.pep
ESMIVEVADAMLEHAFGSAASPVCGCHPSAFNVFVWLRTYGLTCECGVVTPPRQFPICVFK

SEQ ID NO: 154669 - protein, 44 aa, Triticum aestivum
  Clone ID: PAT_TA_49087.pep
WANTPNAHTHLRSYQRPTTHLPEHLLTDLRLGEGEAPRCAGPRG

SEQ ID NO: 154670 - protein, 53 aa, Triticum aestivum
  Clone ID: PAT_TA_49088.pep
LITPIHWLYLAIDKNECVGACRDEEKCVWMGLSSRRSHVSTYHPSYEDVMLQG

SEQ ID NO: 154671 - protein, 76 aa, Triticum aestivum
  Clone ID: PAT_TA_49089.pep
ATVAAVLIMLTMNSGFPVMFVSSLKADMRMVTTVAESTEYNWGVSHLVAMVVVGSKLRRRRRSRVLDIERKVETQN

SEQ ID NO: 154672 - protein, 35 aa, Triticum aestivum
  Clone ID: PAT_TA_49090.pep
DHIALVKTYGLGPYCTRIKTAMNDIKEMGKMMNYL

SEQ ID NO: 154673 - protein, 58 aa, Triticum aestivum
  Clone ID: PAT_TA_49091.pep
LEYIHNIGILNPYDGSADTRGAGEYGVCVYSIHVQVRRRCQPPHRPRPAPVVGSVGSR

SEQ ID NO: 154674 - protein, 76 aa, Triticum aestivum
  Clone ID: PAT_TA_49092.pep
ITESAGSGSTAPGLWRRCSRKMLVLSLAAMSVDAVSLTHRHLPNRWIVRARTMDYHVEWAAAELRRDLMMSGTLTL

SEQ ID NO: 154675 - protein, 58 aa, Triticum aestivum
  Clone ID: PAT_TA_49093.pep
ETQASTTPCVTVHRRQPTTRREANFLTHWHGTLGGPAYPMALALGGSSTPNMGPCILT

SEQ ID NO: 154676 - protein, 81 aa, Triticum aestivum
  unsure (1)..(81): unsure at all Xaa locations
  Clone ID: PAT_TA_49094.pep
MEGSSIRTPEITIVPAPRPATAGGRGPLDAANVASTEPITPGSPSWASKERTGSVWMPGWKLDXLCTESISATAMMARFLY

SEQ ID NO: 154677 - protein, 128 aa, Triticum aestivum
  unsure (1)..(128): unsure at all Xaa locations
  Clone ID: PAT_TA_49095.pep
MHLRWVSTRPAPCMAEPPEETARAPPPSPGVPGVGATPLSTKPPGMTVAWTQKAGPAGPGWDTTTTSRTLRLVAEDTFMHKELRGRKTADVLSWKDMKTTADVMGGTTTIWLLYEMLGFHXLTMLSHG

SEQ ID NO: 154678 - protein, 36 aa, Triticum aestivum
  Clone ID: PAT_TA_49096.pep
MGANTHPTLASATAQNEYHSTGDGDGRRGGGGRGGG

SEQ ID NO: 154679 - protein, 61 aa, Triticum aestivum
  Clone ID: PAT_TA_49097.pep
QYTSLWYLLATLRCKYMVYSKTVTVPANKVVEESAPSRARIMSMHLGIPPPFEEVPTRHWK

SEQ ID NO: 154680 - protein, 72 aa, Triticum aestivum
  unsure (1)..(72): unsure at all Xaa locations
  Clone ID: PAT_TA_49098.pep
SNTTHYXKTWGRDRTAPQFPYRPTPPATPTPTHYRGGPSERWGSLPFKSPQRVLLHPTLGSTASPTASDPRL

SEQ ID NO: 154681 - protein, 51 aa, Triticum aestivum
  unsure (1)..(51): unsure at all Xaa locations
  Clone ID: PAT_TA_49099.pep
LKNSYRKLSADRTQPKFPNLPTRPQINTYKTNLGGTNKRLKHQXIQYLDSD

SEQ ID NO: 154682 - protein, 28 aa, Triticum aestivum
  Clone ID: PAT_TA_49100.pep
THALSHGGGILTGRDLRRGLIYHTQKLI

SEQ ID NO: 154683 - protein, 50 aa, Triticum aestivum
  Clone ID: PAT_TA_49101.pep
ANRHIHSRLTIRILQISPSSAISMLSELSILLLIPLALCLYSPHFLTRFI

SEQ ID NO: 154684 - protein, 103 aa, Triticum aestivum
  unsure (1)..(103): unsure at all Xaa locations
  Clone ID: PAT_TA_49102.pep
WENHREGLMSPQTETNISGLSTAGGIEYKLPYYTPHYETNDTDILAPFQLSPQPLVTSVQAHAALAALSYTRTWTTAXTDGLTCLHRFKXTCYDIEPVAMEYT

SEQ ID NO: 154685 - protein, 96 aa, Triticum aestivum
  unsure (1)..(96): unsure at all Xaa locations
  Clone ID: PAT_TA_49103.pep
MADAQDIXTLVCHNTTRMVKAGFTXDDAPRTVLPSIGCRTHDTXVMVRMEQKDAYVGDEAQXQHGILTFKTPLSTXIISNWNNMDKIXHHTIYNDL

SEQ ID NO: 154686 - protein, 84 aa, Triticum aestivum
  Clone ID: PAT_TA_49104.pep
LTAKGAAIEQLQLAPLPAIDAGLNPTPTSSLRLPKVQTEPEPGPACVFDHDRPGPDVCPEARATLLECGLRHRKFSLLQAGNSP

SEQ ID NO: 154687 - protein, 79 aa, Triticum aestivum
  Clone ID: PAT_TA_49105.pep
TLNCWADPPLHITVMINWGSHSNMNAEHTLFTSKYSYPALIFLNKPIGYTNTIATDMKRMLQLLEYLQAQLVLTRGGRG

SEQ ID NO: 154688 - protein, 73 aa, Triticum aestivum
  Clone ID: PAT_TA_49106.pep
NVPASPTNGPSRGDYCHARRAGPDDPCERAGRVIRTYHATTAALHAHKRAMHMAHTSETLFATSIPLCATTVC

SEQ ID NO: 154689 - protein, 108 aa, Triticum aestivum
  Clone ID: PAT_TA_49107.pep
FHHGRSGVLLGASLCPPVSSAHTEFAVFIRVVLVIILVLHLVCISDDLRHVLGDERAVLRGRLGLGDLRSRVAALQFRLGVQRRLFPDHGQLPRCWPPHQCSAGVRIV

SEQ ID NO: 154690 - protein, 49 aa, Triticum aestivum
  Clone ID: PAT_TA_49108.pep
SWAAEAYRNLNTLVNTRFRKYENRSYHGVGSLRPSAFLGTTRSTTTGLC

SEQ ID NO: 154691 - protein, 41 aa, Triticum aestivum
  Clone ID: PAT_TA_49109.pep
KKHREGRMLPLAETKTSGRTTAGDIDHKLTDYTPDYETNAY

SEQ ID NO: 154692 - protein, 73 aa, Triticum aestivum
  Clone ID: PAT_TA_49110.pep
TRTNGTTPRVQPHAQTDPGEVNKRRQSPLLLLKLPFTPAPARYHTPYNIDRRMLPHAIHVPPTLWTPAAPRCS

SEQ ID NO: 154693 - protein, 58 aa, Triticum aestivum
  Clone ID: PAT_TA_49111.pep
MISIPINLLKILQTDPLFMKLNTMKSVPVSHYHYILMTNSYTIPLYLEDKYTKRPIFT

SEQ ID NO: 154694 - protein, 88 aa, Triticum aestivum
  unsure (1)..(88): unsure at all Xaa locations
  Clone ID: PAT_TA_49112.pep
SSELLGREEYXGEMQLGGPKIMAVNGVAHLTVTDELVGVTVISKRLIYVHSVCSTGLYPVTETVLKPPGGDLVTYFVRRIYRDAQCRP

SEQ ID NO: 154695 - protein, 32 aa, Triticum aestivum
  Clone ID: PAT_TA_49113.pep
NINFGLYSFARKFQPPLCVILRISGRTCGSNL

SEQ ID NO: 154696 - protein, 60 aa, Triticum aestivum
  Clone ID: PAT_TA_49114.pep
VHAVQASEMESVVAITSKSDQDTRFHHYYVGSTAALPLISVCNPSPPSDNFPVLSFSAEL

SEQ ID NO: 154697 - protein, 50 aa, Triticum aestivum
  Clone ID: PAT_TA_49115.pep
GAAARKTNGALNSPALLTERSKKLRALASRLMKSPPPSVPPPDENSPDAC

SEQ ID NO: 154698 - protein, 41 aa, Triticum aestivum
  Clone ID: PAT_TA_49116.pep
VLSRNHVWFAFSLVQTYSICRDFPRQGTFASLSMPSSIVLW

SEQ ID NO: 154699 - protein, 79 aa, Triticum aestivum
  Clone ID: PAT_TA_49117.pep
GKAAGLHVPHPNSCAHPRFRQCLRSLLGGFYAPGGLAPTNMLTSQLNLLVSYRLSTGSLTAGSQNIVSLFDRFKKKPWP

SEQ ID NO: 154700 - protein, 62 aa, Triticum aestivum
  Clone ID: PAT_TA_49118.pep
PERNDGIDPRDRAMRGRPRGGEGSGGGMVHQDQDRWLEANQLPREQKHGGHQRFPVKNSISV

SEQ ID NO: 154701 - protein, 72 aa, Triticum aestivum
  Clone ID: PAT_TA_49119.pep
RTATELQAKNDAFDLADQKRLREGGWRRRGTPTGGPGRRSWRAQCCAYRTPARRTSSGSLAGREPITAGRTS

SEQ ID NO: 154702 - protein, 62 aa, Triticum aestivum
  Clone ID: PAT_TA_49120.pep
LLEKASMMIRTTGGTAMIVGSTCPRYVSNRVLFLPPNSGETMSYTTGECPGDYETYTNNREL

SEQ ID NO: 154703 - protein, 59 aa, Triticum aestivum
  Clone ID: PAT_TA_49121.pep
EAVWSGLRMSQNPASWGVPAISKAVELAESTEIHRSSPIPSSKGRAGLSIALFEVACGF

SEQ ID NO: 154704 - protein, 49 aa, Triticum aestivum
  Clone ID: PAT_TA_49122.pep
KTRSDNSLTRLNRRPMIWHDRVQKYASCRACTSIRKSISYHGKSTSDFG

SEQ ID NO: 154705 - protein, 109 aa, Triticum aestivum
  Clone ID: PAT_TA_49123.pep
CDGSTHACAGVARLLTSGVHREGLMLTQTETKVGGVTTADGIDHKLLNYTPEYEAKDTVMLPAFKLSPQPVAPSVLAQAQLAALSYTATWTTAWTDGLTCIDRYKGHML

SEQ ID NO: 154706 - protein, 69 aa, Triticum aestivum
  Clone ID: PAT_TA_49124.pep
SFHCFMLSSRVMHMVHPVVKLPVRALTCDLENFWLVLELLRCALMVGFRGVMLRPDHPAPPQSIDRPPT

SEQ ID NO: 154707 - protein, 67 aa, Triticum aestivum
  Clone ID: PAT_TA_49125.pep
WPWRTGPELSDRATHTSTRCITKQQKRKNSRCRAERALVEIVVGGCRASIRLHVLARSYISLHTPFS

SEQ ID NO: 154708 - protein, 104 aa, Triticum aestivum
  Clone ID: PAT_TA_49126.pep
ASHGQCPRRRRRTHDGVGVGFTLHDGGRGGVVHVGHCGHANDGAASTDSRATSASGAIRAMVPEYQGCSSHRCTFLPRVSLHRMHGRTRGSRWQFGSGTPGGQL

SEQ ID NO: 154709 - protein, 52 aa, Triticum aestivum
  Clone ID: PAT_TA_49127.pep
VPHPNARLVPRVRPLMRSTTFSREYTQDRQTLLLAIRDRKGDLTCSASAKVS

SEQ ID NO: 154710 - protein, 107 aa, Triticum aestivum
  unsure (1)..(107): unsure at all Xaa locations
  Clone ID: PAT_TA_49128.pep
VYSKSRNPVALGLRSADQAIRDPPGAWRQVWSLXNVSFTHWFMFRXGTLQSIANMXNRDAKDHGYNVCYNSRAPCMHPMFSLXSSKPEAYLLRMLNGSHDVYVTRAQ

SEQ ID NO: 154711 - protein, 50 aa, Triticum aestivum
  Clone ID: PAT_TA_49129.pep
APSQPWVYKRARLFTVMCLIPAMAASHFVVNTSESVGRFFCTCTVRAGAR

SEQ ID NO: 154712 - protein, 76 aa, Triticum aestivum
  Clone ID: PAT_TA_49130.pep
LSMFFYELDHRVQAVLRLVLTRDSGRSASLVVRESRSVVSRSWCPSPSCLSYHACRVASPFFPPSQPGFQSDPHAW

SEQ ID NO: 154713 - protein, 55 aa, Triticum aestivum
  unsure (1)..(55): unsure at all Xaa locations
  Clone ID: PAT_TA_49131.pep
SNGCGLSKARIQQRIRRMQVXPMEGIKEHASVAYLTPLYTGDLVXHVDYLNGCKW

SEQ ID NO: 154714 - protein, 132 aa, Triticum aestivum
  Clone ID: PAT_TA_49132.pep
NHHLLLEWRATTTAAAGPCPTPTPTSASTAAGPCTPTPPRSATTPACTATATGTDMDTAGQTCTPTPLTWSASTPAGTATAVAAGPCTPTPSTRSASTPAGTGMGMGTDTATATGTTTAGLCPTSPPPRSVS

SEQ ID NO: 154715 - protein, 34 aa, Triticum aestivum
  Clone ID: PAT_TA_49133.pep
VVTHEDLRLTSGRDTGGPIICFGATVFYCIMLHR

SEQ ID NO: 154716 - protein, 89 aa, Triticum aestivum
  unsure (1)..(89): unsure at all Xaa locations
  Clone ID: PAT_TA_49134.pep
MMVIPGDLPPVPYGISQVNIDGYFRGVTGEHQRTLKMYCHTNTNYGMYVLYGQAVLAPVKSKEXYEHWIMDMKWCIRIMDQGHYADFHI

SEQ ID NO: 154717 - protein, 75 aa, Triticum aestivum
  Clone ID: PAT_TA_49135.pep
MSCNCGSGCSCGSYCKCGKMYPDLTEQGSAAAHVAAVVVLGVAPDNKAGQFEVAAGQPGEGCSCGDNCKCNPCNC

SEQ ID NO: 154718 - protein, 81 aa, Triticum aestivum
  Clone ID: PAT_TA_49136.pep
HATTCPHRQLKWPHMVAQEGITVTLMLSLRPNRWCAYTFGALIPNANVPTGSSTASCSGILTWNDNLSPRFHGAPRPLNPT

SEQ ID NO: 154719 - protein, 104 aa, Triticum aestivum
  unsure (1)..(104): unsure at all Xaa locations
  Clone ID: PAT_TA_49137.pep
SPTLPAKLSGGVAVIKVGGASETELEDRHLRIEDAKNATFAVIEEGIVPGGGAVYLHNVTYFPAIKESIXDLDERIGADIIHKVLHAXRSIIVYYSYIKGEVVI

SEQ ID NO: 154720 - protein, 118 aa, Triticum aestivum
  unsure (1)..(118): unsure at all Xaa locations
  Clone ID: PAT_TA_49138.pep
MPPQTETKAGAGFKAGGNDYKWTYYTPEYETKDADILAAFRVSPXPGVPPEEAGAAVSAESSTGTWTTVWTDGLTSLDRYKGRCYHIEPVAEEDSQWICDVAYPLHLLEEGCATNMFT

SEQ ID NO: 154721 - protein, 109 aa, Triticum aestivum
  Clone ID: PAT_TA_49139.pep
LISRASTPATVVAWSCTDRTHGCSLTIYLGRKLLYPVPLAGNDHEESCDVNRVPPLAELHSHQDNSTGKWKDLAYEVHRHQQGICRRYVILPSLHHAPAGDGGLDVART

SEQ ID NO: 154722 - protein, 109 aa, Triticum aestivum
  unsure (1)..(109): unsure at all Xaa locations
  Clone ID: PAT_TA_49140.pep
MSPQTETKAGAGFKAGVNDYKWTYYTPEYETKDADIQAAFRVCPHSGVPTEEAWAAVSAESCTGTWTTVWTDGLTSLDRCKGRCYHIEPAAXEHMQWICYVCYPLHPFE

SEQ ID NO: 154723 - protein, 91 aa, Triticum aestivum
  unsure (1)..(91): unsure at all Xaa locations
  Clone ID: PAT_TA_49141.pep
MGMIKIGIIGFRGIERLVNRVVLKSDDAHLQGVNEQCITTDYMTYMPMYDTVHRHXHHNVLKLKDDMTLLCDENPGPDYGVMNPEEIHRGE

SEQ ID NO: 154724 - protein, 101 aa, Triticum aestivum
  Clone ID: PAT_TA_49142.pep
MVHGTLEVLLVGAKGLENTDFLCNMDPYALLKCRSQEQRSSIASGKGSNPEWNESFVFTVSDQATELVIKLMDSDSGTSDDFVGEATIPLEAVYTEGSIPP

SEQ ID NO: 154725 - protein, 82 aa, Triticum aestivum
  Clone ID: PAT_TA_49143.pep
MDDALTTGSIRSTDGEKKRLAKASLAYNCESKNCPHFRKLFPEYVEKYNQQLEKEQTGAEPEPQENPAPAPSPCRVQQAAAM

SEQ ID NO: 154726 - protein, 106 aa, Triticum aestivum
  Clone ID: PAT_TA_49144.pep
HASAHASAHASEKASAKSVEVYEASRDAIIPHFVKFKEVSDPYFQEAKKISKPYIDQVAEVTKPHVEKVRSTLKPYTKRAVHVYGTFLESATTYHRQHEEAEEIAS

SEQ ID NO: 154727 - protein, 104 aa, Triticum aestivum
  unsure (1)..(104): unsure at all Xaa locations
  Clone ID: PAT_TA_49145.pep
MLGYQLARTELDTLLRTFQDGIHQLQTKFXEHPTPIDYQYFKKAIASKVVILHKGAHDNSEIPIHGDSXSPEYTPMCYPLLFXMHEADRTSVNGSERIKEDISE

SEQ ID NO: 154728 - protein, 108 aa, Triticum aestivum
  Clone ID: PAT_TA_49146.pep
MVKAYLRYEPALCFGVVAFPKSNVVHDPCGRRLLAGALDRFAAWDLKRGLPFATLTPYSFSAFLDVYCVVFFPAAGCVFGSSVASGHADGSIMLWDAHTGACEATLHG

SEQ ID NO: 154729 - protein, 52 aa, Triticum aestivum
  Clone ID: PAT_TA_49147.pep
AVPIRISGRRSGRLNVQDIKESAQPDVRHEISQRVKPMTEVPTVPYCCGSLP

SEQ ID NO: 154730 - protein, 54 aa, Triticum aestivum
  Clone ID: PAT_TA_49148.pep
QCGSSAVTQGTTPEICTWKLDISLITDLGDPAASVQANGLTTLKILRTRGRTSG

SEQ ID NO: 154731 - protein, 55 aa, Triticum aestivum
  Clone ID: PAT_TA_49149.pep
YDGTQLVSQSFTVSLQIAPSNGTGSTQASTLTCVRRPRERRVSDFHRVHRHTSLI

SEQ ID NO: 154732 - protein, 85 aa, Triticum aestivum
  Clone ID: PAT_TA_49150.pep
ASVSTTLSPVFCISSCSSVYVPVDVLSNSCYIVMYCPPFEYYFVIVSTFLDKKKKKKYNTNLKKGGCYKSIRGGRSKGSKLTSGG

SEQ ID NO: 154733 - protein, 57 aa, Triticum aestivum
  Clone ID: PAT_TA_49151.pep
QCSTLRRLSGCSRSTYSKSGVGDEHVPGQESCRHRTSLQAPISSASAVFSGALSGCE

SEQ ID NO: 154734 - protein, 55 aa, Triticum aestivum
  Clone ID: PAT_TA_49152.pep
AYMVGSMVDQAVLIWLLHCPPPIVPSGCTLTNYLGMNLMKLCDLLLITNIARVLM

SEQ ID NO: 154735 - protein, 74 aa, Triticum aestivum
  unsure (1)..(74): unsure at all Xaa locations
  Clone ID: PAT_TA_49153.pep
MSCCAGNCGCGSGCTCRYSCGGCTMYTEMDXGVNTAWETLIMGVAPSTDTPCFEATAHNGGCKCGHNCSCNQST

SEQ ID NO: 154736 - protein, 64 aa, Triticum aestivum
  Clone ID: PAT_TA_49154.pep
CCPRHPARYPLIMWCRQVAVGQRSLDLADSATSTELSYSALARRCTRFSINIRSVTARSLAITQ

SEQ ID NO: 154737 - protein, 38 aa, Triticum aestivum
  Clone ID: PAT_TA_49155.pep
SHTENGRSPTLLAYLLSQTFHPSTLHTHAHIPLLLYRP

SEQ ID NO: 154738 - protein, 106 aa, Triticum aestivum
  unsure (1)..(106): unsure at all Xaa locations
  Clone ID: PAT_TA_49156.pep
ALASLAPTNMLATQLNLLVSYRYSTASPTAGTQNIAXIFDRSKKKPAXSHSPPXLATCSVLIDDXLCKWYCSDRRIYLPNCILDRSEAPDFLTXEGAGDYRYDPFG

SEQ ID NO: 154739 - protein, 77 aa, Triticum aestivum
  unsure (1)..(77): unsure at all Xaa locations
  Clone ID: PAT_TA_49157.pep
MRKWSLSCALQLIIFMTTLRKAAKKLQTNAKESRNXGPDFMNGEETLGAVTDGSSTDSEVAQRASVTSSRNTPRNSG

SEQ ID NO: 154740 - protein, 94 aa, Triticum aestivum
  Clone ID: PAT_TA_49158.pep
CWAYRHTRSHIIIGLPLITEILHLEILIPSFIRFISARPDRVRSTLVQGEELRVEHIGSWRRDTYGVRLLLGMLSLLAITTRGHTDADERNQSE

SEQ ID NO: 154741 - protein, 62 aa, Triticum aestivum
  unsure (1)..(62): unsure at all Xaa locations
  Clone ID: PAT_TA_49159.pep
KGILLVNMPALLGGTRHMPAATAVNCTGWICAALSWGXDAYTYRHSRWKRHSHLWSGALDYG

SEQ ID NO: 154742 - protein, 92 aa, Triticum aestivum
  Clone ID: PAT_TA_49160.pep
LNLLWWRTPGLSPYVLRAHTALGTKGLSYNYLSEDRWCTSELLISFNPVYKKVTVLIYNSTSVSQSVLILEYLDYSVGIARNGKPILSGDPF

SEQ ID NO: 154743 - protein, 77 aa, Triticum aestivum
  Clone ID: PAT_TA_49161.pep
EKRWVPRPINWKKGAIKKSQGVEMKGQKLGTLRPNARNLKNGPPKILPLYFFIFFSFFFFFFFYFYITTSFFFSHAS

SEQ ID NO: 154744 - protein, 51 aa, Triticum aestivum
  Clone ID: PAT_TA_49162.pep
LRHVVHCTKEATGQLVLLIVELQAPSPSVHSTAARTMQIWSRAGIIFSVDL

SEQ ID NO: 154745 - protein, 66 aa, Triticum aestivum
  Clone ID: PAT_TA_49163.pep
MPAPAGEEDKNPSSASGKGSIAHMNLKAKGQDGNEGIFRMKRSTDMKKLLNAYCNRQTVDMKATGI

SEQ ID NO: 154746 - protein, 74 aa, Triticum aestivum
  unsure (1)..(74): unsure at all Xaa locations
  Clone ID: PAT_TA_49164.pep
MALILMGSSATSVSPLEGXKSTLGLPVRLRSKGSSLCRCSNCGGIRCLQAWPIWGIXNLKTLSYMRTIRSDALL

SEQ ID NO: 154747 - protein, 44 aa, Triticum aestivum
  Clone ID: PAT_TA_49165.pep
ACRTAEASCSPSFWCKGSIMPLPMLLPWPDSEADIHLAIPSHLQ

SEQ ID NO: 154748 - protein, 46 aa, Triticum aestivum
  unsure (1)..(46): unsure at all Xaa locations
  Clone ID: PAT_TA_49166.pep
MSGCAGNCGCGSRCTCRNSWGGCTMYPEMDXGVNTAWETLIMSAAP

SEQ ID NO: 154749 - protein, 100 aa, Triticum aestivum
  unsure (1)..(100): unsure at all Xaa locations
  Clone ID: PAT_TA_49167.pep
MAHAVMASCATTVXPLHGLKSTAGLPVRLRYRXSLCSGSNGRRIRCMQAWPTEDIYKLKTLCYLPTICTDALVXHVYYLIRSKWVPWITFSKAGSTTGEH

SEQ ID NO: 154750 - protein, 48 aa, Triticum aestivum
  Clone ID: PAT_TA_49168.pep
TVDRIQPTARLEGSFLAAWRGTLGAPAYPMSLALGGARTPNMLPCSLT

SEQ ID NO: 154751 - protein, 76 aa, Triticum aestivum
  Clone ID: PAT_TA_49169.pep
NSHCMWIASIFSRKMSMRASMFDQPSACRLVDGRGAIGFQSSRGCRRQSRSWSGRAQTVHTNSHCDLHSGGCGSAL

SEQ ID NO: 154752 - protein, 96 aa, Triticum aestivum
  Clone ID: PAT_TA_49170.pep
AGHSRRRTSTRRSSVRHTELERAVITTAPVGRKRGTNYQMSWEWRVHRRRTPRSPWWLRRQLTIHGTMCMVRRRPWWCQMRLSTHSTMCSARQCPW

SEQ ID NO: 154753 - protein, 56 aa, Triticum aestivum
  unsure (1)..(56): unsure at all Xaa locations
  Clone ID: PAT_TA_49171.pep
MLTAIVRGLNKHLTRLNDLSHWMHDKLVTTSASKPLXCSYMGTDCLTLILIVKNRL

SEQ ID NO: 154754 - protein, 73 aa, Triticum aestivum
  Clone ID: PAT_TA_49172.pep
MRDGPCLLLLTSQLPGVAAGMLLGATDAAASCGMDSSALSTCMWYARGNGGDPSADCCTPVRSIASSSRCTAV

SEQ ID NO: 154755 - protein, 65 aa, Triticum aestivum
  Clone ID: PAT_TA_49173.pep
TRTRGCPLSSHRMLELLSLAYHNRVWHLTDRIPNTRLLFARSISEHQTTSFRKVLYATNRALQSC

SEQ ID NO: 154756 - protein, 63 aa, Triticum aestivum
  Clone ID: PAT_TA_49174.pep
WRGCSCISGRPPNQGLADRAPWAESRYRPRSIERGARLPGAYHPSELRHHLIDALCQPEPPSH

SEQ ID NO: 154757 - protein, 58 aa, Triticum aestivum
  Clone ID: PAT_TA_49175.pep
SPPRTKDRCWLTASSLSTADIAVQLPYWVPKKVGHTASQLSNEIRSVTSRLHLRKCGR

SEQ ID NO: 154758 - protein, 65 aa, Triticum aestivum
  Clone ID: PAT_TA_49176.pep
MYLFMLRMRTNERIYWQRMHSEKYKNGQDLMYARDITRTICDVHNGLSVESSPLLLLAIQRLNSG

SEQ ID NO: 154759 - protein, 78 aa, Triticum aestivum
  unsure (1)..(78): unsure at all Xaa locations
  Clone ID: PAT_TA_49177.pep
AAFAASIDSGLTLFDTGVLYGSSLIASGNSKSLLRDLITERTHLGAVDVTADTTFAALPXRFGRSTVLSALKKSMKRL

SEQ ID NO: 154760 - protein, 57 aa, Triticum aestivum
  Clone ID: PAT_TA_49178.pep
RTEILNYPIEPRVRNPYPCKKVVSLYLMHLARTCPYAPKPGSKNLCRCSMPTRIRSM

SEQ ID NO: 154761 - protein, 60 aa, Triticum aestivum
  Clone ID: PAT_TA_49179.pep
ATTACELEQASELDRLAELIVYEDSLPCLMHAMRKQVTAPQEQQALTGHDSVRRMGHNGR

SEQ ID NO: 154762 - protein, 87 aa, Triticum aestivum
  Clone ID: PAT_TA_49180.pep
RKQPKLERERATVRAEKPPYRARGEPPVRSATMPMLIPDDVRAKAGIYTCYATRHETTRLMLSETELRSGLLTIKDIIECGYMEETG

SEQ ID NO: 154763 - protein, 85 aa, Triticum aestivum
  Clone ID: PAT_TA_49181.pep
WRQIFSLRLSRFVPCCLYHPTRIHIMTLKPPYNVTHQDNKSTLVCLMPIKPNNMFMTHLLMQIPTASDPFADAKTMDFCAGTRSK

SEQ ID NO: 154764 - protein, 44 aa, Triticum aestivum
  Clone ID: PAT_TA_49182.pep
RVSWYTSDVRGPVLCDIPSRSYIRCLIRVELLLHRCTIIKPYLD

SEQ ID NO: 154765 - protein, 96 aa, Triticum aestivum
  Clone ID: PAT_TA_49183.pep
DDLTNLKYLKLVIKETMKRHSTLPLLLPTKDMEPRKIFGFHIPKGTTLLINAYAISRNPKHWDDPEEFKPEKTESALDDLQGTNCELIPYGASTRM

SEQ ID NO: 154766 - protein, 60 aa, Triticum aestivum
  unsure (1)..(60): unsure at all Xaa locations
  Clone ID: PAT_TA_49184.pep
MAAKEPLRVLLTGSLRQMGYALDTMMARGVMLVANQPVILHMLDMXYAAEALKGVMRELI

SEQ ID NO: 154767 - protein, 66 aa, Triticum aestivum
  Clone ID: PAT_TA_49185.pep
ESSASVQSHKNGLSGVCAITCIRAIAPICPRVHSRHCLCLITMSLTYCVVSDANHSQTAILTSQHA

SEQ ID NO: 154768 - protein, 46 aa, Triticum aestivum
  Clone ID: PAT_TA_49186.pep
ATTLGRTRGSSGYRHTVTEKCYLLYRQVWTHCCWTELGEICTPFGA

SEQ ID NO: 154769 - protein, 92 aa, Triticum aestivum
  Clone ID: PAT_TA_49187.pep
RSGVPEQRSGAPVDTPGAGGCTSGPHGGVARTHFLQFGSTSNRCRSEYELVLARLYLAIGAGASLCPMTQAFPLRRVGEYMAVNFRQHGRAH

SEQ ID NO: 154770 - protein, 39 aa, Triticum aestivum
  Clone ID: PAT_TA_49188.pep
DIMLTKKMLGPLQSWKMRSLRTCDLLTVTLCNDVLPTYT

SEQ ID NO: 154771 - protein, 100 aa, Triticum aestivum
  Clone ID: PAT_TA_49189.pep
HGSFRDLLCPLHGIRVPRSACGLGAGRSSSGMRTESRMLCASIWKSCHLRRPNGDWPLHDHQRPLLGRMSRAEKPSAKQKLTFIATRQRASLFEQASTRK

SEQ ID NO: 154772 - protein, 51 aa, Triticum aestivum
  Clone ID: PAT_TA_49190.pep
CESNSLLTVTMLETTDIVTSETTHYAASLEVPSTIWASDAVGTLYDNAYID

SEQ ID NO: 154773 - protein, 84 aa, Triticum aestivum
  Clone ID: PAT_TA_49191.pep
MSTSRKIIQTDMGMLPFNCKDTATHALSDLKTGNQKLKSNLMDLYINTAMQMVVVGIRTGAVIHVLFRSDKRLKKIHVTLVMEL

SEQ ID NO: 154774 - protein, 80 aa, Triticum aestivum
  Clone ID: PAT_TA_49192.pep
LWHYSPLVDSLDHTTNAYNVMHRRNNLCALSAKQQSVHVDDNVAFADGAVAEQPVSTEALNEPSEQNDHCTNSPIDAMPT

SEQ ID NO: 154775 - protein, 63 aa, Triticum aestivum
  Clone ID: PAT_TA_49193.pep
SMGWKQFLCLTEQWVGTILRRYTRLSLCKSWTVHTYQTMKSLIGACLPTNVDNDDDMLHSVNA

SEQ ID NO: 154776 - protein, 82 aa, Triticum aestivum
  Clone ID: PAT_TA_49194.pep
MASTIMGASSRTVVAKTPVLCGKWRAGRTRQLRYITTGGNGRTTMGNYLWFWPKRVKNLSACSAQTTAYTNGEFPGDYEVDT

SEQ ID NO: 154777 - protein, 35 aa, Triticum aestivum
  Clone ID: PAT_TA_49195.pep
SHACTHTFARSVVITYGDPHMVWSRCLLMRISDDR

SEQ ID NO: 154778 - protein, 60 aa, Triticum aestivum
  unsure (1)..(60): unsure at all Xaa locations
  Clone ID: PAT_TA_49196.pep
ISYMCAYQSAMNNSDATVLDSDATSERDAISWRSYIALGSXQLVFREINWSGVTSLEARK

SEQ ID NO: 154779 - protein, 80 aa, Triticum aestivum
  Clone ID: PAT_TA_49197.pep
PTRKEPGNLVHTDDRTAAYRACDRRTADNPTCVCQAAAPVAEMGDGVDGAILPSFLSCRIRDPLGVTVPSDSCCTRWYSP

SEQ ID NO: 154780 - protein, 49 aa, Triticum aestivum
  Clone ID: PAT_TA_49198.pep
ACIALLRLRVHGLDCSHFARCYWWSRFCFRFLWLLKWFRPSGCLAPDMV

SEQ ID NO: 154781 - protein, 116 aa, Triticum aestivum
  unsure (1)..(116): unsure at all Xaa locations
  Clone ID: PAT_TA_49199.pep
AKAQYGATPCGSHDNLYADTMDDDVPTYGNDAKRYLTYMLGSYPAPPAMALELPATTRKSIGPVSGPMXITVTAGMMQVGDHRITXTKAAGHLXKNGASNLLLSLTVESNQSTNCI

SEQ ID NO: 154782 - protein, 57 aa, Triticum aestivum
  Clone ID: PAT_TA_49200.pep
ATRMNITLAATRVLTFIYEAATSFMYMNLMTCYMTLDHDMTAKLSKFGMSKDGSWGH

SEQ ID NO: 154783 - protein, 97 aa, Triticum aestivum
  unsure (1)..(97): unsure at all Xaa locations
  Clone ID: PAT_TA_49201.pep
EQFEEGRTFAEYNIXMESSLHLVLRLLGGLQICVKTLTAKTITLEAESSNTMDYVKAKIQXRRALARXQMGVILATTQFEDSRTLTDYYIQKESTLH

SEQ ID NO: 154784 - protein, 65 aa, Triticum aestivum
  Clone ID: PAT_TA_49202.pep
STCHNSIYICTIVHTVIARQLHDSHSCCGQFWHDILIISGYDQLRRHMHPCPSCVHKLHGACTFW

SEQ ID NO: 154785 - protein, 73 aa, Triticum aestivum
  unsure (1)..(73): unsure at all Xaa locations
  Clone ID: PAT_TA_49203.pep
MAHALMGSSANTVXPLHGLKSTACLPVRLRYRXSLCRFSHGRRIRCMQAWPTEDLXTQKTLYYLSTICTDAIL

SEQ ID NO: 154786 - protein, 107 aa, Triticum aestivum
  Clone ID: PAT_TA_49204.pep
IRLSEWTQAYDHNTFPALVVLTTMELLSDGVADHDGAPVRGRGRRAARGSHVPGPHDAPGQLGRGAPGADGQHGMLCARHRRASCRIVCWRLCGLVGHWRSGVRQVK

SEQ ID NO: 154787 - protein, 42 aa, Triticum aestivum
  Clone ID: PAT_TA_49205.pep
IACLVQVFIANHCNAPACPFCNGQPCIGAQHGLDPGQILFRR

SEQ ID NO: 154788 - protein, 64 aa, Triticum aestivum
  Clone ID: PAT_TA_49206.pep
VGGSSNSVRPVTGVRQQLVYAGVLRRSAVCQLRSFRDCMGLAVAPGHWSEGSAEDASPLRPSST

SEQ ID NO: 154789 - protein, 100 aa, Triticum aestivum
  unsure (1)..(100): unsure at all Xaa locations
  Clone ID: PAT_TA_49207.pep
RSDFWPKISLRIVYTLRHQIRHGXLKSCSDLXAPMKRCMLXLLTTKGSKTXLQLELTKPAGIMIEGVNGSDKTTXVGKLGYRFKNDCAQVLMARCDTLLA

SEQ ID NO: 154790 - protein, 66 aa, Triticum aestivum
  Clone ID: PAT_TA_49208.pep
RTQKSKAINYQRSSSLRRCTRPTIDMPARGPCAQDRRITAGRLFTQRMDLIMSACSTRDDFINVVQ

SEQ ID NO: 154791 - protein, 33 aa, Triticum aestivum
  Clone ID: PAT_TA_49209.pep
PRLRQGLMSPQTETIAGGVSTADGMDHKMPYYT

SEQ ID NO: 154792 - protein, 68 aa, Triticum aestivum
  Clone ID: PAT_TA_49210.pep
HILRYPCMVPKRELTFALKSLWDGTSIAADFENGGTVLRTSIWKQTADATIKNILRNTLCYYDHDIDT

SEQ ID NO: 154793 - protein, 94 aa, Triticum aestivum
  unsure (1)..(94): unsure at all Xaa locations
  Clone ID: PAT_TA_49211.pep
QLRPTSSFHTKTTTTNSRQAVWNDYXWLTTSRWRRMLIXDYNALENIWHLPRERMPKRVVHARSTSPKGSVESTYERRGLTCAELLRSPGACTS

SEQ ID NO: 154794 - protein, 89 aa, Triticum aestivum
  Clone ID: PAT_TA_49212.pep
LRNRPGGRHASRTRLRSSGWTGSSVILTRTMKRLITLSLKPNVTVGILGLYSTILAILWRAREFIFTNTSMITGSMTTCFNSIYIYFYL

SEQ ID NO: 154795 - protein, 63 aa, Triticum aestivum
  Clone ID: PAT_TA_49213.pep
ATPARTRDEGGRGSVTDGGGVAGPLIDLLLAGDGAQDHDLLTGGLALRLQTHYGRGGLSPRDL

SEQ ID NO: 154796 - protein, 103 aa, Triticum aestivum
  unsure (1)..(103): unsure at all Xaa locations
  Clone ID: PAT_TA_49214.pep
RMLGKLTVGSLDKFHLDIKQLFNSKVFMRLSKAEQNADQKARDDSVRLLQLERQLALEXRMRDMTLGARFAAYADVKMSERLPIQXGDHYKKLNSFLMEFLIL

SEQ ID NO: 154797 - protein, 54 aa, Triticum aestivum
  unsure (1)..(54): unsure at all Xaa locations
  Clone ID: PAT_TA_49215.pep
SLTHDALIEHMDWESKIEERDRPILHDKTLSAMYPVASLNEXLYYLVTGGTIWT

SEQ ID NO: 154798 - protein, 70 aa, Triticum aestivum
  unsure (1)..(70): unsure at all Xaa locations
  Clone ID: PAT_TA_49216.pep
AILRLTRKVVPCMIVTDMDVXRSTXSPRMGPTFTSMIMSCHKAAHLALNALTRPNGINGTLYNVTPTLDT

SEQ ID NO: 154799 - protein, 43 aa, Triticum aestivum
  Clone ID: PAT_TA_49217.pep
QVYVNGILSLVSGYGMCHMNVAMTISYGWAVRFLRHLVLSGSP

SEQ ID NO: 154800 - protein, 43 aa, Triticum aestivum
  unsure (1)..(43): unsure at all Xaa locations
  Clone ID: PAT_TA_49218.pep
SAHASEAEMYLMGASVTSWKDTHGKDLLYVXPDAVHNGQKPMS

SEQ ID NO: 154801 - protein, 56 aa, Triticum aestivum
  Clone ID: PAT_TA_49219.pep
MDWSSRAGASAARSALRRAPFSACWCCSAGGILRTSTAGGLGTPMHLHRAELAALL

SEQ ID NO: 154802 - protein, 63 aa, Triticum aestivum
  Clone ID: PAT_TA_49220.pep
GRPQCPPRRVLTWLTSMHPRVHSMRWSGASEIFTGSGQPVEVVCTDGYTFHSATTANVGRLRT

SEQ ID NO: 154803 - protein, 106 aa, Triticum aestivum
  unsure (1)..(106): unsure at all Xaa locations
  Clone ID: PAT_TA_49221.pep
VDSWSYSWAWLLHLQSLLVPGAARPTGLLRDWCRWLHTSAVRLLPAATTRHAESTGTVKMETRGGDREGEARPWSTDFNSWYTDAIGAPXLSVYWAARCTMAIRHY

SEQ ID NO: 154804 - protein, 78 aa, Triticum aestivum
  Clone ID: PAT_TA_49222.pep
GPPVVITTLRMLHPAGVQLPGNETACVLTAFLQTDVQPYTSRIGSRCPSMAFRHSFQVLVCVIRTLTTPFHTVWQHVV

SEQ ID NO: 154805 - protein, 74 aa, Triticum aestivum
  unsure (1)..(74): unsure at all Xaa locations
  Clone ID: PAT_TA_49223.pep
SRTHVVPIVVTGNDFSTLYATVIRDGSTEKLYWAPTRNXRMGVCKAILQTDNVCDEYALKIVDTFPRQCTDSMG

SEQ ID NO: 154806 - protein, 60 aa, Triticum aestivum
  unsure (1)..(60): unsure at all Xaa locations
  Clone ID: PAT_TA_49224.pep
RFINLNNQEKXVGMPLPAVLILHGHYACRVGDLTNYDAFTLGGPYSFRGVRVGELGASNN

SEQ ID NO: 154807 - protein, 87 aa, Triticum aestivum
  unsure (1)..(87): unsure at all Xaa locations
  Clone ID: PAT_TA_49225.pep
LAKRPLQLSDLIAATGIAKMRQAYIKTDSLRRSXQKQLWCTKTRMGHMDIDYQDPHGPVLKYQTIPGLTRHGDLYYERQEFEAKLME

SEQ ID NO: 154808 - protein, 40 aa, Triticum aestivum
  Clone ID: PAT_TA_49226.pep
RAFKPGCDIYVTFSDERSRQPGATKNDNGKTSTETALQSL

SEQ ID NO: 154809 - protein, 91 aa, Triticum aestivum
  unsure (1)..(91): unsure at all Xaa locations
  Clone ID: PAT_TA_49227.pep
AVLNTPLLFQLRSEATASLAPTNMLVTQLNLLVSYRYATASPTAGTQKIVCIFDRYKKKPAXRHRPHXVASWSVRIGEKICKWDCPDRRMY

SEQ ID NO: 154810 - protein, 101 aa, Triticum aestivum
  Clone ID: PAT_TA_49228.pep
MTLVLSFTNGNEWDGAYTLMFKVPKPWFVTPLSLLNDGLADKLNMEGSCYQAILPDENIMMTSCDISWSYEAGGYPRTLDILSECIDPTSDMFHPIVIMED

SEQ ID NO: 154811 - protein, 71 aa, Triticum aestivum
  Clone ID: PAT_TA_49229.pep
RSACELVSYPRLHRRGHRRNSSHLCRWPLRRPCLPGREPLPELLSQPPPGTPPCHICNLASSWSMTCKQSS

SEQ ID NO: 154812 - protein, 51 aa, Triticum aestivum
  Clone ID: PAT_TA_49230.pep
KSWGRSTTEQAIYPENGRDRPLDPVNHVVLVILTAGDPRDDHGPYGRCPAG

SEQ ID NO: 154813 - protein, 77 aa, Triticum aestivum
  Clone ID: PAT_TA_49231.pep
FTASMVCTTFYDSPWHRAVCSSDHTVQHIVTSIRSYTPALGPPHKWFVFYIHSGAVLVVSPSSPLWTRSQCILNDLN

SEQ ID NO: 154814 - protein, 85 aa, Triticum aestivum
  Clone ID: PAT_TA_49232.pep
YQRVDPSVRATLSKPRSHCSGQRVSTHDNLLMRACSCNREADAAKKHLPWRPVFKSKTTVKSVCNPRSQKPTECMQLEDQRIYTV

SEQ ID NO: 154815 - protein, 57 aa, Triticum aestivum
  Clone ID: PAT_TA_49233.pep
RPRERGRVGEPWSCPASVACLQSMLTYRRRLSVMEVVRSDEENASQCCLHPCREGQQ

SEQ ID NO: 154816 - protein, 60 aa, Triticum aestivum
  Clone ID: PAT_TA_49234.pep
HACMHLILLPWLPLHRLHLYRSLTARTAVVLSLSNGQTVVALEPITAWAIVLYYSRRGGC

SEQ ID NO: 154817 - protein, 78 aa, Triticum aestivum
  Clone ID: PAT_TA_49235.pep
ADSICIYRYFVRSISYSSIIGHTLHNIYNYSWLRVLRPRRLIKLAVSGTPKIQCYMDMANIRFPILSGNGGEHIPNRT

SEQ ID NO: 154818 - protein, 35 aa, Triticum aestivum
  unsure (1)..(35): unsure at all Xaa locations
  Clone ID: PAT_TA_49236.pep
MSGPHPWGGTMDISNAVSATDXNRSRYLRRSTMMR

SEQ ID NO: 154819 - protein, 34 aa, Triticum aestivum
  Clone ID: PAT_TA_49237.pep
GGDRPHRVLGLKHQTRTVGVRPQVQDLYRCAITS

SEQ ID NO: 154820 - protein, 84 aa, Triticum aestivum
  Clone ID: PAT_TA_49238.pep
MVRMDIHGMCLYFRAEDDQHSAILHKGVHAEDGHPAYSRLLPEATPFMQHISIECPMVHRLSQDILLRASYVPAREMYLGVRVG

SEQ ID NO: 154821 - protein, 57 aa, Triticum aestivum
  unsure (1)..(57): unsure at all Xaa locations
  Clone ID: PAT_TA_49239.pep
YARMVTSSCSLTWTLIELSMHPVCLEQAREEVLPHFGXTTPDCENLRRLKSATQILY

SEQ ID NO: 154822 - protein, 60 aa, Triticum aestivum
  unsure (1)..(60): unsure at all Xaa locations
  Clone ID: PAT_TA_49240.pep
DLIAMYRTSHLGFNDDIQGTLXLALAGLLTTLTMILGRLGDQTYLLLGSWXAGTGIADLI

SEQ ID NO: 154823 - protein, 40 aa, Triticum aestivum
  Clone ID: PAT_TA_49241.pep
IKEIEWIRIRVLLELISAASRVILGLYEIDAQQETKLVVA

SEQ ID NO: 154824 - protein, 71 aa, Triticum aestivum
  Clone ID: PAT_TA_49242.pep
SVHRILSPIRFYSGYEASAAGLTTRAARVEDSGSHLPDRSRGYRNAPYDVALGIQEVRSRSHSKQEAIVHP

SEQ ID NO: 154825 - protein, 45 aa, Triticum aestivum
  Clone ID: PAT_TA_49243.pep
FLGNRSRHEANASTGLLTEHAQVLHSLVQLDSMDSAQMRRLTRGS

SEQ ID NO: 154826 - protein, 64 aa, Triticum aestivum
  Clone ID: PAT_TA_49244.pep
GTATFGEVPPLLDGYPGLGTGSTSVVLDPRYCMGEVGVEFRPVPGSSGIASADCPRVFFVSVSR

SEQ ID NO: 154827 - protein, 46 aa, Triticum aestivum
  Clone ID: PAT_TA_49245.pep
PSSFVRPASALAFKVSAVWPREDVTDDLLQASSGCVTSCTRGRESS

SEQ ID NO: 154828 - protein, 63 aa, Triticum aestivum
  Clone ID: PAT_TA_49246.pep
YVWSSVQLVCSRTKHPADTSFDHVIRRGQCGVGPNISTQTDGERPAYRFKTLESVWSNIAGND

SEQ ID NO: 154829 - protein, 101 aa, Triticum aestivum
  Clone ID: PAT_TA_49247.pep
LRLLVTLGANVIEVGMQVCEPYSDGHVIQAFVERSLSGGVSTDAAMAMLKEVTPELSCPVVSLSDFNPIARRVTGSLTARSREAGVQGAVHSTIYKGRHDG

SEQ ID NO: 154830 - protein, 74 aa, Triticum aestivum
  Clone ID: PAT_TA_49248.pep
IHIHHGICIIQGHILHLILDHLTNTMQRVKRDGHNCGTSDLISNNKEPIKVLILVQTKSQPRCSLGLSCKSTFL

SEQ ID NO: 154831 - protein, 106 aa, Triticum aestivum
  Clone ID: PAT_TA_49249.pep
RLQVRPFRRSGRRTVRARVRPRVRTGQKTGMAMGAYFADRHHHGHLAVGLPYTPQSGGRTSRIGATICMKAHKKQSHHPGNGKGDGDRRAQPWAGRVASPETDQRG

SEQ ID NO: 154832 - protein, 88 aa, Triticum aestivum
  Clone ID: PAT_TA_49250.pep
LVLSVLDSIGLPFSATVRGWSAAGARASGRFVLLRRSLFCRAMSVGAMKRPWHRLCEPRRRYPRACPKTLPRAEPAAFIWRSAGRRRW

SEQ ID NO: 154833 - protein, 114 aa, Triticum aestivum
  Clone ID: PAT_TA_49251.pep
MAAASAPLLLALALACAASLAAAGDTNRVYDPCTDTKIQRGDGFTFGLAFAANGAFYSGSTQLSPCDRRLTQLSQLSLLRPKVDEISLLTVNTTTGFSPGSSGGYMVAFAGRKY

SEQ ID NO: 154834 - protein, 93 aa, Triticum aestivum
  unsure (1)..(93): unsure at all Xaa locations
  Clone ID: PAT_TA_49252.pep
AYAHAFETLVLLVTKPLETSLVTDGPWLLTLPSIAIITREITMSAVRERARAQNTQILEAVAVYNLXGMWTTATHMTGLTVLLASTYPSLHFQ

SEQ ID NO: 154835 - protein, 153 aa, Triticum aestivum
  unsure (1)..(153): unsure at all Xaa locations
  Clone ID: PAT_TA_49253.pep
EREDTFHVFRRCPRAVHLWRTMAEVWSIPDIESVYXHRTEWLLNLIVESNEGDRLRLIMLLWRCWHVRNEITHDKLAPPVEVSRRLLQSYVTSLLGIQQYPQGDWDKGKMTIEQEGAEQPISHVGGVPRIVHKWSPPPANWTKLNVDGFFSHD

SEQ ID NO: 154836 - protein, 63 aa, Triticum aestivum
  unsure (1)..(63): unsure at all Xaa locations
  Clone ID: PAT_TA_49254.pep
MAPEGSHVDAKQYDSNDDLLLYQGDSEXAFTSYTXGHESFYDTGRQANRMRGMHTYRFEKPSS

SEQ ID NO: 154837 - protein, 58 aa, Triticum aestivum
  Clone ID: PAT_TA_49255.pep
MSAMKFCRECNNILYPKEDRDQKVLLFACRNCDHQEVADNNCVYRNVVHHSAGEFTQV

SEQ ID NO: 154838 - protein, 52 aa, Triticum aestivum
  Clone ID: PAT_TA_49256.pep
GTGILSPSPDQWSDSFFRGPAEQVQDQGFLIKHSLRSRQAFATANGSKPVGT

SEQ ID NO: 154839 - protein, 141 aa, Triticum aestivum
  Clone ID: PAT_TA_49257.pep
MENNLPVNICEYEELAKKALPKMHYDYINGGAEDEHTLRDNIAAYGRILVRPRFLVDVSNIDMSINLLGYDMPSPIIVAPTGSHILANPEGEVATARAAATWNTLMVLSFSTRCKIKEAAFSCNAIRFYQLYVFKNQNILT

SEQ ID NO: 154840 - protein, 49 aa, Triticum aestivum
  Clone ID: PAT_TA_49258.pep
LCLECDGTGEPNIEPQFLEWVGEDTKCPYCEGLGYTICDVCQGINTVHS

SEQ ID NO: 154841 - protein, 74 aa, Triticum aestivum
  Clone ID: PAT_TA_49259.pep
PSRSIVVCSALSELRRAYVSSPVGLPPCCGHRSSQVSGAPDSWISASVASLAVLAWCTVGQSHFSSLPYAWDPL

SEQ ID NO: 154842 - protein, 67 aa, Triticum aestivum
  Clone ID: PAT_TA_49260.pep
SKALSLYMAMFMFRSISLQHYMHQLWKGIIQRLGSPKASPLSMTRTCPAIPEFSAYTGACSSPGPRR

SEQ ID NO: 154843 - protein, 44 aa, Triticum aestivum
  Clone ID: PAT_TA_49261.pep
FLWAVQKTTRVRPTPCAGRAKTTRRPVHCCSKQNVHAIAPCCLA

SEQ ID NO: 154844 - protein, 74 aa, Triticum aestivum
  Clone ID: PAT_TA_49262.pep
RRQMLVWSVYHNVSHLCVASVVVSVPLVVMTFSRFLSAALDSIYAVTVHMPGHPLSHYSAHAWCPLIALHARVR

SEQ ID NO: 154845 - protein, 82 aa, Triticum aestivum
  unsure (1)..(82): unsure at all Xaa locations
  Clone ID: PAT_TA_49263.pep
MAPAVMAYFVTTGPRFDGLKWTDGLAVRRGYGSGGLSSVSNVRRIRCMQVXPIEGVQKHATVAYLPPLYTEDLLKHVDYLNR

SEQ ID NO: 154846 - protein, 82 aa, Triticum aestivum
  unsure (1)..(82): unsure at all Xaa locations
  Clone ID: PAT_TA_49264.pep
PLPGKQPDPNPQPLPDPQPLPGPRPDPXPQPLPEPKPHTNPQPLSEPQPDANAQPLPVPHPDSNSQPLPGQNLHLLLNPQPN

SEQ ID NO: 154847 - protein, 92 aa, Triticum aestivum
  unsure (1)..(92): unsure at all Xaa locations
  Clone ID: PAT_TA_49265.pep
XNVVLMVVMDYAAGEHIHHGARSITTTGFQPQDGWIGRLAWSASEAFSDQIPVRPAGPQSWREQHCLRRRRKRRRRRDARSIASEEVEGEKE

SEQ ID NO: 154848 - protein, 56 aa, Triticum aestivum
  Clone ID: PAT_TA_49266.pep
RPAVPHPYSWGDPFVQALLRVACVTTYRVIREGLMSPLTVTIVGGVSTADGIDHKM

SEQ ID NO: 154849 - protein, 60 aa, Triticum aestivum
  Clone ID: PAT_TA_49267.pep
RGLLVLPESGRSELGAVTEIILKRSHAQCKSSTLTIFMQLYMPRWDKLHTFMYDDTLDLN

SEQ ID NO: 154850 - protein, 91 aa, Triticum aestivum
  Clone ID: PAT_TA_49268.pep
ARPSRRWRANIDSGSLMMMHVHGDELHAEVERARTRFGHDTRALSTAVRPEQAGAYHGRDDQHDHNRIVKRRQRLQRQLCQLHDGINEQAE

SEQ ID NO: 154851 - protein, 109 aa, Triticum aestivum
  Clone ID: PAT_TA_49269.pep
RLTTGLAWSTQAYAVPVFRDRTTLHPALLLSQKQGVRRCIDRAATPSVWPDHWCIVAMSVAGRLTHRAIVVCLAVITWIHIDTVNVKLHVPKKDIGRDIAGPKYRDLLG

SEQ ID NO: 154852 - protein, 115 aa, Triticum aestivum
  Clone ID: PAT_TA_49270.pep
MSPQTETKAGAGFKAGVKDYKWTYYTPEYETKDTDILAAFRVCPHPGVPPEEAGAAVSAESCTGTWTTVWTDGLTSLDRYKGRCSHIEPVAEEDSQWICYVAYPLDLFEEGFVTN

SEQ ID NO: 154853 - protein, 66 aa, Triticum aestivum
  Clone ID: PAT_TA_49271.pep
EYEKQCACRTVCSARSSARFDGPYGIDPLRSWLGLRWIWGLIKATSSVGTGLRMTSYRSLYYRVYG

SEQ ID NO: 154854 - protein, 70 aa, Triticum aestivum
  Clone ID: PAT_TA_49272.pep
HNGVRVLDEHEPQPELVDEGARPALAAAWAAVYVHYGFSVVTFAHGAALPCIDGRRGCKCSLSREYGCAY

SEQ ID NO: 154855 - protein, 82 aa, Triticum aestivum
  Clone ID: PAT_TA_49273.pep
SSLAEVHGLNDGLRVRSDCHLLQYKCMLRTLNADVQIDANHTISGRGDNIQLDHNSDPLKHPCAVLQIHIQTDVTRALDQHP

SEQ ID NO: 154856 - protein, 41 aa, Triticum aestivum
  Clone ID: PAT_TA_49274.pep
FMTVSLIDTLRSRDWFVIQWRWSSVLVIMPVGLRVSVPDSI

SEQ ID NO: 154857 - protein, 68 aa, Triticum aestivum
  Clone ID: PAT_TA_49275.pep
TRRTAPVLMLPAMICSSHRFTHACAMLNQLELRNLYMAHTIRYCVTDGACFYDNRLIVELIHCNKPRL

SEQ ID NO: 154858 - protein, 130 aa, Triticum aestivum
  unsure (1)..(130): unsure at all Xaa locations
  Clone ID: PAT_TA_49276.pep
PTRPPTRPGVLKANIIKFEPELPSWKSSAIADLGVGIENKVAMHFDKAFWPNVQVLGMVGPTPKTCGYFPNSLGXTRATWWGSRRFAQDVEKLSDKEAVELVMCHLRKMIPDATEPSQYLVFGWGSDPNF

SEQ ID NO: 154859 - protein, 54 aa, Triticum aestivum
  Clone ID: PAT_TA_49277.pep
IEMPIDKAMETLLRLGLVVELSTNGSSSSVIALPCPDAYEILKGRWDSLLEHKT

SEQ ID NO: 154860 - protein, 138 aa, Triticum aestivum
  Clone ID: PAT_TA_49278.pep
MMSAKLGAATPSVLLTPCPGPHGLRPYPTAASCLPDTVTGPPVSAGPDQEHSGAPGQEEAAVFCPSQPRSGASSQLSRWSRARALRSGRRLELAAIRASAALEVPTKSSAPTEHEATATDDDDHGDEAVGVGSQASGN

SEQ ID NO: 154861 - protein, 78 aa, Triticum aestivum
  Clone ID: PAT_TA_49279.pep
THAFDDAYGDTRIWTSMLLSSSDVCLYWVNTKIKGFCIWSDNTRPHVHMNECCQHGCSFEINVNNNMWFWARIVYYRT

SEQ ID NO: 154862 - protein, 63 aa, Triticum aestivum
  Clone ID: PAT_TA_49280.pep
RQNLRASHTYRTTTRARHAQISFTDKRIAASSLLDWSHISSISTTRSASDDHDDNHQVRLGWS

SEQ ID NO: 154863 - protein, 80 aa, Triticum aestivum
  Clone ID: PAT_TA_49281.pep
RSSACICEPWSRILKKNSVDCDYDLAFFNLDNSYIDFAFPILLMLYSIYCYRLLPELCMDGYRFIHHSRMASFVYYELRR

SEQ ID NO: 154864 - protein, 100 aa, Triticum aestivum
  unsure (1)..(100): unsure at all Xaa locations
  Clone ID: PAT_TA_49282.pep
MGLFSSLCCTAVAALSWNVLARPRSSLLGAAGKAXASRASFGVRAAALVRGMWLAVSTTSAWIDGSLDADLRSDPXTFGSDPESLRWNMQAELVLCLRAM

SEQ ID NO: 154865 - protein, 64 aa, Triticum aestivum
  Clone ID: PAT_TA_49283.pep
LIDCNAIPMSRVQRLVPLQQVLEQVPSFIESTSKTMMDTARQILHYDTMNTRTWIALDTQDYPL

SEQ ID NO: 154866 - protein, 49 aa, Triticum aestivum
  Clone ID: PAT_TA_49284.pep
RTLTKPGFALTSSYPRARAGPTCYLSCGQPRPPRLTGLRWPWANCPYSV

SEQ ID NO: 154867 - protein, 50 aa, Triticum aestivum
  unsure (1)..(50): unsure at all Xaa locations
  Clone ID: PAT_TA_49285.pep
MGTIDIGIDGFXRIARLVSRVALQSDYVELACANYPCITTEYMTYMSKSY

SEQ ID NO: 154868 - protein, 44 aa, Triticum aestivum
  Clone ID: PAT_TA_49286.pep
VGGSMHHSYHDKSKYVCLAIFMARKRNHPSKLSGIACRTSLTGQ

SEQ ID NO: 154869 - protein, 33 aa, Triticum aestivum
  Clone ID: PAT_TA_49287.pep
TVIRRSSSAMLIRFGALVFKHLDHEGIRCLAMS

SEQ ID NO: 154870 - protein, 86 aa, Triticum aestivum
  unsure (1)..(86): unsure at all Xaa locations
  Clone ID: PAT_TA_49288.pep
RSPTRPSTRPRTIACSALSTRSNCTKLXRTRASALSKPVKGLGLWRERFPRNMSWICARMCWVSLSYMSTRELINLVLLGAMALST

SEQ ID NO: 154871 - protein, 49 aa, Triticum aestivum
  Clone ID: PAT_TA_49289.pep
RRRRPQYRRRSPPRRRRRRRMCPRRRRRKQRRVPPRRLKRPRQRHRAPM

SEQ ID NO: 154872 - protein, 99 aa, Triticum aestivum
  unsure (1)..(99): unsure at all Xaa locations
  Clone ID: PAT_TA_49290.pep
RXCGKRDSNRGNTLAAPGLPPCKKAGPSSSSSSYDGRADGSTRRRHGRGARTEHDGYSIVQQLPALVLRHYQEVSGIGRPVITGGQMDTATSMEGSQHG

SEQ ID NO: 154873 - protein, 67 aa, Triticum aestivum
  Clone ID: PAT_TA_49291.pep
LESSPAPSAPPPPTSPGAERSSPLSPSSFLIVLDSRAPYRPALSGYLHSMEPGCVSLSDKVAFTTGT

SEQ ID NO: 154874 - protein, 127 aa, Triticum aestivum
  unsure (1)..(127): unsure at all Xaa locations
  Clone ID: PAT_TA_49292.pep
MLLVVLIDGCGIAAIAGGSRNTQDHDGYMKAHTLDHGXNGEALLMLGRSQGWMASHGRSSRTMEEKLXWMEVNRTDMKAIEAAKRDRRMRYRISETPCTELTNNEYMSMWRRHDSQLWLAEDTRAMT

SEQ ID NO: 154875 - protein, 62 aa, Triticum aestivum
  Clone ID: PAT_TA_49293.pep
IRQSRSHSRQPDQMHKEGPSLPSAYDLTMGRPHQREPLLHRKYAISIARSPRAGCDTPTASA

SEQ ID NO: 154876 - protein, 63 aa, Triticum aestivum
  Clone ID: PAT_TA_49294.pep
DALRSRFAETTPRFLILFFSGHAAIVWLVYTASRYQNKTRSHLPWTPTQKMVHASLLAYCGTL

SEQ ID NO: 154877 - protein, 41 aa, Triticum aestivum
  Clone ID: PAT_TA_49295.pep
VHAWDESDHLQSHRQGLMSPLTETIVGGLSTADVMDLKMPY

SEQ ID NO: 154878 - protein, 59 aa, Triticum aestivum
  Clone ID: PAT_TA_49296.pep
ARTPVILAAGVAPLTTDRGRSHVAFFSRQTHKGPALLDTDAVQAIACVMHGCVAAYLLL

SEQ ID NO: 154879 - protein, 68 aa, Triticum aestivum
  unsure (1)..(68): unsure at all Xaa locations
  Clone ID: PAT_TA_49297.pep
PLQGLKSTAGLPVRRPSSRSGLCRGSHGGRIRSMQAWPTWGLYKLETLCYLSTTFTDALLXPVDYLIR

SEQ ID NO: 154880 - protein, 76 aa, Triticum aestivum
  Clone ID: PAT_TA_49298.pep
RAAGECCWLVHGHATGGAVLIPRPASRPAWTEARACSRRRGRVRSAWPGGHRCCYFTGASQHAVPLPDRPLGEGPA

SEQ ID NO: 154881 - protein, 81 aa, Triticum aestivum
  unsure (1)..(81): unsure at all Xaa locations
  Clone ID: PAT_TA_49299.pep
ISSLCYARSSLIISCNIGTLYXYCISSCMDQIMDRYERYSYAKKAVVTSXMRTXGNWCHYYKSLSVXGETIQNCRMHLMGE

SEQ ID NO: 154882 - protein, 113 aa, Triticum aestivum
  unsure (1)..(113): unsure at all Xaa locations
  Clone ID: PAT_TA_49300.pep
MGDVKTHINILPIGHVNSGXXATTGHLFYGLGGIDMRGTKRFXRAPGCMNSRWSKRTXVLDXLKVYRKRGLTITTALWKMQTTKYYXSRTGAPGHRNLIENMITWTSQADCAG

SEQ ID NO: 154883 - protein, 57 aa, Triticum aestivum
  Clone ID: PAT_TA_49301.pep
TRAFALYPTYCFKSSHSKTYALIWVHKTEDMDTHLLPAAASQMMGPAPHNVMSTSEP

SEQ ID NO: 154884 - protein, 45 aa, Triticum aestivum
  Clone ID: PAT_TA_49302.pep
CSDVKGSSLLVRLSWQRQSPTYQDSMPLLRIRFRRWTSTTRHPGR

SEQ ID NO: 154885 - protein, 101 aa, Triticum aestivum
  Clone ID: PAT_TA_49303.pep
SGGIGLVARTDSAAHRAGGLPRRHRLESRQAPLPLGSMNARAGSWARLHPYPGEVGHLLLDGERLGLALHLLCRPPSAQSPCPLSLPRSPNGTRTAPQPRL

SEQ ID NO: 154886 - protein, 92 aa, Triticum aestivum
  Clone ID: PAT_TA_49304.pep
CCCRSSDTCMDVQQHASRRGYRWMTAGGTQCIQAQDEIREGVSTAVAPIHGDRRAHVCCDTCRRPWSSAACLLPTSVSCANRMASCMSVWAY

SEQ ID NO: 154887 - protein, 86 aa, Triticum aestivum
  Clone ID: PAT_TA_49305.pep
DCLHGCRVRHQLRCSSLRAPRPCLVPQHGTTWTVSRSGDVHELDRLVSTLSGRRRKYTDQDVFCAQRRRRPQYDLSHAWVQPAISG

SEQ ID NO: 154888 - protein, 84 aa, Triticum aestivum
  Clone ID: PAT_TA_49306.pep
SPWSGPVPAPRISSQCCSLKLYGEVTLRDQEERRDERGMPSVQPPLPVPAFLCPARCTPTTLLPPGTMSCRRRSGPPPTRGGPG

SEQ ID NO: 154889 - protein, 32 aa, Triticum aestivum
  Clone ID: PAT_TA_49307.pep
ACSNIEANDTLCMRSIDCHSILGRSHENQELD

SEQ ID NO: 154890 - protein, 53 aa, Triticum aestivum
  Clone ID: PAT_TA_49308.pep
FASSKISGSVPFFGMEHLIPWHCTRHRALLSLVLDTARTPGVSSSQVESDTAR

SEQ ID NO: 154891 - protein, 74 aa, Triticum aestivum
  Clone ID: PAT_TA_49309.pep
PTICTYSTPRLHQHISVISVTVVTAVSSTFSTSYIQSLYHSLHMSSPALLPLLRNTTIMHCSYLCVPHTCALII

SEQ ID NO: 154892 - protein, 100 aa, Triticum aestivum
  unsure (1)..(100): unsure at all Xaa locations
  Clone ID: PAT_TA_49310.pep
TGATIAKPTSIEARNPCRKHRVSSTKLTPIARWINLLTDNKCCLEMCSWNXTMLSAVDILAIIHDDWXSHLLMLTDDWAEQLLSTLKRATRTVLTNMATG

SEQ ID NO: 154893 - protein, 91 aa, Triticum aestivum
  Clone ID: PAT_TA_49311.pep
IGLPVIMPCSRSADGHVAGLLSGGWSVTVHGFGRGAGAAADMFVIRTCRGSELACHQDVDGHLDVVWLGNNRIHGLRLRLMLRNASARVHA

SEQ ID NO: 154894 - protein, 83 aa, Triticum aestivum
  Clone ID: PAT_TA_49312.pep
CQVEWPPQHQPNPRSEVAGTKQTYTRCTGRYEADTQLVHQAQSTSQATTHQGNKQVRYRHGTSEVAEMLQYEHSTHLVDPKVP

SEQ ID NO: 154895 - protein, 63 aa, Triticum aestivum
  Clone ID: PAT_TA_49313.pep
HSTTHDVRPERTHTVDRRDALRHTPYGCASGPSLVPRSLPSMSSSSPSHGPIRVDLMHLTLAS

SEQ ID NO: 154896 - protein, 84 aa, Triticum aestivum
  Clone ID: PAT_TA_49314.pep
TSRTDTQFLPHLTHPAHTTPASSVAQDEYLAGTLSAHALISAWPLLVTPLSPSISRAHCSRKLPCKMTTCSCRSGTHNDITTLT

SEQ ID NO: 154897 - protein, 53 aa, Triticum aestivum
  Clone ID: PAT_TA_49315.pep
MATAGKAIKRIASMTWKARKPLPLEDAEVASTQAIDARAKILYTALCHTDVYL

SEQ ID NO: 154898 - protein, 69 aa, Triticum aestivum
  unsure (1)..(69): unsure at all Xaa locations
  Clone ID: PAT_TA_49316.pep
LSASNPAIHRPSRYRQIGDTPTAVRSYDAEDDACRPEQSAEYDAMLRQELARDPPDAGAGTEEARXYCC

SEQ ID NO: 154899 - protein, 86 aa, Triticum aestivum
  Clone ID: PAT_TA_49317.pep
SPPHSSPSPLPRSSSLVALSAGPCLSPPRCSTTSPPWTSWVLLVILHDRDRVGSLSTLTVDIGRCRSSSGSRYVALPMRHWMLGCR

SEQ ID NO: 154900 - protein, 84 aa, Triticum aestivum
  Clone ID: PAT_TA_49318.pep
ALEHLSLSQCLRTSLAISMATSVHDYCETDSRVLWRLVPNVQSVLVGGRVQSAEDAGCTAADVSRGRGVNGGRGLPPNSGDRVT

SEQ ID NO: 154901 - protein, 34 aa, Triticum aestivum
  Clone ID: PAT_TA_49319.pep
GLLELVYLLLVLLFIVRRLYKDIFLKIRRFRMCS

SEQ ID NO: 154902 - protein, 56 aa, Triticum aestivum
  Clone ID: PAT_TA_49320.pep
MALTVMGLSATSGFPLEGLKTTVGLAGSRTFKGSRPCRGSHWGRIKSMQAWPIWGL

SEQ ID NO: 154903 - protein, 77 aa, Triticum aestivum
  Clone ID: PAT_TA_49321.pep
AYSLLSTSLQLGKHHRCQHLIIGISSALVESQYIQFLSSCYNSMLSVSVQLPQSCATRWILPLCRCKAYQVDAVSLI

SEQ ID NO: 154904 - protein, 100 aa, Triticum aestivum
  Clone ID: PAT_TA_49322.pep
SHTIPHRPTHADHTLGTWRGPCSARPWPHYTGACCSSADMTSSTTLSLRLNATRTHLMPAVCFTTYPLSTNSRSRTAPTDAKLTASINAFTRMGPNFLWR

SEQ ID NO: 154905 - protein, 63 aa, Triticum aestivum
  Clone ID: PAT_TA_49323.pep
LTIGNSSYRLLAINELQLSYATRHTHTAYHRLPHLTITWSIDTPTTCTHLINGPARNTSTHYH

SEQ ID NO: 154906 - protein, 73 aa, Triticum aestivum
  Clone ID: PAT_TA_49324.pep
SEWTRDRIQLMIQVCQRKRVILSYGLRQIPMWLLLYHRTDLCVYILPLLEVSMPMNSTITSVLRCYHVLHYRN

SEQ ID NO: 154907 - protein, 91 aa, Triticum aestivum
  Clone ID: PAT_TA_49325.pep
TAVFSPKFFNSNRGFLPQSELLEPYFGQPFFMVGAKFLANDIRPWDLVVGRGQRQLVFRPLQAPPPFPSFSRAPSSLIIKMFQPSTPNFHN

SEQ ID NO: 154908 - protein, 50 aa, Triticum aestivum
  Clone ID: PAT_TA_49326.pep
LVSNTEQDEFHSSELNNISGVCDHLHELNHLFVTLSLLGELVHGHIHLAG

SEQ ID NO: 154909 - protein, 76 aa, Triticum aestivum
  Clone ID: PAT_TA_49327.pep
TLNPLTNALVFECCPCQKGPSMLLAPHGTSKILWSGPTGYLASPSWRSSGRLAPPTLPLARYSDPSSPAKAHFLRT

SEQ ID NO: 154910 - protein, 100 aa, Triticum aestivum
  unsure (1)..(100): unsure at all Xaa locations
  Clone ID: PAT_TA_49328.pep
ALTCKHYGGCISTDXSNGRRMSYYLVLSERDPAADAVVLWVNGSTSCSSSDRSVDENGGCNCERXSTIGGLTKLDRNTYSSSKVSSMMYLDSNAGAGMAY

SEQ ID NO: 154911 - protein, 64 aa, Triticum aestivum
  Clone ID: PAT_TA_49329.pep
GQMCSWLHRCLKTYVRVRAPLSLRLLLGPRCKLIAVTDCPQLRGKFMDHMPTTLRYDDAPDAGY

SEQ ID NO: 154912 - protein, 65 aa, Triticum aestivum
  Clone ID: PAT_TA_49330.pep
PSAGSAVPGSKISMSVGSHHRPDGHEGRARIGYRGPRGGRAHRVRQTRTGRRALGGADTDPGAGL

SEQ ID NO: 154913 - protein, 94 aa, Triticum aestivum
  Clone ID: PAT_TA_49331.pep
TSIGKAGTACDVRAPEQPARATRPHTRTCSDRTAAATTALVSSSMGCTAVAALSSNVLARARSCFLGAAGKAAGATQAPFGERASALKRCWRVS

SEQ ID NO: 154914 - protein, 84 aa, Triticum aestivum
  Clone ID: PAT_TA_49332.pep
QTPISPVSLCRIQFLCRRSQPPTRCPRRRSQCSNSSPWPSGRVERHRLRRTQGWSHRLRPPRMQIAPPSRSNQKPRRPWQGGSG

SEQ ID NO: 154915 - protein, 86 aa, Triticum aestivum
  Clone ID: PAT_TA_49333.pep
CSTDKLWHTIIRLDTRSCHKPINCLTRTGSSALDKRFMSSVIQTPLHKLCLKFQPFLPQGIRVRIPIYRAWVCRIASKGNSGRTLA

SEQ ID NO: 154916 - protein, 46 aa, Triticum aestivum
  Clone ID: PAT_TA_49334.pep
GRARRTAHSHLSLRALHGTLLALHTHNTCCSSSIVYLTHGRHRRTL

SEQ ID NO: 154917 - protein, 95 aa, Triticum aestivum
  Clone ID: PAT_TA_49335.pep
MLPRAGVCDMDDAACGMGGDDKCPLKLLEPRATLTQRWMMYKMDDRMKMAAGAKAVEPALKYEDSRDCIMTNERRCTSLKSEYVTEDGCLKSKML

SEQ ID NO: 154918 - protein, 62 aa, Triticum aestivum
  Clone ID: PAT_TA_49336.pep
STCVPLCCTWLQRLARRCLCPSTHRRSKMASQWFALTMAAGVTRTWSAPSSGRHRNKRWTKQ

SEQ ID NO: 154919 - protein, 60 aa, Triticum aestivum
  Clone ID: PAT_TA_49337.pep
QAGDKSWFKRGKKFIQNVVESFRVVLIYPPSLVNSLHIYSQMPRVLNDQFASMCVFIICT

SEQ ID NO: 154920 - protein, 96 aa, Triticum aestivum
  Clone ID: PAT_TA_49338.pep
VGAAVGARQKLGWGPGQGTQARELLFKAEAGVADRVLGVGRRSRRGRHQHRPEVHHRRERRHGKSRSSSVAASSRDLGWYSGEVDRALYLTQGTSA

SEQ ID NO: 154921 - protein, 64 aa, Triticum aestivum
  Clone ID: PAT_TA_49339.pep
CYGVPKTTYRLTRVCPINNPVANARRRYRLRRFYFTGHLSLTATAEILSQALDGKCGNHEPYTC

SEQ ID NO: 154922 - protein, 71 aa, Triticum aestivum
  unsure (1)..(71): unsure at all Xaa locations
  Clone ID: PAT_TA_49340.pep
SAALAKDATTLIPNTPWGYLNTVTDACMRRAASKTGFMAPXSTAQDRMGYCMNTDAYEKDQTVPTQTLLIA

SEQ ID NO: 154923 - protein, 80 aa, Triticum aestivum
  unsure (1)..(80): unsure at all Xaa locations
  Clone ID: PAT_TA_49341.pep
RTQGRPTRTDGAKPXDESYKGPRXSKXDPTARRXTRRETGRSGGSPTEQAHEHVHGDNCTEIACLLDPDHIGANQVQRME

SEQ ID NO: 154924 - protein, 91 aa, Triticum aestivum
  unsure (1)..(91): unsure at all Xaa locations
  Clone ID: PAT_TA_49342.pep
SFILNDPFQGLKSTVGLPVSRRYNGTSLWSVSNXGRIICMHVWPIXAFXKFETLYYLPPLISXALFKLVDYLIRSXCVPCLEFSKAVVYLF

SEQ ID NO: 154925 - protein, 83 aa, Triticum aestivum
  unsure (1)..(83): unsure at all Xaa locations
  Clone ID: PAT_TA_49343.pep
MSPHTETQAGVGSKAGVKDYIMAYYTPXYITQDSAIFSDFSGRSHPRGSPVDXGAAAAAESFTVTCTPVWTDGLTSLVRYKGR

SEQ ID NO: 154926 - protein, 85 aa, Triticum aestivum
  unsure (1)..(85): unsure at all Xaa locations
  Clone ID: PAT_TA_49344.pep
MDTWAMTLGRGRATDAFLFNATSPAQHMLAPASASLLVIVARAPVLGSTGPRVPLTPVVGYSDACVAGLDXADADEANETVTEEE

SEQ ID NO: 154927 - protein, 83 aa, Triticum aestivum
  Clone ID: PAT_TA_49345.pep
STRLCCRSYNQMDAPSSHSGHAKLKNLLRLAMVVLAASVLVLSPVNNAMATKSSGRIGRKAFQMRQALLFPCKDKQLKDEHLR

SEQ ID NO: 154928 - protein, 82 aa, Triticum aestivum
  Clone ID: PAT_TA_49346.pep
GRVGGRVGSNPLNNRSRPPPPPPPTRSQIRGAPPRLPWRSRSTSFAGQQLKGHFLLMWIFHYNPTVSCDGSLLVAVFNLIVS

SEQ ID NO: 154929 - protein, 98 aa, Triticum aestivum
  Clone ID: PAT_TA_49347.pep
MAAGSFATSVHDFTVKDSSGKDVDLSVYKGKVLLIVNVASQCGLTNSNYTELSQLYPKYKDQGFEILAFPCNQFGGQEPGTNDEIVQFACTRFKAEDP

SEQ ID NO: 154930 - protein, 55 aa, Triticum aestivum
  Clone ID: PAT_TA_49348.pep
YFVRPVHRLTAGKSVVIMSTMSISLLNPLSPMFIPLALRMCRTTFHHRGSYLRSP

SEQ ID NO: 154931 - protein, 129 aa, Triticum aestivum
  unsure (1)..(129): unsure at all Xaa locations
  Clone ID: PAT_TA_49349.pep
LRTRSIPSPPPIHPFFVPDVADPASAPLARAFLSSSPXAADKPPQLLPVDTAPVAQRLFLEFPGSDEGPPKAKGXGDAVGEENGGIREXVQRFEGXEVEALQRKEVAFRLIVQMLXGEGGLEADKVAKR

SEQ ID NO: 154932 - protein, 87 aa, Triticum aestivum
  unsure (1)..(87): unsure at all Xaa locations
  Clone ID: PAT_TA_49350.pep
QGGLSRPDSECQLRGQPTTCPKTRTMRLLEYVKGAQPETTALLVKXAPAHVVDAMPHTETNVIGTMTADFLAVTVTTAGENVDSLCT

SEQ ID NO: 154933 - protein, 132 aa, Triticum aestivum
  unsure (1)..(132): unsure at all Xaa locations
  Clone ID: PAT_TA_49351.pep
GLMMNRVICSTTRSNRRRSARPGPWTFQVXYPIEKALATGLEXDIKCGKRTFTSRLIGSVXGTKEENKGGNTDFSNLTTVMSTEIYHDDDRSLLKTRGKDNGVTNLNHXANESDLMYDLVEAMNVGKAIEKP

SEQ ID NO: 154934 - protein, 65 aa, Triticum aestivum
  Clone ID: PAT_TA_49352.pep
MDVVKAAQISGRTLEKVVVQPVVLFSIVDHYNRVGRYTRKRVRGLLLCTSCLGCDDLTNWYSLPM

SEQ ID NO: 154935 - protein, 72 aa, Triticum aestivum
  Clone ID: PAT_TA_49353.pep
DVRQLVDSSRAVNWHGMDNLFQTKPCAYKMKPREQIRNCQHQVMYTSLTEGPCQLSFHTSECRFVLSHNWYM

SEQ ID NO: 154936 - protein, 109 aa, Triticum aestivum
  Clone ID: PAT_TA_49354.pep
MAQIIDGKAIAGEIRREIAAEVAALSSAHSIVPGLAVVIVGSRKDSQTYVHMKRKACAEVGIRSFHVDLPEDISEAALVGQVHRLNADPRVHGILVQLPLPKHINEENY

SEQ ID NO: 154937 - protein, 94 aa, Triticum aestivum
  Clone ID: PAT_TA_49355.pep
SKKYTSDEPKSGRRTPSWCDRILSYGKGMRLLSYEAVDMRLSDHRPVKAVYTVDIEVFSPKKLQRALTFTDAEVEDRLSSEDERIAGIYSLGLS

SEQ ID NO: 154938 - protein, 61 aa, Triticum aestivum
  Clone ID: PAT_TA_49356.pep
LFGASHFLRCSEHLRRFLRGQNFTGQLPPDFADLPNLLQLSRSLFHGTVPDRWARMNPRVR

SEQ ID NO: 154939 - protein, 111 aa, Triticum aestivum
  unsure (1)..(111): unsure at all Xaa locations
  Clone ID: PAT_TA_49357.pep
PRVRAVMKRLKTVMKKFKTEVYDMKPDFLEPLKAKHMPKYMAFSCADSCVCLWLTLGLEPSMAFIIRIIANMCPYYCTNMYSGVGSAIXYAKCAVKVEVIHMIGHRRCGVI

SEQ ID NO: 154940 - protein, 108 aa, Triticum aestivum
  Clone ID: PAT_TA_49358.pep
MGRHAGTGGGGGVQQKLRKGLWSPEEDEKLYNHIIRYGVGCWSSVPKLAGLQRCGKSCRLRWINYLRPDLKRGSFSQQEEDAIVCLHEILGNRRSQIASHLPVRTDNE

SEQ ID NO: 154941 - protein, 103 aa, Triticum aestivum
  unsure (1)..(103): unsure at all Xaa locations
  Clone ID: PAT_TA_49359.pep
ARLNSIGLRGRHLRFIKHSTERLGGSERPAPAVXRTQLFVCKAQINDQAAPDAAVVTSRRAVPAVVAGAAVAAEYVSRAVAAYWECRNVHGMAKQNTDFWAYS

SEQ ID NO: 154942 - protein, 123 aa, Triticum aestivum
  Clone ID: PAT_TA_49360.pep
RTRGRTRGIIVKNMAEATYVCDYILGGQLDGSSSTREEFLEKFKKAVSPGFDPDVDLEKAGIANQTTMLKGETEEIGKLVEKTMMRKYGVENANEHFVAFNTICDATQERQDAMYHLMKEKGD

SEQ ID NO: 154943 - protein, 106 aa, Triticum aestivum
  Clone ID: PAT_TA_49361.pep
SAALPTVRPLPAIRLSLPLAPPSPSKICCSRCRFLIASRVTSSGGEEGRAALPRGARRCAVNGRRPGGVTGGGQPERALRTVWRVDGRRTGGARHCNRLAHGRSHQ

SEQ ID NO: 154944 - protein, 43 aa, Triticum aestivum
  Clone ID: PAT_TA_49362.pep
TPTCIANGHHNDTRNCRAHRSHTWAVHCRQDYHPSLTVFSLWS

SEQ ID NO: 154945 - protein, 130 aa, Triticum aestivum
  Clone ID: PAT_TA_49363.pep
RGPKGHLLSLSASLPRKSRAPVAVTTDITFGGREGIGGGGRSRNGTQPASPSFPDQPHHHHATESICRRMLIQERGPRREMVHGGYEGAGMHQRVKAVSTGGGWGRERRRMVGIRAAADPLQAMGGPTRP

SEQ ID NO: 154946 - protein, 147 aa, Triticum aestivum
  Clone ID: PAT_TA_49364.pep
KLVHFFTVVQLAFHENPYVFLIFWLENKGQEAYVVPESQSPCPFQLLRFAAAADGVQRIDGRVAPEVLHNLDLTVDRVLYVLGDIPISSGISVNRAMQPVLVNNVTYDDEAAVVLAVVHQGHPPDQHEPHRSERSRTCRVRSRRRAR

SEQ ID NO: 154947 - protein, 76 aa, Triticum aestivum
  Clone ID: PAT_TA_49365.pep
QHITVDPVAKLSRVCRTLNSSYILHTNHSLQITPAALLPALGTTTICTEHINVSRTEESILYTMSLTSYYPHSTGA

SEQ ID NO: 154948 - protein, 137 aa, Triticum aestivum
  Clone ID: PAT_TA_49366.pep
MSPQTETKAGVGFKAGVNDYKLTYYTPEYETKDTDISAAFRVSRYPGVPPEEAGAAVAAESSTGTWTTVWTDGLTSLDRYKGRCYHIEPVAGEDSQWICYVAYPLHLFEEGSRTNMFTSIRGNVSCYKALHALRLED

SEQ ID NO: 154949 - protein, 54 aa, Triticum aestivum
  Clone ID: PAT_TA_49367.pep
KDEGPMLDVSFLGRRKEKKKKERLVGTLPTAFMKLARSMTGRTWSAPAPRRRFL

SEQ ID NO: 154950 - protein, 88 aa, Triticum aestivum
  Clone ID: PAT_TA_49368.pep
LRHGACVALPAHVVTVFCSCRDPPREPAVGDLNLSPQLLQLFPPVVAPGGASLVLPHRLRRLRLATSPNLRMGLPGWIWWLLPNGRRC

SEQ ID NO: 154951 - protein, 85 aa, Triticum aestivum
  Clone ID: PAT_TA_49369.pep
PTRPRLSMLLIWYNVVVREDDSGKGATRQCSRCSGLESAITTDHCSPIVVPHPPSRLHVFGLVIFFLPVFYSCFHRFFDNLILIS

SEQ ID NO: 154952 - protein, 146 aa, Triticum aestivum
  Clone ID: PAT_TA_49370.pep
CGLDEGRAEAELVVFSVMDDLFAKTCINHGTIGALITNCSTFSPVPSMADMIVNRYKLRGDLRVINLSGMACSASVTAVGLASNMLQVMPWGSHVLVVSTDTIGPFYYAGNKRSMQLVNVLFRIGGAAKLLSTSRSKARFPLGHFT

SEQ ID NO: 154953 - protein, 115 aa, Triticum aestivum
  Clone ID: PAT_TA_49371.pep
SIVPPRTVFTRINLQFDLLLPEPKERIVSMFVRQCFDKFSCPVRFRSLPHTFLSSSPLFAATTATTTLRLRKASTPSRIRYGMHPTTMRPPVLVLYRCSSRPCLATRTAIVRIFS

SEQ ID NO: 154954 - protein, 102 aa, Triticum aestivum
  Clone ID: PAT_TA_49372.pep
MASTNMASDTSRFMLADVIPTGTNHGVSSRVSFHLCYRLCLKLVARVEEDAIDAAPAEPAPAREEKPDATWATKGCGKAHPPAKGPKRGTKVRYYTPLLASL

SEQ ID NO: 154955 - protein, 45 aa, Triticum aestivum
  Clone ID: PAT_TA_49373.pep
GNADTERACLSTFDSKNSASRDTDLEHSHLVLLSLRFLSNDFQTP

SEQ ID NO: 154956 - protein, 145 aa, Triticum aestivum
  Clone ID: PAT_TA_49374.pep
MASTPSLLTLFLALVLPLIPLAVAAPEKHLVTHLPGFDGALPSKHYAGYISVDESNGRRMFYYLVLSERDPAADPVVLWLNGGPGCSSFDGFVYENGPFNFERGSTPGGLPKLHLNPYSWSKVIRIPDSEHSLRAQAYPAAACPE

SEQ ID NO: 154957 - protein, 61 aa, Triticum aestivum
  Clone ID: PAT_TA_49375.pep
PCALVMPCAGQPHSSRQSALLMCASTIDATLLMHDRLLKALRLHDPCFFFRTATALLDAYA

SEQ ID NO: 154958 - protein, 117 aa, Triticum aestivum
  Clone ID: PAT_TA_49376.pep
MAQTMASMTGLSQGVRLPGPAGRRASRFTVRASSAEAEAAGRRAVLGLMASGVVGSAFAQVVHAGTVSAIKGGPPPTLFGGLPGTDNSVEARDFDLPLKNRFYLQSLPPAEAAVRAK

SEQ ID NO: 154959 - protein, 86 aa, Triticum aestivum
  Clone ID: PAT_TA_49377.pep
LISHSPPVLHLLPTFMFIAYLSSYTKSHAGMNRISAARPIPRVGIHGGICLFRSVADLERPQVIGRQQSDGQFVGFGLDGGYGSFP

SEQ ID NO: 154960 - protein, 126 aa, Triticum aestivum
  Clone ID: PAT_TA_49378.pep
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCRSEESNLCDLLRINVDPGVMI

SEQ ID NO: 154961 - protein, 62 aa, Triticum aestivum
  Clone ID: PAT_TA_49379.pep
LPAWWIKSFLASTVLSVSQEHASHVSMVHQRAGLSSRDDTPVRSSLQRVEMHSISAIRRGRT

SEQ ID NO: 154962 - protein, 91 aa, Triticum aestivum
  Clone ID: PAT_TA_49380.pep
MGKIKIGINGFRRIGRLVARVALQSDDVELVAVNDPFITTEYMTYMFKYDTGHRHWKHSDIKLKDDKTLLFGEKPGTVFGVRNPEEISRGE

SEQ ID NO: 154963 - protein, 68 aa, Triticum aestivum
  unsure (1)..(68): unsure at all Xaa locations
  Clone ID: PAT_TA_49381.pep
MTLDVLGRTLRYTDVFNLTLKDQDGXTVSLSKFKGKPVVLYLYADDETPGCTKQIIRQNTLSTLGSAG

SEQ ID NO: 154964 - protein, 125 aa, Triticum aestivum
  unsure (1)..(125): unsure at all Xaa locations
  Clone ID: PAT_TA_49382.pep
KPATRWSCKEGGPTLLAQLTYVVLNQYTAASKMDTDTTYTVAXNYLAEVDIILAAVMPVGTTHATKKVLQEKRNRLPEIERAFVHLDYXITHRAEHALLHEKELQDRLRDASLYRLMALDREITV

SEQ ID NO: 154965 - protein, 76 aa, Triticum aestivum
  Clone ID: PAT_TA_49383.pep
CSLPHTVEAVADCNASFGCGSARLPYVHVVPLVSIARDRSSRPSVHISIEDIPPWHNRHRQGYASSREDPPYYRVA

SEQ ID NO: 154966 - protein, 106 aa, Triticum aestivum
  Clone ID: PAT_TA_49384.pep
HPPGVRPVSSVLRARSMRRQSGPDSPIFAPRTGVRPPPAPGARRHPKSSTARPAAGRPSSSSEASTRNPSSGSGGISLSASRSSRSPADAQTILPSLSLRFRTRGS

SEQ ID NO: 154967 - protein, 92 aa, Triticum aestivum
  Clone ID: PAT_TA_49385.pep
MALQYVEAQRQARPDLADWYADLADLYQRKLWHQLTLKLDQFLQIPAAQTGDTLIQLYNNFISDFETKINLLKLAQFAVIASRQYPDKDAAI

SEQ ID NO: 154968 - protein, 123 aa, Triticum aestivum
  Clone ID: PAT_TA_49386.pep
LPFFWFTSSSCMFLISSRSKTTDRSILASILVVFLPKDLASSCRFHAKLILQVLPVLHSHPSLFLGALLILLLLLLSSQTWRTFCWIVLPEASSTRRGASMAGGRRGRTARTAPPARARSTIT

SEQ ID NO: 154969 - protein, 130 aa, Triticum aestivum
  Clone ID: PAT_TA_49387.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESQVFYLKM

SEQ ID NO: 154970 - protein, 144 aa, Triticum aestivum
  unsure (1)..(144): unsure at all Xaa locations
  Clone ID: PAT_TA_49388.pep
SGAQTDLAKDTNRTYARAAECGNSDMGALLCFRQREDGCEMNKPYSNRTVSIIHTEERRXIIHDYNXTEELVTENKEQVPLTADXLLGTEVLHHDDLTRVXGDRPLKADQLTNYHLFKHGFPDEQRTIAEPVTNAKGPDHNGPA

SEQ ID NO: 154971 - protein, 144 aa, Triticum aestivum
  unsure (1)..(144): unsure at all Xaa locations
  Clone ID: PAT_TA_49389.pep
TKGPQGYENHPSEXMLQHCKNPANVQEHYKTTAPLISEDTLGQVDIIVMGIASGGTVTGLGKYLMVKNPNTGIYGDEPAXLNVLNXGKPRPHLITGNGVGFKANIVDMYIMREVLEERREDAVKMVQQVATEGGLLVGISSGAN

SEQ ID NO: 154972 - protein, 98 aa, Triticum aestivum
  Clone ID: PAT_TA_49390.pep
PTRPPTRPAILETAAIGVPPVGGGPEQLTIAVVFKDQSPQAEDLNQLKLMFNSALKKLNPLFKVSSVVVVPSLPRTASNKVMRRVLRKEFTQAKHSKI

SEQ ID NO: 154973 - protein, 100 aa, Triticum aestivum
  Clone ID: PAT_TA_49391.pep
QHDAPYLPSCSRDHDSTPSVLLGTARYSTPAVRFHRPLSHTAGPYPTTAIWCQPLLQHTIQYLPIAARDHNIICDSRHCKPYHPSPESIVLLRRHLRCLD

SEQ ID NO: 154974 - protein, 86 aa, Triticum aestivum
  Clone ID: PAT_TA_49392.pep
SHSTISQINAAATHLIERSLGLSVGRGSSVAGAEAEEAVMVKGTGAGRGAPRHRFWNMRSMQSGCEPGEHAMRAHARGSAPEHGSG

SEQ ID NO: 154975 - protein, 105 aa, Triticum aestivum
  Clone ID: PAT_TA_49393.pep
YTMIPVWSAMHPPVLCVRALLMEQLMLHIWNPVQLLINHAIQLVHLLVHEPVLVQLQVIDHARTHRHAWITRCKLTIMTCHRYISCSMNNKSMPVRLHACIACEC

SEQ ID NO: 154976 - protein, 68 aa, Triticum aestivum
  Clone ID: PAT_TA_49394.pep
HAHPGHGTGPNACVPHPPRAPSVPVARRSARRAPLVSAPLVLLLLVLASLSPCLCSHSSYLGTRVRLG

SEQ ID NO: 154977 - protein, 98 aa, Triticum aestivum
  Clone ID: PAT_TA_49395.pep
KKEREELVGRARDLCRETGNSCDRNRNKRTRSGSALPYHASPQPFGNALLESTGAKKASTSGSLRYETPSRYSIEDVRPAGGAKKFSAAYSNWAQKPS

SEQ ID NO: 154978 - protein, 107 aa, Triticum aestivum
  Clone ID: PAT_TA_49396.pep
TDYWRACLCTAAPLLSRAATEFTWRAVTDSPLNSKHRAGYDSPYSHSHCMWSWTISMSTVHTRGECTYAYTPTLEGSLDACKLANCCTYGHRQLYIFLLIRARSATR

SEQ ID NO: 154979 - protein, 122 aa, Triticum aestivum
  Clone ID: PAT_TA_49397.pep
MAAQGLLSGRHLLGRPLQSSISRSSSSRKSAFVVRALFSPAAKQNDNRQLWFAYKQSLTYLDGTLPGDFGFDPLGLADPQGTGRFIDPRWLAYGEIFNGRTAMIGVEGMIAPEALGQVGLVP

SEQ ID NO: 154980 - protein, 107 aa, Triticum aestivum
  unsure (1)..(107): unsure at all Xaa locations
  Clone ID: PAT_TA_49398.pep
WPCRPPTSLLTQGLKYTAGLPVSRRFNGASLGSVSNGGRIKRMQGWPMEVIKKLETLYYLAPVSTEALLKQDDYLVRCKRVPXLESSKAGFIFREHNAWPGYYDGPT

SEQ ID NO: 154981 - protein, 66 aa, Triticum aestivum
  Clone ID: PAT_TA_49399.pep
MGLHGTSNMLENGATWYMQEHCDRGSARLGHATLALVRDAGPSDPGNGQVLKTFQDWHGTLVKDDL

SEQ ID NO: 154982 - protein, 149 aa, Triticum aestivum
  Clone ID: PAT_TA_49400.pep
RILSFTLSSFQADSTSDIIFHKQNLKFQLPHRSGVFWVSRHKSHNRMHIWKVHCEYSASTPCTYLSSVMSCCLLLGLGHLQNPELDAPVNNANAVRGDPGPEVKGALAAVGSPGERHASASVGYGGIRHDDEGLVGAATPGWRAPLLFS

SEQ ID NO: 154983 - protein, 117 aa, Triticum aestivum
  unsure (1)..(117): unsure at all Xaa locations
  Clone ID: PAT_TA_49401.pep
VDHAYAHAYVPAEPSPPTTSNPVAAHPFPTTXHVAAAPPPPTTFHTAAATSPLPSGSRWRGAALTSLLAPXXPSHHHAPXAPCCAPSXAPTTTQLHLPGRDHALTPAGSKLPDGLDR

SEQ ID NO: 154984 - protein, 75 aa, Triticum aestivum
  Clone ID: PAT_TA_49402.pep
DEFIEFLVIQFPYSPRSTIIYSFAEISGPAKYIFIFRSTITDYILMVWSFTIGPVGKWPVRPSTLLTWCTGPHYR

SEQ ID NO: 154985 - protein, 100 aa, Triticum aestivum
  Clone ID: PAT_TA_49403.pep
FYLERTEKIIPCERNSPVMCDSSTEHLLEQLARFLFRLATTLVRFVPYCEKQRVWFLCVGLVLLKENGEEWPVHWPLLFDLVSLTYYDGVRAGLVLFILA

SEQ ID NO: 154986 - protein, 62 aa, Triticum aestivum
  Clone ID: PAT_TA_49404.pep
LIGADMDSAGTSEAAHCYIQKSVRCVPSGIFHECDLSWTLFILKLHLPASYRSSTFFLINHI

SEQ ID NO: 154987 - protein, 77 aa, Triticum aestivum
  Clone ID: PAT_TA_49405.pep
ILIYTDASAPTCLILSDLKKRFYSNQSIQLSASCPASKNQWAVVKNEIPWWRHASNVSPDANVNTGLTESSSFRPRR

SEQ ID NO: 154988 - protein, 131 aa, Triticum aestivum
  Clone ID: PAT_TA_49406.pep
MQLEEKCDISRGKWVREPNGPVYTNLTCPMLPDFKNCQKFGKDDAHLYWRWQPDGCELPRFVPERFLDVVRGKRLAFIGDSLARNQIDSLLCLLSQAEAPVDVYSDAFDKYRTWHFPAHNFTLMVMWTEFY

SEQ ID NO: 154989 - protein, 128 aa, Triticum aestivum
  Clone ID: PAT_TA_49407.pep
MSVVVTKSSPAVVAGPFDAGIVHLSSFDRCMGPTEVTLLLVFDQPIDQPVKTIKNALSQALAHYPPMAGRLAATGGDGELHIACTGEGVSFVGASASCALDDDDVTRSALLHGDPAVGYPAEYCSLID

SEQ ID NO: 154990 - protein, 119 aa, Triticum aestivum
  unsure (1)..(119): unsure at all Xaa locations
  Clone ID: PAT_TA_49408.pep
LPYVCLWIFEHAYGPRMSAICMAQESGCLAPFAGPIHMSNLAAHKIPKKHGMGPRRLKWFKTLTCGLATSRMHRSVTEAAAMLIXSGIRKSSAKSVYMQFHDMITLYALKQRGTCTAHA

SEQ ID NO: 154991 - protein, 100 aa, Triticum aestivum
  unsure (1)..(100): unsure at all Xaa locations
  Clone ID: PAT_TA_49409.pep
AGVAFKAAPKDYKLTYYTSXYETNDTDFLSKFPVSPHAAVATQVARPAVAGESDTGTRTTVGTDGLTNLDRYNGQCYHIEPAAGEDSQWICYVAYPLDLF

SEQ ID NO: 154992 - protein, 143 aa, Triticum aestivum
  unsure (1)..(143): unsure at all Xaa locations
  Clone ID: PAT_TA_49410.pep
KTRSVHIQCIAATVIASLVTSGSEFEIVKATXNHERARRSNGASAGRLSNERRITCMHVWPIEGIKEVETLSYLPPFSTEALLKQVDYLIRSKWVPCLEFSKVGFIFREHNACPGYYNGRFWTMWKLPMFGCTDATQVINEGG

SEQ ID NO: 154993 - protein, 86 aa, Triticum aestivum
  Clone ID: PAT_TA_49411.pep
MAASIQSFKARQIFYSRCYPTVQADVCWSNGTFSRAGGTSGACTAVYDALQLGNSLYRYFGMGVEQCRHSADCIIAPAPTVYALPF

SEQ ID NO: 154994 - protein, 129 aa, Triticum aestivum
  unsure (1)..(129): unsure at all Xaa locations
  Clone ID: PAT_TA_49412.pep
MARGLMKHLKRLNAPSNGTLDKLGGAFAPKPSSGPHKARECLPLILILRNRLKYALTYREEQSILMQRHIMGDGKVRTVKTYPGGFMDIICIPKTGENYRLLYDTKGRFRLHSGKDEDAXLKLCIVRSV

SEQ ID NO: 154995 - protein, 151 aa, Triticum aestivum
  Clone ID: PAT_TA_49413.pep
MAVLGLSTAFSPPRGSWIAVRLKNGAAAVAVRAEVSFVDGDEAKRLVAEEGYTVLDVRDRRQYERAHVRASAHVPLYIENEDNDIGTIIKRQAHNNFAGLFYGLSFTKLNRDFTKTVRSKFSPESKLLVVCQEGLRSTAAADALEREGFQN

SEQ ID NO: 154996 - protein, 57 aa, Triticum aestivum
  Clone ID: PAT_TA_49414.pep
EACGVGAADYCTVTCTTAWTVGLTNFDRFKRRCYLILPGAGAHRTCICIAAYSLEQS

SEQ ID NO: 154997 - protein, 63 aa, Triticum aestivum
  Clone ID: PAT_TA_49415.pep
HDEAWPTCPVHSTERELHASRMKNHRNRLCTASAHALNHLSWHWTIIICSGFLGICTSACLHC

SEQ ID NO: 154998 - protein, 161 aa, Triticum aestivum
  Clone ID: PAT_TA_49416.pep
ESPLHRNSKEIREQNSDALANGTKHASVERGHINGSGTKGDTVVGCGWGILFIEKLVPIMVNLFLEAPPNERCSASPQVIQGVGRCMNTRRDNPRGTLWRVSAECFNRVVTDEVRQENAECGSDMNSYRLSRARFWKEVADVYETFLVGSCGRVLSSDVPS

SEQ ID NO: 154999 - protein, 46 aa, Triticum aestivum
  Clone ID: PAT_TA_49417.pep
PPTRSRTRYSDAKSDSHLLVRSGAGSLGRVSHIASGKDYELSYYTP

SEQ ID NO: 155000 - protein, 163 aa, Triticum aestivum
  Clone ID: PAT_TA_49418.pep
MRSPSSSMALAPLPLLVAAAFLIPSMASSASHTLDHGLDGEALLMLGRFHGWMAAHGRSYPTMEEKLRRFEVYRSNMEFIEAANRDSRMSYRLGETPFTDLTHDEFMAMYSSNNESSWESEETTVITTRAGPVHEGNAAVEEPPRRTNTNLTAVLPASVDGRE

SEQ ID NO: 155001 - protein, 98 aa, Triticum aestivum
  Clone ID: PAT_TA_49419.pep
SFCNTTHLIKQPMAAAHVSFPFSVQPLHHSASPLAGNGGRSGRNRAFFRPSTVICPGREPASHVLSDDFDFEESITNVQALLHHHRTSRRGLLTHCDH

SEQ ID NO: 155002 - protein, 160 aa, Triticum aestivum
  Clone ID: PAT_TA_49420.pep
MASTYLSSFQATARSGGASPRPRPRVVTCHASEPSGRRSACLSLGLGLATAAQLHTAPARATADADEDPEPANNGWWLTEFPLPVPKIRNKEINNGETGTRSFVKNGIYMADIGPSFRAHAYRVRSSAFDLLALEDLLGKEASNYVNKYLRLKATFIYYD

SEQ ID NO: 155003 - protein, 87 aa, Triticum aestivum
  Clone ID: PAT_TA_49421.pep
PIVAPTSLPYLSRLSSSFAVLCSGGKKIKADTPLGLGGGLTVVIDANDRQAGKEGVYQLGDNVRANVDGYRPIYTPEEWSESGDRFP

SEQ ID NO: 155004 - protein, 71 aa, Triticum aestivum
  Clone ID: PAT_TA_49422.pep
LLLYAPEALELLQRAEPELRLPLHPQIQWQSIQNCKILFLQNLVDPSPGVQVHLKLMRNIRSSDSKDQAKI

SEQ ID NO: 155005 - protein, 100 aa, Triticum aestivum
  Clone ID: PAT_TA_49423.pep
MADVEYRCFVGGLAWATDDQSLQNAFSKYGDVIDSKIITDRETGRSRGFGFVTFALDEVMRQAIEAMNGQDLDGRNITVNEVQAVSSGGRCCARSCRRSC

SEQ ID NO: 155006 - protein, 160 aa, Triticum aestivum
  Clone ID: PAT_TA_49424.pep
THASGAAAGEPAPAGVHAVPSRRLIAGFISGTLNGLFALAGALTGAVTGALAGRASDSGVLRGARSGAITGAVLSILVLQASRAYWCSDRLGASSMSMTDFIEQLLHARFEQQRLGFSAHTSHQSQDMVAGETARRLPNCSHAFHQPCVDKWLFTHGSCP

SEQ ID NO: 155007 - protein, 45 aa, Triticum aestivum
  Clone ID: PAT_TA_49425.pep
TQRMFEVLHAPGMNAHLTCVSLKTRVLTQDANEDLAVMSTSPVQI

SEQ ID NO: 155008 - protein, 32 aa, Triticum aestivum
  Clone ID: PAT_TA_49426.pep
ERDLQARHAMPTPTMYMGPYGAPLGYHCDINA

SEQ ID NO: 155009 - protein, 124 aa, Triticum aestivum
  unsure (1)..(124): unsure at all Xaa locations
  Clone ID: PAT_TA_49427.pep
HASVIVWLPHQLHYFNAHREEPGGPHRASVNETVQGWVWEFAXAYLAVNDSGWHQLVSHWLNTHAVMEPHVISSNRHLKVTHPVHKLLSPDYRDTMTMQTLMNAGVIFEITDRAVDVYGGVHRL

SEQ ID NO: 155010 - protein, 137 aa, Triticum aestivum
  unsure (1)..(137): unsure at all Xaa locations
  Clone ID: PAT_TA_49428.pep
GGTFXPQTETKAGVGFKAGVKDYKLTYYTPEYETKDTDILAAFRVSPXPGVPPEEARAAVAAESSTGTWTTVWTDGLTSLDRYKGRCYHIEPVAGEDSQWICYVAYPLDLFEEGSVTNMFTSIVGNVFGFKALRALR

SEQ ID NO: 155011 - protein, 91 aa, Triticum aestivum
  unsure (1)..(91): unsure at all Xaa locations
  Clone ID: PAT_TA_49429.pep
HGLTSTPEYETKDTDIXAASRVSPDTGVPTKEAGAAGAAESSTGTWTTAWTDGLTSLDRYKGRCYHIQPVAGEDSQWICYGAYTLDLNEEG

SEQ ID NO: 155012 - protein, 104 aa, Triticum aestivum
  unsure (1)..(104): unsure at all Xaa locations
  Clone ID: PAT_TA_49430.pep
MGPTVVAWGATSVDPFQGLKSTEGLHVRRRYNGARLGSVRNGGRVRCMQVWPIEGMKKFETLFYLPPFSTGALLKQVDYLXIRSKWGPCLEVSKGGFIFREHNA

SEQ ID NO: 155013 - protein, 105 aa, Triticum aestivum
  Clone ID: PAT_TA_49431.pep
DPAAWEDPLEFRPERFLSGPAAKIDPMGNNFELIPFGAGRRICAGKLAGMVFVQYFLGMLVHSFEWRLPDGEEKVDMAETFGLALPKAIPLKAVVTPRLVPAAYA

SEQ ID NO: 155014 - protein, 139 aa, Triticum aestivum
  Clone ID: PAT_TA_49432.pep
ISFSPSVTAALVRSRSSKDSVRTSFSLRSFPVDQVQLGSTFGGATVSIDGPPRYPCRLKALKSTPPGFFFFNIDAFAAAVDLEDMGSRKEFSPFPFPASSSESELRSSPEESSTGSSDGAALFIPGLGKGKYAAGERAG

SEQ ID NO: 155015 - protein, 81 aa, Triticum aestivum
  Clone ID: PAT_TA_49433.pep
IICSTQPARALLMLLFYRTYVVSHYIQLCKRCLSAVTQALSYWIQHYFGAVTRLDCLIYYYRYGMLIWILLQGHRSRITSA

SEQ ID NO: 155016 - protein, 91 aa, Triticum aestivum
  Clone ID: PAT_TA_49434.pep
MVSFEMNDLKKIGLGLTGFGVFFSFLGIVFFFDKGLIAMGNILFLSGLGLTIGLKSTMQFFTKPKNYKGTISFGAGFFLVLIGWPFFGMLL

SEQ ID NO: 155017 - protein, 54 aa, Triticum aestivum
  Clone ID: PAT_TA_49435.pep
LKDGRRSALTRRWPSQPAPAPSSGAESRRASPRLLDIGGGRPARSREGQKSIST

SEQ ID NO: 155018 - protein, 137 aa, Triticum aestivum
  Clone ID: PAT_TA_49436.pep
AVGSGPGASPPPSRTNPHRRRRRRRSPPPASTTSSTTEGGVTPAPFLAPPPSPRLAPSHTLSFHGGSARRGRRGLGAAAGAHRVGRPIDNTLLQRVQAHLPTSTQVVGLLTLLIAGAALLPAGAGGADPHGRSGGGR

SEQ ID NO: 155019 - protein, 138 aa, Triticum aestivum
  Clone ID: PAT_TA_49437.pep
TRVRLSVLPPRARDLVLGPVHMQHFAHEATQTVGRRGGRAYPGDGLLACSTRGGVTQPLFINTSSEDGIDHSHTLPINGRSPLTGRCGTPARAGAHRVGRPIDNTLLQRVQAHLTTSTQVEGLLTLLIAGSTLMTAGA

SEQ ID NO: 155020 - protein, 96 aa, Triticum aestivum
  unsure (1)..(96): unsure at all Xaa locations
  Clone ID: PAT_TA_49438.pep
KKMGSVSFVIDCTMPGEDKIMEIACVEKCXQERIKVVGSMAEYLGXSVTVTLDKSKVTVTSDCALCMRFLKVLSMKHVQKHNVRDWLGVIAAIKER

SEQ ID NO: 155021 - protein, 84 aa, Triticum aestivum
  unsure (1)..(84): unsure at all Xaa locations
  Clone ID: PAT_TA_49439.pep
MATLIQLENNYEKHDSTKLKNAYCLNTIGEXDNDYSTSESDHEEITPEAKNYTXATRIIHRLXLRNKNGIFLAHKTTDQNFHDL

SEQ ID NO: 155022 - protein, 54 aa, Triticum aestivum
  Clone ID: PAT_TA_49440.pep
RRSPAPSLSPPTPPRPSPPTPRPWPRPPAPPAPATPPNTCRSAAQCSGPPGYPS

SEQ ID NO: 155023 - protein, 76 aa, Triticum aestivum
  Clone ID: PAT_TA_49441.pep
NKMAIWRVDRRKGVLILLSGAMDEFRQEHKEEHPEANGIVLASHRGSTRRGTRRSMRRRQSIYERWHTPTTARWPS

SEQ ID NO: 155024 - protein, 124 aa, Triticum aestivum
  Clone ID: PAT_TA_49442.pep
MPLSELQTDALKEAITHVAAHPKEKNRKFTETVELQIGLNNYDPQNDKRFSGSVKLPHVPRPKMRVCMLGDAHHVEEAEKIGLDSMDVETLKKTNKNTKLVKRLVKKYHAFLALKAIMKQIPRV

SEQ ID NO: 155025 - protein, 106 aa, Triticum aestivum
  Clone ID: PAT_TA_49443.pep
LHAAWSRYGRLPWKSLFAPAIALARDGYTIVSYVANALKDEEVDVLADPGLRAVFAPGGRLLRDGELCRNPALADVLEALAEDGIAAFYGGAVGERLLEDVRRAVG

SEQ ID NO: 155026 - protein, 34 aa, Triticum aestivum
  Clone ID: PAT_TA_49444.pep
YAQHLGVAGHIGVDCMHVEALKKSNKDKRRVTKL

SEQ ID NO: 155027 - protein, 127 aa, Triticum aestivum
  unsure (1)..(127): unsure at all Xaa locations
  Clone ID: PAT_TA_49445.pep
GFKAGVKDYKLTYYTPEYETKDTDILAAFRVSPQPGVPPEEAGAAVAAESSTGTWTTVWTDGLTSLDRYKGRCYHIEPGAGEDSQWILYVAYPLDLIXEGSATNMFTFIVGYVFGFKALRALPLEDL

SEQ ID NO: 155028 - protein, 116 aa, Triticum aestivum
  unsure (1)..(116): unsure at all Xaa locations
  Clone ID: PAT_TA_49446.pep
MAVTFYDLHTADGLKALEAHLAGKTYISGDGITKDDVKVFAVVPVKPHAELLNAARWYDAASEAVFXRLPDQAYEASAYSDAAAAAPAAFKDEDDDDDMDLFDDETEEDMKASAER

SEQ ID NO: 155029 - protein, 100 aa, Triticum aestivum
  Clone ID: PAT_TA_49447.pep
SCCSSSPSNAALAQAPRLRRLVCKQTTKARSSYTHGDAAGDLRSQIVRRSAPQIDRCLLFEASTPRLRRPPPLAGRRRLHPLRRRLPRGRRSPPRHGRTS

SEQ ID NO: 155030 - protein, 145 aa, Triticum aestivum
  Clone ID: PAT_TA_49448.pep
EFILFYFLFHNTETKGGGGFKAGVKDYKLTYYTPNFETNDTDILAAFRVSPHPGGPPEEAGAAVAAESSTGTWTTVWTDGLTSLDRYKGRCYHIVPVAWEDSQWICYVTYPLDLFEEGFVSNMFTFICSNVFVFKTLRALRLEDL

SEQ ID NO: 155031 - protein, 133 aa, Triticum aestivum
  Clone ID: PAT_TA_49449.pep
KGWIFSPLQTSNPFFSRSLHPVSPIADLHGRRPVPPPLMRLESRRNTSVRLQAGSQPWHGLEGLSFWPARNEVVATLRQGLCWQQQLRGVLDPAPPTSNQWGACAKLMDFLLQCYQIGVCATRPCSRYVDFCN

SEQ ID NO: 155032 - protein, 143 aa, Triticum aestivum
  unsure (1)..(143): unsure at all Xaa locations
  Clone ID: PAT_TA_49450.pep
HLDHHQRSNHRLLFIGAHTHTNTVLSIKHFINIDQQIYYNRAYITYYTHILARLQECPKAXINPNKHALAXLVECSTGTWTTVRTDGLTSLDRYKXRCYDIEPVAGXDSQWICYVAYPLDLFEEGSVTNMFTSIVSNLLIFKT

SEQ ID NO: 155033 - protein, 107 aa, Triticum aestivum
  Clone ID: PAT_TA_49451.pep
MQSPESSSSAAPVLLNIGGTKYATTAETLTQREPDSMLAAMFSGRHTLPHHPTTGAVFVDRDGKHFRHILNWLRDGAIPALSESEHHQLLREAEYYQLLGLADYINE

SEQ ID NO: 155034 - protein, 155 aa, Triticum aestivum
  Clone ID: PAT_TA_49452.pep
MYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGS

SEQ ID NO: 155035 - protein, 132 aa, Triticum aestivum
  Clone ID: PAT_TA_49453.pep
MSPQTETKAGVGFKAGVKDYKLTYYTPEYETKDTDILAAFRVSAQPGVPPEEAGAAVAAESSTGTWTTVWTDGLTSLDRYKGRCYHIEPVAGEDSQWICYVAYPLDLFEEGSVTNMFTSIVGNVFGFKALRA

SEQ ID NO: 155036 - protein, 57 aa, Triticum aestivum
  Clone ID: PAT_TA_49454.pep
HAFAPMFIYPTGTHSRPAVRRESVSKTSKTYSYAPRGDSNGLARSLDPRTTQAPVDL

SEQ ID NO: 155037 - protein, 85 aa, Triticum aestivum
  Clone ID: PAT_TA_49455.pep
HAVHNWACRCLHQTLLLACTSWSHVQSEPVAVGPTVHPRLWAAAVLAGYRVVIELLLHVRQLWMLALVLPHVMHCWNGHRRNRAW

SEQ ID NO: 155038 - protein, 138 aa, Triticum aestivum
  Clone ID: PAT_TA_49456.pep
MDGVKLKVTSRYVIIKNDIFELTLSNPDGIVTGVRYNGVDNLMEILNKEDNRGYWDIVWNPPGQRTGIFDVIKGTEFRIIHHDENQAEVSFTRSWDPSQEGKAVPLIIDKRFIVLRGSSGFYTYGIYEHKEGWPGLAL

SEQ ID NO: 155039 - protein, 103 aa, Triticum aestivum
  Clone ID: PAT_TA_49457.pep
TGPQNQRMRELFCFYFSVSTVRVISNTVARSVIKPGHRPRLYHRRLQRDSTVHAIRADYLPVKRHSASHGDRWRHMSADKADYQAGDLDEPRRFAGGLLGHGR

SEQ ID NO: 155040 - protein, 140 aa, Triticum aestivum
  Clone ID: PAT_TA_49458.pep
PRVRPRVRPRVRQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 155041 - protein, 65 aa, Triticum aestivum
  Clone ID: PAT_TA_49459.pep
SEKRYLCVLFCRAIDYSLCILQASNIVLMISTPTPPSFKNLLHSYVMTARHFINAPFPYYTIVRL

SEQ ID NO: 155042 - protein, 74 aa, Triticum aestivum
  Clone ID: PAT_TA_49460.pep
SISCASYLQIGVCPAGWPRDLTTSRRPQTRFPTWSFGIAASEAANRTLLLMDPAPAPSQWMTRGSRGTRGLSSA

SEQ ID NO: 155043 - protein, 119 aa, Triticum aestivum
  Clone ID: PAT_TA_49461.pep
MGLTEMALSATSGGTFQGLKCTAGLSVRRRCNGARLRRVRNGGRIRSMQVWTIEGIKKFETMCYLAPLSTDALLKQVDYLIRSKWVPCLEISKVRLILREHKACTGYYDGRYWTMRKLS

SEQ ID NO: 155044 - protein, 125 aa, Triticum aestivum
  Clone ID: PAT_TA_49462.pep
GDMGSLFPPWPLPSTVRPLPAARRRPREHHHAPLAVPSSSSHHVRLPPPSSSRSELRLTQTDLARAHTPASRRAVLRPRTAPEADAAAALMVVRAEAGDFARAQSIWAQLLLSSARPCLAAAAPS

SEQ ID NO: 155045 - protein, 58 aa, Triticum aestivum
  Clone ID: PAT_TA_49463.pep
AACSTWSINAACFTSTYYIRNRAQTCDPAHLLQSESEVIGRHRSRVYPWRGCSRQDND

SEQ ID NO: 155046 - protein, 73 aa, Triticum aestivum
  Clone ID: PAT_TA_49464.pep
VHKSSTTSHPKGQQSIVSRYIHRHTFVGSYVQYYITRYIPSCLSKKLIHPRVLLHQIDTKMSITSLDARNRSF

SEQ ID NO: 155047 - protein, 114 aa, Triticum aestivum
  Clone ID: PAT_TA_49465.pep
TKKKVPWLHCHLEFWSRWGKNLAPPAGLKNYLTCFGWNPWPPKKWGKMEGDRGFAVGDFQFEVWPFQGGRWGSIFHGLFFFNFKWTYSFFSFGPFFIFQGRFQNYPAGWPVHPH

SEQ ID NO: 155048 - protein, 70 aa, Triticum aestivum
  Clone ID: PAT_TA_49466.pep
YKLVRMSLIGDVLHGASASGGMCTPRSSWSLVCFASRTWSTIQGIHHMYGHERASHHIRASQGPRYMRAR

SEQ ID NO: 155049 - protein, 50 aa, Triticum aestivum
  Clone ID: PAT_TA_49467.pep
VIVVLVCIMGARTTYSLLYLASSYYLLLFLFSASCFAIFHSCHERCFFPS

SEQ ID NO: 155050 - protein, 108 aa, Triticum aestivum
  Clone ID: PAT_TA_49468.pep
MSPQTETNAGVGFKAGVKDYKLTYYTPEYETKDTDILAAFRVSTQPEVPPDEAGAAVAAESSTGTWTTDWTDGLTSLDRYIGRCYHIEPDAEEDSQWILYVAYPLDLF

SEQ ID NO: 155051 - protein, 58 aa, Triticum aestivum
  Clone ID: PAT_TA_49469.pep
SIFFLPHAGRRQALARLMGIGWSMHAGDGGSTKLSSSPARTRHLTTSSIASHEDRARA

SEQ ID NO: 155052 - protein, 118 aa, Triticum aestivum
  Clone ID: PAT_TA_49470.pep
MDVAGAQARALPLLLGRPAVSLRCSVSFSCGGARRSWVSSATADGEDGGPGYERVAMDTPGAYRLVDRSTGKSVIVWGGVDDGGEPGVPSLGVLSRVTGDRSVFKGAANGGTTASVGS

SEQ ID NO: 155053 - protein, 89 aa, Triticum aestivum
  Clone ID: PAT_TA_49471.pep
SKEFQVCQGKQYRSKVEVLLRFHNHLTIIVWIKFTGQWLDAVSCSPGKPCGSRVIYSHQSCPRTYSMDKAHTAHLCESSYGFLCRFETE

SEQ ID NO: 155054 - protein, 81 aa, Triticum aestivum
  Clone ID: PAT_TA_49472.pep
KACAHACAHAFVHATVAVFVDACLLALSPRVGLAVMWYQLTVYQIAQFKEAYALFNEDRDGFLSIEELMTRRLSLRHSHTD

SEQ ID NO: 155055 - protein, 73 aa, Triticum aestivum
  Clone ID: PAT_TA_49473.pep
MEVIRGPILPRCAAPALTSGSRIGGQLLKRVRMRRRASCGGGVSPGDGYDGVSPRFFGAPTQQHMHGTSSWPG

SEQ ID NO: 155056 - protein, 153 aa, Triticum aestivum
  Clone ID: PAT_TA_49474.pep
PRVRQGEGAIYSLIPSLIRFPAIISSLQSCRLGVCGIACLPASFATAAAAAVAAPAEQGRLRLGGAAREGRPCRGGWRRTWWTWCGRCSPGGCRRACWSPTRSPAACVPGRSAPSLWGEKISFRLITSDSFLHADSFLTNPSMDTPHYNVHSP

SEQ ID NO: 155057 - protein, 80 aa, Triticum aestivum
  Clone ID: PAT_TA_49475.pep
VSRSQHGSSFTMRMLATLSSPSAQAIRIVVVPTRGSPTHHHHRPQRQYSSTCRGYLGACNYWRKMSKRRSLEEDDVEGGF

SEQ ID NO: 155058 - protein, 72 aa, Triticum aestivum
  Clone ID: PAT_TA_49476.pep
MVYWCYSAIRGVMLLIGRWPVVQVQMEMKERQRWRPEEDAILRSYVRQYGTRERNHGTQLFNRPKKRYDEFI

SEQ ID NO: 155059 - protein, 88 aa, Triticum aestivum
  Clone ID: PAT_TA_49477.pep
TIWQSRIAVALLLLVLLAYCDVRELNQKDQALVTERGAGAGVRAGHRVALEKALELPEEPLAGTDTVTRTHTGPAVVVLALAGIPEHR

SEQ ID NO: 155060 - protein, 120 aa, Triticum aestivum
  unsure (1)..(120): unsure at all Xaa locations
  Clone ID: PAT_TA_49478.pep
MEGKEEDVRLGANKYSERQPIGTAAQGSEDKDYKEPPPXSKCASVGIQGIAWSFGGMIFALVYCTAGISGGHINPAVTFGLFLARKLSLTRAVFYIIMQCLGAICGAGVVKGFQQGLYMG

SEQ ID NO: 155061 - protein, 96 aa, Triticum aestivum
  Clone ID: PAT_TA_49479.pep
YNHDHAGRVIDSSRSMHVNAIQHDRSLAVDPAQVWALRNAQPILHHQTVYHQSLKDVTAIIAEVPFLIIERMGAFRPPLLVWYFVCRHSACVGVSQ

SEQ ID NO: 155062 - protein, 141 aa, Triticum aestivum
  Clone ID: PAT_TA_49480.pep
LIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHSSSQYPDVNH

SEQ ID NO: 155063 - protein, 84 aa, Triticum aestivum
  Clone ID: PAT_TA_49481.pep
FLLVTSPIPKMRKGALALYLLLLLTFASMAEEDAAHHRLRPHQHETQGERMQTARKVGRMAGGSGEGSGRNTGGGAADTGPRRT

SEQ ID NO: 155064 - protein, 64 aa, Triticum aestivum
  Clone ID: PAT_TA_49482.pep
VRSNIVSILCCLIRVMSLAVHIGDSRYDHFFAVYPLDHVWLLIEHSLVVVVEVLTGELQFGVLH

SEQ ID NO: 155065 - protein, 97 aa, Triticum aestivum
  Clone ID: PAT_TA_49483.pep
GQSHRHTELLMPVVHVHGRERAPARTRQEPKRHHLQRVAQELIHTQLRQPAGLPPVPACRAAAVTLPRCPSAAEAASARGHVYTRADGHCGAGTSGG

SEQ ID NO: 155066 - protein, 142 aa, Triticum aestivum
  Clone ID: PAT_TA_49484.pep
QTQPMAMQSATQSGIQQNQLNSVQQSVQSLLQQPQQSVGRQQQQAQPSMHQQPSLQSPQPNIPLQQQHQQLMGQQPNAQQNQLIGQQNGAMEMQQQQRLPVQSNNLLNVQQTQQMLNQTSMPLHQPQQLGSQSNMSSLQQQQ

SEQ ID NO: 155067 - protein, 127 aa, Triticum aestivum
  Clone ID: PAT_TA_49485.pep
MGTAAASSFLSPAAKFALQSRCPGAKTAPRSVRFPPVRAQQEVKEEEPAATVPPLQEEQATAAAAAAKGPAQSLPRQPRAESKNMGREYGSQWLSCTTRHVRIYAAYIDPETNAFDQTQTDKLTLML

SEQ ID NO: 155068 - protein, 143 aa, Triticum aestivum
  Clone ID: PAT_TA_49486.pep
SSSRGPLSPFPGGAGPFLRHQPPPGGDSDGGASMDEFDEDDEDEDEEEDDGEDQDAELAARSSQQRRASSPAGIGRPVANGENGTRQIQEGQQWQLYSCGTEQHGRSSSRGDEEPGSVPREMRCEDGYGVIGRREAGPASSYW

SEQ ID NO: 155069 - protein, 104 aa, Triticum aestivum
  Clone ID: PAT_TA_49487.pep
PRVRKKKKKKKKKKKKKKGRPIIRNQDTILMTWEAKVGVSGHLTRFPGPSFSLGCLEYPYLSPLYCPCARPPVARCLMRWATPLFLPSFSPPECRTGRPLYLDL

SEQ ID NO: 155070 - protein, 86 aa, Triticum aestivum
  Clone ID: PAT_TA_49488.pep
RRGALFLAKFSYLEETCVTATLAMLAGLALMAPPARGLQLAMLSTGLHVWTRTCSNQIRGTSLEDTRGLRSWDGCTTSQTTEMRGG

SEQ ID NO: 155071 - protein, 53 aa, Triticum aestivum
  Clone ID: PAT_TA_49489.pep
YESIIQRKFHARIKKKKLFKHQYILIKFLKFLVLVIIILITFCTKYILAIYKL

SEQ ID NO: 155072 - protein, 57 aa, Triticum aestivum
  Clone ID: PAT_TA_49490.pep
NLDFKMKILSYYFREVFVFDCSLTCSDYYYVQMLSVHMLLVSEFSVLLQNGCNFGFL

SEQ ID NO: 155073 - protein, 71 aa, Triticum aestivum
  Clone ID: PAT_TA_49491.pep
RPPMVFKKVFRGGVDSRGDHRPRLGIFYLKTKKGLLFPFQWNPGDLFRGCIKPGGVVFFFFPKIYLAKSPG

SEQ ID NO: 155074 - protein, 53 aa, Triticum aestivum
  Clone ID: PAT_TA_49492.pep
GPHASYMMLIELNKPSTTAMHFTSSSVGIGISTVVHVYVYSSYSFVRANERVA

SEQ ID NO: 155075 - protein, 104 aa, Triticum aestivum
  Clone ID: PAT_TA_49493.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCHIP

SEQ ID NO: 155076 - protein, 88 aa, Triticum aestivum
  Clone ID: PAT_TA_49494.pep
PTRPRTRGKRAHWRANSSHPMTQPPGKLMDTIRRPVAAASSLHHSAGKHLVTLAQRNGVNRRCLLTLLASAAAIPEASESRKALLQGM

SEQ ID NO: 155077 - protein, 144 aa, Triticum aestivum
  unsure (1)..(144): unsure at all Xaa locations
  Clone ID: PAT_TA_49495.pep
HARPARGQAVLVLGASSPSTLASSPGLPRPAPTPPPTXAHPAPSPPLKIQGTLARPPPAPRNAPLLTMSSLSIPPPLLRSSHSPSPPAAAAAKANWRKRAARVRVRAPVAALAGDGGCAGTGMEQQHLQAGSASGSPVREKPFM

SEQ ID NO: 155078 - protein, 109 aa, Triticum aestivum
  Clone ID: PAT_TA_49496.pep
MASGAARSSRSRPAGHSGVLPAGGVGGGAGVQLADKLKIFKTDKFDPDSYVQSKCQTMTEKEIRHLCSYLQDLKKASAEEMRTSVYANYAAFIRTSKEISELERELLSI

SEQ ID NO: 155079 - protein, 143 aa, Triticum aestivum
  Clone ID: PAT_TA_49497.pep
DGVIWKGDKLIDGVPETLDLLRSKGKRLVFVTNNSTKSRKHYGKKFETLGLSVNEEEIFASSFAAAAYLQSIDFPKDKKVYVIGEEGILKELELAGFQYLGGPTDGDKKIELKPGFYMEHDKDVGAVVVGFDRYFNYYKVQYG

SEQ ID NO: 155080 - protein, 44 aa, Triticum aestivum
  Clone ID: PAT_TA_49498.pep
DLFLAGFANRNMMLSRISYFVRRMYLVYLVHYKFINDYHPAESK

SEQ ID NO: 155081 - protein, 128 aa, Triticum aestivum
  unsure (1)..(128): unsure at all Xaa locations
  Clone ID: PAT_TA_49499.pep
MAPVGMAFSATTAAPFQGLKTTDGLPVGRRSSGRLSSHSNGGWIKSMQVWATEGIKRLETLYYLPPLSTAAILKQGDYLIRSKRVPWLEYXKAGFVFREHNSCIGYYHGLYWTMXELPMLGCTDATQV

SEQ ID NO: 155082 - protein, 93 aa, Triticum aestivum
  Clone ID: PAT_TA_49500.pep
SRGLIPFNKSGKVNPHFPYLLHLGISGFDSKFLKIYPQLAPTPLQLEEDLEQLKVLENGYKMKVIKVDHDAHGVDAPEDVEKIEALMRARNIQ

SEQ ID NO: 155083 - protein, 80 aa, Triticum aestivum
  unsure (1)..(80): unsure at all Xaa locations
  Clone ID: PAT_TA_49501.pep
MLPQTETRAPVVFKAWRTDYQWTHYTRKHETTATGLLTPLRVSPQPGATARQAGAAGSGEYXVGAWTPVYTGGLTNLDRY

SEQ ID NO: 155084 - protein, 100 aa, Triticum aestivum
  unsure (1)..(100): unsure at all Xaa locations
  Clone ID: PAT_TA_49502.pep
DRQSPFAPDSGLLPGPLVRSNARDADAEADELQGSAFQRVHSDFMCLSRGLTTDIRNRAECIYVQKFVLXNFLHKHTKTVILYMDNPVPNTNSFQLFICT

SEQ ID NO: 155085 - protein, 113 aa, Triticum aestivum
  unsure (1)..(113): unsure at all Xaa locations
  Clone ID: PAT_TA_49503.pep
SRXSIVATSDRLSAFGLQCQCSLPVSSRVDQLIASLCSLWSSVSDTLVWEDRSGVVSGIGGASAILGAAGILAPSSLHVLFPWSKPHNRFEDAVEMRTTLPPIRTIEDSAHVD

SEQ ID NO: 155086 - protein, 110 aa, Triticum aestivum
  Clone ID: PAT_TA_49504.pep
PFFLPTVPSLSGEILFEPPSSKETDGNTTEDIGHKKMADLSSYFSRLLQSCGELESYSAFTDYLKGLSPSSLDMELRMLQLIDDDEVEESEEPRPELQSISLLLDYFIHE

SEQ ID NO: 155087 - protein, 77 aa, Triticum aestivum
  Clone ID: PAT_TA_49505.pep
RLLDTVTIGSDRGMNTDTRMTQCETTNIYSSRRDARGDSDLFKKMISVISHVFYNCVILDWSTSNNDGSSLNTHTHT

SEQ ID NO: 155088 - protein, 135 aa, Triticum aestivum
  Clone ID: PAT_TA_49506.pep
RSRAITPQDPHTQEQERSAHQVRDHGGPGGSHHLPADPPPRAPCSRHVGRRRAPRLRGRGDRHLWAGAGPGRLLLLLLCRRRGRPALRPGAGGVRRRAHRGHHARVPARHAGVRAGRDGGAHRAAQGVDGERVRL

SEQ ID NO: 155089 - protein, 36 aa, Triticum aestivum
  Clone ID: PAT_TA_49507.pep
MTDLNLPSIFVPLVGLVFPAIAMTSLFLYVQKNKIV

SEQ ID NO: 155090 - protein, 132 aa, Triticum aestivum
  Clone ID: PAT_TA_49508.pep
NLNFPQKNFFPKGCRSCRAVKYNSSNSSVFGGTGLKVPSVVVADPDANSGSSSGIGSGLVGATKWQRQPRRAGARKVTEAGIGRRCTRAEDKGAEAAVVEKRTSMLSSLSLTQQCFFLFLFCGGRPAGFWGL

SEQ ID NO: 155091 - protein, 48 aa, Triticum aestivum
  Clone ID: PAT_TA_49509.pep
IDRLGKLSETCERPELKSTQPRQEMKADLHQATVLPVTSTGPRNSIAR

SEQ ID NO: 155092 - protein, 102 aa, Triticum aestivum
  unsure (1)..(102): unsure at all Xaa locations
  Clone ID: PAT_TA_49510.pep
ELVLYIICFIRGIATILTEIPCYNSPRLPFVKKYNILEGISDRIHILPDAIVSEAAPLKKDDMEYALDIYHPNRIIRRIILNCPTFATTLWKKXLERKCKLY

SEQ ID NO: 155093 - protein, 81 aa, Triticum aestivum
  Clone ID: PAT_TA_49511.pep
PRVRGRVGPPSTPSALASKNQQESQLQLQAQPSNESIDAAIGDVLSKPWLPLPLGLKPPSLGSVMGELERQGVANVPQACG

SEQ ID NO: 155094 - protein, 87 aa, Triticum aestivum
  Clone ID: PAT_TA_49512.pep
STRPECPGSSWFSPMPCPSTAPIVQAPSGTPTTSVSSILGKTLTIKTRTMHNRRVSTDRAMMLMTACKLLLGRQVLRPQPMLFRMRG

SEQ ID NO: 155095 - protein, 67 aa, Triticum aestivum
  Clone ID: PAT_TA_49513.pep
SKTVVTLDIKNKMSPTRLASFCHVTYAMLTDPNSTTEVTYCANQAAKRTVSMNSFVDLYTVHYSTND

SEQ ID NO: 155096 - protein, 92 aa, Triticum aestivum
  unsure (1)..(92): unsure at all Xaa locations
  Clone ID: PAT_TA_49514.pep
MALTVMWSAATADDTFQGLKFTVGLPDTRRSNTEAGLMGVKNGRRIRCXQVWPIECLKTDGTLCYLPPLYTEALLKQDDYLMSSKRAPCIEF

SEQ ID NO: 155097 - protein, 105 aa, Triticum aestivum
  Clone ID: PAT_TA_49515.pep
KILAKESRPGAHTLSTRVGARLPPGRAPCLVGPLVLHRPQLQLYIFTFGEKKIEEKDSSRFTIRSRRQALISLGRADLESVRSSGEGNPSSSSSSTFLHHQFRDA

SEQ ID NO: 155098 - protein, 96 aa, Triticum aestivum
  unsure (1)..(96): unsure at all Xaa locations
  Clone ID: PAT_TA_49516.pep
MVTTPPILKCYGLLLVGLCCTFSADAPFLVSHKKVDLLQPKPVXQRFGGSLDLYNQGSATTYDVAINDDSXAKEPYKLVFREVYKTLKRLEPGATA

SEQ ID NO: 155099 - protein, 122 aa, Triticum aestivum
  Clone ID: PAT_TA_49517.pep
PRVRPRVRPRVRLVLDPGKRDGVVLPGLSQNPDSSLSWLLGARGRAVLTSERPNKKRKLLGADAGLEQLVVLPPLEGDSGSKCDVCCLGESDAASNRMLQCNRCKVSVHQKCYGVQVEPDGY

SEQ ID NO: 155100 - protein, 138 aa, Triticum aestivum
  Clone ID: PAT_TA_49518.pep
DAWGELQYCVLSTIFITERARVQAEAKAAEEARKRAEAVAVAEAAAEAKRLREREREASRQALQQMEKTVEINEGNLFLKDFEMLGTVTGEQNLNLVGAMSPSHMPEPLGSQLGGNPLEQLGLYMKNDDEEDEEVESA

SEQ ID NO: 155101 - protein, 82 aa, Triticum aestivum
  Clone ID: PAT_TA_49519.pep
MEETVTNVSGYQTIVKRKLSKMAYYYYTYRADDKWTLKENREAFSRILLSSRILIDVSTIDMTTSELGIKISMPIMIGPTAF

SEQ ID NO: 155102 - protein, 81 aa, Triticum aestivum
  Clone ID: PAT_TA_49520.pep
TTSALTTTGLSGVATATLALVRLLCGLVRGQLYGERNALSATAIHASKDELTHVSVYMQQHLSALMLDRMEVYRLRGRTLE

SEQ ID NO: 155103 - protein, 87 aa, Triticum aestivum
  Clone ID: PAT_TA_49521.pep
WPNQSLMGQIFWRFACTCLSLKPSCVGCCAIRRGASCGDSPVDVYPLIQVRLRFSGGPLVTPESVDAPDPSVYVVSGHADSSCSSSG

SEQ ID NO: 155104 - protein, 91 aa, Triticum aestivum
  unsure (1)..(91): unsure at all Xaa locations
  Clone ID: PAT_TA_49522.pep
RPPTLSRQGGARARCGFLSGWTTKILXHSPXLPSRGSRAWRGADPVRVLDRHGQRPGYPGGLLGPAGVAERDLDCAEPCVLGAAGQRSLYF

SEQ ID NO: 155105 - protein, 130 aa, Triticum aestivum
  Clone ID: PAT_TA_49523.pep
HASAHASARNEPLRELLVMHEGRRVMLQGGTGAALQPPHGEPSLFPTAATPPRASSTSMMRRQPPWMLCCKRQRDATTTREKCYIPRQLSFRLLRFFAGTGINFCYYRRTFCYIHQDGAATSRRRRQRFC

SEQ ID NO: 155106 - protein, 130 aa, Triticum aestivum
  Clone ID: PAT_TA_49524.pep
QHLQKNHAPRTRAHKRVSFTNTSWLRNRTGKRAKERKWHLEEEREVAGPARRPWGCAQARHRVARHRGARRTARPGACPSRAPRRGGPRGFWRRWRLDWGRDGRRWGWGWGSGRPGVVVEDLAVTDLVGW

SEQ ID NO: 155107 - protein, 128 aa, Triticum aestivum
  Clone ID: PAT_TA_49525.pep
MVATPIRLSSLRYAPPCPAPRGRFAAARVKAEAVAMATEKLGVRVERIPAESRLSELGVRQWPKWGCEKSKFLGTYSAKETCYLLQGKVKVYLNVQEGVVEICGGDLVVFLKVMSCTCDVTVARDKHY

SEQ ID NO: 155108 - protein, 54 aa, Triticum aestivum
  Clone ID: PAT_TA_49526.pep
LKTWAGKEENVKAAQEALYVRCKANSEATLGTYKGDAKLGDGAAESLHVKDYKY

SEQ ID NO: 155109 - protein, 112 aa, Triticum aestivum
  Clone ID: PAT_TA_49527.pep
MKLIAAYLLAYLGGNSSPSAADVKNILDSVGAEADEEKLEFLLAELKGKDITEVIASGREKFAAVPSGGGAIAVGAPAAASGGGAAPAAESKKEEKVEEKEESDEDMGFSLF

SEQ ID NO: 155110 - protein, 135 aa, Triticum aestivum
  Clone ID: PAT_TA_49528.pep
ARPGRPSRLARRIGCPARSRGSNSCTSCIVHGRVDQVLFRFLLLDRLGRRGEDGGGGGSPRRRGRRALPPSVAGVRSSSRRGSGGDVGEPPRSRSMSSIGFGRVEIRHAEVGGDKCSLHFLQSADQWLFGLLVDE

SEQ ID NO: 155111 - protein, 140 aa, Triticum aestivum
  Clone ID: PAT_TA_49529.pep
RPLLAVVLTIAILAAASPSPRRGRDCDLLLRRGGWSTQAATDVDAGVTRDREEDAQRQQAGKHPATAAAAMAPEQLAWMQWEARRVPSGGCARAGTREPGAIRWEQDKEAFEAERSAARGLLRLSLSRLPAATLSPVDWL

SEQ ID NO: 155112 - protein, 73 aa, Triticum aestivum
  Clone ID: PAT_TA_49530.pep
VELCVLQGSLPPPCVKKDHECLGSKKLVFVHSSLASGRRPSTGPNLGQAPLNCLIPSCTTIRFGFPLSHLLPA

SEQ ID NO: 155113 - protein, 138 aa, Triticum aestivum
  Clone ID: PAT_TA_49531.pep
ELNPLQEASGGKKISKDLVRKDADKTGLATIGEEVKRLAQRARDNSLKPQDYEAFSDFPDFVCSDRGGYPGSNNGKCNYISKMNFYLRAGSMSDDVILVSDGDESSNYSLRFEELKGFKNSSNSSKGLVQKIDSDYYT

SEQ ID NO: 155114 - protein, 95 aa, Triticum aestivum
  Clone ID: PAT_TA_49532.pep
MMHGKSDSDITSLAASSPPRSPKRGAGAGGGAYYVQSPSRDSAHDGGGAGGYKSSSMQATPVYNSPNESPSHPSYGRHSRASSVSRFSGILRGSS

SEQ ID NO: 155115 - protein, 117 aa, Triticum aestivum
  Clone ID: PAT_TA_49533.pep
PRELPGELHGALSRALVLVKGKVKGTCFVAFLLLLADAQADDENQDVQLLDPLMHAKRLDKLADKLPLIPYLLAYGVTLVGRLLAGELYDTMYDTQWKLHRNLAFTYVFSYGTSTET

SEQ ID NO: 155116 - protein, 58 aa, Triticum aestivum
  Clone ID: PAT_TA_49534.pep
APDRKHGTSRTSAPYLIKVVGFSVDDVRHVHVMQLKPRWRNTMYLSGLNFKLYTMYLP

SEQ ID NO: 155117 - protein, 139 aa, Triticum aestivum
  unsure (1)..(139): unsure at all Xaa locations
  Clone ID: PAT_TA_49535.pep
PRVRSKVQYKEPMEPPLHHLALDKYCNVAYAMKGTHLWNIVANLMEPLQVXVAIHTDTKELLQELCNTCDETCTLXLFDEAQRGLTRTSYFCAHEVYSVIPDIKTXSNPLPNGLPIGVLLVTEKVAAAINYGDHSTTFG

SEQ ID NO: 155118 - protein, 89 aa, Triticum aestivum
  Clone ID: PAT_TA_49536.pep
MATYELAWCDHQNLLFVEMNVQLLKGFVRSPISTTLPQITGRLYITWGILWSFHEAQSHVLLTSLIISWSITEVIRYFFFAMKETFGFA

SEQ ID NO: 155119 - protein, 128 aa, Triticum aestivum
  unsure (1)..(128): unsure at all Xaa locations
  Clone ID: PAT_TA_49537.pep
HACADSKTDFKIILTMGGTRFIGRXLFKKLHQDAHHTTWMTPITEPMPHESPAESAAXYAKVFYKERDWKGDRKDXTSLKTKVSNEGYNVNDHMDARVATILYAILDTEPNLDQSMYGVYVGVYLISH

SEQ ID NO: 155120 - protein, 55 aa, Triticum aestivum
  Clone ID: PAT_TA_49538.pep
ASALFYTLSKSALFYSLRSQSSFCPVLLTRVDLLSSGPYLSCLSPYTKFPMEKRI

SEQ ID NO: 155121 - protein, 92 aa, Triticum aestivum
  Clone ID: PAT_TA_49539.pep
RSRWRWFRPPRCQRRSSRTRRWDRPRRPSPWRQLRAMKRRRSAGVASQPKKRQSSKAGFFLRTVCLFFRFFTSESLSPSVLIACSEFIVKEP

SEQ ID NO: 155122 - protein, 137 aa, Triticum aestivum
  Clone ID: PAT_TA_49540.pep
DDEKLMSETGLEAYRFSISWSRLIPKGRGAVNPKGLQYYNNLIDELENHGIQVHITLHHLDLPQILEDEYGGWLSPRIIEDFTAYADVCFMELGDRVASWTTENEPNIGILASYDVAIFPPGRSSNPFGATKSTAGD

SEQ ID NO: 155123 - protein, 81 aa, Triticum aestivum
  Clone ID: PAT_TA_49541.pep
CAGGIQVDPRGLQRLLGPGSRERAAPVLSEEAAMAYQERVVYHCNIPRNAGYFHKDDPNVGTEPGGAQACGDVMHLQIRVD

SEQ ID NO: 155124 - protein, 97 aa, Triticum aestivum
  unsure (1)..(97): unsure at all Xaa locations
  Clone ID: PAT_TA_49542.pep
FKCYREGLMSPQTETKAGVGFKAGVKDYKXTYYTPEYETKDTDILAAFRVSPQPGVPPEYARAAVAAESSIGTWTTVWTDGLTXLDRYKGRCYHIEP

SEQ ID NO: 155125 - protein, 58 aa, Triticum aestivum
  Clone ID: PAT_TA_49543.pep
DLAAGRSGHVSLPSRQLLHAVVVLADMQQLPYPRRAAVGTPLSLSPDAGTSSSTAATC

SEQ ID NO: 155126 - protein, 93 aa, Triticum aestivum
  unsure (1)..(93): unsure at all Xaa locations
  Clone ID: PAT_TA_49544.pep
MATAYAPPQACQEMKCGXRAPXPRGLSGASLTRRPRLAXRPASLTRXTYQEGQPFNGDPCFDWLATPVSCSPLVAWDLCNLPAYRTDGRPLLR

SEQ ID NO: 155127 - protein, 75 aa, Triticum aestivum
  Clone ID: PAT_TA_49545.pep
PAPPESGSPRPHAPTSCREGAGGVSCLLFQPGDIGSFSFTALIMLATEFLAAPGNSQTRDEEACVRSRSRSRARF

SEQ ID NO: 155128 - protein, 137 aa, Triticum aestivum
  unsure (1)..(137): unsure at all Xaa locations
  Clone ID: PAT_TA_49546.pep
MDLCHHKQKLKQELGFYAGVKDYKXTYYTPEYETKDTDILAAFRFCPHPGVPADDARAAVAAESSSGTWTTVWTDGLTSLDRYKGRCYHIEPVAGEDSQRICYVAYPLDLFEDGSXTNMFTSIGGNVFGFIALRALC

SEQ ID NO: 155129 - protein, 107 aa, Triticum aestivum
  unsure (1)..(107): unsure at all Xaa locations
  Clone ID: PAT_TA_49547.pep
VRLRRRXVRRWRHXGLRRXTPSLPPRTPGSVRIPPRRPSLTPPNPSSLPNSFSYLSPRNQAGPEANPRETATRKSGYLYGRSNKIAPACSDGDYCVAARWQHASSGE

SEQ ID NO: 155130 - protein, 132 aa, Triticum aestivum
  unsure (1)..(132): unsure at all Xaa locations
  Clone ID: PAT_TA_49548.pep
APRPRGAARQGAPGRLSAGSSRLGGARRGAGTRXTRAPSRAGPPRGGPGSAAARRRIAPTAVPHHPPPPQPPPCRPSALLAATTAISMCSAPLMAAARVALLLSWRVSEWLRCGPFGRSGASEAGLTFADAW

SEQ ID NO: 155131 - protein, 119 aa, Triticum aestivum
  unsure (1)..(119): unsure at all Xaa locations
  Clone ID: PAT_TA_49549.pep
MSPQTETKAGVGFKAGVKDYKLTYYTPEYETKDTDILAAFRVSPQPGVPPEXSGAAVAAESSTGTWTTVWTDGLTSLDRYKXRCYHIVPSAGEYSQWIXYVAYPLDLFEDGSXTNMFTS

SEQ ID NO: 155132 - protein, 66 aa, Triticum aestivum
  Clone ID: PAT_TA_49550.pep
ILLLNLYGGEGIQGEKMDQQVEEASVSVSSVPPEVEEELDVEEEDLDVDEEDMGAEKMALGPQVPL

SEQ ID NO: 155133 - protein, 126 aa, Triticum aestivum
  unsure (1)..(126): unsure at all Xaa locations
  Clone ID: PAT_TA_49551.pep
MSYWEGLMAALTETQAGAESKAGVKDDKLTYYTPEYASKDAAIVAAFRVSSQAGAPPEVAGAAAAAESATGSWTAAWTDGLTSGVRYIGRCYHIEPDTEADSQXICHGTYPLDLSEEGSEANMVTY

SEQ ID NO: 155134 - protein, 77 aa, Triticum aestivum
  Clone ID: PAT_TA_49552.pep
KRIILNLIVCALLRKLLGARHRSRLYGLHLRACRALPSRLLLHTLGPCDRICLLPKVALCPSSLVLYLRAGSSPSMP

SEQ ID NO: 155135 - protein, 103 aa, Triticum aestivum
  unsure (1)..(103): unsure at all Xaa locations
  Clone ID: PAT_TA_49553.pep
ILLPDVWLQILKLSEPETHKPPGSLLRSAAPVQEKLVVAMAPVPLSTFESSPARHPCSDSYQGXRRGAVSASSSSSSANADEVXIEGAGIEGLATELSLRRLG

SEQ ID NO: 155136 - protein, 69 aa, Triticum aestivum
  unsure (1)..(69): unsure at all Xaa locations
  Clone ID: PAT_TA_49554.pep
MGIDLVAGGWFLMTLRVAPLSDDVYLMLLVMLYRFLERRTLIXFYAVILLMLFMSMTNRPPLSMRXLSN

SEQ ID NO: 155137 - protein, 48 aa, Triticum aestivum
  Clone ID: PAT_TA_49555.pep
SARSAPPRPRSTPLSLPRHRTRRSGSTCQGPSCSRTHERRSAAGREKM

SEQ ID NO: 155138 - protein, 60 aa, Triticum aestivum
  unsure (1)..(60): unsure at all Xaa locations
  Clone ID: PAT_TA_49556.pep
NFAKPLGIVLFVDAPFAVQPMRPLVKPRLKQYASLGRSCDAXTERKEYFTEETVPPDFRR

SEQ ID NO: 155139 - protein, 115 aa, Triticum aestivum
  Clone ID: PAT_TA_49557.pep
HASGHLEFMYDQAPESMRSTATALFWLSISLGSYVSTLLITIVHRWSAGPDGSNWLPDNINRGKLDYFYWVVTLLQVMNLVYYLICARQYTYKPVQHYKEEEGEDKSMVELQQKV

SEQ ID NO: 155140 - protein, 46 aa, Triticum aestivum
  Clone ID: PAT_TA_49558.pep
LGQAAWDRGVCEYSNISSTNVIALLSPAINYMPFCDDIVLLITVLN

SEQ ID NO: 155141 - protein, 77 aa, Triticum aestivum
  Clone ID: PAT_TA_49559.pep
TARHTDEHMHYRTVHIRSRREYHSPRDALYYSTSIATRTAVHAVLGETVMRFCRLKCLSRRYPRSPYECCHGCVFVM

SEQ ID NO: 155142 - protein, 63 aa, Triticum aestivum
  Clone ID: PAT_TA_49560.pep
ACSIDYCTILVYSRRYNHCSSNRSHECSYKVLLQQRSTPIKSNSTKNTCATLPWSSGPCALRK

SEQ ID NO: 155143 - protein, 73 aa, Triticum aestivum
  Clone ID: PAT_TA_49561.pep
MAPKSKRGKAKGEKKKKDEKVLPVAIDITVNLPDQSDVILKGISTDRIIDVRRLLCVHTATCAITNYSLSHET

SEQ ID NO: 155144 - protein, 45 aa, Triticum aestivum
  Clone ID: PAT_TA_49562.pep
EVYYRTYLDMTWSSDLRRELEFTKYDEGVRSQRSMLTYDCMLFYT

SEQ ID NO: 155145 - protein, 135 aa, Triticum aestivum
  unsure (1)..(135): unsure at all Xaa locations
  Clone ID: PAT_TA_49563.pep
PRLRRLKPTSKAHATTRCETARRLRTKQTARTGTGSKAHQTMMASKWGRKKVPTTKGLKKYHRYTPRAVNINWILQYHKITDLFICKMTIQPLVRKIGRDFKTVMRSQSHYELDLXEVGEVYLMMLMDDTNLYAM

SEQ ID NO: 155146 - protein, 43 aa, Triticum aestivum
  Clone ID: PAT_TA_49564.pep
RVVIYDDLLVDDNVSFYQHTITYKLFTISVTVTSEIWERVCKL

SEQ ID NO: 155147 - protein, 82 aa, Triticum aestivum
  Clone ID: PAT_TA_49565.pep
MPYTASRPSAPQRARVAAGGGGWKAAAHAASCGAVPGEVARHHEHAAGAGQCCSAVVQAIEAPVGAVWAVVRRFDRPQAYKH

SEQ ID NO: 155148 - protein, 111 aa, Triticum aestivum
  Clone ID: PAT_TA_49566.pep
VIIRLRMILVDLFVCNPLPRSLSMFLVRHPYKFWLEPGRRAKPAGSGRRRTSGGGSCDDDRASRYGGRRRARPGRRRRRRMETTSARGGVAGEEQREENLGRRSGRPRREP

SEQ ID NO: 155149 - protein, 47 aa, Triticum aestivum
  unsure (1)..(47): unsure at all Xaa locations
  Clone ID: PAT_TA_49567.pep
GXAGATHASIHSENSKPKTYKQALILHRAGAHISVTYNLEVSQQCLK

SEQ ID NO: 155150 - protein, 130 aa, Triticum aestivum
  Clone ID: PAT_TA_49568.pep
GIFISFGVLFGFVLLLLLLLVSGVVLLGRGEEHDVYAPFGAGRDGVEPPGAPPSLLRLQRALLRREATALAPPGSGSVAVVCLVLRRWPPTSPEEVRHGSGPGTGAASDARGLRADNVRRRFSYAWADAW

SEQ ID NO: 155151 - protein, 76 aa, Triticum aestivum
  Clone ID: PAT_TA_49569.pep
VVVYPQNECNTCIGRKLALHVVDARRFISQQLFKVVSVYGEDLLLFGCVFGIVGLENTLADCVGICDGIKSSTICF

SEQ ID NO: 155152 - protein, 86 aa, Triticum aestivum
  Clone ID: PAT_TA_49570.pep
MERVFSVEEIPDPFWGQPSPRPAGASAAGPASSGGGGAEGAMNRCPSEWYFQKFLEEAVLDSPAADPGPMAGASGGGVGAAEVKRT

SEQ ID NO: 155153 - protein, 75 aa, Triticum aestivum
  unsure (1)..(75): unsure at all Xaa locations
  Clone ID: PAT_TA_49571.pep
ANHTSHGLPSHTNRRHXGVHILSDPXITAHVQWFRNKQEYTLIQRDTDWPHDXPSLGSPGPKDAYYYAMGSDRQF

SEQ ID NO: 155154 - protein, 143 aa, Triticum aestivum
  Clone ID: PAT_TA_49572.pep
MSPQTETKAGVGFKAGVKDYKLTYYTPEYETKDTDILAAFRVSPQPGVPPEEAGAAEAAESSTATWTTVWTDGLTSLDRYKGRCYHIEPVAGEDSQWICYVANPLDLFEEGTVTNMLTSIEGNVLGFKALRALRLQDLRIPPT

SEQ ID NO: 155155 - protein, 98 aa, Triticum aestivum
  Clone ID: PAT_TA_49573.pep
LAKLRCNTTTEEPDIYSLTRCCRCCDSCQDADEAVGAGGYRQGSGGRGSPLHVHTTHGQVCHAGRVRRPRKVKRFLPPIGVHRGRQRWQDAILLQHRP

SEQ ID NO: 155156 - protein, 152 aa, Triticum aestivum
  unsure (1)..(152): unsure at all Xaa locations
  Clone ID: PAT_TA_49574.pep
LSLSLSLVGSAVLRKETTMEEEEGRAGLRELARFPDVMVVCSSAGWTDQKHMLYLGLLQESFVNRLHDGEISFRGLFDLSPGASGPKQPSKVDRAKVERTRPPCCGNQGDGEALCVEEEEDDDDDASSTETVRQSYSQASATSSXRSSPCHS

SEQ ID NO: 155157 - protein, 135 aa, Triticum aestivum
  unsure (1)..(135): unsure at all Xaa locations
  Clone ID: PAT_TA_49575.pep
MSPQTETNAGVGFKAGVKDYKLTYYTPKYETKDTDILAAYRVSPQPGVTPXEAGAVVAAKYFTGTWTTDWTDGLTTLDRYKGRCYHIKPVAAEDSQWICYVPYALDLFEEGSRSNTFTSIVCNVISFKALPALRG

SEQ ID NO: 155158 - protein, 111 aa, Triticum aestivum
  unsure (1)..(111): unsure at all Xaa locations
  Clone ID: PAT_TA_49576.pep
MDYMNGPGRNQLFVPGPVNIPDQEIRGMSLLNEDYRLTVIPALTKTLLGDVMKMFKTTTGSLFFLPTTGTGAWESALTNTLVAWDRIVFFLLGXYIIVLIDQEKGLRFNVD

SEQ ID NO: 155159 - protein, 57 aa, Triticum aestivum
  Clone ID: PAT_TA_49577.pep
DHHHLFFPFLTISSRSWKSTLTNFSLSWTLILFIFLKNYILISDQLSIKFFLFIRFH

SEQ ID NO: 155160 - protein, 74 aa, Triticum aestivum
  Clone ID: PAT_TA_49578.pep
GTRQPVRSIIRMMPWHRLLKRDDRQLQEKPVLPVQQSTSSACARDRESTALPGARLAQVLTNSCLNSHHWPGQV

SEQ ID NO: 155161 - protein, 40 aa, Triticum aestivum
  Clone ID: PAT_TA_49579.pep
DDRTPASSIFKVALSLSSKAQVISPARISSNSIDIIGRVG

SEQ ID NO: 155162 - protein, 114 aa, Triticum aestivum
  unsure (1)..(114): unsure at all Xaa locations
  Clone ID: PAT_TA_49580.pep
LSLILGLLAGVVPANATSYASYYLVLMRPVAYCVASXFGCCFPSYVYPCGDFFVQSFTTFYSTLNKAMDRCISSSPFDINKLESMVNTLDHYWNHIHCTITCGTSNWTSEWNSY

SEQ ID NO: 155163 - protein, 112 aa, Triticum aestivum
  Clone ID: PAT_TA_49581.pep
MASEKFPTPVADLCDANASLILAGELRILEPVFQPYGQCRSFSGRVVTMRVLEHNAGLRALLETPGEGRVLVLDGGGSKRCALIGGTLAEVARGSGWAGAVVNGCVRDVDDV

SEQ ID NO: 155164 - protein, 144 aa, Triticum aestivum
  Clone ID: PAT_TA_49582.pep
ERAEKRRGAATMATTLWLSPPLLLAGTTTARGGVLSCGPSWSTANLSCKGPLVLIRRRARKQQPSTPIVSLFGRKTPKKTTRETRRPDPDYLVPTAILAISGVFAYADKFVADATVRLLGLFLLIHTTRRRFDFDDDALEGKVG

SEQ ID NO: 155165 - protein, 49 aa, Triticum aestivum; identical to SEQ ID NO: 147490
  Clone ID: PAT_TA_49583.pep

SEQ ID NO: 155166 - protein, 112 aa, Triticum aestivum
  unsure (1)..(112): unsure at all Xaa locations
  Clone ID: PAT_TA_49584.pep
SXVVSTYICQAQQLCKKNLGMCSNIFHHEAERNLNEMRGSRCRARAHPTPPTAVHLRPPPPPLGDRRARWHWPNRRFRPPAAGVASPTIPLNTPHNGIFSDAGEPTPRVRGR

SEQ ID NO: 155167 - protein, 44 aa, Triticum aestivum
  Clone ID: PAT_TA_49585.pep
TPIQPTKHTPRKCTGLKGPRKQLSTKEVRKLAPTTFEVKNPHRY

SEQ ID NO: 155168 - protein, 71 aa, Triticum aestivum
  Clone ID: PAT_TA_49586.pep
MSMLACALQTMGSSCSRPHSVNEADAADNTRSADIDRRILHETKADQHIHKLLLLGAGESGKSTIFKQIKL

SEQ ID NO: 155169 - protein, 142 aa, Triticum aestivum
  unsure (1)..(142): unsure at all Xaa locations
  Clone ID: PAT_TA_49587.pep
SRSATQAPQLNSPTDCLCLLTPPQTPRRPSASSPPPPPPDPARVPASSRPRRPAAPPSSRAPLPGEGARPCAPLLDLIAAMQKDTGSGDVSPSHVGRVRHRRRPNETATDGNRANGDXXLVSDQNKYKSMLIRTYSTLWMIG

SEQ ID NO: 155170 - protein, 59 aa, Triticum aestivum
  Clone ID: PAT_TA_49588.pep
MSSIGTGYDLSVTTFSPDGRVFQVEYAGKAVDNSGTIVGIKCKDGIVPGVEKLITSKMI

SEQ ID NO: 155171 - protein, 164 aa, Triticum aestivum
  unsure (1)..(164): unsure at all Xaa locations
  Clone ID: PAT_TA_49589.pep
RVRNQLLLMRLLVKDRYLLETAKAIVRVDAPVSFIDADAGAPNWSVDKGNNLLSDVAREVVRRKGKRSEAMEEVSVARTANLRLQYLDDLVRELDGDVESLDMSKSKRTQQQGDNRAAENLRRILESDIQNDHPDANSTWDFGWNPVWELPMEKXDVVQDLEKN

SEQ ID NO: 155172 - protein, 153 aa, Triticum aestivum
  Clone ID: PAT_TA_49590.pep
VRPRVRDVRLERVLRAAAMPNDTVILTTLNSAWAEPGSMLDVFLESFRVGEHTRELLDHLVIVSLDLAAHRRCKQIHPHCLAVATEGVDFSGQKNFMTDGYLRMMWRRIDFLRQVLEKGYSFIFTDTDIVWLRSPLPRLYAEGDFQIACDHFT

SEQ ID NO: 155173 - protein, 148 aa, Triticum aestivum
  unsure (1)..(148): unsure at all Xaa locations
  Clone ID: PAT_TA_49591.pep
MVDMICLSHRLSEVMGYITGEKKKKKKKKKKAASAAGTATPENEPESFDPLVFFQNYIHTLMEGGANIQVLLDDASVNLAPGLGGRAGGTSYGDYFVGPGLEQLIEQLAENDPNRYGTPPAAKSALTTLPDVVXTDAMVXAAEGAQCA

SEQ ID NO: 155174 - protein, 147 aa, Triticum aestivum
  Clone ID: PAT_TA_49592.pep
NIKATTLGLFFLPGDHKQRTEKQARLHFHKLITLAWRAAVVTTAHDPRELVLSVVLWPDEADEEAAGRVTAVHDPPELGALAVLWQDDADDEAPGTSWRRPTGALLRLYKETRACEGRHLQWGCRMAAPWLLTALRRWPPWPGASQR

SEQ ID NO: 155175 - protein, 115 aa, Triticum aestivum
  Clone ID: PAT_TA_49593.pep
QCWMSASWSLCSSLSISFLLGPLMQGVYPLISRRGRPRTPTPGSYLGHRYERREMQRGGRFRRGGYGRDDYYGNSYRRSPPPMYREYRDTRDYPPYRDTRDYSPPHRDARDYYDG

SEQ ID NO: 155176 - protein, 131 aa, Triticum aestivum
  Clone ID: PAT_TA_49594.pep
RNPSSADAEIRGETGEKMEISAQSPPPRRRDSAQGGEDRPPAVRAGETSREPGRHWRMTPAAAAEISRKSRFLARFGRAGPRRPVCSAGAGVDEDPGEADGSLGVDGLMDGLEGRDLSLPPLFLPGCFPRT

SEQ ID NO: 155177 - protein, 70 aa, Triticum aestivum
  Clone ID: PAT_TA_49595.pep
MGQGVVEIQPRELQFTFELKKQSSCSVHLVNKSDEYVAFKVKTTSPKRYCVRPNIGVILPRATCDFTVTM

SEQ ID NO: 155178 - protein, 111 aa, Triticum aestivum
  unsure (1)..(111): unsure at all Xaa locations
  Clone ID: PAT_TA_49596.pep
RDGDVRPTDSSRRRLEIMGAAWRLSGPRPASGPCAVRTLDPARALVRGAVPEAKPCVSWSRGDHVARRKNLRHGPCPSVRPPRDVNVIRPPCGPRRRGXPTLYGELTWRYP

SEQ ID NO: 155179 - protein, 96 aa, Triticum aestivum
  Clone ID: PAT_TA_49597.pep
MGSVDLVLKPACEGCGSTSDLYGTGCKHTTLCSSCGKSMALSRARCLVCSAPITNLIREYNVRANASTDKAFSIGRFVTGLPPFSKKKNAENKWSL

SEQ ID NO: 155180 - protein, 103 aa, Triticum aestivum
  Clone ID: PAT_TA_49598.pep
LAGRADRKMQPPRNSLQDRRKPSPSIDEEPANQRAHGGFAGKIMVARLTGSPCRDGGSCGWEEEAGSSLYQGSDLVYSGTEKGCVSQRRTHASADAWADAWAD

SEQ ID NO: 155181 - protein, 79 aa, Triticum aestivum
  Clone ID: PAT_TA_49599.pep
MATTGRVRPSPLLAAWLALGFAWHCALHHAPAAAVTLSTASRWVVDEAGDRVKLACVNWPSHLEPMLAEGLGMRAVGAI

SEQ ID NO: 155182 - protein, 135 aa, Triticum aestivum
  unsure (1)..(135): unsure at all Xaa locations
  Clone ID: PAT_TA_49600.pep
SADAWVCISDRLAGVSENAGRIQRHRLRRPQVPGKRHHLLEASRTLSRGALFRLLPPHILFPLFQARCITDVRADAGSTTFLAGTLSLKEENEVHLIRLLPGENELVCDGLFYHPNEIWDLKFCPFDHKLFXTVY

SEQ ID NO: 155183 - protein, 87 aa, Triticum aestivum
  unsure (1)..(87): unsure at all Xaa locations
  Clone ID: PAT_TA_49601.pep
FDRQSDESYEEKRTKIGGDVLKTNSSIEIHASKVYTRASNSAKFCTSRVGIGSNRLRTMNYTGQHTLGLKRREKWSXVVFLVKMIDN

SEQ ID NO: 155184 - protein, 65 aa, Triticum aestivum
  Clone ID: PAT_TA_49602.pep
NSDAMNQRHPSRCYPRWCIEPFRVQCLIRSRVHQICPEMFRKQSPKRAPDSLDVCVRRSPELRSG

SEQ ID NO: 155185 - protein, 119 aa, Triticum aestivum
  Clone ID: PAT_TA_49603.pep
LSIQEPPSREAEKTGSQRACRKRRIPRRRVKPRPPGTLRSAAGHQIGNRSDSTDGLDRNIQPPGNLLQDTRKNRRSIGQQPANHRAHSGFSWEIMVVTLACSPCADAGTSGSSASRVTL

SEQ ID NO: 155186 - protein, 159 aa, Triticum aestivum
  unsure (1)..(159): unsure at all Xaa locations
  Clone ID: PAT_TA_49604.pep
RSLSFFRRFRSASRFLHSAASRSRLCRSPSASRRRLRRRGLPAAYRSPPTPNLPSPRPSRAAADAPAPPSTAARCSLPRTATPRPPRHPPALPPGTAXPEPLPPAPSNRXATPPRRAARGLPPPRPTRTPAPPSPATSTYPPVSVSGTGTLLLKVVRAD

SEQ ID NO: 155187 - protein, 124 aa, Triticum aestivum
  Clone ID: PAT_TA_49605.pep
RPPTRPPPSRRGRRIRSALALAPGAAPPSGWGRRTRPALALAPPPPPSRRGRRIRPALALPPPPPPSRWGRRIRPALALPPPPAWTTSCSGPAASSPSPSPPRPPSPPPSAAPAPPVNPPPAPS

SEQ ID NO: 155188 - protein, 155 aa, Triticum aestivum
  unsure (1)..(155): unsure at all Xaa locations
  Clone ID: PAT_TA_49606.pep
VRDTDASLARIARSNGKTVLHSAARMGHVEVVASLLNKDPDIGFRTDRKGQTALHMASKGQNAEILLELLKPDVSVIHLEDNKGNRALHVATRKGNTIXKQGNEELVNILREVGGITAKEQANPPKSAKQLKQTVSDIKQCVQSQIKQTRQTKMH

SEQ ID NO: 155189 - protein, 83 aa, Triticum aestivum
  Clone ID: PAT_TA_49607.pep
FPHGCLRVLRCGYHQSRTLVVRGHTHPEFTDAFASSSARRNGSNHEERTHQLNRKEKMPRMGNLTGKSRRSTATETHAARPAK

SEQ ID NO: 155190 - protein, 109 aa, Triticum aestivum
  unsure (1)..(109): unsure at all Xaa locations
  Clone ID: PAT_TA_49608.pep
VSRVAAWTTKNDEYSTDLYNSGGEAAAEIEAGGTVPLSRRVVAVPLGRKLVLLVTGRSVGDVFDKNVIAPLGRSTELMHYKLGSALVEVKLVWTAXMIKGRGRREPFDV

SEQ ID NO: 155191 - protein, 126 aa, Triticum aestivum
  Clone ID: PAT_TA_49609.pep
MEEYLANMRTLRCYMNDLEEEAAKRSAEEQRQRTAIDAHDSDIALVRAQAKQVSDEAEHLAKARAHVCVEMAEKQGRIASLEVVGATLKQTLDLLQLEITSTSAKLGQKRLFYTKTIETLSVKLQE

SEQ ID NO: 155192 - protein, 66 aa, Triticum aestivum
  Clone ID: PAT_TA_49610.pep
MSKINILISIFRRIGRLALRSDLQSLDVELDPFITTLIITYFMTYISKYDTCHRHCMHIDVNLTVV

SEQ ID NO: 155193 - protein, 47 aa, Triticum aestivum
  Clone ID: PAT_TA_49611.pep
LFFIFFFIFVYFFFKKTHQGGLFFMGTYTLLYTVLHNPQAVGALTPN

SEQ ID NO: 155194 - protein, 79 aa, Triticum aestivum
  Clone ID: PAT_TA_49612.pep
ACKRWACSVQQPLRRRCRLCSLSLVCQPLATCLPCKCSISDNRCRTWFCMSLIKRESRSGTWLCISRPKILFLYLRILR

SEQ ID NO: 155195 - protein, 103 aa, Triticum aestivum
  Clone ID: PAT_TA_49613.pep
MNSSRSLLSSPLFPTSSPNFRSSPSPSRTSVPMIHDSTGGRASTACHYSPSLVAEEQQAHSSVSLKGEKALLEFLLDMALEQHTEGKSLTGQDGAEGEFESYL

SEQ ID NO: 155196 - protein, 143 aa, Triticum aestivum
  Clone ID: PAT_TA_49614.pep
GEPTAESSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDWDRVVEARDELHRMLNEDE

SEQ ID NO: 155197 - protein, 138 aa, Triticum aestivum
  Clone ID: PAT_TA_49615.pep
RSRIRGGATRPLRAMLLWMVDDPRVVLINLGDRLHSVRTIYALPIPKAEAVAQETLAVWCSLASRLGVWALKAELEDLCFAVLQPQVFMKIRSELTSMWNSTSKDKSMRRSSIRRGLLAFTKEVHATSTHDLLSSNDQ

SEQ ID NO: 155198 - protein, 130 aa, Triticum aestivum
  Clone ID: PAT_TA_49616.pep
VRPRVRTKAAVAEALANAGLSNAELVQRTNAAVAKALADAAKVVANTAAAKATKSILARRDPGGCTIRLLSMTFYLKDDAPISVGHSVASAMATCKTEKAEFIVLTEKERLECDVYDVENYGTRFGSFFN

SEQ ID NO: 155199 - protein, 65 aa, Triticum aestivum
  Clone ID: PAT_TA_49617.pep
HACIHAYATTNYSHLLTARDRRICHPGALLSHHGPGCAWMHARGVRRLVLPGQEYHDASYLLAMP

SEQ ID NO: 155200 - protein, 148 aa, Triticum aestivum
  Clone ID: PAT_TA_49618.pep
AHASEAKQLNGNGELFTHKYPGLGVRLGDGSGLSTAVVLKSIPSDTKHVFLCGGSSKVERAIATALCERGVQVIMNQKEYDMLKLRVSESSIAYLKFSSDETPQIWIGDIIHDKQQMGAPKGATFIPTSQIPLKRMRKDCTYLSSLAM

SEQ ID NO: 155201 - protein, 132 aa, Triticum aestivum
  Clone ID: PAT_TA_49619.pep
RAPHQNGRSTTLAPTRRQIRAAPAATAPLMAESRPAPSLRARTPRHPFSRWDPCPHSLAARTPPCTPTRARSTPHRPPASALPAAAASPPLCRPPPRLQAPEPCPRGAPARQILRRDPPRDAPPPPSLEPAR

SEQ ID NO: 155202 - protein, 148 aa, Triticum aestivum
  unsure (1)..(148): unsure at all Xaa locations
  Clone ID: PAT_TA_49620.pep
RQAAAAAKRTRGAGDVVHDYRSGVFPFYEKWRNEYGPVFTYSVGNMVFLHASDPAVVRDVCLSVSPDELGKSTYMKVTHHPLFGDGILKSNGDAWARQRKLIAPEFFPDKIKGMVDLMVDSARALVRSWEARVAESXRRALELTVDDD

SEQ ID NO: 155203 - protein, 148 aa, Triticum aestivum
  unsure (1)..(148): unsure at all Xaa locations
  Clone ID: PAT_TA_49621.pep
VRIPGGRRVHTKLANLPPIIGLYSSFVPPLGYAVLGSSRDLAVGPVSIASLIMGSMLRQAVSPSAEPMLFLQLAFTSTFFGGLVQASLGILRLGFIIDFLSKATLVGFMAGAAIILSLHQLKALLGXIVHFTTQMGIGPVMGFVFQHT

SEQ ID NO: 155204 - protein, 97 aa, Triticum aestivum
  Clone ID: PAT_TA_49622.pep
VVSCVFTSCTCIYRPAPQEIQVPYLLTKLIHWLWLPIHLTGAHVIIQIDTYMASTQAREVLEASFDTHVQHKSLFWLTSPLSSTKSNVCFTILPIQF

SEQ ID NO: 155205 - protein, 129 aa, Triticum aestivum
  unsure (1)..(129): unsure at all Xaa locations
  Clone ID: PAT_TA_49623.pep
MAPTVMAFTATTISLLGGLKAXAGLPFSLLSNGSLFRVSNGGRIRCMQVWPIEGIKKFETLSYLPPLSTEALLKQVDYLIRSKWVPCLEFRXVSFIFREHNNSPGYYYGRYWTMXNLPMFGCTYSIQVL

SEQ ID NO: 155206 - protein, 107 aa, Triticum aestivum
  Clone ID: PAT_TA_49624.pep
LGLEQENCIKGLTKFSNDVKATFSRFCAHAQARGFNIHFQEYFLPTPPFYCQQKVLPATSRDQGIVAHPQVVQIERWRTEGSSADGWGDGSCKRWRRKGLMGKKGWR

SEQ ID NO: 155207 - protein, 136 aa, Triticum aestivum
  unsure (1)..(136): unsure at all Xaa locations
  Clone ID: PAT_TA_49625.pep
LVSSHYTEAYIRQPDSSKLEGVIKEGAQRICIETPGQHELYLVNSCISFGTSPIVFDTHNPVLVHISAKKYLVRGEIHVDISSPLEEIDLLEDIGGDAFKSNGSSIDKISTMPGFXKSYQNGITGFWYSTWTDLGG

SEQ ID NO: 155208 - protein, 108 aa, Triticum aestivum
  Clone ID: PAT_TA_49626.pep
MATAATTGAAVPVGRHQHRHHLGLRPCPNPRCLHRLRLPALVAFSSPSAPSTSFSSSLSAPATPSTEGGGRLLADLVGVFNELTGRMGESLSFYLRYYQKIIALKIFY

SEQ ID NO: 155209 - protein, 94 aa, Triticum aestivum
  Clone ID: PAT_TA_49627.pep
WPATRVITAKMINAMHQSNIFEVLCTHPSMRLQHTLSGILPSYGALSLSAKSCYQQLPRIMALGLHPHIVHIEMWRTESSRHQNGFKRDFFKNL

SEQ ID NO: 155210 - protein, 83 aa, Triticum aestivum
  Clone ID: PAT_TA_49628.pep
SPSSPKPILNPMPWSTAGNMADKSAQMTAQIRGQHLSSHHIIRKIERDLDGDMCGFKYWLAHHTMDYTSIIVNNNDNYHSDAQ

SEQ ID NO: 155211 - protein, 101 aa, Triticum aestivum
  unsure (1)..(101): unsure at all Xaa locations
  Clone ID: PAT_TA_49629.pep
MAAQGLLSGRQLLGRPLQSSISRSSSSRKSAFVVRASFSPPAKQNDIRQLWFAYKQSLTYLDGTLPGDFGFXPMGLYDPEGTVWVIEPRWLAYGEILNGRT

SEQ ID NO: 155212 - protein, 50 aa, Triticum aestivum
  Clone ID: PAT_TA_49630.pep
VQCPPIRKPPFRRNRKQLIKVQEPCHCWAHRNHYDQDFPTLHATICLTIT

SEQ ID NO: 155213 - protein, 38 aa, Triticum aestivum
  Clone ID: PAT_TA_49631.pep
ISRVSKVAIQHNCELNLTVYLVSQHCPIIHRYRRAPHQ

SEQ ID NO: 155214 - protein, 61 aa, Triticum aestivum
  unsure (1)..(61): unsure at all Xaa locations
  Clone ID: PAT_TA_49632.pep
GRDGSVLFWTTGSRKTTLIGALVXHVERVEWEIIIDFVSISNIGLHDLCSRXGIIPQDATL

SEQ ID NO: 155215 - protein, 124 aa, Triticum aestivum
  unsure (1)..(124): unsure at all Xaa locations
  Clone ID: PAT_TA_49633.pep
TLPYTFELRADLGQTYDSDSTLSRYEMNSGKGQAVLFVGDLSYADRYPNHDNNRWDTWGRFVERSGAYQPWIWTAGNHEIDFVPDIGEIEPFKPFMNRNHSPHKALGRFFXLWFYIKRAVVYIF

SEQ ID NO: 155216 - protein, 36 aa, Triticum aestivum
  Clone ID: PAT_TA_49634.pep
DHTYARIELGKRTRRPQYVTRQHASSLVDHTISNEH

SEQ ID NO: 155217 - protein, 124 aa, Triticum aestivum
  Clone ID: PAT_TA_49635.pep
APRVRKKLETLSYLPPLKTEDLVMHVNYLIRCKCVPCLEFNTVELIFREHNEYGGYYDGRDWTMWKLLMFGCTDATQAINEVEEVKNEYHDPYVRIIECDNMREVQCDSFIDLKPPGWQEFDKV

SEQ ID NO: 155218 - protein, 95 aa, Triticum aestivum
  Clone ID: PAT_TA_49636.pep
MDGCNAQKFKMARQRNLAKLQGGKGSQLEANKRAMNMQCKICMQTLIRTTYDAHCKEHAEAMHTKSDLAQCFHHLKQRYLPNQMARETKESEKLS

SEQ ID NO: 155219 - protein, 97 aa, Triticum aestivum
  Clone ID: PAT_TA_49637.pep
MLPPYTVRSCDDRTLLADAVIASENGASGATSAVLPARLLFDCYSVLGDTDNDVHRISFNQTFGQREYCVNRDVELYGKLLKIGCGNERMTAYFNKT

SEQ ID NO: 155220 - protein, 83 aa, Triticum aestivum
  Clone ID: PAT_TA_49638.pep
PLLLGPLILIHCPSFYNLLSRKTRGFSNLLPLKLHSFSPFWGITKKALSIGPCIMLGPLTGDCAPLFAGPFGAWDLVVFAPFN

SEQ ID NO: 155221 - protein, 52 aa, Triticum aestivum
  Clone ID: PAT_TA_49639.pep
RTRNFECLAAVVHWSDEASSKCILAAIRWYDDSTTRLVMPHFSIPLGSVPGP

SEQ ID NO: 155222 - protein, 132 aa, Triticum aestivum
  Clone ID: PAT_TA_49640.pep
TLVRSQLRHTPQGRETPGGTTIGSGYGTQQRGMRDRHGRGSASHRNGKQHQHRQRGEAAQDLVRHAPAHRLRRLLTCSPPRSRQGGGRGSSRGGDKAATTGLGGGGRQLRVLPHVWRTHTAIHPRCARTALG

SEQ ID NO: 155223 - protein, 93 aa, Triticum aestivum
  Clone ID: PAT_TA_49641.pep
AYAHAFADTLLGELTHHHQRIGGGRTAGLVDRTFLAELCATGSQDEVEQRRTCQGRPSDPQGVLDRGEGARGQGPAFIQEGRRPSPCCLLDKS

SEQ ID NO: 155224 - protein, 65 aa, Triticum aestivum
  Clone ID: PAT_TA_49642.pep
AFVVDAVARITCSLHSHMREVARMCADARNRCGMACNKSVMLISSSSADVAPNRLTFDEIHSNNY

SEQ ID NO: 155225 - protein, 48 aa, Triticum aestivum
  Clone ID: PAT_TA_49643.pep
RLTIGLAGRAQAYALPVFTCRHTHTHTHGTFCLCRCIVMLTVDPRGEA

SEQ ID NO: 155226 - protein, 100 aa, Triticum aestivum
  Clone ID: PAT_TA_49644.pep
MSPQTEAKAGAGFKADVNDYKWTYYTPEYETKDTDIQAAFRVSPQPDVPTEEARAAVSAESSTGTWTTVWTDGLTSLDRYKGRCYHIEPCAEEDSQWICD

SEQ ID NO: 155227 - protein, 85 aa, Triticum aestivum
  Clone ID: PAT_TA_49645.pep
HHHQFTARTNPRQPLIDQLGLVCRAWRAPLRWRLNCTDCSAMARELEARVDGYQGAPVAARDLCPELANLSHRAVRLAGSECYAL

SEQ ID NO: 155228 - protein, 134 aa, Triticum aestivum
  unsure (1)..(134): unsure at all Xaa locations
  Clone ID: PAT_TA_49646.pep
VRDDLQKNISVLTEXFNEVHAEGDREIKVTQEEKDTGLTHLTQAECSIKNLESAIAQLKEDLSIQLEYNSSWNIHFEESRTNLQGDILALRDEKETGLSESHQSEAFGTNFETELEKQSQSISAVHRADDESHQ

SEQ ID NO: 155229 - protein, 64 aa, Triticum aestivum
  Clone ID: PAT_TA_49647.pep
MGWIRSVFCLLRKIIVRAHSARKYRRGMRILYKDIKSCEDEDVHVLWSMLGHSHRHPAMENLKL

SEQ ID NO: 155230 - protein, 118 aa, Triticum aestivum
  unsure (1)..(118): unsure at all Xaa locations
  Clone ID: PAT_TA_49648.pep
MAVALSSTVGAHACTPTIFLGKKLKKQVTLAVNYHGKSSEANRFTVMAAVNIDEKRNTDKWKGLAYDIYDHQQDITRGXGIVDSLFQAPTGDGTHDVVLSYYEYVRQGLKKFDFDSTM

SEQ ID NO: 155231 - protein, 107 aa, Triticum aestivum
  Clone ID: PAT_TA_49649.pep
QLHAPASVCNGVTNFCLPTFPSYAGLLNSYIFNLRFNLQSVHGPAAVVLPESRDELRRAILGARARSVAIHVRSGRHSYEGLFYTTENHVPGAVIDLWKPNPVRVEP

SEQ ID NO: 155232 - protein, 62 aa, Triticum aestivum
  Clone ID: PAT_TA_49650.pep
ADDESLVVVPNRLPGDGSSSLGEKDANRTELARIHPSSLAQGSSAKFAGVCGSSLTLSARYV

SEQ ID NO: 155233 - protein, 136 aa, Triticum aestivum
  Clone ID: PAT_TA_49651.pep
LTTGEREEEEAANVHGGKEEEALACGWGINGNKGRCYDLCLDYHWCMIRCLHPFDCGLLPVDYLVCLHHSKEVLRRVRIYMEGQPQIRRCCSQGHGRSRRIFFCCTSPLAYVLNFLLCFCLLQVLSCSAMSKAIIT

SEQ ID NO: 155234 - protein, 155 aa, Triticum aestivum
  Clone ID: PAT_TA_49652.pep
MASSATTRAPFQGLKSTDGLTVRRRYSDSLCSVSNGVRIRCMQVWPIEGIKKLETLSYLPPLYTEALLKHVDYLIRCKWVPCLQLSTVDFVFLEHINYGGFYDCRYWTMRKLPMLGCTDTTQVLNVVEEVKKEYPDRYVRGIGLDNLRQVQCVSF

SEQ ID NO: 155235 - protein, 57 aa, Triticum aestivum
  Clone ID: PAT_TA_49653.pep
LKHHLVSFIMRYNFHLPIISQASVAYVICSRSVNGFTLISSLRTLYPRLLLQFVQDK

SEQ ID NO: 155236 - protein, 65 aa, Triticum aestivum
  Clone ID: PAT_TA_49654.pep
MATDREDSNSLLADDSIVEYVLQTALYPREHKLLDELLLITPQLSERPMASDSEHIQVFYGLLVV

SEQ ID NO: 155237 - protein, 103 aa, Triticum aestivum
  Clone ID: PAT_TA_49655.pep
CLQVALLSRPDLLSWCQPHQSPPLLTDVRRAPQKPSQTRADGHPPQRPRQGRPASVLKCTSGSASITRRGWPQPQAPASTTPGGVRSGRLKDRVWGPRKPLAP

SEQ ID NO: 155238 - protein, 110 aa, Triticum aestivum
  unsure (1)..(110): unsure at all Xaa locations
  Clone ID: PAT_TA_49656.pep
MQIFVNTLTGKTITLEVESYDTIDNVKGKIQDKEGIRPDQHRLICGGKQLEDGRTLAYYNIQKESTLHLVLKLQGGMHIFVKTLTGKTITXLEVESSDTIDNVKGKIHDK

SEQ ID NO: 155239 - protein, 110 aa, Triticum aestivum
  Clone ID: PAT_TA_49657.pep
GRRSASSLILLDADALLARLPPPLLLLIRRRFQDGGRRLGGLLRGHPRQGARGEAPPRILLHRGLMRAASGDGTCDREDQHARPQETSLQGGHRHGGTWDQTLEPGNMVW

SEQ ID NO: 155240 - protein, 76 aa, Triticum aestivum
  unsure (1)..(76): unsure at all Xaa locations
  Clone ID: PAT_TA_49658.pep
GALPEPATIGLCVLNATRTDHEDLDRLQPPGARELQADRAKCGDRVLQXHRVRHMLDLVVSTCDKLAEIYEDNDRA

SEQ ID NO: 155241 - protein, 40 aa, Triticum aestivum
  Clone ID: PAT_TA_49659.pep
TRRILNSRAIARDLCHHIQKLRGGAEFKAGVNDYKLTYYT

SEQ ID NO: 155242 - protein, 94 aa, Triticum aestivum
  unsure (1)..(94): unsure at all Xaa locations
  Clone ID: PAT_TA_49660.pep
MMGETGTSVSDYHAIDNHQLTKMAYHYYAYGAEDERTLLEIREAXLRILFGAHVLIVVYTIDMTTSVLRMNISMHIMISATDFQNTDHAVGECA

SEQ ID NO: 155243 - protein, 96 aa, Triticum aestivum
  Clone ID: PAT_TA_49661.pep
THYRVSGSPQACASISIGVENRLEIHESQWLALAWGGFESGVAARRACVFDGGEDEPLPAADAAGGAAFDQGLAGFGLQGEQHARLHSQCHRQGRA

SEQ ID NO: 155244 - protein, 30 aa, Triticum aestivum
  Clone ID: PAT_TA_49662.pep
QEGYAFFVCIEVQYLIHVSNHRGARQSSQL

SEQ ID NO: 155245 - protein, 42 aa, Triticum aestivum
  Clone ID: PAT_TA_49663.pep
MESADAGGLFSMRAVLAMLQWWGFNVTGIIINKWILQKLDFK

SEQ ID NO: 155246 - protein, 132 aa, Triticum aestivum
  unsure (1)..(132): unsure at all Xaa locations
  Clone ID: PAT_TA_49664.pep
MAAHAAVLLSLLVLTTCSADTHLHFFLHDVVYGSNLTAAQVIKGPASYCNALHDVAFVDTTVIDDALTESXYPTSAPAERAQGFYMMSSQARIVLMMCVNLLLTTADYNGSTLAVIGRVHVMTTTRDLSVVG

SEQ ID NO: 155247 - protein, 106 aa, Triticum aestivum
  unsure (1)..(106): unsure at all Xaa locations
  Clone ID: PAT_TA_49665.pep
DYPDQILRGARRRLSSYLSWRPVATVVSSVPVAGAGRPGRDHDHRSAYQRRIPIQSLFLTAARGFSLAETLGPRNQDAGWDERPTTAAXLNNPNSKILYDQDNHER

SEQ ID NO: 155248 - protein, 137 aa, Triticum aestivum
  unsure (1)..(137): unsure at all Xaa locations
  Clone ID: PAT_TA_49666.pep
HVLQPNWMLDPHSLCGEKGGDLPDSVRPVGLLLMAYGDMHEHTGDFFRVLRQNHKYMVLMCTDLSRSRTTDGVYNPTYGAFVDMDIDAHRGIIXLRTLGEHSVVESYSGGGQACITERVYPDHVLNGNKDLFVLNNG

SEQ ID NO: 155249 - protein, 98 aa, Triticum aestivum
  unsure (1)..(98): unsure at all Xaa locations
  Clone ID: PAT_TA_49667.pep
MSPQTETKAGVGFKAGVKDYKWTYYTREYETKDADIXAAFRVCPYPGVPTEEAGAAVSAESSTGTWTTVWTDGLTSLDRYKGRCYHIEPVAGEDRQWI

SEQ ID NO: 155250 - protein, 112 aa, Triticum aestivum
  Clone ID: PAT_TA_49668.pep
WCHPTCNHGQTPVLAHPDRTAVLRFCSLTLYSRLAASVRGVWLLTAAVEPRTAQHEEAEADDYWTLVLGLGRTVGVGHSLVASLLSRKIKTGLIIRNPKKTYMDEQKNTYLY

SEQ ID NO: 155251 - protein, 119 aa, Triticum aestivum
  Clone ID: PAT_TA_49669.pep
RGRPTRPVMVLGEITTTATDDYEKIVRDSCRNICFICDDLGLDPDRCMVLRNIEHQSPDIAHGVHGHFTKRSEEGGAGVQGMMFRYATHETPDLVPLSHLLDTKLGARLTDARKNGTCS

SEQ ID NO: 155252 - protein, 96 aa, Triticum aestivum
  Clone ID: PAT_TA_49670.pep
RSTRRTRPYILGCDGRVLLSCVSLQRQGASVAPRQAMYLLCVCAASHTRVVVEQMYSVGDVCGSYDGCCRLTKEAVATVVKFLCLPGVYSFIVSMV

SEQ ID NO: 155253 - protein, 59 aa, Triticum aestivum
  Clone ID: PAT_TA_49671.pep
FRHKLIMNTLVQAAQREPGLMDAGLERLKTGFGKFKTEAYDQKPDFLEPLKGRQAPKFM

SEQ ID NO: 155254 - protein, 126 aa, Triticum aestivum
  Clone ID: PAT_TA_49672.pep
WLSWTTIVAHCEGFKWTVGLTVRRRYISPGLSSVSNGGRIRCMQVWPIEGIKKLETVSYLPPLYTEALLKQVDYLIRCKWVPCLQLSKVDLVVREHNNYGGFYDGRVRTMWKLPMFGCTDTAQVLN

SEQ ID NO: 155255 - protein, 105 aa, Triticum aestivum
  unsure (1)..(105): unsure at all Xaa locations
  Clone ID: PAT_TA_49673.pep
MSPQTETKAGAGVNAGGNDYKWTYYTPEYETKDADLQAAFRVCPXPGVPPEEAGAAVAGESSTGTWTTVWTDGLXTSLDRYKGRCSHIEPVAGEDSQWICDGGYP

SEQ ID NO: 155256 - protein, 83 aa, Triticum aestivum
  unsure (1)..(83): unsure at all Xaa locations
  Clone ID: PAT_TA_49674.pep
MACEKHRHHLFHHKKEGQDLQAAADGGVHMHGYSTXTVVTHTRIQGQYERITKVEKHHMHTEHLGEMGAHAHGALRLVRSLSS

SEQ ID NO: 155257 - protein, 49 aa, Triticum aestivum
  Clone ID: PAT_TA_49675.pep
TPSGPRRRRASWAGRVSRLPYRPWQQRRLRSSRRSCLALDCDKQCIGHV

SEQ ID NO: 155258 - protein, 88 aa, Triticum aestivum
  Clone ID: PAT_TA_49676.pep
LLGNASASNPSDTTQPPCVGRTSPSLLSPSISTILDPLVESTIGGTRLITIPTLTYPQREAGEIPVLQAEPMNIESGVIGGDSEYNET

SEQ ID NO: 155259 - protein, 66 aa, Triticum aestivum
  unsure (1)..(66): unsure at all Xaa locations
  Clone ID: PAT_TA_49677.pep
MEREELSTERVNRGVEATDPDAESLDLIRXRVRRRLPDFLESGNLKYVRLGDHYVLKHGMYMAHNP

SEQ ID NO: 155260 - protein, 77 aa, Triticum aestivum
  unsure (1)..(77): unsure at all Xaa locations
  Clone ID: PAT_TA_49678.pep
GLASPQTETNAGGGGKADVKEYKSSNYTPNYESXDAVMQASFQVCADSGVPTYESWACCLCSNLQLVHVQLSRTVGF

SEQ ID NO: 155261 - protein, 165 aa, Triticum aestivum
  Clone ID: PAT_TA_49679.pep
SGKHREALESDYVSENLHHWIDLIFGYKQRGKAAEDAVNVFYHYTYEGNVDIDAVSDPTMKASILAQINHFGQTPKQLFQKAHPQRRTDRKIPPHPLRYSTYLTHQEIRKTASSVSQIVTYNDKILIAASNSLLKPVAYSEYISWGFPDRSLRILTYDQDRLQST

SEQ ID NO: 155262 - protein, 51 aa, Triticum aestivum
  Clone ID: PAT_TA_49680.pep
TTTRAVHIRPPPPPLGDRRDSWHWFNRSLWGTAAGVKNPPPPLNTPRHGIF

SEQ ID NO: 155263 - protein, 127 aa, Triticum aestivum
  Clone ID: PAT_TA_49681.pep
RPRTRGRASSPTPAPPPPPPPGPVPSRATSQLPPPPLPPQPPPPRCRSRPHSPDSACRSPTPTSAPPPTRSSSPPPAPPAAGPSSTSPSPPPPPPAPVPPPPHPPRPPPRRRPPACSVRGRRRRPAR

SEQ ID NO: 155264 - protein, 96 aa, Triticum aestivum
  Clone ID: PAT_TA_49682.pep
ARRGAQAPRTAGGASSGSTAARGRRTGSPERATGSSAAPPGLSPTRPGTTPFSDRISSPDAKSRRGKLEKKSSRFFGGRMPGAGSTHDAAAHASAD

SEQ ID NO: 155265 - protein, 88 aa, Triticum aestivum
  Clone ID: PAT_TA_49683.pep
SVKYLGAARSSGVVSDSAPSPPRPSFHRTTPRCRLGFLCQHLFHDRLIESLDSKTATSRSSRLTHPMIRVDRLSRPSFTDSPTSTSRD

SEQ ID NO: 155266 - protein, 83 aa, Triticum aestivum
  Clone ID: PAT_TA_49684.pep
MVKAVAVLTGSEGVKGTIFFTQEGDGPTTVTGSVTGLKEGLHGFHVHALGDTTNGCMSTGPHFNPAGHVHGAPEDEIPHAGDL

SEQ ID NO: 155267 - protein, 53 aa, Triticum aestivum
  Clone ID: PAT_TA_49685.pep
MATRHNQQNAAAAPQPAANRGAAGKQKGAAAGRPAPGGNRRALGDIGNVVHAH

SEQ ID NO: 155268 - protein, 78 aa, Triticum aestivum
  Clone ID: PAT_TA_49686.pep
AAIIKKLKSTCIIIFQDNINVQYVILPPYQNKCLNFVITLVVQNCTKVKTLILGRREYLTRKSNCATTDEQLVKLEPS

SEQ ID NO: 155269 - protein, 131 aa, Triticum aestivum
  Clone ID: PAT_TA_49687.pep
RPRTRGSQSTMLSGEETFAIAVQDPLLASYGIVEPIGEESMNADLSMNMGSLVPGSNQKLSIRRAQVKNSEYLDQAGTSVNGYYVQNQTPGDANINFSHMNEFSMSEADGVDASELFGLGFYPKKRICCWS

SEQ ID NO: 155270 - protein, 130 aa, Triticum aestivum
  Clone ID: PAT_TA_49688.pep
KNYWVFQNPYLIARKLGFTWPRQQQANREATVRSPALVFLYTASTSRTAPQHGLVSRSRRRRCGCLGRCGTGQRACAPLECALLCTSHSSPPLLLGKHLLRTKGHPHVHGALPRTAKDTLVVQIAGSFPD

SEQ ID NO: 155271 - protein, 100 aa, Triticum aestivum
  Clone ID: PAT_TA_49689.pep
MAPKAEKKPAAKKPAEEEPTTEKAEKAPAAKKPKAEKRLPAGKTASKEGGEKRGRKMGKKSVETYKIYIFKVLKQVHPDIGISFKPCHHELFITTFREAR

SEQ ID NO: 155272 - protein, 68 aa, Triticum aestivum
  Clone ID: PAT_TA_49690.pep
NIHHAVVLKVFLSLDKLGPLVSSVLDMPVKSPLLHVGLYRFLSRLQLLSILYYRSVIFLVQVTRHSEA

SEQ ID NO: 155273 - protein, 61 aa, Triticum aestivum
  Clone ID: PAT_TA_49691.pep
SDDHHLYRLMSFLSIAHRGMLLMIYPTLLPEYANKAAYKAVKTVTKSGSKATNCRQKATAA

SEQ ID NO: 155274 - protein, 60 aa, Triticum aestivum
  Clone ID: PAT_TA_49692.pep
SESYIYINLHGQKVTRPEYRERKKSKPQLIQREIYCEHSCMMHIPKALQIHQERQNRLLP

SEQ ID NO: 155275 - protein, 55 aa, Triticum aestivum
  unsure (1)..(55): unsure at all Xaa locations
  Clone ID: PAT_TA_49693.pep
VRDGVVNARSRVLGGGSCLNAGLYTRASNEYVRTAGWDAFLVNSXFRWVECFSGV

SEQ ID NO: 155276 - protein, 99 aa, Triticum aestivum
  Clone ID: PAT_TA_49694.pep
TAPTLQSPHTKYDLDRSLSPASNMMKLSSSMYVSLIALTNQNQPWMEDEEGYTGFADPHEEDEEWREVKRSREDNAAGSPWHRFRLSLCVRLSGRVGGR

SEQ ID NO: 155277 - protein, 82 aa, Triticum aestivum
  Clone ID: PAT_TA_49695.pep
MDFMKAFDQTVREIKREVNLKVLKVPELEQKVLDATSDEPWGPHGSALSELAQATKKYSECQMVMGVLWARLGERDANWRHV

SEQ ID NO: 155278 - protein, 61 aa, Triticum aestivum
  Clone ID: PAT_TA_49696.pep
MGSSSKVVRPEEVLESLKNDGTVDALRMKIIAQLKADEDMKKNTMMMVEQKKVLKTPGAEK

SEQ ID NO: 155279 - protein, 147 aa, Triticum aestivum
  Clone ID: PAT_TA_49697.pep
RKCLKTTSSSMQNQREEFAARIWTTAARRKLTQRRSASEPSYASRPRRRSRCTAKRPMAPRRTKARSPPAIADGLGFGVLERRCRALGFSGWDGSRGEQAVWWWWIYRTEGGDGGQMAKQRRRRKSRRRERGRKRADCPHPLPAIGR

SEQ ID NO: 155280 - protein, 99 aa, Triticum aestivum
  Clone ID: PAT_TA_49698.pep
HQFGPLRTLTLQLKSYPKSRPNFVAHLLTTALPSPGADLCRLDRLHASSHQLIPYTSMAVPPSTTHLWIHPAHHLPLPLPNHYLGFGSGSGMLRFHKRT

SEQ ID NO: 155281 - protein, 79 aa, Triticum aestivum
  unsure (1)..(79): unsure at all Xaa locations
  Clone ID: PAT_TA_49699.pep
MARTMQTDRKSSGGKAPXSNLTAKAARMSAPPTGGVKMPHRFRPGTVALGEIRLCQKSTELLIRKLPLQSLVREIDQDF

SEQ ID NO: 155282 - protein, 70 aa, Triticum aestivum
  unsure (1)..(70): unsure at all Xaa locations
  Clone ID: PAT_TA_49700.pep
RPLAATDTDTNVLVKDEPSGGPSGXVALLLHSRDFLPEEQGRHESYRSLVLARLRRDSVRAVALSARAFL

SEQ ID NO: 155283 - protein, 125 aa, Triticum aestivum
  unsure (1)..(125): unsure at all Xaa locations
  Clone ID: PAT_TA_49701.pep
VRPRVRGRVGVPAVVFSVAGYTDNWFHDNTDALIPLFLTTAHLKGEVQLLITNYKPWWVQKYTPLLRKLSNYDVINFDADADVHCFSRGYLGLYRDRDLIIAPHPTRNPRNYTMVDYIALLRAXY

SEQ ID NO: 155284 - protein, 83 aa, Triticum aestivum
  Clone ID: PAT_TA_49702.pep
MAGRRCPHVMSLHDSGPPLLGRAPQHPQPGDDRDEPPHGALLHHPRGGPAQHPVVAVLEDRIVARDRDIHEFLVNYQRDAVTH

SEQ ID NO: 155285 - protein, 70 aa, Triticum aestivum
  unsure (1)..(70): unsure at all Xaa locations
  Clone ID: PAT_TA_49703.pep
IGSSSADRIXXRRHRRGGSNGVLVAGARGLRKEEADRILDRGRVRLVIGPVGNGRIPRWEMQWTGGGSGR

SEQ ID NO: 155286 - protein, 60 aa, Triticum aestivum
  Clone ID: PAT_TA_49704.pep
AKNYSHSHIGNSTVHLLTIIRVRLPFLAIGTVMDQKILAFHIYKDYLQSSSTKLKPTGRV

SEQ ID NO: 155287 - protein, 65 aa, Triticum aestivum
  Clone ID: PAT_TA_49705.pep
RPKVFNPPTVGKGASRPAIDALGSYRLIQWHGSLGCRDKYGAVGTFMSGYYKSKKGRMFEKEVQD

SEQ ID NO: 155288 - protein, 89 aa, Triticum aestivum
  Clone ID: PAT_TA_49706.pep
PPSHGYTSLVLPRTPIDHLANKQPRKGVVRRAFPTLTSPGFGPLSPRRTPIGRFGLLSRISVALTLGRCQLPRQGCQRQWRKEAYAWAD

SEQ ID NO: 155289 - protein, 111 aa, Triticum aestivum
  Clone ID: PAT_TA_49707.pep
DEHDLEEVVVLIVHPVRHLRLPSSLPVAASPRLSSRGPRSITRPMSNPEKASSTLRLPGWDGTRRCSPGRAGGEWEGWGQIREWNGDEGRRETGERKGAGGRDLVPSWPPD

SEQ ID NO: 155290 - protein, 131 aa, Triticum aestivum
  Clone ID: PAT_TA_49708.pep
MGTAVLPVAHKLSLASPFLPCHRRPCRPPAQQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAI

SEQ ID NO: 155291 - protein, 136 aa, Triticum aestivum
  Clone ID: PAT_TA_49709.pep
VRGRVGKDDIHGLTGLHNLGNTCFMNSAIQSLVHTPPLVEYFLKEYTQEINTENPLGLQGELAVAFAELLRKLWTAGRTSVPPRAFKSKLSRFAPQFSGYNQHDSQELLAFLLDGLHEDLNRVKKKPYIEAKDADD

SEQ ID NO: 155292 - protein, 86 aa, Triticum aestivum
  unsure (1)..(86): unsure at all Xaa locations
  Clone ID: PAT_TA_49710.pep
NLLIFVDLKRRVLQLFYSKFIPNPVQEYKQVYRFSPISLVQEIHLXGGGXQGAAPAVLTEEVMLPFCLFPALTMVVQRVWHVVIFL

SEQ ID NO: 155293 - protein, 119 aa, Triticum aestivum
  unsure (1)..(119): unsure at all Xaa locations
  Clone ID: PAT_TA_49711.pep
SAHAXADAWARPSRVFLEVTLARLPLGFGETMEDAGMEFLLDSVERFPLLEEFADSHEQPDPVPLALLANGVKRAAVQADSNAGSDCGQQIGGDRNDEARSGVRRRQEMSPLGLRSLPT

SEQ ID NO: 155294 - protein, 78 aa, Triticum aestivum
  unsure (1)..(78): unsure at all Xaa locations
  Clone ID: PAT_TA_49712.pep
RPPTRXPTRXPTRPPKPTLHHCMRSINPSPAPYPFVSPFQTPGRNPNHSCGRPTTSGRRDKTPPLDAVWLSHGARAEQ

SEQ ID NO: 155295 - protein, 79 aa, Triticum aestivum
  Clone ID: PAT_TA_49713.pep
MLSLRCWAPAFGLAFERTVALRPRKFNSLVVCGARGPRPRYPRVWETDKRIGTGSKSQKLGKCIKGLANVKEEGYGALD

SEQ ID NO: 155296 - protein, 73 aa, Triticum aestivum
  Clone ID: PAT_TA_49714.pep
VRSLPPLRASPRLPFPSAPRHPSPPPAIPGGQAVSPPPRLALAPSAWTPAKPRGRLTRYKFHTQVRLPTADHT

SEQ ID NO: 155297 - protein, 63 aa, Triticum aestivum
  Clone ID: PAT_TA_49715.pep
MSKQGGKAKPLKQAKVAEKDYDENDLAYLQKKKDEQKALKELKAKAGQKGALGGSGLKKRGKK

SEQ ID NO: 155298 - protein, 71 aa, Triticum aestivum
  Clone ID: PAT_TA_49716.pep
MGMATAAAATTAAPDRLRQPCRTRPAAQISSSKNRAPKAPVVIAHECPSAMRAHVLEVPAGRDVLSCVAAF

SEQ ID NO: 155299 - protein, 140 aa, Triticum aestivum
  Clone ID: PAT_TA_49717.pep
VRGRVGSGQVPAQIGNLKQLSYLHLEQNALEGSIPPEIGLCNSLVDLDLAENSLSGKIPDTVGSLLMLDSLNLSHNMISGGIPDALQSLRLSYADFSHNNLSGPIPPQLLMTAGDDAFSENSDLCVTDTSKGWRQSGTSL

SEQ ID NO: 155300 - protein, 135 aa, Triticum aestivum
  Clone ID: PAT_TA_49718.pep
HGSEAPHEGRARPARAPVPPPPPTNADDERQIPPTGAAITQPASCSPPCQPPWQPSVAASRTTPRSGQGKSPHGDPASREGEKAPPPPMPGGLRPPTRPGGGEGRDGERVAVRRRLGFPPLPPVGAPEERTRGRT

SEQ ID NO: 155301 - protein, 87 aa, Triticum aestivum
  Clone ID: PAT_TA_49719.pep
RPGSHPVSEPPAAAPPTRTPAAPAPPPPPRRPTAPRRASSPSPLLRRARSGSGAPCSRDLMRGGSPWEEDLGLRRRGGWEGGRVGGR

SEQ ID NO: 155302 - protein, 101 aa, Triticum aestivum
  Clone ID: PAT_TA_49720.pep
VRWNPNLETVLASHAADKRVMIWDVSRIGEEQADEDAGDGPPELLFVHGGHTAKISELSWNPSEKWVVASVAEDNVLQIWEVAESIYSDDNGSNSNAQPLP

SEQ ID NO: 155303 - protein, 137 aa, Triticum aestivum
  Clone ID: PAT_TA_49721.pep
SAHASEDYFNGKEPNKGVNPDEAVAYGAAVQASIVSGHVDENTKTMILLDVAPLTLGMETVGGVMTKLIPRNTVVPTKKTQVFTTYQDKQTTVSIKVYEGERSMTKDNRLLGKFDLSGIPPAPRGTPQIEVTFEVDV

SEQ ID NO: 155304 - protein, 39 aa, Triticum aestivum
  Clone ID: PAT_TA_49722.pep
RPLGNCDKLVYVGRVERVLIDLPLTLPYSMDVCIASRSL

SEQ ID NO: 155305 - protein, 106 aa, Triticum aestivum
  unsure (1)..(106): unsure at all Xaa locations
  Clone ID: PAT_TA_49723.pep
SGVRSHRIHTMSLKGYYEASLRPPAEDDVFTAAAAATKWDWGEALLDRAAYMVDKVNHTSARCRFKRDVLDEREVEMRVTLCLAPAAFVXYFCCHAYYTDDKRRRQ

SEQ ID NO: 155306 - protein, 49 aa, Triticum aestivum
  unsure (1)..(49): unsure at all Xaa locations
  Clone ID: PAT_TA_49724.pep
ILIFPIRWFPPFSFGAKVRISFFXSNSHPSMFCHPVQYHIACHPRVRGR

SEQ ID NO: 155307 - protein, 133 aa, Triticum aestivum
  Clone ID: PAT_TA_49725.pep
PLGGTPPPPPLKGPLKGGAHFPFKLGKCLEGQTGRALSFFPKLAKRGCPAKPFNLGTARVFQSPRFKTPARAIELGYPKKKLNRCQHAEVNLGPLKRPPPFFFFFFFFFFFFFFFFFFFFPPHFFFFFFFFFF

SEQ ID NO: 155308 - protein, 85 aa, Triticum aestivum
  Clone ID: PAT_TA_49726.pep
VRAHARKETRNEPNLTLNQSLAHGEVHGGRRTLHRTLARPRSQRPQLPLHLALLCALLSRAFLQASLEAPRALRRGLPKGRHHHP

SEQ ID NO: 155309 - protein, 48 aa, Triticum aestivum
  Clone ID: PAT_TA_49727.pep
RPFSWAEYDIMAPVPPKTEEALAAVFICNCGARNFRLQALEMLVSLDV

SEQ ID NO: 155310 - protein, 164 aa, Triticum aestivum
  unsure (1)..(164): unsure at all Xaa locations
  Clone ID: PAT_TA_49728.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIXPLILGIWGGKGQGKSFQG

SEQ ID NO: 155311 - protein, 126 aa, Triticum aestivum
  Clone ID: PAT_TA_49729.pep
LVPLIYYSASISSRPGRLLRAWLLARPCSLLLVRAALVLCSVVLGGARLHLGGGRPRRAADPRGGPHAGPAELASDPPQRLDLELGYLRHQQPRLAPGYRQHQQLRLHRALSQLPREWLEPAAAQE

SEQ ID NO: 155312 - protein, 100 aa, Triticum aestivum
  unsure (1)..(100): unsure at all Xaa locations
  Clone ID: PAT_TA_49730.pep
TDILRGFRVSTTPGGVSTQPGASTTSESSTRTXHLLWTDGLTNLDRYKGQCYHIQPGPHEDSKWILYVTYPLHLFQEAXXTNMXTCIXRNPFGLKALXAL

SEQ ID NO: 155313 - protein, 68 aa, Triticum aestivum
  Clone ID: PAT_TA_49731.pep
SSDLVLQELEGSVNESRFRHMYIQYNNTGCELYYIDHHMDADMMIQDNKTEPAVVTDEGRSYSATVNH

SEQ ID NO: 155314 - protein, 63 aa, Triticum aestivum
  Clone ID: PAT_TA_49732.pep
LYCEDIYHRYKTNIGTTQHTKHTYANRILPHGSGYTSNNRNEIILATRLVLTDQQNNTKQANI

SEQ ID NO: 155315 - protein, 152 aa, Triticum aestivum
  Clone ID: PAT_TA_49733.pep
MRALPMAVSRGAVACATPAAAAAAVPRRSMLLSTAAAGAALQSDPIRRGSTPKLKLRASAGAAQAAATSFSSNDEAFTWAKKDNRRLLHVVYRVGDIDRTIKFYTECLGMKLLRKRDIPEEKYTNAFLGYGPEETNFAIELTYNYRVDSYDI

SEQ ID NO: 155316 - protein, 117 aa, Triticum aestivum
  Clone ID: PAT_TA_49734.pep
PSYSWARGARPPLPPQGRPCSLGLLPCLLFFLAQHPHSRHHGRRKKAQISPCLLMFLNNLSRRFLQAATFSFDPPNQQQQIILLKQYSSRTTSKTSGTSSAEEGDRCTKLIPLPRIP

SEQ ID NO: 155317 - protein, 148 aa, Triticum aestivum
  unsure (1)..(148): unsure at all Xaa locations
  Clone ID: PAT_TA_49735.pep
PSHYVGSYLATVRGSVTLIESITMDQLIHHFXETVHVVMTMRCFRXVDGFFQEILNRLNSSLRMDFHNNGVNEWLELRVRLAVSFTVCFTASLMITLTKSYIQAEFVGLSLSYGLSLNSVLFCAGWMSSFMENKMRIEERINLLLNIQ

SEQ ID NO: 155318 - protein, 145 aa, Triticum aestivum
  Clone ID: PAT_TA_49736.pep
RTRGRTRGFPSCSPPLPSPPRSAEPPQFPSPPPSLTRSYLYRPIQNPRRKILSTNPSGVRVLPAEAAALLHCSSLVTSGLGSRVVIWRLLGSGGVSGWDPAIWSCFVVIWCVGRYGHGRGQGPAAAEARGGRQRRGVCVGGRGGG

SEQ ID NO: 155319 - protein, 144 aa, Triticum aestivum
  unsure (1)..(144): unsure at all Xaa locations
  Clone ID: PAT_TA_49737.pep
RTRGVKVQRPFVLETVTIDLFIIRNLGLVLKRFPQVALDVVGLVDEWAARFFEELDYVNGGENGTLFAEMMREDLPQVVVPRTYPEYTSRKVLTTGWVDGEKLSQSTEDDVGSLGNVGVICYLKQXLDTGFXHADPHPGNMIRT

SEQ ID NO: 155320 - protein, 109 aa, Triticum aestivum
  Clone ID: PAT_TA_49738.pep
RPQSALWLVSKRWAADVVLAGAAAPCGNGALSGCRLRATPASARSGSRCVNGGAAVSVSGGPSARWRWPCPAWGIRQCHTSQRGGAIPSPAEAAPTADDGSAPWRPCGR

SEQ ID NO: 155321 - protein, 173 aa, Triticum aestivum
  unsure (1)..(173): unsure at all Xaa locations
  Clone ID: PAT_TA_49739.pep
PLDLFMPSRWMRHPLDVRLRPHASSRALTNSPRPWRIALAAXRALAAGCRPSPVPALAAGCRPSPPVAAPRRRRLRCFSPTLEPCMDVAKNFPGRSKTRRRLQQKMSLPAQLNDSSSKKCSVAENHGSKPTAVVANLCFSSSKTKNSGSKNAKKGAFVEGCSSKIKDTGGSTH

SEQ ID NO: 155322 - protein, 77 aa, Triticum aestivum
  Clone ID: PAT_TA_49740.pep
YYYDSRWLVQGRIYSDLNIRLYRLELPTLKAACNNHEALLFNRYLVQAISQHGSLSNICSVPCLLRITIYICVFSSS

SEQ ID NO: 155323 - protein, 150 aa, Triticum aestivum
  unsure (1)..(150): unsure at all Xaa locations
  Clone ID: PAT_TA_49741.pep
PTRPRATCGRPWASPFPHSSPPPPPPPLAMETSAVPEATEAWPPMENDENQKPFPLTGPGGLSFLKAVSDVSVTPITGLNVYSAACVLTRAETSVNIVLKAAFLGLPFSILPILLITRRIIRVVEQGGCSMDIGALLGLSQXIYIYVLGG

SEQ ID NO: 155324 - protein, 87 aa, Triticum aestivum
  unsure (1)..(87): unsure at all Xaa locations
  Clone ID: PAT_TA_49742.pep
QKSPNPNHKSNPLMXXXXXXRDGFKXCPHPPDNDTITQYNRPVHTSTKRVEGEPAESTHTPQQNQQLHLQELTKSTKXPEPTDTAKP

SEQ ID NO: 155325 - protein, 43 aa, Triticum aestivum
  Clone ID: PAT_TA_49743.pep
CETLSYLPPLSTEALLKQVDYLIRSKWVPCLEFSKVRYIFREH

SEQ ID NO: 155326 - protein, 105 aa, Triticum aestivum
  unsure (1)..(105): unsure at all Xaa locations
  Clone ID: PAT_TA_49744.pep
ATAPSLWSLPQLHVRRLNRLQTFRHSPPLCRQALLKTVDYLIRSKWMPCLEFSKVGFVFREHNSSPGYYDGRYWTMCKLTMFGCTDATQVLNXVQEVKKEYADAY

SEQ ID NO: 155327 - protein, 125 aa, Triticum aestivum
  unsure (1)..(125): unsure at all Xaa locations
  Clone ID: PAT_TA_49745.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEGRLSSYEYVSQGLKKYDFDXTMGGFYIAP

SEQ ID NO: 155328 - protein, 88 aa, Triticum aestivum
  unsure (1)..(88): unsure at all Xaa locations
  Clone ID: PAT_TA_49746.pep
MLDRGRAKLDERAQMKMSDRFFIEEEEEEEADEVLTESSYIXAPSPSSSSNGEDSSSEVGGEGEAKEVESKLKEEPGLGCLDALKDSL

SEQ ID NO: 155329 - protein, 134 aa, Triticum aestivum
  unsure (1)..(134): unsure at all Xaa locations
  Clone ID: PAT_TA_49747.pep
LREDEEAARLRAWHLSLQIGTNVSEYQAISKYKLSKMSYXDYYTFGAQDEWTIMENRAAYCRILVCPRILIDVATIDMTTHWLTVXISMPIMIILTGFHMMIHPXDGEYCNRYGTNSAARTAMTLASGATSSAE

SEQ ID NO: 155330 - protein, 158 aa, Triticum aestivum
  Clone ID: PAT_TA_49748.pep
MAVRATVSRFPVTQGALDECGIQWGISVTPFAADDETGQPPATAGRGDRLPRCERCWAYFNTYCDVERWGWACALCSTLNGFDDDALHRFQRPEACPELNASFIDFEMPVDDADGAGDGVKARPVYVAAVDLACSEEFLELIKSALLAALEALIPGSL

SEQ ID NO: 155331 - protein, 148 aa, Triticum aestivum
  unsure (1)..(148): unsure at all Xaa locations
  Clone ID: PAT_TA_49749.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEXEGSVTNHVTSIVGNVXFGFKALRALRLEDLRIPPTYSK

SEQ ID NO: 155332 - protein, 93 aa, Triticum aestivum
  unsure (1)..(93): unsure at all Xaa locations
  Clone ID: PAT_TA_49750.pep
MERDTATTATATAAARVCRRCKAKYSPXGHTPRSCRFHPSFFVCRRHDDQKRYYELKDGDPPYAAKFYDCCGAEDPDAAGCATGFHLSYDDPE

SEQ ID NO: 155333 - protein, 50 aa, Triticum aestivum
  Clone ID: PAT_TA_49751.pep
KGPPLYNFIFLIFLFFFFYFFYFIFFFIYFIFFFFFFFFFFFFFFLFFFF

SEQ ID NO: 155334 - protein, 48 aa, Triticum aestivum
  Clone ID: PAT_TA_49752.pep
TSITRDAECEKTGAVMLYFQERAKVIDHLGGRGMGQIFEDTIMRSMAS

SEQ ID NO: 155335 - protein, 176 aa, Triticum aestivum
  Clone ID: PAT_TA_49753.pep
DRVLAARDAHLHSTLPLYYLCLRAGYRSNNPAVLPTNWPTLHMFPSFVANLHNLHDYFALVLAGSGHNFRAHGPPGTGMRLFVTCDPANIRHIFTTNYTNFPKGAEFAAIFDIMGGSLFTIDGELCRQQRAKVKGVLSSPWMVARIAACCRDQVENNLLPLVPTWRALALRSTCKK

SEQ ID NO: 155336 - protein, 37 aa, Triticum aestivum
  Clone ID: PAT_TA_49754.pep
MAAAVVHLSVHGRLRRSPEAVVSQACHRPSLLRCRAF

SEQ ID NO: 155337 - protein, 76 aa, Triticum aestivum
  unsure (1)..(76): unsure at all Xaa locations
  Clone ID: PAT_TA_49755.pep
MASGGVFLLLLLLVAGVVAVFFRMRRRRGDGSSSAPSPPSLPLLGHLHLLKKPLHRSLAALAGAAPXLSLRVGARR

SEQ ID NO: 155338 - protein, 93 aa, Triticum aestivum
  Clone ID: PAT_TA_49756.pep
RLMGRAQGTYIAAGKDQLALLMLMNFLFTAGKYNGSSVAIMGRNAVFTEVREMAVVGGTGVFRWAPGYAQARTHTLDLKTGDATVEYNVFIMH

SEQ ID NO: 155339 - protein, 104 aa, Triticum aestivum
  Clone ID: PAT_TA_49757.pep
MAMAATGRGLLLSRPSPLRTTRAPRRGGTADPPCSPDLAGPAPPPRHELLLERLRLRHLKDSPSPGPPKPLRERARNGERGYPTPQNQQRSVEEESFEELGLEE

SEQ ID NO: 155340 - protein, 125 aa, Triticum aestivum
  unsure (1)..(125): unsure at all Xaa locations
  Clone ID: PAT_TA_49758.pep
HFPFRPRHPSLLLPHPKSTTNKILSFNIHDYFLHAIIPXELPSXLLTQAEYNNLFXCEXVGDIXXHLSTTKYXPYXXNXPSPXHTTTIXXXXTLXXXXXYKHXXXXXNXPLSTFLXYITYXHXIH

SEQ ID NO: 155341 - protein, 65 aa, Triticum aestivum
  Clone ID: PAT_TA_49759.pep
HCFLLSQPAEMEAALPASGSSTDTDSVSMSSRAMCSTNSPNSADKRDLCTQAVMRPRGVETPPLR

SEQ ID NO: 155342 - protein, 103 aa, Triticum aestivum
  Clone ID: PAT_TA_49760.pep
AGPKLEHNQHVELKAGINGHNVPSVYPHMRENCGCTSTSCSGIARGPSTVAQSAGGGARRRAAAEEEEEEGLRPAAAAAGGLARGRRPDSSSAGTPAGRVVDR

SEQ ID NO: 155343 - protein, 121 aa, Triticum aestivum
  unsure (1)..(121): unsure at all Xaa locations
  Clone ID: PAT_TA_49761.pep
ISFSCSACSQKSSATXLTWFFALLLILATMIQVRAQPPTAGKCMPYPPSVCPVLHLTLGAVPRFVREVQHLRPLPIGLRLETGYGREIGGSTASFSPTDARGASVPWRRVEVGGAGDQCRA

SEQ ID NO: 155344 - protein, 46 aa, Triticum aestivum
  Clone ID: PAT_TA_49762.pep
FSEEGIYLHSTFLPPTLITLTPTYTHSLPGPQLHRPPTYQSTIQLS

SEQ ID NO: 155345 - protein, 185 aa, Triticum aestivum
  unsure (1)..(185): unsure at all Xaa locations
  Clone ID: PAT_TA_49763.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILXIXGGKGQGKSFQCELVFGKMGINPIMMSAGELE

SEQ ID NO: 155346 - protein, 112 aa, Triticum aestivum
  Clone ID: PAT_TA_49764.pep
IRAAGGSPRAFAAIGIPDLPHRAPAASAPAPYFGHSRYEHFVVPSQRLVKPHRAPRIRGAAPGERTPFQIRPLSCRAWSLGPWRNHLRLRVSDAAMSLPGKKAAAGAGGIRR

SEQ ID NO: 155347 - protein, 182 aa, Triticum aestivum
  Clone ID: PAT_TA_49765.pep
MYADRFPSAELQRRPADYQLKTWDYDSICSMQQQAQQDHEHSKESSLQSSLKQKVRRLLLEEEEELATRLIIMDQLQSLGVAYHFEEEIRNILMSMHVHDAHHQLKHDLSSTALLFRMLRGYGISASTDMLSAFRDENGDFKAANPKDIDGFVALHEASYLAFPGEAMLDEAEHSPSRNSNN

SEQ ID NO: 155348 - protein, 121 aa, Triticum aestivum
  Clone ID: PAT_TA_49766.pep
NPASHLRLDVQPGVAETHNRYPCQSLVVPRQLPETSPAYPTPRQLPEPGPPCRRHRGADGRPGPTRQRVRCYHRSRTYTGWEDEDLQVLGAGDERTTRSSLPCHHGLQMRGDFVGKAREAE

SEQ ID NO: 155349 - protein, 84 aa, Triticum aestivum
  unsure (1)..(84): unsure at all Xaa locations
  Clone ID: PAT_TA_49767.pep
MPTYRILDISIRISRVSPNPGAPAXEAGSAAAAQSHTRTWTTARTDGLTXCDRYKGRRYHIXPVAVEDSQWILFGAYAFDLFEE

SEQ ID NO: 155350 - protein, 154 aa, Triticum aestivum
  unsure (1)..(154): unsure at all Xaa locations
  Clone ID: PAT_TA_49768.pep
FKSYREGLMSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEGGSVTNMFTSIVGNVXFGFKALRALRLEDLRIPPTYS

SEQ ID NO: 155351 - protein, 85 aa, Triticum aestivum
  Clone ID: PAT_TA_49769.pep
EKEHLKFLRLLLKDFMIKYGIDTENWILIQFATARKIIVLCPWSISQMKAVEGHKGSLLLYRASTHKGSLLHLQKLMMLAMLFAV

SEQ ID NO: 155352 - protein, 58 aa, Triticum aestivum
  unsure (1)..(58): unsure at all Xaa locations
  Clone ID: PAT_TA_49770.pep
GXVRLHSAPRLRSGSGRSCSAKYRSQQTAALRILGAVDSRTGPKGQLNQDVQTKDTPM

SEQ ID NO: 155353 - protein, 112 aa, Triticum aestivum
  unsure (1)..(112): unsure at all Xaa locations
  Clone ID: PAT_TA_49771.pep
PQLGARGRGSGTGARFSRRALDSAAVLYPGEGGAGLELDLDRGRFVAPVRVEDSAAVASCINGATRNHRTDGRDEEMGGGRKERGGTHRRGGARRRLAGGGVHENXGTRVAP

SEQ ID NO: 155354 - protein, 163 aa, Triticum aestivum
  Clone ID: PAT_TA_49772.pep
ARSIFHRDVKSGNILLGADLRAKLADFGLSRAARGAEDASRSHVSTAPQGTPGYVDPEYHQSFHLSDKSDVYSFGVVLLELITAMKVVDFGRPANEVNLACLALDRIGKGRVEEIGDPALLRHGEEWVIGAVRHVSELAFQCLAFDKDVRPSMSEGARELCRS

SEQ ID NO: 155355 - protein, 220 aa, Triticum aestivum
  unsure (1)..(220): unsure at all Xaa locations
  Clone ID: PAT_TA_49773.pep
MGRRRRFTQQPTSDDDDDDDKAVPQPLRTTKPTAPLSPGAKKQQRHRADEDDLELEEEEEDEKDLAELRKNEEEERREETQTRRRRGRKPKRPAEESDEDPEEKKAESEEEEESREEDSTEAVPVGEPLKVTGKGKKQRRHYLSFEYEGNTFELEDPVLLTPEQQKEKPYVAIIKDITENDGSLSVTGQWFYRPEEADKXGGGNWTGSDTRELFYRFYID

SEQ ID NO: 155356 - protein, 130 aa, Triticum aestivum
  unsure (1)..(130): unsure at all Xaa locations
  Clone ID: PAT_TA_49774.pep
RACRCGPWRTSRSSRPCSTVPSLSTEAMLMQGDYLIHYKWEPCLEFSKVGQSXREHNASAGYYDGRDWTTRKLTMFGCTDATQEINEVEEAMKEYPDPYVRIIGLHNMRQVQGVSFIAFXPPGCEEAGKA

SEQ ID NO: 155357 - protein, 70 aa, Triticum aestivum
  Clone ID: PAT_TA_49775.pep
LVRAVGVFTIVGLDAGIRSGVAPPVEDRSVVHHILSLARLCPSLCSAVAHSLKDSGRFCIVLVISLCVAL

SEQ ID NO: 155358 - protein, 68 aa, Triticum aestivum
  Clone ID: PAT_TA_49776.pep
CFTSAKKTIYLFRLLLSSVLPLVFFLTVPRIMDFPLACPTTNSSSSGLCNRYCSRTSTTVSAIDLRPF

SEQ ID NO: 155359 - protein, 154 aa, Triticum aestivum
  unsure (1)..(154): unsure at all Xaa locations
  Clone ID: PAT_TA_49777.pep
MAASLQAAATLMPAKIGGRASSARPSSHVARAFGVDAGARITCSLXSDIREVASKCADAAKMAGFALATSALLVSGASAEGAPKRLTFDEIQSKTXMEVKGTGTANQCPTIDGGVDSFPFKAGKYEMKKFCLEPTFFTVKAEGIQKNEPPALQK

SEQ ID NO: 155360 - protein, 122 aa, Triticum aestivum
  unsure (1)..(122): unsure at all Xaa locations
  Clone ID: PAT_TA_49778.pep
LGTFRPSSQRDGEDGDEADEDHPAPGVLNIRDTAAHLIGRTPLVYLNRVXEGCXXXXXXXLXXLXPSFSVXARXXXSXXXXAXXXGAXXPGXAXLXXPXSGXLGVGLAFLAALXGSXLXLAV

SEQ ID NO: 155361 - protein, 83 aa, Triticum aestivum
  Clone ID: PAT_TA_49779.pep
SLTAVVIKGLADHKDQLGAPLCPCRHYDDKAAEAAQGFWNCPCVPMRERKECHCMLFLTPDNDFAGEDQAISLEEIKEATSKY

SEQ ID NO: 155362 - protein, 103 aa, Triticum aestivum
  Clone ID: PAT_TA_49780.pep
PAYRPIPSPRVRGVASPPHSVLGSRSARPFVGFSSSGKRKECGREYRASRGCWPRRPALKRLLRRAHTQTSCRRRRSPFGSHSRREAASIEQNADDGDIPHER

SEQ ID NO: 155363 - protein, 96 aa, Triticum aestivum
  unsure (1)..(96): unsure at all Xaa locations
  Clone ID: PAT_TA_49781.pep
XIGHSLITLTTQRYIRSICSLRANTMYGSTSQSPRXVTLLPRCATQVQLLCSSVSKRCFCREQRGLSQGRRENRFDSCGDATLNPSHLRGWYTEET

SEQ ID NO: 155364 - protein, 95 aa, Triticum aestivum
  Clone ID: PAT_TA_49782.pep
PRVRPRVRAPAKPSLAARLPRNSRSSWTLHEGMVKAGAIDRGLPGAFAGWLGVFLPSSFAPSGGASASASVAGGLTILYALKLQLRVVLLYVGQQ

SEQ ID NO: 155365 - protein, 111 aa, Triticum aestivum
  Clone ID: PAT_TA_49783.pep
PTRPPTRPDPRVRGRVGADPDYSSYKALEFANGLFSTFTPSAGLKIIQLYREGYRQDWELSFEKNTRTKGGWYQGGLLVAGPGIDNISYIHKDKEAGDDPEMEDVLTACCS

SEQ ID NO: 155366 - protein, 133 aa, Triticum aestivum
  unsure (1)..(133): unsure at all Xaa locations
  Clone ID: PAT_TA_49784.pep
MSPQTETKAGVGFKAGVKDXKLTYYNPKYETKXDTDILARFRVSPXPGVPTERNRGXITAESSNGTWTTVWTDGIKSLDRYKGRCYQIEPVAGENNQWICYVAYPLELFEEGSVTNMFTXIVGNVFGFKALRA

SEQ ID NO: 155367 - protein, 152 aa, Triticum aestivum
  unsure (1)..(152): unsure at all Xaa locations
  Clone ID: PAT_TA_49785.pep
MGISRDSMHKRRATGGKQKAWRKKRKYELGRQPANTKLSSDKTVRRVRVRGGNVKWRALRLDTGNFSWGSEXAVTRKTRLLDVVYNSSNNELVRTQTLVKNAIVQVAAAATEEAKKSNNVQRKLEKRQQGRTLDSHIEEQFSGGRLLACISS

SEQ ID NO: 155368 - protein, 160 aa, Triticum aestivum
  unsure (1)..(160): unsure at all Xaa locations
  Clone ID: PAT_TA_49786.pep
ILCLCVVLVFFTIRKKSKDRSKTMGGFQLMDDNYPRVTYAELVQGTSGFATDNLIGRGRYGSVYKCSLLLNTMMTTVAVKVFDLQQSGSSKSFLAECEALGRIRHRNLISVITCCSSSDSDQNDFKALVLEFMPNGSLDRWXHIDVHASQQLQGLTLMQR

SEQ ID NO: 155369 - protein, 79 aa, Triticum aestivum
  Clone ID: PAT_TA_49787.pep
ERPQQHEDKREAKLEMAPTMASMTGLSHGVRLPGPAGRRAQQVHREGVVGGGRGRRTTCGPCPNGQRSRRQRVRSGGAR

SEQ ID NO: 155370 - protein, 104 aa, Triticum aestivum
  unsure (1)..(104): unsure at all Xaa locations
  Clone ID: PAT_TA_49788.pep
SYDVPSQGEDGIVSSKPRAMLMPCKIGGRXSSARASSDVGRAFGVDASARITCCLQPDMREVASKCADHVKMGGFALGTCDILVXXASAEAAPKRLTCYEIQSK

SEQ ID NO: 155371 - protein, 102 aa, Triticum aestivum
  Clone ID: PAT_TA_49789.pep
IGKGFQGEIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 155372 - protein, 95 aa, Triticum aestivum
  unsure (1)..(95): unsure at all Xaa locations
  Clone ID: PAT_TA_49790.pep
MEITMIIAHLMPDVYRYESIIESWXPSWALAMEMEMESMLELMWELTSDHQTLXLNTLXKPKVTQTDGMTDEGTAQVLTGVMIEGVLRLDDWMLN

SEQ ID NO: 155373 - protein, 54 aa, Triticum aestivum
  Clone ID: PAT_TA_49791.pep
GAGRATPRKSGASSARGRLHLWSRPLNFQPNDRNLEAFFQGKPMLTPVLPEAML

SEQ ID NO: 155374 - protein, 130 aa, Triticum aestivum
  unsure (1)..(130): unsure at all Xaa locations
  Clone ID: PAT_TA_49792.pep
EHLGDGERXVGQDRQRSLGRAPQRPQRRAVLLHLRRLPLPILAVSLLGHRRRGVEEHDLLLALSGSGGDDPALGPAAVVTPLPRHVAGDTEAGAAGGEARRRREEAVAGPGRVQEEVARGGXIAADAVGS

SEQ ID NO: 155375 - protein, 82 aa, Triticum aestivum
  Clone ID: PAT_TA_49793.pep
EFIIGLHMRFFFRFPLVSYSLRPKILVRGMDVSRCILILHTSICIHFDDKYFRTEGVLKLAIHSGFNVNIAFVFHMKFYYLF

SEQ ID NO: 155376 - protein, 163 aa, Triticum aestivum
  Clone ID: PAT_TA_49794.pep
THPPSVDSLPNSGHRLQIPLPQTPRSSVGSIDATSLPLDSAEAAARPATLAPNPAPDPPARAGGGMAANAHANLAGRSAPNELDVLRFLEETGEAYQGFEGASLSSRGCLVGSGVVKDLVAFAGDADDKPLSARPLPRFPVRHDPTPSRPCVSFAALGRGSGM

SEQ ID NO: 155377 - protein, 143 aa, Triticum aestivum
  unsure (1)..(143): unsure at all Xaa locations
  Clone ID: PAT_TA_49795.pep
FCSPRQNSVAVEDLASKEDSATIVAVMASSIHESTAEPLLVIMNPLLLSSACSGSWQDLEFLLNRGIDQVQRSIMPSQAFLDLLMAYGSDSCINKSASTQRVSDDIEAFLNLPSTVPSLLDGVTTEGGTVLHVXATYGDSDGF

SEQ ID NO: 155378 - protein, 116 aa, Triticum aestivum
  unsure (1)..(116): unsure at all Xaa locations
  Clone ID: PAT_TA_49796.pep
MGGRVGGRVGAARAIGGCPIYVSDKPGNHNFDLLKKLVLPDGSVLRAQLPGRPTRDCLFSDPARDGASLLKIWNMNKCAGVVGXVFNCQGAXGWCRIVKKTRIHDEAPGTLTGSVR

SEQ ID NO: 155379 - protein, 106 aa, Triticum aestivum
  Clone ID: PAT_TA_49797.pep
MAAQKVVLRVPTMTDDKAKRRAIEAVADIYGIDSIVADLKDNKMIIIGEMDTVAIAKKLKKVGKIDIVSVGPAKEEKKEEKKEEKKEEKKEEKKEEKKEEKKEEKK

SEQ ID NO: 155380 - protein, 105 aa, Triticum aestivum
  Clone ID: PAT_TA_49798.pep
RLSRSLVSPQRQLHACARQIRILACMRCYPRSSEDTLAEIHRRTVLASRSLHLTRLRRNLGHMRASTGGGSHRNGRLPLPWREPSVNAAPPSPLSSLFLLPLLTS

SEQ ID NO: 155381 - protein, 65 aa, Triticum aestivum
  Clone ID: PAT_TA_49799.pep
MESSPTSRKTLKNLHFHLKKVKRKKITNAAYQQGPLCVAVHLKNMWGHHLHLKREKTFKKIITSI

SEQ ID NO: 155382 - protein, 95 aa, Triticum aestivum
  Clone ID: PAT_TA_49800.pep
PSLARITADARSPRPASGTRPPSPSPPAWPPPSPSPPPPRPSPPPRPRARRAPTRRSRPRAARGPRPRPSARSPAPTQARGQPRVQPKVHARGRV

SEQ ID NO: 155383 - protein, 168 aa, Triticum aestivum
  Clone ID: PAT_TA_49801.pep
MASGIASMSSSLAVLLLGVLLLSRSSVGNAARHLDVPPPLPVPEVLPKPGLPPLPTPEEQPNPELPPLPTPDVLPEPPLPAPDVLPKPGLPTPNVQPKPELPPLPKPEVPKPDVEPKPELPPVPKGEEPPKTELPPPPTGGIPPKPVSPPLPTGELPPKPEPERVPKT

SEQ ID NO: 155384 - protein, 68 aa, Triticum aestivum
  unsure (1)..(68): unsure at all Xaa locations
  Clone ID: PAT_TA_49802.pep
TYGRYWTXWXLPMFGCTDATQVINEVEEVKKEYPDAYVRIIGFDNMRQVQCVSFIAFKRGGCEESGKA

SEQ ID NO: 155385 - protein, 156 aa, Triticum aestivum
  Clone ID: PAT_TA_49803.pep
LIMVFSKVEVNLKRLLEAAPRQQNQAKLVHYITTARELLEQLGAEITPEGISSVSKAKLSEYSEKIEALAATLASLVPENENLVDESREQDNSYEREKVGSPISLSSGLRRRSTAQMEVGPSSHERKEKDTGAPIKLDAEAQAHIEKHRKLQEDLT

SEQ ID NO: 155386 - protein, 142 aa, Triticum aestivum
  Clone ID: PAT_TA_49804.pep
MASPQCCANPPALNPAAGEGKVVDSFGGIKAYVAGAQDSKAAVVLISDVYGFEAPNLRKIADKVASSGYFVVVPDFLHGDPFVPENADRPIAVWIKEHTPGKAFEEAKPVIAALKEQGASSVGAAGYCWGAKVVAELGKANE

SEQ ID NO: 155387 - protein, 113 aa, Triticum aestivum
  unsure (1)..(113): unsure at all Xaa locations
  Clone ID: PAT_TA_49805.pep
VADQHLTQIPRAAALHASKPRCRLPSRRLCKDVLYYRLTTSGAQNLTDSSSEHXADCSVELHCGKHXQEYVDSVNRQXCISQLYCHTVKDLMKDAYNNGNPLTKYNDAVEVWN

SEQ ID NO: 155388 - protein, 69 aa, Triticum aestivum
  unsure (1)..(69): unsure at all Xaa locations
  Clone ID: PAT_TA_49806.pep
PPPPPRKGCCFPSSSRARALLMSWVKWWRRGSRAGGEDDXGFEEGLLGVCXKTXNKCDRTHGRTRARPG

SEQ ID NO: 155389 - protein, 155 aa, Triticum aestivum
  Clone ID: PAT_TA_49807.pep
MAVLPFRLRLRTAAISGLSPSTSVVCPSRQHRDGGSFSCRAAAAAGGPIIVSGDPPTFVSAPGRRIVAVGDLHGDLHQTRAALVMAGVLSAESDCHVWTGGQTVLVQVGDILDRGEDEIAILSLLSSLNVQAKSQGGAVFQVNGNHETMNVEGDF

SEQ ID NO: 155390 - protein, 166 aa, Triticum aestivum
  Clone ID: PAT_TA_49808.pep
QQLGRWKSGDARPSAPTAGAPPLHRRRRHSCKAAPIEGSHGEHHHSSGGTGRCCRRYETALVDERRCCNAPTRRWPPYSSDGGGAAMERSTPTAELQWRCSTQARSCNGALDTDGGAALERSTQAAELQWGCKSSATELQWSASGPGAASLRLRLAWCSVAGASLG

SEQ ID NO: 155391 - protein, 144 aa, Triticum aestivum
  unsure (1)..(144): unsure at all Xaa locations
  Clone ID: PAT_TA_49809.pep
KSASSSGFGGSNCRAGRTSGEDRSGVVGAANAAATAAVACXGSGSGGGRGPCSGEAGSDLGSLLRNGRKLRSMESEERDEGEDSCDDGEDSSTSPAPKRKTRPPRRLLKQRNRGSSIPKFLHERGGNAEGDKVADVGREHGGHQ

SEQ ID NO: 155392 - protein, 170 aa, Triticum aestivum
  unsure (1)..(170): unsure at all Xaa locations
  Clone ID: PAT_TA_49810.pep
SCLYTSQRRVGEKKQQKQGTVPSNRFGVILEWEGVVVEDDDPDLEPRVWYVLSLEEAKGGGHDEMLKEIEGMRTDQAISEVLCWSTDAKEIERLAARKEVIYQKLRGTFYQLRPGVLDCLNALVDSDIPIAVTASSPRMSLEEGIKAVGLQGYXDVXVAGEDSXXGTXGR

SEQ ID NO: 155393 - protein, 149 aa, Triticum aestivum
  Clone ID: PAT_TA_49811.pep
QSIGVAYHHWSPVLSHRSGQWDSSSMGRYRLIHLRDTGMEIVAHGHGSNCKREAEAPSLGPISSCLSRVASSARRNPQGHNHKREAGRQEEMEREGPCELWRPFQAQNSEKGTQDKVWRMGPGPFHSIPPSLPPSLPTDAGRVGGRVGA

SEQ ID NO: 155394 - protein, 77 aa, Triticum aestivum
  unsure (1)..(77): unsure at all Xaa locations
  Clone ID: PAT_TA_49812.pep
VLQVYSYFXCQGLFPTPLPVFLYNLLQCXSKYSRVGVNFDNKRSRSLATGREPLAPERLVYVRVRGAAGDEVAAARR

SEQ ID NO: 155395 - protein, 67 aa, Triticum aestivum
  Clone ID: PAT_TA_49813.pep
MPGIIVDGVVTEEIQHEVGSSQNKENLTAPTMAPSMQSEALEMHVENSGAGEPSIEQLYNNVCEMES

SEQ ID NO: 155396 - protein, 59 aa, Triticum aestivum
  Clone ID: PAT_TA_49814.pep
AWLQHKPPWSAAAGQLHSAWTHSSHRLRAVFILGRLCHLLSAPDLCSVITLALFFVLRV

SEQ ID NO: 155397 - protein, 163 aa, Triticum aestivum
  unsure (1)..(163): unsure at all Xaa locations
  Clone ID: PAT_TA_49815.pep
MSPQTDTKAGVAFKAGVKDYKSTYYTSQYETNDTDILAAFPVSPHPGVASEEAGAAVAAESSTGTWTTVWTDGLTSLDRYKGRCYHIXPVAGEDSQWICYVAYPLDLFEEGSVTNMFTSIVGNVFGFKALRALRVEDLPIPPTYSKTXQGPAHGIQVERDKLN

SEQ ID NO: 155398 - protein, 126 aa, Triticum aestivum
  unsure (1)..(126): unsure at all Xaa locations
  Clone ID: PAT_TA_49816.pep
MEAQTEPTAGDGCKDMDKDYKXTDYNRQHETKDTRNVSQNEEKHHKHKEHLEETGAAVAGESSIDTXTMRRTDWTAPGTEHMHRDGGMHIEPCAGEDSQWIWYAAYTLDLTEEASSTNMITSISGN

SEQ ID NO: 155399 - protein, 63 aa, Triticum aestivum
  Clone ID: PAT_TA_49817.pep
LTRPAHSLRRTAGSSTNKMSVLLSLRRLCCTLSSSSMWPDGGDIQNSEKMKTQIIARLLYPGC

SEQ ID NO: 155400 - protein, 141 aa, Triticum aestivum
  unsure (1)..(141): unsure at all Xaa locations
  Clone ID: PAT_TA_49818.pep
MAQTMSSMTGLSXALRLPGPTGMRASRFTVRASSAEAVADGRRAVLGLMASGVVGSAXAQVVHAGTVAVIKVGPPPTLYGGLPCTDNYDEARDFDLPMXIRLYLHMLSPSEAAVRAMECIQDILNLXSIIVMYQWPYVIND

SEQ ID NO: 155401 - protein, 161 aa, Triticum aestivum
  Clone ID: PAT_TA_49819.pep
EHRRRRRPQSAPSAAATLESSLLAAVSDRKERGTTCHPPLHRVTGQVMVSLLPPSRARPSPPPSAAPPDPSLPPAPLHDAAAPVCRFSFGSRASVVLIRAPPPPSPTHRRRRRPPLLHSGLPRPSSARGRVRSSPASADLHQRQRVAEVQIGQWIWTQRIV

SEQ ID NO: 155402 - protein, 79 aa, Triticum aestivum
  unsure (1)..(79): unsure at all Xaa locations
  Clone ID: PAT_TA_49820.pep
ITSVNLISRCVLSEGIKMVETVAYLPALSTXALLKQVDYLIRSXWVPWLEFSKVVNIFREHNGYAGYYDGRYWTMCKLP

SEQ ID NO: 155403 - protein, 137 aa, Triticum aestivum
  unsure (1)..(137): unsure at all Xaa locations
  Clone ID: PAT_TA_49821.pep
MAEEKHHHHLFHHKEGEDFQPAADGGVXRTGTPTETVVTATGNEGEYERITKEEKHHKHKEHLGEMGASAAGAFALYEKHEAKKDPEHAHKHKIEEEVAXAAAVGAGGFVFHEHHEKKQDHKEAKEASGEKKHHHFG

SEQ ID NO: 155404 - protein, 59 aa, Triticum aestivum
  Clone ID: PAT_TA_49822.pep
RRPALIPHPQHHGRQLSGQRHLHFLLLPADSSVPPLEASTDPPDSHRGHAHGEELVCLS

SEQ ID NO: 155405 - protein, 66 aa, Triticum aestivum
  Clone ID: PAT_TA_49823.pep
TGAGGACWTRCGSGHIIADRDPVRLHARRHRWPPCLAPTLAPGRCSQLAYCSAAPVKAQREAAAEA

SEQ ID NO: 155406 - protein, 101 aa, Triticum aestivum
  Clone ID: PAT_TA_49824.pep
GNLVAVADSFLEDLRRRLVVDTQEPMAARHAHLALSINQSSSDLQLSQTPQRIMPREKGFLSDTGARPPTIPQSPAAYHHPQRPREPLLVPLPRYKHHPKS

SEQ ID NO: 155407 - protein, 138 aa, Triticum aestivum
  Clone ID: PAT_TA_49825.pep
MAGGDILLRTHGGLPVLARASPCSLRLRFTASGRRAPSSLAAAKVDIGDVVSQLRSGSARGAADTKRQRRVSEGGLAFPRVVTSRIRGAEEEGKGEAPQLNAEKIGGEAGGVDGSYLSETRFDQGAISELSLKGVKDA

SEQ ID NO: 155408 - protein, 184 aa, Triticum aestivum
  unsure (1)..(184): unsure at all Xaa locations
  Clone ID: PAT_TA_49826.pep
PSRHGQAPRRPPPRRPARPPPPTAPRSSCSCFPTPSPRSGSPSPRFPPNAHADRLAIFPARRITPNQYAASHISFPLVRFRQLTLARVLFDEMPQSGVRLDEYVYTAGVQDYKAAGNLTARRGSWRGLGVKASMVSYVLLCGLCKNQRIQEAAEPRXVKDNGVVTGXGVAADEVTYRELLMGFW

SEQ ID NO: 155409 - protein, 46 aa, Triticum aestivum
  Clone ID: PAT_TA_49827.pep
HTPSSSSLPPVLAQHNEPLARERARAGDQRLHESPELVRGLASELY

SEQ ID NO: 155410 - protein, 57 aa, Triticum aestivum
  unsure (1)..(57): unsure at all Xaa locations
  Clone ID: PAT_TA_49828.pep
MSGGGGGAAATQGQQDLRVAPGFRFHPTDEELVMHYLCRRSAGLPIXVPIIGEVNLY

SEQ ID NO: 155411 - protein, 163 aa, Triticum aestivum
  unsure (1)..(163): unsure at all Xaa locations
  Clone ID: PAT_TA_49829.pep
MQIFVKTLTGKTITLEVEXSDTIDSVKAKIHDMEGIPADQQRLIFAGKQLEDGRTLADYNIQKECTLHLVLRLRGGMQIYVKTLTGKTITLEVESSDTIDNVKAKIQDKEGIHADQQRLICAGMHLEDGLTLADYNXQKESTXHLVLRLRGGMQIXVKTLTGK

SEQ ID NO: 155412 - protein, 177 aa, Triticum aestivum
  Clone ID: PAT_TA_49830.pep
YATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDW

SEQ ID NO: 155413 - protein, 157 aa, Triticum aestivum
  unsure (1)..(157): unsure at all Xaa locations
  Clone ID: PAT_TA_49831.pep
MKDRAGFHFSIGCMSQSAVAVADPLRKKPPAPAPQQQADNPSSSSITTQDRAPREEGTGGDEKAKEGIVAAGVQRLLKGIKTFFAAYDGEEEEEEEEREIVIGYPTDVQHVGHIGWDGLNKVGGMGMVGAFSVPXSLPLRQLEIAMDPGAATTTCTN

SEQ ID NO: 155414 - protein, 86 aa, Triticum aestivum
  unsure (1)..(86): unsure at all Xaa locations
  Clone ID: PAT_TA_49832.pep
SWSSLVIMMSLVKRCTITTEWCFFSCLCFLSGVSSSPLSQRFMIVPVLSSAPPPXRKKEFVARRATKCFLSTCIQFTILMYVRXWL

SEQ ID NO: 155415 - protein, 166 aa, Triticum aestivum
  Clone ID: PAT_TA_49833.pep
PTPPESSPFYVNQSNPVKEPLNCPPGDLPGLSSPSPPTSPSPLAPRLLGSLAPKSSLPIPGLQEPGGLSLKFTMGGCVGKGRSIVEEKLDFKGGNVHVITTKEDWDQKIEEANKDGKIVVANFSASWCGPCRVIAPVYAEMSKTYPQLMFLTIDVDDLMDFSSTWD

SEQ ID NO: 155416 - protein, 182 aa, Triticum aestivum
  unsure (1)..(182): unsure at all Xaa locations
  Clone ID: PAT_TA_49834.pep
MAPLRGAKRRKRHPEKALPAGVMAPLPPPDAADWWDSFSRRLAAGHYSKDCQNFESVFKMSRKTFDYICTLITGDFSRKTQGFRNFRFGDKTILALEDQVAVALLRLTTGESLLSIGNRFGMNHSAISNXTWKFIESLEDHAISHLKWPDPEEMATIKAXFEKLQGXPNCCGAIDTTHXLMC

SEQ ID NO: 155417 - protein, 174 aa, Triticum aestivum
  Clone ID: PAT_TA_49835.pep
PTVRPACGARPLNPRKAQLEQLPLILLVAWLASPPQNAPPSLSNGGHCHTHALFVSRRGGASRPTVASLHLRRVPTLSFHLRGAQGPAAFRALSSPFPGCRRRRRSGMVVRAEMFGQLTTGLESAWNKLRGVDRLTKENIAEPMRDIRRALLEADVSVPVARSFIEAVTEKAIG

SEQ ID NO: 155418 - protein, 136 aa, Triticum aestivum
  Clone ID: PAT_TA_49836.pep
SSFTPSLSISSHLTSSSPLADVSSRFRRRWRRGSRSGGAYYKEAMEKNKQYVVQPPSVEKCQELSKQLFYTRLASLPGRYEALWKEVDGVKQLWKNRKELKVEDLGIATLFGVELYAWFCVGEIAGRGFTLTGYKV

SEQ ID NO: 155419 - protein, 165 aa, Triticum aestivum
  Clone ID: PAT_TA_49837.pep
RTRGRTRGRVGLLLAPSSSLALNPPRPRLCQTVQQEILQSDIQSKADKSPVTVADYGSQVLVSLVLNMEVTSGSFSMVAEEDSEDLRKDSAEEILEHITDLVNETLAEDGSYNITLSKEGILSAIDTGKSEGGPSGRHWVLDPIDGTKGFLRGGQYAIALALLDE

SEQ ID NO: 155420 - protein, 117 aa, Triticum aestivum
  unsure (1)..(117): unsure at all Xaa locations
  Clone ID: PAT_TA_49838.pep
APTRDDRIGVCKWVTSTGIENIGKKLVNSRDGPVTFEQPKMTVEKLLEYGHMLVQEQDNVKRVQLADTYMSQAALGDANQDAMKTGTFYGXEHSPYTPTKNFDPTARSDDGSCLYTF

SEQ ID NO: 155421 - protein, 68 aa, Triticum aestivum
  Clone ID: PAT_TA_49839.pep
MASAMELSLLNPAMHHHGIAAKTASPLPVLPARRGAVRFRVRAADAAPPAPAAKPGSPKKRGKTEVNE

SEQ ID NO: 155422 - protein, 78 aa, Triticum aestivum
  Clone ID: PAT_TA_49840.pep
GPDAGTGACPMRSIKHGERACELALTAPLQTLMQNGLIHRVDLRVNSGLKSRLDVLMAADMGAYEYGSGTATMIATGR

SEQ ID NO: 155423 - protein, 49 aa, Triticum aestivum
  unsure (1)..(49): unsure at all Xaa locations
  Clone ID: PAT_TA_49841.pep
EEQWDSVAAARCRRCVVSSXVSYSFSSSSSSSRRYINPSSHLMGRAPCC

SEQ ID NO: 155424 - protein, 59 aa, Triticum aestivum
  Clone ID: PAT_TA_49842.pep
KPKPPASIVLGILLLDHKNVVDHQKRSYSPGQSLLSFRQHTGVVPVSPIHMYILTMKFN

SEQ ID NO: 155425 - protein, 108 aa, Triticum aestivum
  Clone ID: PAT_TA_49843.pep
LPGARRWPPRPPPATAGRRPASAPRPPPRPPRTPTRTSSPRTPSRPPPRTPTATRPAPPRGSPRPRTAAAPPTRPRRRAPWRRTGRRCGSGPPPPRRPRRGRPSRRCA

SEQ ID NO: 155426 - protein, 101 aa, Triticum aestivum
  unsure (1)..(101): unsure at all Xaa locations
  Clone ID: PAT_TA_49844.pep
ATRPIKVDAYHKKKRGFHGWLLMXPTPHEPTELRSDWDVATTFSLIQMVGVTGEFERKVECYHATLSGDCXHHELETARLRDILGNIXANTGDPPAGWDTD

SEQ ID NO: 155427 - protein, 61 aa, Triticum aestivum
  Clone ID: PAT_TA_49845.pep
DGLGRGGGVDCFTKDDLNLLTEDAVLTQLKDVYAEGKDLALTVMWAMVEEHICAVWDERPR

SEQ ID NO: 155428 - protein, 64 aa, Triticum aestivum
  Clone ID: PAT_TA_49846.pep
MSKSGALDLASGLGGKIDKEQVKSAVDEYEKYHGYYGGKEESRKSNYTDMVNKYYDLATSFYEY

SEQ ID NO: 155429 - protein, 90 aa, Triticum aestivum
  unsure (1)..(90): unsure at all Xaa locations
  Clone ID: PAT_TA_49847.pep
ALPTGRKFYANLLDAGMSXVGGEESSVTGSDHIREKDGVGAGIAWLSILGYKNNDNVARDKIATGADIAFHHWATYWSPYSTPSDYENVD

SEQ ID NO: 155430 - protein, 41 aa, Triticum aestivum
  Clone ID: PAT_TA_49848.pep
STLYTYIVNTGHNGPVALKPITVDCPFILAELPDPLWRMRR

SEQ ID NO: 155431 - protein, 101 aa, Triticum aestivum
  Clone ID: PAT_TA_49849.pep
PAGPWRRSAPAKVKLLLWSAPLPRGGRCWWRGLPWPPRRSSPGPVRRHSEAADGKFMPVIDRKAGYYFGYPFRWQEVYVQGRDKVYKDVIEPLESVSLHMI

SEQ ID NO: 155432 - protein, 82 aa, Triticum aestivum
  Clone ID: PAT_TA_49850.pep
METVALEEVQNCAVKLRSNPQRRKNQVYVGCGAGFGGDRPMAALKLLERVEELNYIVLECLAERTLADRYQVMLAGGKRFDP

SEQ ID NO: 155433 - protein, 95 aa, Triticum aestivum
  Clone ID: PAT_TA_49851.pep
VIRLSPITSQQLSSGHLPFQHRIPHSLNSGRSDTACAATGSRSKVLRAPASTFHSARAPSVTGQRGEHGVGAAEEQKGSMAGGVLASERVGGRVG

SEQ ID NO: 155434 - protein, 64 aa, Triticum aestivum
  unsure (1)..(64): unsure at all Xaa locations
  Clone ID: PAT_TA_49852.pep
DWALRLKGITYYSVDEDFAYNRDTLLCYNLVTKMAPVLIHDRKTIVESTIIMEYIYXAWKDGYP

SEQ ID NO: 155435 - protein, 80 aa, Triticum aestivum
  Clone ID: PAT_TA_49853.pep
KLAKKTEGWSVTESGEASFVGLKRKKKKLVELDPSPASTGDGEDTLDDQVGEDEQGEGIVAGGSTQYPWGGTDRDYQYDE

SEQ ID NO: 155436 - protein, 36 aa, Triticum aestivum
  Clone ID: PAT_TA_49854.pep
AGGSMRSCIVRVCIHAPKPKLASAIDSQVSIRRSMR

SEQ ID NO: 155437 - protein, 88 aa, Triticum aestivum
  Clone ID: PAT_TA_49855.pep
GFKKILVLPVHFSQVLNPHSVRQPEWEGSPNLIQKSGLISTLINTPFSTAVQKPMPRPAQHSTDLAVYPRGPPPPVQPPKLLKFWDPH

SEQ ID NO: 155438 - protein, 94 aa, Triticum aestivum
  Clone ID: PAT_TA_49856.pep
TNDTTHAFTLVSGHLLRPIWCQLGPLCFMPKTMLAVKECAKAGRTRSTAFPRTIRSSVAYLGGNPSTYRLATETPPALFRTRDGDQPDETKLVI

SEQ ID NO: 155439 - protein, 103 aa, Triticum aestivum
  Clone ID: PAT_TA_49857.pep
STAVLKPVGYSENSFLSNWANKTEKIFSLVWIRRKQGQLGTETNMEVLVCAYMKGKWLGKGGLTYCRLNCKTVNRTIGLWVDEACTNQIIHRIQDTIRARSGN

SEQ ID NO: 155440 - protein, 83 aa, Triticum aestivum
  Clone ID: PAT_TA_49858.pep
LRPSPTGCEHFRRGPALCPVTTTARTPARMGNVNEGKGIFAPLVVVVRNIVGRKRFNQLRGKAIALHSQVITEFCKTIGADPK

SEQ ID NO: 155441 - protein, 117 aa, Triticum aestivum
  Clone ID: PAT_TA_49859.pep
AEDGGLGLAALTEFNLRLWAWETGPEGVMEWVLRRTIQLDAFLPPNVSSVPLVNNHSASGRPVRILGLIEDDDMFFMWTREGVFAVELKSMWCNKVFEAQVPATIFPYTGFYTTSDV

SEQ ID NO: 155442 - protein, 105 aa, Triticum aestivum
  Clone ID: PAT_TA_49860.pep
DGRSSWSTHVIMPSPAKPCTSTTRWCFLPCFCFLSGASSLSVSQKFMTVPESYTAAACFRRPAFVAIQATECFISTCIQFTFLCTARHMVVAYLLLNDYCLFYHG

SEQ ID NO: 155443 - protein, 74 aa, Triticum aestivum
  Clone ID: PAT_TA_49861.pep
MGDGVAFEAARKIIMHPLYASRSSPWLDLKVFYVRVSNCMVDESAPDHLTLNHIPLSPDTVIEVNGRRSSMHTE

SEQ ID NO: 155444 - protein, 107 aa, Triticum aestivum
  Clone ID: PAT_TA_49862.pep
LLIGLSVSAVVIISSACFLAMQLQRKKHKKEKDEYFKQNGGLMLYDEMRSRQVDTVRILTEKEIKIATDNYNEDRVLGCGGHGMVYKGTLDDLKEVAIKKSKVINDD

SEQ ID NO: 155445 - protein, 59 aa, Triticum aestivum
  Clone ID: PAT_TA_49863.pep
AIHAVGFVIARTASGFALGDDGATASCVAVATASWGGRGRAEMVITRCSSFLPFETTEE

SEQ ID NO: 155446 - protein, 98 aa, Triticum aestivum
  Clone ID: PAT_TA_49864.pep
TRPRTRGRTRGRQGKISPRRLTSQAAEMLLILIAVLASAWPAAASASQPPSGTCQRRCGDVDIPYPFGIGRGCYLYTGENDVTFGLTCNLTADGTYRP

SEQ ID NO: 155447 - protein, 77 aa, Triticum aestivum
  Clone ID: PAT_TA_49865.pep
QKYVEKRIHKTLNDALAVVMVFDVISEVQREGLPRGLPSAIVNLLADLAAVLGRIERRSAYLHALLDELLGLHLCMH

SEQ ID NO: 155448 - protein, 58 aa, Triticum aestivum
  Clone ID: PAT_TA_49866.pep
EKSLITMLFYQHKRKSRKYIIGNERKPPSGDLCKPPVAPKTIMSPAFSVTSKPSLLAR

SEQ ID NO: 155449 - protein, 89 aa, Triticum aestivum
  unsure (1)..(89): unsure at all Xaa locations
  Clone ID: PAT_TA_49867.pep
MHSLAMGKIKIGINGFGMIGRLVSRVFLHSDDVELVAVNDPFITSEDMTYMLKYDTVHGHWKHRDIXLKDYKTLLFGEKPDTVFGVKNP

SEQ ID NO: 155450 - protein, 47 aa, Triticum aestivum
  Clone ID: PAT_TA_49868.pep
GARLQQGPLERVVPALALVDGRHHLVLRRRQQRHLPAHRRLLARQDV

SEQ ID NO: 155451 - protein, 46 aa, Triticum aestivum
  unsure (1)..(46): unsure at all Xaa locations
  Clone ID: PAT_TA_49869.pep
DEGGDVVVLVAVGGGKVGPARVLVHAHAQMVHHSPIGVVDFLXCKT

SEQ ID NO: 155452 - protein, 74 aa, Triticum aestivum
  unsure (1)..(74): unsure at all Xaa locations
  Clone ID: PAT_TA_49870.pep
APQLPRXADAWCKEGHIMVCKIAERHLSEDAAAVVQELLPDSAGRELSTMCPCSDTMRFSYHWARPLHYVNTPN

SEQ ID NO: 155453 - protein, 74 aa, Triticum aestivum
  unsure (1)..(74): unsure at all Xaa locations
  Clone ID: PAT_TA_49871.pep
RPVLNPDDEAETEHLLALAGGDEARVRFFPCDLLDGAAMLAAARGCSGVFHLASPXTVDRVLDPHKELVVPAVE

SEQ ID NO: 155454 - protein, 95 aa, Triticum aestivum
  Clone ID: PAT_TA_49872.pep
TIPPLPSSPPSLPHPDLATTNVSGAAAAPSPDEVPLRLPPDGPVRLLRASMVRKTWSHTVSQPGFRRRLRELHPAPLALGFLHNRADERSPCFIP

SEQ ID NO: 155455 - protein, 63 aa, Triticum aestivum
  unsure (1)..(63): unsure at all Xaa locations
  Clone ID: PAT_TA_49873.pep
MVHGYPPDGGYRYPPQGYPPPGVPYPSSGAYSSSPHYGYRXPGCYPPHGGYPGVGYPGYCFWS

SEQ ID NO: 155456 - protein, 40 aa, Triticum aestivum
  Clone ID: PAT_TA_49874.pep
GQDNKPRIVVRHRIIIAAYRRLRLLSRRRQTWAQLHEAVN

SEQ ID NO: 155457 - protein, 75 aa, Triticum aestivum
  unsure (1)..(75): unsure at all Xaa locations
  Clone ID: PAT_TA_49875.pep
SIYRSYLISTLQGRLKIADFGWAVRSNAKRHTLCGTIDYLAPEMVEKKAHDYAVDNWTLXILXYEFFVWLGHPLK

SEQ ID NO: 155458 - protein, 88 aa, Triticum aestivum
  Clone ID: PAT_TA_49876.pep
TLLNSIVVGRRLYRHIKVLEKMQDAEVNVQTIYCFNTFPTMTLEVLMNLFHRMDRMILHGPHLNHMMWGAARFIVVHTLLIGLRDLTW

SEQ ID NO: 155459 - protein, 64 aa, Triticum aestivum
  Clone ID: PAT_TA_49877.pep
SSFHPMVIAEHKHHARGDPLQGGYSDFLLLPTLPGQDSRDLAHHVLSPRRPNLALLPLIRHALS

SEQ ID NO: 155460 - protein, 134 aa, Triticum aestivum
  Clone ID: PAT_TA_49878.pep
DVAGDEELRAWWEEVRTKGHADKKDEPWWPVCDSKENLVQILTIIMWVTSGHHAAVNFGQYHYAGYFPNRPTVVRKNIPVEENRDDEMKKFMARPEEVLLQSLPSQMQAIKVMATLDILSSHSPDEEYMGEYAE

SEQ ID NO: 155461 - protein, 83 aa, Triticum aestivum
  Clone ID: PAT_TA_49879.pep
AAIVPDVDLNLRVWCNYVIETQTRDDRTYLIHHSHATTIWVPDALIRYREENDDNDHNRLLETKGDGHDYLQVTRMLCNGRCE

SEQ ID NO: 155462 - protein, 53 aa, Triticum aestivum
  Clone ID: PAT_TA_49880.pep
PARKAQPGSGSGRKRRCRDAGAEVGLPDPAAATVGGIRLLAGYLAHEFFACGT

SEQ ID NO: 155463 - protein, 81 aa, Triticum aestivum
  unsure (1)..(81): unsure at all Xaa locations
  Clone ID: PAT_TA_49881.pep
MVVKDEFDEHAEKGKTLTHTTTNXSKLCLYSLYNQAIVGPVNTARPGGLLDMAGKAKCDAXKAVEAKSKEEAMVDYITKVK

SEQ ID NO: 155464 - protein, 118 aa, Triticum aestivum
  unsure (1)..(118): unsure at all Xaa locations
  Clone ID: PAT_TA_49882.pep
MELLPFSQQNVSFKVILTSDPKLPFKVFSVPDAAPFTHVLKFAFXEFKVPPHTISNITNDGVFINPQKSACSVFLKHGFELLLIPRNKFGTPLAFFLVHCRINFDLILYYRNKYIFIL

SEQ ID NO: 155465 - protein, 34 aa, Triticum aestivum
  Clone ID: PAT_TA_49883.pep
WKNVSDIGSDELPGLSNSLEKGDRSWRLKSQNPS

SEQ ID NO: 155466 - protein, 69 aa, Triticum aestivum
  Clone ID: PAT_TA_49884.pep
ATHAYNHTYNIKSTHFFLYPLPPERRGLTLFYPPPLNIIFFLILIYPPPTPFNKKHIYGPLIAFLPNPH

SEQ ID NO: 155467 - protein, 44 aa, Triticum aestivum
  Clone ID: PAT_TA_49885.pep
METGWHSLEGPILCVYNCGFFSIAMTMNMCSECHMEMALKQEHA

SEQ ID NO: 155468 - protein, 107 aa, Triticum aestivum
  Clone ID: PAT_TA_49886.pep
KTRTADVERMDGALHSTGDDIASKHPPPSNVHPPAVSVCVEDKCPRVQQQVVRSATAVACSCPSAHNRGASTDTSPAASAAAATTGRAILISLDLFFRRWQSGQWWP

SEQ ID NO: 155469 - protein, 133 aa, Triticum aestivum
  unsure (1)..(133): unsure at all Xaa locations
  Clone ID: PAT_TA_49887.pep
PMRPASRLLRKMFGRSKLRRGLPISVGVGGGGGVIRPAGRGRRQPAARAPGWWRRSSRGAHVCDSGESSAXLGWRRRRRRPARLNGVSTPPPPRFDSVGYFFFKPSGIKIFGEPVMTLFFGRGLLLYLVEEGF

SEQ ID NO: 155470 - protein, 62 aa, Triticum aestivum
  Clone ID: PAT_TA_49888.pep
MRDIISIHIGQAGIQVGNSCWELYCLEHGIQPDCLMPSDTLVGVAKDAFNTLFSETGSGKHV

SEQ ID NO: 155471 - protein, 89 aa, Triticum aestivum
  unsure (1)..(89): unsure at all Xaa locations
  Clone ID: PAT_TA_49889.pep
LPDATQGSDHLSXVFSTQIGLGDKDIDALSGGHTLVCMSYVWRQVCTLTAATKNADKASRIMLYYAARSTSSSLILSVIHFFCSRSQPC

SEQ ID NO: 155472 - protein, 93 aa, Triticum aestivum
  unsure (1)..(93): unsure at all Xaa locations
  Clone ID: PAT_TA_49890.pep
MAATIHSEKARQIFDSRGNPTVXVDECCSYGTLARAAVPSGASTGVYEALELTDRGSDYLGKGVSKAVNHVNFIIAPAVVGEDPTAQTELYNF

SEQ ID NO: 155473 - protein, 79 aa, Triticum aestivum
  Clone ID: PAT_TA_49891.pep
CMRNNDIYCHCCQRLLDWKYANAYLLNQKYKKRQFILKNNMMLQEGRQLAETDDMMAKSAHAHIYNLRTVAKDSVILIN

SEQ ID NO: 155474 - protein, 68 aa, Triticum aestivum
  Clone ID: PAT_TA_49892.pep
HVDGLDDAGLHDIAGGPNAQCQDHLPLDGGEKEQRRLGDGLRLPELELGGRHWMDSGVGGGEIPRTRG

SEQ ID NO: 155475 - protein, 94 aa, Triticum aestivum
  Clone ID: PAT_TA_49893.pep
NNTNVRTHQMISDAKKTLLFLGQPYRAGDQPDPGAGSLENVPHGTVHVWTGDPAQPNLEDMGNFFSAARDPIFFAHHGNIDRLWHVWRASPSNT

SEQ ID NO: 155476 - protein, 111 aa, Triticum aestivum
  unsure (1)..(111): unsure at all Xaa locations
  Clone ID: PAT_TA_49894.pep
IFRLTRVGYGLCAPAASEVEGERCMVFGGRRNDGRAECRVGVERNNTSHITMGDEEDASGSEGVPMGHQDHPLGVGEAFKAHTRDXLKLKLGGGAYRTEELQTRVLNVMMM

SEQ ID NO: 155477 - protein, 98 aa, Triticum aestivum
  Clone ID: PAT_TA_49895.pep
NRFSWLIITRCGTSIGRKYTQLIQSSNHVDSLHNMIAYKSVLKYFIDYTSVSERFIKMCVIFSFQFISHMDHYLEKHNLQNLIHLLFLILCLIIMDYE

SEQ ID NO: 155478 - protein, 67 aa, Triticum aestivum
  Clone ID: PAT_TA_49896.pep
VFTLVVAFSPQCHSADHSTQGGYEYFLLWPQPLKVPLAAVIMAPVLLPLWTAGLERMAQPTLLGVLY

SEQ ID NO: 155479 - protein, 55 aa, Triticum aestivum
  unsure (1)..(55): unsure at all Xaa locations
  Clone ID: PAT_TA_49897.pep
SHCTSPAGRLPPWQPPAAPACLSCCSSCRRLSSPRIHRQRRLXXHKQSSRYRYTV

SEQ ID NO: 155480 - protein, 70 aa, Triticum aestivum
  Clone ID: PAT_TA_49898.pep
KSVICHLRLRGLTFVFITKREGKKSKGFQVSWTSYRQQTLTIICTSSWSEFIAGSEMVLTLHIHIISISL

SEQ ID NO: 155481 - protein, 48 aa, Triticum aestivum
  unsure (1)..(48): unsure at all Xaa locations
  Clone ID: PAT_TA_49899.pep
KTTVATVWEXDLMGKKVFGRADLNVPVDDSQMITDDTRIRSFMLTIKY

SEQ ID NO: 155482 - protein, 122 aa, Triticum aestivum
  Clone ID: PAT_TA_49900.pep
RTRGWAARLVLALGAEAKIDVVAGWAEYALPFTTLEHALKVESELKMLERRKFGKKSPPIQVAIVGLGYSGVELAATISERLKNTGTVKAINFQTTICPNAPPGNREAALKVLESQNIQLFL

SEQ ID NO: 155483 - protein, 100 aa, Triticum aestivum
  Clone ID: PAT_TA_49901.pep
WRLPVRPHRKPPGVRAPRPPPVRRYASPAAAVPPPPPPPRPLPPASAYVHLPFCRKRCHYCDFPIVALGSSASSPGGPGEGKDPWICLLTSAFFFPYVVT

SEQ ID NO: 155484 - protein, 67 aa, Triticum aestivum
  unsure (1)..(67): unsure at all Xaa locations
  Clone ID: PAT_TA_49902.pep
LDSSSTMAFSADPTAQPYLGEXFRLVLHLLTDRTVVRSAALPFPXXGNVAYNDHCRFLCMDSVYNTS

SEQ ID NO: 155485 - protein, 84 aa, Triticum aestivum
  unsure (1)..(84): unsure at all Xaa locations
  Clone ID: PAT_TA_49903.pep
MRPSEFLRCRGCSRSVPSLPRSALGAVADTTTSTSXPITQASGSRSTLRWRITVCTVPQFLFVDACSTTFTSTSTPSTATSTTA

SEQ ID NO: 155486 - protein, 94 aa, Triticum aestivum
  unsure (1)..(94): unsure at all Xaa locations
  Clone ID: PAT_TA_49904.pep
TSSPAEEILSMIIWVLEGGGWALSXDALTRTRPRRHTDGVRARRRPWQEARGSGAVERGRGGMRRXGVEFGFGHPCPREGHGSGRVAGWRAAWC

SEQ ID NO: 155487 - protein, 50 aa, Triticum aestivum
  Clone ID: PAT_TA_49905.pep
AYTASARRVGRYLPGEHGGANGRGTADMHPRHWPSDFARNPKINPSLAYK

SEQ ID NO: 155488 - protein, 86 aa, Triticum aestivum
  unsure (1)..(86): unsure at all Xaa locations
  Clone ID: PAT_TA_49906.pep
RHAPGRVRLGRSLRIRSPPVVSTMSTRAWGRHHVXHTCLDNSCLMLHTTDTRTQYVHDTSIELERGSCWTTMNLKIMVPGTCDTIG

SEQ ID NO: 155489 - protein, 82 aa, Triticum aestivum
  unsure (1)..(82): unsure at all Xaa locations
  Clone ID: PAT_TA_49907.pep
RANANNSLIFPVIHVNKLDTAEWSTTMGVXRDACDNXRFFELLNHVILLDLMYDVDLLSKAHYPSYLEEHFMEFAANTLDAV

SEQ ID NO: 155490 - protein, 59 aa, Triticum aestivum
  unsure (1)..(59): unsure at all Xaa locations
  Clone ID: PAT_TA_49908.pep
RCDPSRSQKDASRRAGLKEHDHGCVSXSLSKYDAHATRICCAHVVVALWPLSPIPARLG

SEQ ID NO: 155491 - protein, 93 aa, Triticum aestivum
  Clone ID: PAT_TA_49909.pep
YSSQIPLSYCTFNCYCLISSFKLLFRHGSTIFDRTGFASLTVWHMKTWKPLTVLPLGEDPPAITSLCFNHNGKILAASATDGMIHMFGILLLW

SEQ ID NO: 155492 - protein, 72 aa, Triticum aestivum
  Clone ID: PAT_TA_49910.pep
PTRPRTRGRTRGRTRGCKRRQTELERARARWPPSINQLPHWWPHQASLPFPAGFLLSPSFEAVARKSRSTGP

SEQ ID NO: 155493 - protein, 44 aa, Triticum aestivum
  unsure (1)..(44): unsure at all Xaa locations
  Clone ID: PAT_TA_49911.pep
PRRHPRPAAGRPLSPQEKERNLLXLPGKNPRPQSRPTVDAYIST

SEQ ID NO: 155494 - protein, 44 aa, Triticum aestivum
  unsure (1)..(44): unsure at all Xaa locations
  Clone ID: PAT_TA_49912.pep
MSKLQSDAVKDAISHIVGEAXXNKRKFTDTVELXIXLKNYYPHK

SEQ ID NO: 155495 - protein, 77 aa, Triticum aestivum
  Clone ID: PAT_TA_49913.pep
RVLPNAVTFLTGNANKLEEVQLKKQVIYAVNYHRLDLTELQGEPKDIFKEKARMASSSGKVLRTISATTRRTSPEGR

SEQ ID NO: 155496 - protein, 59 aa, Triticum aestivum
  Clone ID: PAT_TA_49914.pep
PRVRPRVATNKTDQKRASEVGDRKTLMLARAIYNRRAYEKSNLFFRCFSSLSIRWQYRP

SEQ ID NO: 155497 - protein, 77 aa, Triticum aestivum
  Clone ID: PAT_TA_49915.pep
MEFRDRTAPILLVLYTTGSPYTVSGGCSARPPGASKRSISSGSAPSSSPSCRRCSPLPQAAFSSSDHAMIIHRPRSR

SEQ ID NO: 155498 - protein, 110 aa, Triticum aestivum
  Clone ID: PAT_TA_49916.pep
RTPAKSAREPWQIASPRNVPPRSNRRAMEAGVGLALQSRATGFGSGRRPSAIHGDESRTRTGATHVNYLVLSSRLLRAHAAKRSIYLTGLKHNGGSHDILATLNDDSLMI

SEQ ID NO: 155499 - protein, 131 aa, Triticum aestivum
  Clone ID: PAT_TA_49917.pep
GGQTSEAITTIANTTTTKTMRGGKLEAVRAGEEGVPGRDGAEAGGGVRGWRRRHGVRAVGAATLRCLLDIQLVGFRRPGRRRAERRERRAGGRAGAPRSRPANGSASPELRFGASTAKRDLGIGSGRARLA

SEQ ID NO: 155500 - protein, 104 aa, Triticum aestivum
  unsure (1)..(104): unsure at all Xaa locations
  Clone ID: PAT_TA_49918.pep
MTILAYKTIEILHDETVNVXANIISVTVPTATLTLNFLHLNLXDSQRAECRRKLKVNPFLHTXNILCAFPTDISYFQNLITGISNGFRYTIALVYSQLLIDPSM

SEQ ID NO: 155501 - protein, 43 aa, Triticum aestivum
  Clone ID: PAT_TA_49919.pep
TICIVWARKLVNIRRRNVASSSCRGGEDNGSHGECSKISAGDD

SEQ ID NO: 155502 - protein, 90 aa, Triticum aestivum
  unsure (1)..(90): unsure at all Xaa locations
  Clone ID: PAT_TA_49920.pep
MASTAAPPAAXVARRAASASVAAAPLRRAGLAAGCQPARSLAFAAGADPRLAVHVASRCRAAFAARGTRAVVTMVKKSVWDLIAGDHDGK

SEQ ID NO: 155503 - protein, 79 aa, Triticum aestivum
  Clone ID: PAT_TA_49921.pep
SIITSSVEIVCLMLELPFSIVSSEAPLVSFLDGGDNYSLSVAARAIAFLPTIGWLPNAGGNTPFQVRRDPPWSLTAILW

SEQ ID NO: 155504 - protein, 72 aa, Triticum aestivum
  Clone ID: PAT_TA_49922.pep
AHGCIVHQISTTAIPRFASSSHKHILKRLSVHSEWYRRCRARPRVRIRVSIIPYLGTQMLSPRSKIGYLRSS

SEQ ID NO: 155505 - protein, 117 aa, Triticum aestivum
  Clone ID: PAT_TA_49923.pep
PTRPPTRPVSGPRAGLQKEAMAFQELFLSDTCKSLIHVFFSQRATLKVPGITDLGLMPRKVSKVAIVGGGLMGSGIATALILSHYPVILKEVNEEFLNAGIDRIKENLQSRVRKGKM

SEQ ID NO: 155506 - protein, 83 aa, Triticum aestivum
  Clone ID: PAT_TA_49924.pep
AKKQCFSRVPNPKRDECSLQGAATLLMYSVSSRLVHSSFSRFFFIYLFFVFSFYQKCSCVPTDDQLKFIYLFLVMDFIASLIK

SEQ ID NO: 155507 - protein, 55 aa, Triticum aestivum
  Clone ID: PAT_TA_49925.pep
MDRVPVSALLLGVLLAGSLLALCAAKEEAKMLGTAIGIDLGTTYSCVGAYKNSHV

SEQ ID NO: 155508 - protein, 87 aa, Triticum aestivum
  Clone ID: PAT_TA_49926.pep
YVRWFGLEVVTVSRQGPQVPLREPMPTVQSPLRAAVRQQYPLLDGQRRDEPAAVVGAVCRRQRVIQAATLKFFLCYMGRLAPSTNRL

SEQ ID NO: 155509 - protein, 84 aa, Triticum aestivum
  unsure (1)..(84): unsure at all Xaa locations
  Clone ID: PAT_TA_49927.pep
LHYYRNVTNEGFTXLLNLFNLPCEISPXATLRNSAWPAGPELWSVADXDRGRGPPMLAGDWPRCGDRAGFRECAGGSPADCCGE

SEQ ID NO: 155510 - protein, 97 aa, Triticum aestivum
  Clone ID: PAT_TA_49928.pep
MDRRAASQGDYDEQDRRVKGAEVFVGGLPRSATEGTLREIFSTCGEIVDLRIMKDQNGVSKGFGFVRFAERECAYIAKRQKNGIELQGKRLACDLFL

SEQ ID NO: 155511 - protein, 90 aa, Triticum aestivum
  Clone ID: PAT_TA_49929.pep
PRCTRMHIDVRWRPWPACRPLDGAPADPLLVVVFAVIMSSSVCHGAGIGPGALDPSRRPICGGRPCGQPGLPYGGRPRPYLYLSQPGPGS

SEQ ID NO: 155512 - protein, 100 aa, Triticum aestivum
  Clone ID: PAT_TA_49930.pep
TGSPPMTMGAEREAGEEEESRRPLLPSSPSPAAEHQHQYQHLGRSSSSALRCGGGLLGFFSTVLLLLRVSHVLFCPDPSTHSSAQAPGLFSVVTALHFYW

SEQ ID NO: 155513 - protein, 58 aa, Triticum aestivum
  Clone ID: PAT_TA_49931.pep
MAATDDNQAVDAFLASCAESGDAAYGAAKAVLERLQAPASRAEARRLLGSVRRRFADP

SEQ ID NO: 155514 - protein, 103 aa, Triticum aestivum
  Clone ID: PAT_TA_49932.pep
MNDYHDQKFTRYVPTNKILESLRDIWLCVDEMEDLCITFKPFRFTEGCSSRVQGSLNQTCSTGRSGDKRKRKDFASSIPKPQEFIEDEHTPEFTVDEHKHPTI

SEQ ID NO: 155515 - protein, 33 aa, Triticum aestivum
  Clone ID: PAT_TA_49933.pep
PGVKFWAFVVHVQLVVRAKVYLRVGERVPARVG

SEQ ID NO: 155516 - protein, 98 aa, Triticum aestivum
  unsure (1)..(98): unsure at all Xaa locations
  Clone ID: PAT_TA_49934.pep
MRTAGRTPATRTLSCVLFLLVAVASLASAAAITKGDFPPGFVFGTGSSAYQIEGAVAEDGRXPSIWDTFTHSGYSADGATADVTADQYHKYKEDVKLL

SEQ ID NO: 155517 - protein, 90 aa, Triticum aestivum
  Clone ID: PAT_TA_49935.pep
VAAVVVTVLVHDLVHALHAVHVDVGGHAACQSDWQADGHIVVAVAADAAAVAPAGDAQHDGRHDPRRGNHRGGHLACHLASAVCSRFGRS

SEQ ID NO: 155518 - protein, 106 aa, Triticum aestivum
  unsure (1)..(106): unsure at all Xaa locations
  Clone ID: PAT_TA_49936.pep
MSFYARRGGDRGSERFQGGGGRGGYAMRGRSGLPPRGPLGINARPSARIIAKSFSRTKDMTWRPDLFSDSMAASGIETGTKLYISNLDYXCSNEDIKELFQKLSFE

SEQ ID NO: 155519 - protein, 59 aa, Triticum aestivum
  Clone ID: PAT_TA_49937.pep
HVALHDPEPEPGVIGLINTKLSPIQVAQIASEDARSICMREYGSAPDINIYGDQNLTFP

SEQ ID NO: 155520 - protein, 118 aa, Triticum aestivum
  unsure (1)..(118): unsure at all Xaa locations
  Clone ID: PAT_TA_49938.pep
SGLTSAQTETKAGVGFKAVAEEDKLTYYTPXYETKDTDILAAFRVSPQPGVPPEEAGAALAAESSTGTWTTVWTDGLTSLDRYIGRCYHIEPVAGEDSQWICYVAYPLDLSEEGAVTN

SEQ ID NO: 155521 - protein, 64 aa, Triticum aestivum
  Clone ID: PAT_TA_49939.pep
MARALGGASAPNVGRGGRRAHASHASLDSDLKAFNHNPAHGSFAPLGFQPSAMTNCVNQRFLSD

SEQ ID NO: 155522 - protein, 94 aa, Triticum aestivum
  Clone ID: PAT_TA_49940.pep
MASPSSSLCSSLGYPRAASLGARRRAGFSSSRKLFQVKASRVDSFSKSDIIVSPSILSANFAKLGEQVKAGEVAGCDWIHVDVMDGRFVPNITI

SEQ ID NO: 155523 - protein, 40 aa, Triticum aestivum
  Clone ID: PAT_TA_49941.pep
PVKIGSYCSPCSSGEPQVRLSNLQFRSSSIGVVALYLTQL

SEQ ID NO: 155524 - protein, 102 aa, Triticum aestivum
  Clone ID: PAT_TA_49942.pep
HARFVSFQSSTFIFGVQEMVFRGTDTVAVLMEWVLARLVLHPDVQARVHESWTAGGATAVTDRALSYSAIRTRYRRRVLASCYSSSCHWMAPTLARIATCRT

SEQ ID NO: 155525 - protein, 62 aa, Triticum aestivum
  Clone ID: PAT_TA_49943.pep
TSVGVRLVNHVVSKTMISSRTDIHTARGMLKRGADPGEEPLAARLMESRDITGARTAEIVYM

SEQ ID NO: 155526 - protein, 95 aa, Triticum aestivum
  unsure (1)..(95): unsure at all Xaa locations
  Clone ID: PAT_TA_49944.pep
MVVCTADGQRGHGDGGDAVDCNKVAVLTAVAXVQDRGVKDEDDFVLRTFLVSRDYNIGMASTMLLQYLEWERVTMRHVCIFGEEVRVLIVKSRVD

SEQ ID NO: 155527 - protein, 82 aa, Triticum aestivum
  Clone ID: PAT_TA_49945.pep
FPSDAHASAHSSCLFLLLRHFQLRDPLGVVHLLMRGGRSLCHSLPSIHIRDHLLLQQVLRRLRYSFFLNPISEQIVLAHPFF

SEQ ID NO: 155528 - protein, 82 aa, Triticum aestivum
  Clone ID: PAT_TA_49946.pep
SSEHARSKIDRCPCVSARTRRTLSSRSACPMANRVFVPCVEVTLGYGSNRLLVSISNSLHRCTPDLERTSDAAGISNPNLLY

SEQ ID NO: 155529 - protein, 121 aa, Triticum aestivum
  Clone ID: PAT_TA_49947.pep
APGDRRLQHQERRADRHRAKRRATEAAASGTARSSPPSAAPGDGGCGLRNGAQLAYERRAGRGTSWPQGWCAVRSRAPRWDEHGANPPAPTSKQINIAVFAAPWRSYCFACGESEWIGRVG

SEQ ID NO: 155530 - protein, 106 aa, Triticum aestivum
  Clone ID: PAT_TA_49948.pep
DAPVPPCITQLQGGLVQGAIEVEDRAQRSAITRVNADDVRVAVAAPAARGEANNELLEFMGKVTFFNLNSWQYFRYLNVYGIRLHWYLYGYKSNNVFKLLTRTCLY

SEQ ID NO: 155531 - protein, 71 aa, Triticum aestivum
  Clone ID: PAT_TA_49949.pep
LLPHRRPPYSTNYCILSGVWNGVLDRHKVFEALEMIVFFRTGVRPRSWDETQAAWMEDTGSAAAVALTDSS

SEQ ID NO: 155532 - protein, 45 aa, Triticum aestivum
  Clone ID: PAT_TA_49950.pep
SAHPSSNASGLFYSVGSYKITLSWGAASGAHRVNPPNPKPRCFGL

SEQ ID NO: 155533 - protein, 79 aa, Triticum aestivum
  Clone ID: PAT_TA_49951.pep
LLMQDVVNAVDADHVLNKVRALGDISNAMIMLVKYTSTHGPDPRMFLEKLMEQEKLLFELRLDCVNAMIRGCSTSSLAT

SEQ ID NO: 155534 - protein, 75 aa, Triticum aestivum
  Clone ID: PAT_TA_49952.pep
GNSPREYFVGPSDCHVLIYATRVYFIVDVMLVFIHLYAELFLVGPSMSFMSMSRLKIILTIAITLFPTPTWVKLV

SEQ ID NO: 155535 - protein, 72 aa, Triticum aestivum
  Clone ID: PAT_TA_49953.pep
MLDGDCHQIRHQPIAFRSVCSQYAHNIKQVIQLFLSRFHVISGFLLPSRPPIVKLVEKHGLRHSAAQPRPET

SEQ ID NO: 155536 - protein, 95 aa, Triticum aestivum
  unsure (1)..(95): unsure at all Xaa locations
  Clone ID: PAT_TA_49954.pep
MANTYPVFSAEYHEAVKKARQNLLALIAEKNCSPLMLRLAWHSDGTFDVSXKTCGPFXTMNNPADQAHTANAGLDNNFQMLHPMKEKIPTIFYTY

SEQ ID NO: 155537 - protein, 71 aa, Triticum aestivum
  Clone ID: PAT_TA_49955.pep
GLFSSLPEESLRSSYKFSSVASRFKQQLQALMETLSSTEPHYVRCVKPNSVNRPQLFENQSVLHQLRCGGV

SEQ ID NO: 155538 - protein, 79 aa, Triticum aestivum
  Clone ID: PAT_TA_49956.pep
TYGFCSLHFSPRRRNDLRKGITQFALCKEASVIFFSLMPLRRNSSVTESNICRCQFRGTKFCLRSSTAEVQNCRVAYVG

SEQ ID NO: 155539 - protein, 133 aa, Triticum aestivum
  unsure (1)..(133): unsure at all Xaa locations
  Clone ID: PAT_TA_49957.pep
HASVLIFCPHPTTSREKEGSIRGGAAAAGAAVASGISIRTVADTNISRAPGSCAAVRAVVSLGNKAXADEKSEEIWNAADESMPGGGNSPGRAFKAVVGQPIVXFDTVKGSYMGDVGGKELIDYVGSLGPGII

SEQ ID NO: 155540 - protein, 138 aa, Triticum aestivum
  Clone ID: PAT_TA_49958.pep
RPSHTWAHRSGASPSSKSGPPTPRNPKPAAMAMERPVRLVLDASLLLDPVGAGAQEAAPVPTLRPGAEALLRRLRHSNLGVAICHPEEMPTTVSGFLEMTADLNSFGYIPLPAPTGNHLLNELMLEGSRTRSWFYGTS

SEQ ID NO: 155541 - protein, 83 aa, Triticum aestivum
  Clone ID: PAT_TA_49959.pep
NFFSTDFPGVALGQALEVEHSGWFLCSLGRRWPDCTGCTAIACSRWWWCRAASQPSLCTPKTHLRESVNRCRCFLFFHWFRPA

SEQ ID NO: 155542 - protein, 113 aa, Triticum aestivum
  Clone ID: PAT_TA_49960.pep
EEMMLMRPRFLSPSPPSSRREPRLRTLYEASRGCSNCYPCCARPPGPGRRPCYNKRPPTNLRRFTGRMVDLTRRMQLAQIMAEVEANKRRARSGRGGGDNIIRMNAVLEACVS

SEQ ID NO: 155543 - protein, 105 aa, Triticum aestivum
  unsure (1)..(105): unsure at all Xaa locations
  Clone ID: PAT_TA_49961.pep
RLHLTTRTTNRWLCLPAAATRDAVKHLGMVLLKADVTPHRLDGLIRRYPQHHQMAASINDLRCRTELRIQNNRQVFTHHFXSTFESTERVRDYQYDPLHLEPETD

SEQ ID NO: 155544 - protein, 33 aa, Triticum aestivum
  Clone ID: PAT_TA_49962.pep
VSKTVFASPSRVNFRLDQRKAVETIPAYSNIYI

SEQ ID NO: 155545 - protein, 125 aa, Triticum aestivum
  Clone ID: PAT_TA_49963.pep
PIQDVIQTDAAINPGNSGGPLLDSSGNLIGVNTAIYSPSGASSGVGFSIPVDTVGGIVDQLIQFGKVTRPILGIKFAPDQSVEQLGLSGVLVLDAPPNGPAGKAGLQSTKRDAYGRLILRDINTF

SEQ ID NO: 155546 - protein, 42 aa, Triticum aestivum
  Clone ID: PAT_TA_49964.pep
KKEGNKAKATVASALPIVTATLGVNATPQGVYHSPQSAVPLL

SEQ ID NO: 155547 - protein, 88 aa, Triticum aestivum
  Clone ID: PAT_TA_49965.pep
VENQDEVYLPEWIYEKVFSRHEWELTPEMTAEDKEKMRQLTIVGLWCIQWNPKNRPSMTKVVNMLTGRLQNLQVPPKPFVSYENQPRT

SEQ ID NO: 155548 - protein, 63 aa, Triticum aestivum
  Clone ID: PAT_TA_49966.pep
IMKSMKNCSSNFCGLISGLVTRCKVRLSTNFRHTAHGNGGLQYPSIQTDATYLNLNQCKQITL

SEQ ID NO: 155549 - protein, 59 aa, Triticum aestivum
  Clone ID: PAT_TA_49967.pep
PSVGVSCLHVILPPQLRRRRLAPLHLAADEEPGGGLQPLERSQVGGVRGRHGGGDGCSM

SEQ ID NO: 155550 - protein, 65 aa, Triticum aestivum
  Clone ID: PAT_TA_49968.pep
QRIQTTACCKGSYQAAGAQHFRPDRLRQWYGPLGAQAPLTRVAAGGRRTPAMLASILTYRAYPII

SEQ ID NO: 155551 - protein, 123 aa, Triticum aestivum
  Clone ID: PAT_TA_49969.pep
YVTTCRPHTPYEFLHFFMLADELSSPLYTDWSRRRGEGIGLRALRWKEMLWKTEERGGDRAAGAPVERDAVETACSHKIDTNPAGARRTAGSPSAANPAGSAALKQRLHISVEAHVDGDERDT

SEQ ID NO: 155552 - protein, 77 aa, Triticum aestivum
  Clone ID: PAT_TA_49970.pep
SGSTTWPPPPRTPTGLPILAAKISTSMTTIDRLHGVTDIEIQFLQMNGNAIGVYLNVNGPMAHLRAYTEESQYDGRL

SEQ ID NO: 155553 - protein, 94 aa, Triticum aestivum
  Clone ID: PAT_TA_49971.pep
AWLPLPAARSLEFLDQLHAQTTPPVGNPRALSTPCTGSQQANAAARAGPERALPGPIPRRRGAGAGGPDLRDGLLDRRRSAGCGAAVRRVLWGG

SEQ ID NO: 155554 - protein, 110 aa, Triticum aestivum
  Clone ID: PAT_TA_49972.pep
MTEVCVKAAVGHPDTLGDCPFSQRVLLTLEEKKVPYQMKLIDVSNKPDWFLKINPEGKVPVYNGGDGKWIADSDVITQVIEEKYPTPSLVTPPEYASMGSKIFSTFVTFL

SEQ ID NO: 155555 - protein, 91 aa, Triticum aestivum
  unsure (1)..(91): unsure at all Xaa locations
  Clone ID: PAT_TA_49973.pep
MATTAMALSPSSFXGKAVKDLPSSALFGEARVTMRKTAAKAKPVSSGSPWYGSDRVLYLGPLSGDPPSYLTGEFPGDYGWDTAGLSADPET

SEQ ID NO: 155556 - protein, 77 aa, Triticum aestivum
  Clone ID: PAT_TA_49974.pep
IGGCLHSVLPIGKGPTALHFLYLVMYGISHGLCLVVVCTTTSCTMNAGSHDCTTEASPACAATCTMPSPTVSLHDRR

SEQ ID NO: 155557 - protein, 53 aa, Triticum aestivum
  Clone ID: PAT_TA_49975.pep
GPPRSAPPAVLETWLSWARRGPGAVDMVSGQRWSSRSRARWWGTTGIAGIWRR

SEQ ID NO: 155558 - protein, 79 aa, Triticum aestivum
  Clone ID: PAT_TA_49976.pep
ETLEDTWVVVAHDLICYWLQVLQDIDITTTTDQERTNYDLLGTGLTPTYLQSILTRRALRTAADCTTKSRPERAMLSRM

SEQ ID NO: 155559 - protein, 92 aa, Triticum aestivum
  Clone ID: PAT_TA_49977.pep
RAASSRTSHRLDPGRMPRLVSIPSRTGIPLERVVVVAAGSAAHFPWIPVESHAHHAATWRDRPRRRARLAPFVWIPLERIARVGRIGRGWIP

SEQ ID NO: 155560 - protein, 121 aa, Triticum aestivum
  unsure (1)..(121): unsure at all Xaa locations
  Clone ID: PAT_TA_49978.pep
MATTGMASSATCVXAPLQGLKITEGLPVSAHDAAKPASXSSNCRRIRCMQGRPIEVMKKXKTLSYLSPLCTEAFLKQVYYXIRSXRVPCLEFNKDGSFXREHNSCGAYYDEAYWTMWKLSM

SEQ ID NO: 155561 - protein, 97 aa, Triticum aestivum
  Clone ID: PAT_TA_49979.pep
RTVQTADEGSIWSSRSASVTRVQQQIQTGRRPKTAVGQLRAFRRNDQEIDVEIEGRPGKKTQFEQHELQRAMETLKPGLCYHVIKATCIIEIPKPTY

SEQ ID NO: 155562 - protein, 107 aa, Triticum aestivum
  Clone ID: PAT_TA_49980.pep
MSGGGAGDTLDKLVVVLAKRDGVDKLGKTYQYVSKLAHWAAETSHPGLAGRAKSWETAAGLSRKVFRSGRSLTGFNALRRSPGEFGALAVLANAGEMDYFFFDHVTW

SEQ ID NO: 155563 - protein, 131 aa, Triticum aestivum
  Clone ID: PAT_TA_49981.pep
MAVKCILLFGVVLVSFLLLCQDGVDARELTEAKPKESEEKNMKPGYGNNGGGYGNNGGYGNNGGYGNNGGGYGNNGGGYQHGGGYGNNGGGYQHGGGYRNNGGGYWWRIWKQWWVWWRVWKSWIWRWLWQS

SEQ ID NO: 155564 - protein, 145 aa, Triticum aestivum
  unsure (1)..(145): unsure at all Xaa locations
  Clone ID: PAT_TA_49982.pep
MASTATCEAPMQGLKYTDGLPVSRRSNSASLGSDSNGGRIRSMQEWPIEGIKKFETLSYLPPISTEALLKQVXDYXRSSSKWERCLDDSKAGHMTREHNASRGYYKRRNWTMWKLPMIGSTDATQVINEDEEGKKENPDANVRII

SEQ ID NO: 155565 - protein, 129 aa, Triticum aestivum
  Clone ID: PAT_TA_49983.pep
MAGEKNEVKLLGMWASPYMARVKLALNLKGVSYEYMEEDLANKSELLLCSNPVHKVVPVLIHDGKPICESQVIVQYVDEAFHAAAKALLPADPYERAVARFWAGYIDDKVLGPWEMVLKAKTGKERAVW

SEQ ID NO: 155566 - protein, 116 aa, Triticum aestivum
  unsure (1)..(116): unsure at all Xaa locations
  Clone ID: PAT_TA_49984.pep
PRPGRPSRGRRAXQRGKEXRRRGERGGRQTAXXXGPRGRXXXXXPRRRREAXAXPXRXXXGXRRRGRRRGRXGGARGGRQQRPQGRRGRRXRRARPPXRRPARRRGQERGXPQSNK

SEQ ID NO: 155567 - protein, 137 aa, Triticum aestivum
  Clone ID: PAT_TA_49985.pep
MEGLMSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRAL

SEQ ID NO: 155568 - protein, 86 aa, Triticum aestivum
  Clone ID: PAT_TA_49986.pep
SNNGLFTLYVYMRSHESHEELIILELQTKRAEQEKAHIRADRRRGGYGHGRPPSAATPSGRHAHRVSSLQPAAGQEAVARIGATTL

SEQ ID NO: 155569 - protein, 135 aa, Triticum aestivum
  unsure (1)..(135): unsure at all Xaa locations
  Clone ID: PAT_TA_49987.pep
MAAISSTSYFSSQPELPASSATATASISKGRQPRRHRTSGCVMLEPASGGGAVGRRTRSLTEEDLEELKGCLDLGFGFSYHEIPGLCGTLPGLELCYSMTRRFLDEQRTLVGQLEPAASAAPPIPDWKXSGPGDD

SEQ ID NO: 155570 - protein, 83 aa, Triticum aestivum
  Clone ID: PAT_TA_49988.pep
MSTSSGAKEAPANNPGLQAEADPATKGYIMQQTMFRVKDPKVSLDFYSRVMGMSLLKRLDFPEMKFSLYFLGYEDLSAAPADP

SEQ ID NO: 155571 - protein, 59 aa, Triticum aestivum
  Clone ID: PAT_TA_49989.pep
MSLRQLLGWSDGEVMRPESKPCSRLMRHTAGIFSVGGGLAFWVLCRLHYGPRITVPRSL

SEQ ID NO: 155572 - protein, 130 aa, Triticum aestivum
  Clone ID: PAT_TA_49990.pep
DKSRADRNIERKARPASNPRPTPTIGHHQPPRTDHRSLPCRHCTPQADKAGPVTTTSQTGLTRCRTDSPDASPGATALPARPTMLTRGTARTASDVPTLPLKKHRMPTEGTMLSLTINNNRLTWILQRVL

SEQ ID NO: 155573 - protein, 123 aa, Triticum aestivum
  unsure (1)..(123): unsure at all Xaa locations
  Clone ID: PAT_TA_49991.pep
MTPEVKVPLLEGRGATPAQTLGNIVVSIVGTGVLGLPFAFRTAGWXAGALGVAGAGAATFYCMLLLLDCRDKLREQETEEDGLGVEQRCHGGNYTYGDLGERGFGPIGRYFTEAIIIIGQTGG

SEQ ID NO: 155574 - protein, 150 aa, Triticum aestivum
  Clone ID: PAT_TA_49992.pep
DEENNNLEEDDAHQISHADTDQDDREIDEEEFDEDLLEEEDDDEEDEEGVILRLEEGINGINVFDHIEVFGGSNNVSGDTLRVMPLDIFGTRRQGRSTSIYNLLGRASDQGVLDHPLLEEPSMLLPQQRQPENLVEMAFSDRNQENSSSR

SEQ ID NO: 155575 - protein, 88 aa, Triticum aestivum
  Clone ID: PAT_TA_49993.pep
TNLNPAKPPPPPPQERHPSSPCRATDGTTSLLRPPPARARRAGTAARPSPASPDFAATNALGQIHSSGHRPGRSIRTARQQDLDVTED

SEQ ID NO: 155576 - protein, 80 aa, Triticum aestivum
  unsure (1)..(80): unsure at all Xaa locations
  Clone ID: PAT_TA_49994.pep
CIPRNIVAPPKNLNMVKHIRSSGSPPLGEGLHPPHXPNXIPRRRLLIILLVNRDGLAHHDPPQHEISDGHRLPRVVIFFG

SEQ ID NO: 155577 - protein, 80 aa, Triticum aestivum; identical to SEQ ID NO: 106963
  Clone ID: PAT_TA_49995.pep

SEQ ID NO: 155578 - protein, 47 aa, Triticum aestivum
  Clone ID: PAT_TA_49996.pep
KEVLVERWMVKLMEMRMVSCFRESAHCVEIRDGRGRNGVGRVGERVG

SEQ ID NO: 155579 - protein, 64 aa, Triticum aestivum
  unsure (1)..(64): unsure at all Xaa locations
  Clone ID: PAT_TA_49997.pep
ADNLVVSGFMIWRRAGVWSSMWRLCCCFVXCRSDSFADQTTGGSRPVNDKLALTPSRTAIFFCI

SEQ ID NO: 155580 - protein, 74 aa, Triticum aestivum
  Clone ID: PAT_TA_49998.pep
AGNSGLDHSRPKPPWPGGGRKHPPLQPDCFFSRGDASQGPICCHGGSNPNSINRSRLPCTEIVQAIDEWLEIGL

SEQ ID NO: 155581 - protein, 96 aa, Triticum aestivum
  Clone ID: PAT_TA_49999.pep
MASKRILKELKDLQRDPPTSCSAGPVAEDMFHWQATIMGPSESPYAGGVFLVTIHFPPDYPFKPPKVAFKTKVFHPNINSNGSICLDILKEQWSPA

SEQ ID NO: 155582 - protein, 122 aa, Triticum aestivum
  Clone ID: PAT_TA_50000.pep
NSFAYSTYTSLTCSSSSSQTCALSYMQRTILVSIQSAIQLATKTASSSSQWRLTTAELGGLTTPLLAGLATWVPPSLESKVAPAMESGNMDFFNFGIYDTEGTDVYGRHDRDHFYRYNVMLY

SEQ ID NO: 155583 - protein, 85 aa, Triticum aestivum
  unsure (1)..(85): unsure at all Xaa locations
  Clone ID: PAT_TA_50001.pep
LIAQLVQNIEEHPVHGCSLRAITNHRIANERRPVCSRFPAVCEPIANVERTLPPELLHRMVYGHSLKLYXTSYIFTSVCAPVSLL

SEQ ID NO: 155584 - protein, 80 aa, Triticum aestivum
  Clone ID: PAT_TA_50002.pep
MAQNLLPTHTNAAHLPMMRHLISAELERLMSCNRAALSRPTTIYSTVFLVYLVFFNHTGSMPTCLLWSMRHIYAYVLLTT

SEQ ID NO: 155585 - protein, 109 aa, Triticum aestivum
  unsure (1)..(109): unsure at all Xaa locations
  Clone ID: PAT_TA_50003.pep
PDRSSHLSRPTPHTARPRRRPRRAPPPLIHALLARLEGEXEQLEKGVEPAXEKLVHPLERIVDRLDVVWNVVDHLKAVKDSADLRAAVEDVQPEKVKFYLRLGQSKPIY

SEQ ID NO: 155586 - protein, 34 aa, Triticum aestivum
  Clone ID: PAT_TA_50004.pep
DMATLIWRQYHPAQYRPIASDDDQQVDRNVSLGS

SEQ ID NO: 155587 - protein, 87 aa, Triticum aestivum
  Clone ID: PAT_TA_50005.pep
TAASTCRPLYDHYGGAAIYISSQNRRTSSHPTWARMQAAAAADSMNILIMGSTRCIVTLALQETRPAGTPGDIVHQMKGTHNPGAAR

SEQ ID NO: 155588 - protein, 89 aa, Triticum aestivum
  unsure (1)..(89): unsure at all Xaa locations
  Clone ID: PAT_TA_50006.pep
MAWSAAAAVSRFAAYPADEIRLPFSAAAXRLRISSPGAAVSYPRPSPSTPTAXVQKEAVQTEKAPATLGPYCEARKGNNFVFVLGVFWL

SEQ ID NO: 155589 - protein, 121 aa, Triticum aestivum
  Clone ID: PAT_TA_50007.pep
RNPRSDASPLETSQMRTHFFTRKQPPPHKIAESKTERRHKPHAQARAAIRRSTKKYSPARSTNWLTVIGEKNGGRIGEHACHAEGEHAGDEEQKLDAPLLHVEHLRGCARSARALQTKDLS

SEQ ID NO: 155590 - protein, 114 aa, Triticum aestivum
  unsure (1)..(114): unsure at all Xaa locations
  Clone ID: PAT_TA_50008.pep
KAWVSVSQSYKLDDIWRSMMXEGRSKEEKEFDAEKMSSIELTDKLKEILGTKRYLIVLDDVWAAKVFFEIKHVFVDEHMGSRIIITTRTKEVAAAHDGCMNEREPLDEKKAWLL

SEQ ID NO: 155591 - protein, 74 aa, Triticum aestivum
  unsure (1)..(74): unsure at all Xaa locations
  Clone ID: PAT_TA_50009.pep
FPPRQQGLVPAMEAGIITWCLHLSAEVAKRVLFASSSAPGLPAPRGXRRMGPRRIGEDRAGRRGVGGERGGMAG

SEQ ID NO: 155592 - protein, 92 aa, Triticum aestivum
  unsure (1)..(92): unsure at all Xaa locations
  Clone ID: PAT_TA_50010.pep
IAIALLHVGPVEFIYYWFHRGXDHHFLYSRYHSHHHAFIVTEPITAVIHPFVETLAYLLLLSIPMLIPIYMGXGSVLGGGLYLAWHDFIKNM

SEQ ID NO: 155593 - protein, 71 aa, Triticum aestivum
  Clone ID: PAT_TA_50011.pep
HPSFPFHSPEKGLLTHLRLANGVLSMKSNSLTPTNQCHHTDTLTLNPPIPIYYYYPYFANTELTHNENMLA

SEQ ID NO: 155594 - protein, 87 aa, Triticum aestivum
  Clone ID: PAT_TA_50012.pep
MASKRILKELKDLQRDPPTSCSAGPVAEDMFHWQATIMGPSESPYAGGVFLVTIHFPPDYPFKPPKVAFKTKVFHPNINSNGSICLD

SEQ ID NO: 155595 - protein, 98 aa, Triticum aestivum
  Clone ID: PAT_TA_50013.pep
MDAEQESQWAAAQGIGIGEDLVPAALRHLEFLAAVDRRRWLYEGPLLHRAIHRYKACWLPLLAKYTEASVADEPLVVPLDCEWIWHCHRLNPTQYIKD

SEQ ID NO: 155596 - protein, 35 aa, Triticum aestivum
  Clone ID: PAT_TA_50014.pep
RPRNGQDPRQNTLGASSDGTLRMLTKVRHLEKRAP

SEQ ID NO: 155597 - protein, 63 aa, Triticum aestivum
  unsure (1)..(63): unsure at all Xaa locations
  Clone ID: PAT_TA_50015.pep
XNLSLQALSNAESHAARQRKLGAGPNYAQPPTLLSLLHANPQILQPSLQDPEKHHPAILQVIH

SEQ ID NO: 155598 - protein, 111 aa, Triticum aestivum
  Clone ID: PAT_TA_50016.pep
SALLKLQSSPTVHHHRALYPPSCRSFPSPPRLTHPTPPPLTLISTPSPFPFYSRRVPAVSTPSAVSGIVSFDLTLNLGLGLAVELANGRREMSRGKSPEPLDFFIWTVEDV

SEQ ID NO: 155599 - protein, 66 aa, Triticum aestivum
  Clone ID: PAT_TA_50017.pep
STGRDVSHWQLRVAASSRSISLYRPELSLQEAKHAAQVSDLSSEGCGVPLLFYSDARAEPILHLLP

SEQ ID NO: 155600 - protein, 104 aa, Triticum aestivum
  unsure (1)..(104): unsure at all Xaa locations
  Clone ID: PAT_TA_50018.pep
AHAEKREGPXXPQGEXKAGGGXKAXXKXXKXXXNTPEXEXKXTXXXAAXRGXPQPGXPPEEAGXXRAAEXTTXTXTTXXXEGXTRXXXXKGRXXHXEPGAGEDS

SEQ ID NO: 155601 - protein, 81 aa, Triticum aestivum
  Clone ID: PAT_TA_50019.pep
PRTWGGHGTPATGPARPPPPPPRPPPPPGLPPTPQTSPRARACPNSAGHRSKLARRRGNGSRQREEEEEACVKEGERGGFR

SEQ ID NO: 155602 - protein, 96 aa, Triticum aestivum
  Clone ID: PAT_TA_50020.pep
MVFSRKPCSICVFCFERVFLEICMCTYMAGWNCANCDGLLSMSNYLNAEILYSTYHVNNMYLFLFHMWIEKLPYIVVPLAIVCNSQINLLSLLSSI

SEQ ID NO: 155603 - protein, 117 aa, Triticum aestivum
  Clone ID: PAT_TA_50021.pep
LAGPNILLDYSGSRNYLRGGKAQLGILTTIDADVHIPRHGYIIATNPIVIYFMIILMAHLEPSEGIMAHSTIYVHANAYYATRSELSMCARARHPEVPVTKGRPDSIIQAIATRRSL

SEQ ID NO: 155604 - protein, 113 aa, Triticum aestivum
  unsure (1)..(113): unsure at all Xaa locations
  Clone ID: PAT_TA_50022.pep
LAYYTPKYGTXGSDILAAFRGSPXPGVPPEEARAAVAAESSTGTWTTVWTDGLTSLDRYKGRCYHIXPVAGEDSQWICDVSYPLDLFEEGSVTNMFTSIVGNVFGFKALRALR

SEQ ID NO: 155605 - protein, 109 aa, Triticum aestivum
  unsure (1)..(109): unsure at all Xaa locations
  Clone ID: PAT_TA_50023.pep
ETRSKDGKRKEPIEGSSKSNRDRWKLLCSIXSVAYGAGIQXLTSYXQAAYHPVCARAGDLCVELEDDDENHLMLLEEDEDPCIHLLSYLLKHRQTYTERSSVGRYLGNP

SEQ ID NO: 155606 - protein, 129 aa, Triticum aestivum
  Clone ID: PAT_TA_50024.pep
DAWGLIPIDRGKKMGADVERCSKKRTMAADPTSRDDPLAKKKKKVVDLGSDSDEDLPDPSQWAGVNPDSFGDDYLAKMEKARLDEESAPRPVKIATLDYYKPATRFHTVELFPVRRSGSKAVLLAAKFL

SEQ ID NO: 155607 - protein, 68 aa, Triticum aestivum
  Clone ID: PAT_TA_50025.pep
IGSVGLDSSAPLHQGFKAGMKSLRGCFSMVRKRAKQQGNLLFLASIHIFCDLKKIVKRIPVLALFKNG

SEQ ID NO: 155608 - protein, 43 aa, Triticum aestivum
  Clone ID: PAT_TA_50026.pep
GVELTARPWPLRKGVLATTARKTAALIVDAMCAAPGSVRWPSR

SEQ ID NO: 155609 - protein, 38 aa, Triticum aestivum
  Clone ID: PAT_TA_50027.pep
LHDIYTLPDINPMTITYFPGLFTQYYIPYDPLAHEERS

SEQ ID NO: 155610 - protein, 59 aa, Triticum aestivum
  Clone ID: PAT_TA_50028.pep
CSHTAKLTHIYRTHTPFANLVSKMLFTSNGILGETSPPSSHTTIPAVSSSAASHAFTFS

SEQ ID NO: 155611 - protein, 89 aa, Triticum aestivum
  Clone ID: PAT_TA_50029.pep
RATRPLSFSPLAHGIPYSLPHTRRRAVRSAVIIYFFIKQSIMSSTQLIWAGVSYSWPSLTTACAYLTRTHIGSAHSNARLVSSLTKLSL

SEQ ID NO: 155612 - protein, 110 aa, Triticum aestivum
  unsure (1)..(110): unsure at all Xaa locations
  Clone ID: PAT_TA_50030.pep
HTPTLPSTSTEKGKDILPGRFLGSRLGPFLFPITSLPFFHYLFLFNLFITFIVFLLFFLFLNLILFYFTPFFFKLFLKLFYILYKFSYXLYLFFFFNSSFFTFFNGFLYF

SEQ ID NO: 155613 - protein, 55 aa, Triticum aestivum
  Clone ID: PAT_TA_50031.pep
ISGSGVRSVIERLPLNTAMKITKQSLLYVNKLVWHVCYLVDCQTYNVVNNLLTKR

SEQ ID NO: 155614 - protein, 132 aa, Triticum aestivum
  unsure (1)..(132): unsure at all Xaa locations
  Clone ID: PAT_TA_50032.pep
AFPNQNAAELPKPNQSPRPCSPSSFLSPPPLLPSISSTHRDPTPHPIPSLLLAPSPPQWRQPPPCPCPDPPAVPRSPSRRPXAPGPRCAPPPGAPRGAEAAPRRALRGCRRQCGGRAPHREKVRRLPGRHGH

SEQ ID NO: 155615 - protein, 45 aa, Triticum aestivum
  Clone ID: PAT_TA_50033.pep
VPPYVSSNKYSLNNTVNSMLIRSKCNCSKNLVKHLVYPIDITSTH

SEQ ID NO: 155616 - protein, 128 aa, Triticum aestivum
  Clone ID: PAT_TA_50034.pep
LLELLLSLGGVRWTIEEIQQSLYRGVAMSKGADMKGKPIYCFPARCADIHQSKSGLCIEINHPHASRRNHSASLGKPPCTCMKALVRSPSMRAYFHGKNFGAMRGCPRNIQVTVSSPGGKKDIVKDLV

SEQ ID NO: 155617 - protein, 95 aa, Triticum aestivum
  Clone ID: PAT_TA_50035.pep
SSPSIDPPPASRQSIVLQGEEETGPRISPWAGDVVGGGNLDEDLPRVMPLSDLDVGDGRPRQQCPDGALEVCNEGGDGSSITSASAPLASRLRFL

SEQ ID NO: 155618 - protein, 94 aa, Triticum aestivum
  unsure (1)..(94): unsure at all Xaa locations
  Clone ID: PAT_TA_50036.pep
MATMSRALGSAFVGFTRTPAVPATTPLPLPSSRASSALLLRWQRSRGVGGVVTXGGARWYSSGRNAKISMSLRAGIVGLPNVGXSTLFTPLVKW

SEQ ID NO: 155619 - protein, 61 aa, Triticum aestivum
  Clone ID: PAT_TA_50037.pep
HASGCVLISLSHTQVETLMYLCIKTYQAYDQCKCLNLCLCLFIRDLYFSYIQVTLFLKLLD

SEQ ID NO: 155620 - protein, 68 aa, Triticum aestivum
  Clone ID: PAT_TA_50038.pep
LLQDFVSSDGDKLSCFTLLSMPSCSLSEGSISVNYSSMLSGVLVYGDEAANLASCLLILVTGLLPICY

SEQ ID NO: 155621 - protein, 65 aa, Triticum aestivum
  unsure (1)..(65): unsure at all Xaa locations
  Clone ID: PAT_TA_50039.pep
RARPTVTLLTLKYEAERQKINYDDLWKLIYRVKLKXDAYMLREHNACAEYYNGMYWTTGNHFKKQ

SEQ ID NO: 155622 - protein, 98 aa, Triticum aestivum
  Clone ID: PAT_TA_50040.pep
MDRAELTTEQVLKRDIPWETYMSTKLITSTCLQLLRRYDHKPESQRGPLLDEDGPSYVRVFLNILRSISKEETVEYVLALIDEMLAANPKRAALFYDK

SEQ ID NO: 155623 - protein, 103 aa, Triticum aestivum
  Clone ID: PAT_TA_50041.pep
MPCLNVWTNVNLEGVDTCAVLADACSTVVTIIGKPEAYVMVDLKGSVPMACGGTQEPAAYGELVSIGGLNADVNKKLSAGIASILESKLAIPKAPFYLKFHDS

SEQ ID NO: 155624 - protein, 99 aa, Triticum aestivum
  unsure (1)..(99): unsure at all Xaa locations
  Clone ID: PAT_TA_50042.pep
MASMATTVIALQGINVTPFLGLKRTSNLPGIRRFNSGGLIRGMHGGTIKGMQKWAILGIMTPVTMDDLLTLSKYVILXQGEYLIQFKRVACILLEHDGF

SEQ ID NO: 155625 - protein, 142 aa, Triticum aestivum
  Clone ID: PAT_TA_50043.pep
STSPTSALLLGQSRGSELDRTAGVHAHGAPLRHLPRQDALLPRGAVPSAERPPPLGHKQYFVSSDVGGGKMQWYAFHKEPAGGTDPENGKKKRLLEIFSGWCDNVIDLLNATEEEAILRRDIYDRPPTINWGKGRVTLLGDS

SEQ ID NO: 155626 - protein, 131 aa, Triticum aestivum
  Clone ID: PAT_TA_50044.pep
RGYCSGAPPRPVRCARFRPRAAMAVAGDAAHFQKVRIQREDTTFDAYVVGKQDAPGVVVLQEWWGVNNQVKNHATHISQIGHGYRALVPDLYRGKVALDAAEAWHLMEGLDWQGAIKDIQASVKWLKENGS

SEQ ID NO: 155627 - protein, 140 aa, Triticum aestivum
  Clone ID: PAT_TA_50045.pep
RVYFSHQTKGLAKRSAASAHPTPAPAPAAILPPRHRPPPPASLLPPPPAASDGGGVSGARLPRFGFGFGSALRGIPKGFCPRFYNIQASICNGLVHRRKIPLPLRWSFRSIQARNNHSPSAVAPKDYCETYIQFLRNKRI

SEQ ID NO: 155628 - protein, 76 aa, Triticum aestivum
  Clone ID: PAT_TA_50046.pep
SGLPISYYLIYLYYINPDIQTDVQSPSHQALAGAAFFSTALLRWWPRSHGEGKQRQRARERERGRGRERESNRTRG

SEQ ID NO: 155629 - protein, 129 aa, Triticum aestivum
  Clone ID: PAT_TA_50047.pep
MEAATSNPSSKRIALVTGGNKGVGLETCRQLASKGLKVVLTARNEARGLEAVEGVRRSGADVVFHQLDVTDPDSVARLADFVRDQFGKLDILINNAGISGVDRDPVLVAKVKEQVESMDVDQRVQWMKE

SEQ ID NO: 155630 - protein, 127 aa, Triticum aestivum
  unsure (1)..(127): unsure at all Xaa locations
  Clone ID: PAT_TA_50048.pep
AIVNQNLAKMDYDYYAFLSGDEWTLNEKRLAFLHILVLHQLLLDECAMNMSXFVLLRKIYKPIINLPNWFXKIAHTPREYPTRRAGAAAGSVMTLACRASFSGDEVHLTAPRIPLLQLYLYNDTNVV

SEQ ID NO: 155631 - protein, 79 aa, Triticum aestivum
  unsure (1)..(79): unsure at all Xaa locations
  Clone ID: PAT_TA_50049.pep
LLVRKCKRNGTVEHVESIDSTLNAGQIDFTDDGXVVVSLTYVFLPSDKGKLDAEIQVAAYNCCLNKGSAYTVDNDAEML

SEQ ID NO: 155632 - protein, 44 aa, Triticum aestivum
  unsure (1)..(44): unsure at all Xaa locations
  Clone ID: PAT_TA_50050.pep
FPPNYXRLPTFYPHPSAQVPFIEVVLLIDPPPSPPPPCIKEEWL

SEQ ID NO: 155633 - protein, 77 aa, Triticum aestivum
  Clone ID: PAT_TA_50051.pep
VVLGSNSPPLSLSVIHGRYEHDIGHPLYGHRLISSGRHACLYVDDEASVGSVLFTRTVVVLPTASPASCDVSQQRIS

SEQ ID NO: 155634 - protein, 108 aa, Triticum aestivum
  Clone ID: PAT_TA_50052.pep
MDTSTRPVAAASSLHHSAAKHLAILAHRNVVNRRYLLTLLASAAAIPEAGESRKALLQDYVKKSKENKEKNDKERRDAVYKRNYKDYFGFMEGPVREKPAEELTESEK

SEQ ID NO: 155635 - protein, 77 aa, Triticum aestivum
  unsure (1)..(77): unsure at all Xaa locations
  Clone ID: PAT_TA_50053.pep
MGKEKTHINIGVIGHVDSGKATTTGHLIYKVGGIDKRGIERAEKRSREMNKRTFKNAXVLDKLKAERERGINIDNAL

SEQ ID NO: 155636 - protein, 95 aa, Triticum aestivum
  Clone ID: PAT_TA_50054.pep
GSVARQSGVTVAHGLRLAIPVGIRIGTALRISLTDAAVVCCRYRQNVAGPSRRHRYRPSRVHRYRARRVRRFIQRRAARWRHGVGIRLRHRWKVD

SEQ ID NO: 155637 - protein, 77 aa, Triticum aestivum
  Clone ID: PAT_TA_50055.pep
LEYHRYILMAEPDHIFVKPLPNLAFDNDPAAFPFFYITPSEHEKIIRKYYPEERGPITNVDPIGNSPVIIKKVIHCC

SEQ ID NO: 155638 - protein, 83 aa, Triticum aestivum
  Clone ID: PAT_TA_50056.pep
MASKGERDVEIHVSSPPPDDRDAARPLLPAACEAYSVSAAILPFFFPALGGLLYGYDIGATSGATISLKSPTSSGTAWYDLSS

SEQ ID NO: 155639 - protein, 77 aa, Triticum aestivum
  Clone ID: PAT_TA_50057.pep
ARLRERLPTKPRTEIKTMRSGRKKLAGPGPDPVSQRGHMVPELMTGEDLAGPGTSGNNLSGSTQPKRPLMLSSCRRE

SEQ ID NO: 155640 - protein, 70 aa, Triticum aestivum
  unsure (1)..(70): unsure at all Xaa locations
  Clone ID: PAT_TA_50058.pep
YRGRGRNSGGPLPVGRPXPLLFHQLPYPPERLFQLPRRHLILYLISQYTVKHISSHSILIIFYLSPLLFI

SEQ ID NO: 155641 - protein, 126 aa, Triticum aestivum
  Clone ID: PAT_TA_50059.pep
QLGNRAEREREKPAANPTQDPGSLPFPTPDRNRELAREIDIPANLLLRFQARPGLGPVPRPLPPPSILLHRYQSTPAAAAVRVESLLLLRLRQACAWRDSRTRRSRGRQISRWRESVRTQCPLISS

SEQ ID NO: 155642 - protein, 80 aa, Triticum aestivum
  Clone ID: PAT_TA_50060.pep
ASTSVQAGRSLQPSCVPEPSPPDRRWEGPRLCIGMPTSRRSGCARWPFPGSMLGREGLQCGVDVKSPAQSDPSSSMSVRL

SEQ ID NO: 155643 - protein, 61 aa, Triticum aestivum
  Clone ID: PAT_TA_50061.pep
TKTLHPILLSTYISPLIQEEFSDWACPLTSTTISSPSIPIIDPLNVHISHPDHLYFVIPIH

SEQ ID NO: 155644 - protein, 112 aa, Triticum aestivum
  unsure (1)..(112): unsure at all Xaa locations
  Clone ID: PAT_TA_50062.pep
MADAPVELPGRLAILPFRNKVLLPGAIVRIRCTNPSSVKLVEQELWQREDKGLIGVLPVRDSEAAAVGSILSPGVGSDSSEGGRXSPCGSAGESTKQDAKSGKEPIHWHSPG

SEQ ID NO: 155645 - protein, 154 aa, Triticum aestivum
  Clone ID: PAT_TA_50063.pep
LIHLKIHLSLAPSQNPTSSGRPFSSFLLDPHPPPATSSTHAAAAASPSAFSPGSTYGCSSHCCKGAGPRRSGVAVVRLLLLAINAMAAASPSYGRGRGAGAGGGNDGLRCYNRFFLLEMTVQVDDGSEPETRTSGCCNHGDGALDPSCSSCNHG

SEQ ID NO: 155646 - protein, 105 aa, Triticum aestivum
  Clone ID: PAT_TA_50064.pep
MPPPCPTLCRLPATNLGLPWCPRSIPFPRLALAARRARAVAARASSSSSSPDSSFGSRMEDSVKKTLADNPVVIYSKSWCSYSMEGKGLFKRIGVDPHVIELDQL

SEQ ID NO: 155647 - protein, 97 aa, Triticum aestivum
  Clone ID: PAT_TA_50065.pep
VPPAGSQRRQYRGYWFPEWHLPALAGGRDHCEPKPTDIFLVSCPKSGTTWLKSLAFATVHRDVHPPSSREHPLLHKNPRWLASIHRRNLSATGRRCT

SEQ ID NO: 155648 - protein, 101 aa, Triticum aestivum
  Clone ID: PAT_TA_50066.pep
ESMEWSQGSQQGKILSDAQTPPVPSGLPLVGKGEKSDVTSLCIIAFRFTLLSSVGNLLVVFHYDGTSKDTSELLTGTIERFTSSSIIILVIAMEKLLQDLL

SEQ ID NO: 155649 - protein, 130 aa, Triticum aestivum
  Clone ID: PAT_TA_50067.pep
MASLSSLLVAAVFLLAGSAFFYRYDTGSGNKTSATTTTHLHFYMHDDYTGPRPTAMRVVSGRAISTGDDATALKTAPRQFGDIVVLNNALTVGPIGGSARVGTAHGWAVRVSEGGIVSDLTLHLVLEAGE

SEQ ID NO: 155650 - protein, 58 aa, Triticum aestivum
  Clone ID: PAT_TA_50068.pep
SASYYNAFYILNTVFALKVMFYLLTYLSPFYILNYTVILPITQPPTTLPSTLHHTTNT

SEQ ID NO: 155651 - protein, 145 aa, Triticum aestivum
  unsure (1)..(145): unsure at all Xaa locations
  Clone ID: PAT_TA_50069.pep
VLRHLSYNLFIFILDNFTNFFSKYSHYLYQIFYSICKNIILKNFYRISLIFIIKFFIHSLFQFINIFFNKFFLIFVILMSINKFCFYLFNIILSSFYIKYYLQXFYYILFLQYYYNFISIYYYILFFILLSYFFNILLNLFYYFF

SEQ ID NO: 155652 - protein, 72 aa, Triticum aestivum
  Clone ID: PAT_TA_50070.pep
ASGRGVNILQGDHRRIHRLLRELRKFLMPTVHFLGLEIAPALFVSCFCSNTTNLVPRYVTFCELYFPISVRM

SEQ ID NO: 155653 - protein, 35 aa, Triticum aestivum
  Clone ID: PAT_TA_50071.pep
GADGCAYLTCGSHHFRDPRREAPHKVNHCPALARA

SEQ ID NO: 155654 - protein, 42 aa, Triticum aestivum
  unsure (1)..(42): unsure at all Xaa locations
  Clone ID: PAT_TA_50072.pep
XHXFLYLLALLSHFXQCFASAALLRVHRYFPRGTFSDVMIAS

SEQ ID NO: 155655 - protein, 83 aa, Triticum aestivum
  unsure (1)..(83): unsure at all Xaa locations
  Clone ID: PAT_TA_50073.pep
PTDTKAAEGLKAGVKDVILTYYTQYYEPXILISLAAFRIMPQPAVTLEEAWAALSALFFTGTWTTVRSDGLTCPDRTNDDAIT

SEQ ID NO: 155656 - protein, 92 aa, Triticum aestivum
  unsure (1)..(92): unsure at all Xaa locations
  Clone ID: PAT_TA_50074.pep
VIGQGLMSPHTESNAGVAFKAGVKDYKLTYYTPXYDTKDTDILAAFRVSPQPGVPSXNAGAAVSVASSSGSWSTVWTDGLTSLDRYKGLCYH

SEQ ID NO: 155657 - protein, 72 aa, Triticum aestivum
  Clone ID: PAT_TA_50075.pep
MGKMPVRMKAVVFALSPFQQQVMPCLWMDITSKIHHKVFENWISVTLLITSVVGTYQFAMWYKELEKLSHRY

SEQ ID NO: 155658 - protein, 157 aa, Triticum aestivum
  Clone ID: PAT_TA_50076.pep
RIYSSSIISNHVVLRWLLLVLILLYVLFLLRVVLDFLLVVRGSVHLLPDLYHGRFLLFGLFFFRCRRLFLVFLFFSICILLFFHFFLFLFVLFYYFLGCFYCSVYSLISFLHFFQLVFVFFCFMIYFFYFSLFLNLFSFFCIFLCFVVFCYFSFFLS

SEQ ID NO: 155659 - protein, 37 aa, Triticum aestivum
  Clone ID: PAT_TA_50077.pep
PTRPHGSWDDVFKLSVTLYLVGTVIWNLFSTGEKIID

SEQ ID NO: 155660 - protein, 97 aa, Triticum aestivum
  unsure (1)..(97): unsure at all Xaa locations
  Clone ID: PAT_TA_50078.pep
RTRGRRTNNKQVGFLTNRHVAVDLDYPNQKMSHPLPPNLGPGVYLGAVERASSFITDDVWNGIDAGTNPETFVRADGAFNPXADDFVISTVTTIVKG

SEQ ID NO: 155661 - protein, 57 aa, Triticum aestivum
  Clone ID: PAT_TA_50079.pep
GHFYSLEVVRGEQPRSKACVATRSDLQPTPATMARHYHLTDYRIIVGLGVCFFVGGP

SEQ ID NO: 155662 - protein, 143 aa, Triticum aestivum
  unsure (1)..(143): unsure at all Xaa locations
  Clone ID: PAT_TA_50080.pep
TQVGLAFLLPNYSSPPRIASHRGSPEITYTLVKAVAVLTGSEGVMGTIFFTQEGDGPTTVTGSVTGLMDGLHGFHVHALGDTTNGCMLTGPHFNPAGHVHGAPXDVIRLACVLGNVTAGAVGVAYINVTDCHIPLTGPNSIVG

SEQ ID NO: 155663 - protein, 51 aa, Triticum aestivum
  unsure (1)..(51): unsure at all Xaa locations
  Clone ID: PAT_TA_50081.pep
RPCTRSPHSVMSHVWEVFSRSRAAERTRHRGGKGGGPTRPRTSGRTRGXWR

SEQ ID NO: 155664 - protein, 48 aa, Triticum aestivum
  Clone ID: PAT_TA_50082.pep
IFLAQIFAQNKCVSYNYLKIICFTSDSNNKYHVLWVMSLELDNDMVGC

SEQ ID NO: 155665 - protein, 47 aa, Triticum aestivum
  Clone ID: PAT_TA_50083.pep
SHLFFHPLPHLPTRVRSVTQDHPCPDPVAHLPMSAGALGLALVESLA

SEQ ID NO: 155666 - protein, 46 aa, Triticum aestivum
  Clone ID: PAT_TA_50084.pep
IVQYVYIQASMCRKVISVTSLARISHSCGYRQLSGNRRRMAISRTA

SEQ ID NO: 155667 - protein, 61 aa, Triticum aestivum
  unsure (1)..(61): unsure at all Xaa locations
  Clone ID: PAT_TA_50085.pep
MSSPSGKVLTLEEVANLTSKDDCCLDIGGXLYNVTKFLDDHPLGDYFLLFXTDKDAIDDFF

SEQ ID NO: 155668 - protein, 147 aa, Triticum aestivum
  Clone ID: PAT_TA_50086.pep
SLQFRLTCSSRMVVAERSTSQQAPMYPSYLVQKVCPSDWSFLLRRRRGGVATCGEWRVEVEKRMGRGRPLVAGEEYHPVLVLLGQSEVRRGSQTAGDETNRSWNGTSARHTRQARHRIWIAATVGKPEEDGREDWSRRRLVRKLGLG

SEQ ID NO: 155669 - protein, 132 aa, Triticum aestivum
  Clone ID: PAT_TA_50087.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRA

SEQ ID NO: 155670 - protein, 72 aa, Triticum aestivum
  Clone ID: PAT_TA_50088.pep
MARLNSKAVVAAVVLAAVVLMMAVREASIVLACEPLDFKLAPCLADATERGSLLSLACGAVQEGLYENARST

SEQ ID NO: 155671 - protein, 81 aa, Triticum aestivum
  Clone ID: PAT_TA_50089.pep
IGQNKLIDGLNSEGFIFANSLIKIWTNAQMAEQSWDGGIVCRRDIVLIQGRCYCTLQPTIGDAKPWHILADSLVWVYTLVV

SEQ ID NO: 155672 - protein, 82 aa, Triticum aestivum
  Clone ID: PAT_TA_50090.pep
HWIELTSVEGCRCTHEATIEDVKKGETVCYLPPLSTEALLTHVDYLIRSKWVPCLEFNTDGFILRELNASAEYYYGRYWTMW

SEQ ID NO: 155673 - protein, 74 aa, Triticum aestivum
  Clone ID: PAT_TA_50091.pep
GKLCVTSYWIDTLVLKTKGNTYATLLHHPFLFKGKATHAQEVAALSYAQITHLHKNSAPAHLICGCYFMFYISV

SEQ ID NO: 155674 - protein, 57 aa, Triticum aestivum
  unsure (1)..(57): unsure at all Xaa locations
  Clone ID: PAT_TA_50092.pep
MSCCGGNCGCGSGCKCGNGCXGCKMYPEMDEGVNTTSQTLIMGVAPSKGTPLFEAAA

SEQ ID NO: 155675 - protein, 77 aa, Triticum aestivum
  Clone ID: PAT_TA_50093.pep
REHNASPGYYDGRYWTMWKLPMFGCTDATQVINEVEEVKKEYPDAYVRIIGFDNMRQVQCVSFIAFKPPGCEESGKA

SEQ ID NO: 155676 - protein, 122 aa, Triticum aestivum
  unsure (1)..(122): unsure at all Xaa locations
  Clone ID: PAT_TA_50094.pep
MSPQTETXKTPSRSKADDIDYKMTYYTAECETMDTDMLAYLHVSAQHAVASKDTGAAXAAESSTGTWTTVWTDGLTSLDRYKGRCYHIVPVAAEDRQWICYVAYPLDLFEEGSVTNMFTFIV

SEQ ID NO: 155677 - protein, 69 aa, Triticum aestivum
  Clone ID: PAT_TA_50095.pep
RSLPSSESADIVCSSHINPPLPPENLSAISSMLLNLCIYTPVSINLLSSKHCRYAIAVIFTFLINPRVR

SEQ ID NO: 155678 - protein, 137 aa, Triticum aestivum
  unsure (1)..(137): unsure at all Xaa locations
  Clone ID: PAT_TA_50096.pep
MSPQTETKAGVGFKAGVKDYKLTYYTPEYXTKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLED

SEQ ID NO: 155679 - protein, 154 aa, Triticum aestivum
  Clone ID: PAT_TA_50097.pep
RNLLEQDTLKWVFVGGKGGVGKTTCSSIVSILLASVRQSVLVISTDPAHNLSDAFQQRFTKFPTLVKGFSNLYAMEIDPKVENDDFGNEGMEGFISELTNAIPGVDEAMSFAEMLKLVQTMDYSVVVFDTAPTGHTLRLLQFPATLEKGLEKMM

SEQ ID NO: 155680 - protein, 100 aa, Triticum aestivum
  Clone ID: PAT_TA_50098.pep
PRLPLFLSVLLSRSRARTRWRMRCGQWPRRRAPRPVGRPPGWPPSSTPFCTPPGRQQDRHQDRHPARSSSPPRSTRWSTSWPDISDHVIELATQRPMLTL

SEQ ID NO: 155681 - protein, 145 aa, Triticum aestivum
  unsure (1)..(145): unsure at all Xaa locations
  Clone ID: PAT_TA_50099.pep
STLSSPQLSSPCSPPTSNGGRPTPFQPLPSSVLFLPREGCGGPEPAVLPACCSPRHPQGIGFDHKFRAALSSRGXKLSNTVGVSLCPRGRNTLLDEYGNPKVVNNGVTIARAIVLAYPMENAAAALIREVASKTNDSAGDGTTTA

SEQ ID NO: 155682 - protein, 64 aa, Triticum aestivum
  Clone ID: PAT_TA_50100.pep
HALEGTHCGQNRREERRGEDRGFLKPRGFPLRSFLISSTIYRRHSTLKGGITPRTHYHRLYEIH

SEQ ID NO: 155683 - protein, 93 aa, Triticum aestivum
  Clone ID: PAT_TA_50101.pep
PFYPLFRLACHTLQHQQRPAAYHRITASGGHHQRRRGDHRRRPCRDRLASGPMFAPADDEERVVEEHLLQGRHGGYPCRHSFVGPVRFCSPRL

SEQ ID NO: 155684 - protein, 87 aa, Triticum aestivum
  Clone ID: PAT_TA_50102.pep
KPLALGICNVYSQNYLNGHIPQNRLWKGNINNPPIISLSSADTEADGGGEGTMYWCEGGRRWSPPRNGRIEERRGESAEFGGRGAEK

SEQ ID NO: 155685 - protein, 132 aa, Triticum aestivum
  Clone ID: PAT_TA_50103.pep
HSSPELSMTPVVHCSVGTISLFHIGSFRPSREIQIRRFRGSERYSRVTSPSRHGLLQPQTPFHLISIYKRSWSSANNRLRTLSAAAVGTDVTVEGSASPSGETSEAAPAAAETTGQAVASKSPASSPPKLGR

SEQ ID NO: 155686 - protein, 75 aa, Triticum aestivum
  Clone ID: PAT_TA_50104.pep
LPSSNPNQLDAHAPPRMTTTRRSSSPTDAARLSSRRRLVSPLPPSPSRPPDRIRPDPAPAAMEILFSLVNKLQRA

SEQ ID NO: 155687 - protein, 123 aa, Triticum aestivum
  unsure (1)..(123): unsure at all Xaa locations
  Clone ID: PAT_TA_50105.pep
MGAYKFVSELWRRKQSDVMRFVQRVRCCEYRQQPAIVRITRPTRPDRARLLGFMAKQGYVVYRIRLRRFGLDSXPVPMGIVYGMPNHQGFTQLMFQWYKLSVADXRAGHRLFGFIVLISYWVY

SEQ ID NO: 155688 - protein, 53 aa, Triticum aestivum
  Clone ID: PAT_TA_50106.pep
KKHCPNYMKTCLNQAAWKPTPPIACHARARTTLPPTTSGPLRPWCNARLSWTS

SEQ ID NO: 155689 - protein, 78 aa, Triticum aestivum
  Clone ID: PAT_TA_50107.pep
SIRHSALSATRTAGLYASRFSADRSSSGMASPPAPTPSVAESGKLVRTPSGTTRAALALADSAGHRRAQEAVRDSRAN

SEQ ID NO: 155690 - protein, 95 aa, Triticum aestivum
  Clone ID: PAT_TA_50108.pep
MAAAFSSTAGAPACTPTNLLGKKLKKQVTSAVNYHGKSSKANRFTVMAAENIDEKRNTDKRKGLAYDISDDQQDITRGKGIVDSLFQAPTGDGTH

SEQ ID NO: 155691 - protein, 84 aa, Triticum aestivum
  Clone ID: PAT_TA_50109.pep
RCLDIFLVTLFNSGTGVVADGPRSVTIAVHSLYVHNRDTVTKSIHAGTVAIGVFTLADSKINRATSLMLCLKLDQRPGVLDTRL

SEQ ID NO: 155692 - protein, 98 aa, Triticum aestivum
  unsure (1)..(98): unsure at all Xaa locations
  Clone ID: PAT_TA_50110.pep
MHFNNLVLEGAIRVEFSLEAFKADLFPAVTNIVGALGPKGPAREANLPWLKARMSGARFHFFVGDGXVQQETLENLKLAIKATKKLCAVMLDTXGPEL

SEQ ID NO: 155693 - protein, 98 aa, Triticum aestivum
  Clone ID: PAT_TA_50111.pep
TRARILTPSKERLQFEGVSKYMVARDLLAFRDNVMWYFSQVAFTYKDGRMARHAPVCLSLYNDSIHEFHGQRVRPCSGQNHINHGICRDRYPCHGCGL

SEQ ID NO: 155694 - protein, 58 aa, Triticum aestivum
  Clone ID: PAT_TA_50112.pep
MACNYGDTTGEEGRLHTDEHHSNSTTPTGEAGSPKNTLRRWPESASAPSGASHGPASK

SEQ ID NO: 155695 - protein, 65 aa, Triticum aestivum
  Clone ID: PAT_TA_50113.pep
MSRESVTGAARYIPSWLVKKLLDRGWTEHGTVRYLGDEMMTELLKGLHGADDHVELVEVDIYDAG

SEQ ID NO: 155696 - protein, 44 aa, Triticum aestivum
  Clone ID: PAT_TA_50114.pep
PRVRFGCTDATQVINEVEEVKKEYPGTYVQIIEFDNMRQVQCVR

SEQ ID NO: 155697 - protein, 57 aa, Triticum aestivum
  Clone ID: PAT_TA_50115.pep
MLAMDQHQEESCVPPGFRFHPTEEELVGYYLARKVAGQNIDLGIIQEVDLYRTEPWD

SEQ ID NO: 155698 - protein, 43 aa, Triticum aestivum
  Clone ID: PAT_TA_50116.pep
LFSEKLTHAISGASAVACATENAMSNQKARDVYHFPGRKEVRL

SEQ ID NO: 155699 - protein, 75 aa, Triticum aestivum
  unsure (1)..(75): unsure at all Xaa locations
  Clone ID: PAT_TA_50117.pep
MYAAAGARGLKCVARPDFSWKPTGRPHHTLAAVVSTSGVGIHSGARATXKLVHERRREERHVRPDHRYAGLWLAM

SEQ ID NO: 155700 - protein, 48 aa, Triticum aestivum
  Clone ID: PAT_TA_50118.pep
ELHYENKIITVRKIHYKYCERNTKRYYNENTLRFTLYQNKIITLHQTK

SEQ ID NO: 155701 - protein, 33 aa, Triticum aestivum
  Clone ID: PAT_TA_50119.pep
TIRSGKIHSILHPTQYHIPAIRMHHYHQTLNFT

SEQ ID NO: 155702 - protein, 146 aa, Triticum aestivum
  Clone ID: PAT_TA_50120.pep
NVYTLTKAMGEILLGQYKGELAIVIIRPTMVTSTYQDPFPGWIEGTRTIDALIVAYDEQALPCFLGDRNDIIDLIPADMVINAALVAMAVHWNEKLQVIYHVSSSCQNPLSVNDFVDSCFDYFSISPRILNGRVLQTRRPYLFKRY

SEQ ID NO: 155703 - protein, 84 aa, Triticum aestivum
  Clone ID: PAT_TA_50121.pep
IFLQGRNKGRGWTRRKKSPDPYKLAQERMDRMSGCRMSGHVKKGGRGWKFTWEGTDGYTDQDLDAIGNKGRCTGGINNTKSYGD

SEQ ID NO: 155704 - protein, 86 aa, Triticum aestivum
  Clone ID: PAT_TA_50122.pep
MAITTCFSCSKQVGSFSNATWTVHERTLGLLPLLLQRPPPCAAPTRAVVTAGHAAILVLDCLPVVAGPARRGTARPGRSGGGSGKI

SEQ ID NO: 155705 - protein, 120 aa, Triticum aestivum
  unsure (1)..(120): unsure at all Xaa locations
  Clone ID: PAT_TA_50123.pep
IPTWETHSTPTASSTDIARTIATKLVPDLVLAAMLVVAFDAAIYCAKVNCAMASCVSYSKCNGDSTAGSCCGGCWRWASISRSTAHKHAEWKGIXSGVRRLNPGMAASMPSKSRVKIRYC

SEQ ID NO: 155706 - protein, 44 aa, Triticum aestivum
  Clone ID: PAT_TA_50124.pep
SKKLRRKHFSLYEFTDLCLSFRSTFLNYYYRSVDLEVSVEIYIL

SEQ ID NO: 155707 - protein, 47 aa, Triticum aestivum
  unsure (1)..(47): unsure at all Xaa locations
  Clone ID: PAT_TA_50125.pep
PRRPAISLSLTTHTMCAHIALNRPLAPAPSLSSCPGPWPCSVPXHSF

SEQ ID NO: 155708 - protein, 121 aa, Triticum aestivum
  Clone ID: PAT_TA_50126.pep
LFHALLLFQGRDRKGYQPGVRNNEHPFSGDREGFRHVSPKSHRLRGARACHRIHFSARQGWLGVGPRRRRVPSNRPDGRRLLPPSLRGWLSATSNRGLLIKSPSEPAAAFGAPLRQNRSSN

SEQ ID NO: 155709 - protein, 97 aa, Triticum aestivum
  Clone ID: PAT_TA_50127.pep
SMPPCGSYPACSSPVQSAHPLASSCSLRWSSHQCEFTGNGPSLATGSLSGLSSLETDVTKSTSIVDHRNVNRHEPTCDYEPLRSDFTSTSLNDRNCP

SEQ ID NO: 155710 - protein, 120 aa, Triticum aestivum
  Clone ID: PAT_TA_50128.pep
AVRRRPRSLCFLISCRERDHRSREGINHVDVWIVFRSEVNPEEHTCNSNSKASRRSSSGPDKPPDPAEAPTAAEEAHAVPSALLKSFRMADLRATTKNFGSASYLGEGGFGCMYKGWIDK

SEQ ID NO: 155711 - protein, 114 aa, Triticum aestivum
  unsure (1)..(114): unsure at all Xaa locations
  Clone ID: PAT_TA_50129.pep
RSPQPSGMGPSGWNRRLGRGPVTGRPGPGHRIGARPSXRXRIFSSLWGCRLDLAGERMGWGGRPVAFIQIRQGEGLGHAPLGAQEGEVRGGGRGEETPELGVAAGAWAGRHGRV

SEQ ID NO: 155712 - protein, 69 aa, Triticum aestivum
  Clone ID: PAT_TA_50130.pep
QRIQNTARLERSLEAVIHGPTDAPAYPMAQALVDAYTTTYCMKQKVPKSSDNYSEFHVRAYRPITPDVA

SEQ ID NO: 155713 - protein, 80 aa, Triticum aestivum
  Clone ID: PAT_TA_50131.pep
STWPSQKKSTSMKICSRIPTTATCCSFPCRTQGGGASSPPPGGAARAMLSSSDMPAGEKRWGRRPATRGSVNRGLPGRVG

SEQ ID NO: 155714 - protein, 143 aa, Triticum aestivum
  unsure (1)..(143): unsure at all Xaa locations
  Clone ID: PAT_TA_50132.pep
FNWLISKLHRYTVGLISPYTETKPNDGFYVLLINSKATHYTLYYETKHTNMSAAFRVSPEPASPLDKTSSAVAVESYTGTCTDFCTDXLTTTDRSKDHSMTSSSVAGEDSQWIXYAAYPLDLFEEAYDTNMFTFIVRNVFGLK

SEQ ID NO: 155715 - protein, 96 aa, Triticum aestivum
  unsure (1)..(96): unsure at all Xaa locations
  Clone ID: PAT_TA_50133.pep
SNEPSLELLFYVHISVYRXLYKTRYIFRGLFRVDNNISWSAKLSPKLLSALFNDLNFIKNFYLNNWLMKINRILNIIPSNPTNFSFLYIGRRFGSG

SEQ ID NO: 155716 - protein, 84 aa, Triticum aestivum
  Clone ID: PAT_TA_50134.pep
MEMGGDEMMMTSGATGRIVPVFRSVLSRRALLRLAVALHSLFLWLLLLVGRRRRPDSVSPAEPGRLGKGRIRRCPLGRGSWCNN

SEQ ID NO: 155717 - protein, 92 aa, Triticum aestivum
  Clone ID: PAT_TA_50135.pep
MEREMAASYEPKLHSEIRIFGSSDEILTDLAEYISQVSEISVKERGYFAIALSGGPLVSFLSKLCEAPYIKTLDWSKWYIFWSDERAVAKNH

SEQ ID NO: 155718 - protein, 85 aa, Triticum aestivum
  Clone ID: PAT_TA_50136.pep
QKGSPSPLGFKELEWFADIDLFHDDQAPAPKWGRTAAEVPELFASPQPASNAGFYKTAGARQSKKAKVELPEDDDEDYLIGPDLG

SEQ ID NO: 155719 - protein, 73 aa, Triticum aestivum
  Clone ID: PAT_TA_50137.pep
YACVHGGLDCTRHDKDVDAHASMLCRDRFTFGAIAIYRSQVETGAVKAPYLNATGSTCDRIVNRAVFGRELGT

SEQ ID NO: 155720 - protein, 102 aa, Triticum aestivum
  unsure (1)..(102): unsure at all Xaa locations
  Clone ID: PAT_TA_50138.pep
LTSGIVGRSLTASKVPQASQQAAVVYCYIHRSNRLLLPTNFLGKKAQEAXAQDGNYHGTSSKANRLTAMTAVNIDEKRNTDKWKGLAYDISADPEDITKREG

SEQ ID NO: 155721 - protein, 124 aa, Triticum aestivum
  unsure (1)..(124): unsure at all Xaa locations
  Clone ID: PAT_TA_50139.pep
MAPTVMAWSATYVAPFQGLKSTDRLPVSRRSNGASLGSVSNGGRIRCMHVRPIEGIKKLETLCYLPPLSTEALLKQVDYPIRSKWVPCLEYSKVGFILREHNAFPGYYDGRYWXTMWKLPMFGC

SEQ ID NO: 155722 - protein, 57 aa, Triticum aestivum
  Clone ID: PAT_TA_50140.pep
RAGKQEPKKGAPQKSPPFFIFVYFNFVSSIFFFFPFFFFFFFFFFFFFFFFFFFFFF

SEQ ID NO: 155723 - protein, 67 aa, Triticum aestivum
  Clone ID: PAT_TA_50141.pep
HSFSLQVAHIHSARRRRTSRQEADGTDNLAAPRGAGGDHRHHPLHRLPLTSQPASSRAAHLAGCCIM

SEQ ID NO: 155724 - protein, 59 aa, Triticum aestivum
  Clone ID: PAT_TA_50142.pep
PLSRRSSPSSLSLLFVKQSNTCRILLYIDRMSLPFKDQKATLIYNTCLPHSIYHFGYFI

SEQ ID NO: 155725 - protein, 114 aa, Triticum aestivum
  unsure (1)..(114): unsure at all Xaa locations
  Clone ID: PAT_TA_50143.pep
LTSYSVVLTSPQTDTKADAGYKAXVNKYKLTYYTLEYETKDTDIMAAFPVSPDPAVPPEEATAAVAAESSTDTWTTVWTDGLTSLDRYKGRCYNIEPVAGEDSQWICYVAYSLD

SEQ ID NO: 155726 - protein, 75 aa, Triticum aestivum
  unsure (1)..(75): unsure at all Xaa locations
  Clone ID: PAT_TA_50144.pep
PVEKRTLRRRSATEISGGXRMLVGLNGPTARSFTSTVVSGSSPAAAAMVFSCSIRFLFAVFGYAWVETADPYLQV

SEQ ID NO: 155727 - protein, 110 aa, Triticum aestivum
  Clone ID: PAT_TA_50145.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSFYEYVSQGLK

SEQ ID NO: 155728 - protein, 117 aa, Triticum aestivum
  unsure (1)..(117): unsure at all Xaa locations
  Clone ID: PAT_TA_50146.pep
LPDPQHPRSSLLPPSLTRRHAPSHLLLLLLRPRSPAANCYSSTASPLPPPHLSIARTQVTRQQGRSGRLPSLMEEHAXAASRLSRSASVPMQPGGSFSGGNESCRRTGRCACAAQLG

SEQ ID NO: 155729 - protein, 114 aa, Triticum aestivum
  unsure (1)..(114): unsure at all Xaa locations
  Clone ID: PAT_TA_50147.pep
KRQRRTARRPRRTPRCAGNPALFLKVMVSPDLPLNQLACDHTGPMLVLSSRSCRLRVAPVSVARLAPRLEELDAFVVRQALHAHPDAAPRXGTSRRVNKVLCSASDGAPVNVTG

SEQ ID NO: 155730 - protein, 73 aa, Triticum aestivum
  Clone ID: PAT_TA_50148.pep
FTFRDIEKSTSASNSFNYRLHEFQARVKLCVGFPDPTKCEFGSTVFSFHWNSVSSEWLLPDLKLDICKALLAV

SEQ ID NO: 155731 - protein, 102 aa, Triticum aestivum
  Clone ID: PAT_TA_50149.pep
EHTHQPKFAPKNGDIRRRRNDRLARFEGTDEGAQRDCDPDGREVAAASASASHLGDAWVTRGNEFGRKRCGDVKMATHGGGAAAHRGLDPTARRGLGMTDGR

SEQ ID NO: 155732 - protein, 120 aa, Triticum aestivum
  unsure (1)..(120): unsure at all Xaa locations
  Clone ID: PAT_TA_50150.pep
IAMFKMEPKIHYAXDDCPGSPPHGFPKDDALQFEGEMLDFFKAXVVTEDLRVAKKIASKGKGWVTPTKPYXVTARITARTAGCKEILPNKEVPYFFTLGKSEAPKGLEMGIGTMAPKEKA

SEQ ID NO: 155733 - protein, 55 aa, Triticum aestivum
  Clone ID: PAT_TA_50151.pep
MASATLLKSSFLPKKAEWGVARQVAAPRVSMVVRAGAYDDELVKTAKTIASPGRG

SEQ ID NO: 155734 - protein, 138 aa, Triticum aestivum
  Clone ID: PAT_TA_50152.pep
LYRGVSADILMLDRSGYLQIVDFRFAKKLEGERTYTICGIADSLPPEIVLGRGHGFTADWWALGVLIYFMLQSDMPFGSWRESELEPFGKIAKGRLIIPSAFNGEVGDLITKLLVVDENTRLGATGADAVKEHPWFDG

SEQ ID NO: 155735 - protein, 95 aa, Triticum aestivum
  Clone ID: PAT_TA_50153.pep
LSFAHAYDRDPLLIDFSYQPTIALFCSYSIQARTRSKSCEPTPTADPSICDRRIEIRRTPGGPQPSLSLPPGCTSRGASSSFTYRTPRRRGAVLS

SEQ ID NO: 155736 - protein, 54 aa, Triticum aestivum
  unsure (1)..(54): unsure at all Xaa locations
  Clone ID: PAT_TA_50154.pep
MAEEANAPADTTSTGADAAPVTAWHPVRDHLEYTRSKDXLVLAVIVHVVYHDRG

SEQ ID NO: 155737 - protein, 128 aa, Triticum aestivum
  Clone ID: PAT_TA_50155.pep
MPILFSQELLISVVVVLLVPLYLYLRASCRSKNPAVLPTNWPILHMFPSLVANIHNIHDYGTLVFAGSGHNFRAHSPPGTGMRFFVTCDPRNVRHIFTTNYTNFPKGAEFAAIFDIMGGSLFTIDGEP

SEQ ID NO: 155738 - protein, 60 aa, Triticum aestivum
  Clone ID: PAT_TA_50156.pep
GSGCSCGSDCKCRKMYPDLTDQGSAAAHVDAVDLLVVDPVNMAHYFEVDPVQGQLGLICH

SEQ ID NO: 155739 - protein, 126 aa, Triticum aestivum
  unsure (1)..(126): unsure at all Xaa locations
  Clone ID: PAT_TA_50157.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFERGFRTNMFTSIXGNVFG

SEQ ID NO: 155740 - protein, 135 aa, Triticum aestivum
  Clone ID: PAT_TA_50158.pep
VTEEQPHHRSPLTATTRTICRRAASSAWPRPAVVTRELCRHPVRTVDLRATCTALNPTMASCSLPQCRTWPALAVAMTAEWGKIHGAAHGVSISARVAKFWLAIVWAERQIWRISTPQVAQGVLTTYYTIYKELW

SEQ ID NO: 155741 - protein, 71 aa, Triticum aestivum
  Clone ID: PAT_TA_50159.pep
APTRGWCWNRQGVVLQLSSSEAGTISCWCCTPRPLGRGRWPRRATMGGRDVGTSLGGSSNQRQILLYPVSF

SEQ ID NO: 155742 - protein, 34 aa, Triticum aestivum
  Clone ID: PAT_TA_50160.pep
GGGRGQHGPGRDGHAPLSLGFVWDGQDPTCGEFL

SEQ ID NO: 155743 - protein, 132 aa, Triticum aestivum
  unsure (1)..(132): unsure at all Xaa locations
  Clone ID: PAT_TA_50161.pep
MLLPFALLAGAAAGAFLLFKFATADGDFTLLSCGRARRDKVEGKVVWITGASRGIGEVLSMQFASLGAKLILSARNKEELERVKRNIMSKHPDSKIEVLPMXLSSDEESLKEVVHSAESLFSSAGIDYMMHN

SEQ ID NO: 155744 - protein, 143 aa, Triticum aestivum
  Clone ID: PAT_TA_50162.pep
PRVRLDNRKRDISIEKGPVRELGLEFPACPDDVEGRRFSYAYYSRKLANKEVMDRKWLVYSKELDKVFCFACKLFKSNQSRSLLASDGLRDWKHLSGRLQEHESSVEHLTNMNTWNDLRLRLSKNQTIDDDMQREIAKEKERW

SEQ ID NO: 155745 - protein, 93 aa, Triticum aestivum
  Clone ID: PAT_TA_50163.pep
ASLPPVHALLCDQVVVRPEKSHLGKWCHVSNSLLVLHVPSGPDRYAPDLSIVGVDLEGSRALHRRPRCPRVHPTISLLETARLERNMPVHAFR

SEQ ID NO: 155746 - protein, 125 aa, Triticum aestivum
  unsure (1)..(125): unsure at all Xaa locations
  Clone ID: PAT_TA_50164.pep
ILIRILRKKWAKKRAPEKGLGRALWRAIRVFTGASSETSPETLLRAMVGLMEQEVGELGQEICQRKXLGELLYNNRYKNRDEHVDELDDVPEALLEALWNAGWNVGQHAVHDTDGATDRIIKMLV

SEQ ID NO: 155747 - protein, 67 aa, Triticum aestivum
  unsure (1)..(67): unsure at all Xaa locations
  Clone ID: PAT_TA_50165.pep
ARLRFNRCLNGASLGSISNDRRIRCILVXPSXGLKKLQTLYYLSWLTTDDLLKHVYYASPSMMRPWL

SEQ ID NO: 155748 - protein, 62 aa, Triticum aestivum
  unsure (1)..(62): unsure at all Xaa locations
  Clone ID: PAT_TA_50166.pep
AIASNNEDXQPHGPQPCCSQLARHQIGVAGSIVALGANSPPPVVTDSPYQQSACLSHNSWRT

SEQ ID NO: 155749 - protein, 61 aa, Triticum aestivum
  Clone ID: PAT_TA_50167.pep
WHGKQPGLVPTRPEHQGRARSVRHGRAGDLGHTAPHSGRLAEAPLHQELRRQGPRPGFHPE

SEQ ID NO: 155750 - protein, 65 aa, Triticum aestivum
  Clone ID: PAT_TA_50168.pep
WGVSTSRYLLYAGEFGKINANVLHNFRMHYAITRVATNAPGVKMYIQTGMAEHRDELRELLKRDN

SEQ ID NO: 155751 - protein, 83 aa, Triticum aestivum
  Clone ID: PAT_TA_50169.pep
PPTETVCRVLSMSPLQRLKSTIVLRIRRLSNLTRLGSVSISGRIRCMQMWPIEVIKTLLTMTYSTPIRTDAILKQVDYLITLQ

SEQ ID NO: 155752 - protein, 79 aa, Triticum aestivum
  Clone ID: PAT_TA_50170.pep
FKSHREGLMSPQTETKAGVAYTAGAHDYKLTHYTPEYETKDTDIWAAFRVSAQPGVPTGEAGAAVAAESYTGTWTTVWT

SEQ ID NO: 155753 - protein, 84 aa, Triticum aestivum
  unsure (1)..(84): unsure at all Xaa locations
  Clone ID: PAT_TA_50171.pep
RKHYGMKCKTLALSVKAEEILGVTFTTAAYLDTIGLPNDRMVYVIAEEGILMELELDXSHDHGVPTDCYKRIELKPGXYMQHDK

SEQ ID NO: 155754 - protein, 41 aa, Triticum aestivum
  unsure (1)..(41): unsure at all Xaa locations
  Clone ID: PAT_TA_50172.pep
RTXSTTQYICPPYLCLIPDPXRGGCLAWRSARLGYLPEHNS

SEQ ID NO: 155755 - protein, 149 aa, Triticum aestivum
  Clone ID: PAT_TA_50173.pep
HASGSCSRCLSLARAGAPTDVTSLLLRFCACGSEHVVCPACTCAERIASPISGLTSVHLAAVSPLSFLGLACSPCLKCYAYVNSAAADMDLAGASSHENSSCKVDTNGALPLERLYFCSMQAGSYELEWLLEHHLSLRQHELPAGDGVA

SEQ ID NO: 155756 - protein, 57 aa, Triticum aestivum
  Clone ID: PAT_TA_50174.pep
MPAQLTAVIPSYSQADKAAGGSAASCTDSHFLYYPTRRLRNAVRAQVSTTETEEPAP

SEQ ID NO: 155757 - protein, 85 aa, Triticum aestivum
  Clone ID: PAT_TA_50175.pep
MIQVAKLETGERGATMGVIHDACHIWVFFELLNHAMWDQLMDQVELVSKAHYAGRREEQFKDVAAKTLEADEKGDYVNDLYWEST

SEQ ID NO: 155758 - protein, 86 aa, Triticum aestivum
  Clone ID: PAT_TA_50176.pep
LEGPKIKLWFHLLPPPSPRKQQERQQNSSLLPARSAACQRATTELPGEPCRRRRRQSRRRHRPERSSAASGPPHKVCLPLKSHPCV

SEQ ID NO: 155759 - protein, 59 aa, Triticum aestivum
  Clone ID: PAT_TA_50177.pep
QGVSCEAEGVSGSEPHLPCKRLADGSKRVQLSQFPQEQLPEDKIWIGFKRSECIVHLDS

SEQ ID NO: 155760 - protein, 171 aa, Triticum aestivum
  Clone ID: PAT_TA_50178.pep
TTALTYRQRATAAALSWICRGEREKMRGRERREKERKRRGGTASDGRVANPARVGLGRTPPRRTAMMEGSAGTIQAPDRRTRWVATPPVRWGHPRRCGLGTERRGPCRGLAVMRTSGPPYIVFVPRWRGRRQASTLHREQRRRHKLQFIANLGRWFRFVYGIGSLCAPLCG

SEQ ID NO: 155761 - protein, 136 aa, Triticum aestivum
  unsure (1)..(136): unsure at all Xaa locations
  Clone ID: PAT_TA_50179.pep
MVTTVMALSHSFFAGKAVKCLPLSALFGEARVTMRKTEAKAKLESAGSPWYGSDRVLYLGPVSGYQLSYLTGEFSVYYRWDTASLWTTRKTLGXNREVEAIHXRRSILAALCCIYPQLIVPIGIKIGEAGLFKVDS

SEQ ID NO: 155762 - protein, 147 aa, Triticum aestivum
  Clone ID: PAT_TA_50180.pep
RTGSTTAAHTSAQGAESSPALNAGLENVQLTRAVEHYQGSGASDGGWIAKIAALLVGEDPSQSYALICGNCHMHNGLARKEDYPHITYYCPHCHALNTSKNSGPSTPVAPADVISAASSVVESELINLATVQELPKEEHAEKEVEAS

SEQ ID NO: 155763 - protein, 96 aa, Triticum aestivum
  unsure (1)..(96): unsure at all Xaa locations
  Clone ID: PAT_TA_50181.pep
SGRLPFRVIDEDYCGPMGVVLLNYSEADFTVKPRDRVIQIIVQVIATQEVPXVEDLDATVWRSPRWRTTPPSGVPQGGGPRRFVHTSREVVWLGWW

SEQ ID NO: 155764 - protein, 217 aa, Triticum aestivum
  unsure (1)..(217): unsure at all Xaa locations
  Clone ID: PAT_TA_50182.pep
DAWGSIYLYXXGSIQTLHVIDPDMVKELASCKSLDLGKPSYLQKEHGALLGTGILTANGDLWVHQRKVIAPEFFMDKVKGMVNLMMDAALSMLNSWEEKVESEGGRAEILVDEFLRNFSADVISRASFGSSFVEGKEIFYKIRQLQKAMAKRSMLIGVPGSRYLPTKSNREIWNLXSCIRSLILNIAKKHGQDSATTPNKXFLHSIIEGSKSASFSS

SEQ ID NO: 155765 - protein, 77 aa, Triticum aestivum
  Clone ID: PAT_TA_50183.pep
STIVNDIDISHPSQSGAACVGHDTSAALEVVFALCARLQSFLRRPFIPPHPSRFQLKRNKCIAYRWFFNPMIFLICF

SEQ ID NO: 155766 - protein, 61 aa, Triticum aestivum
  unsure (1)..(61): unsure at all Xaa locations
  Clone ID: PAT_TA_50184.pep
AHALGVWNLPNCRRRMERFLIFCSPLAPSGSCPISRLTLIAAVVHPFHSFAATFNRLXCQI

SEQ ID NO: 155767 - protein, 136 aa, Triticum aestivum
  unsure (1)..(136): unsure at all Xaa locations
  Clone ID: PAT_TA_50185.pep
MQKINALLSFLTQMPCVRLIVVVGGDNANTPSTTAAAGVEIITYSRLHSQGKMSSQTYRPPKPEDVATICYTSGTTGTPXGSSLGVKFYPSDVYISYLPLAHIYERANQIALLHYGVAIGFYQGDNLKAVDDLAAL

SEQ ID NO: 155768 - protein, 94 aa, Triticum aestivum
  Clone ID: PAT_TA_50186.pep
MADDSSSPASYIRLVQHLIEKCICYDMNKEECVQALEKHANILPAVTSTGNSSVHSHIALIGSFEFVIDRSTGFLALHICMHAEEGRCSSTGLF

SEQ ID NO: 155769 - protein, 75 aa, Triticum aestivum
  unsure (1)..(75): unsure at all Xaa locations
  Clone ID: PAT_TA_50187.pep
MCCNCGSACSCGSNCKCGKMYPDLTEHGSAAVQVVDEVVLGVAPENKAVQFEVAALQSGXGCSCCDNCKCNPCNC

SEQ ID NO: 155770 - protein, 122 aa, Triticum aestivum
  Clone ID: PAT_TA_50188.pep
EFGLFPRASPSAAAAAGRRPSSSSSSAAALRRAPPPAVWATVDGPLGMPLEEAEVHARRFFLWGFFCLLFLWAINCCYFWPVLRSPDVFSPLVFAPISPFVMRSAIGFIIFGVVFLTWAMTF

SEQ ID NO: 155771 - protein, 131 aa, Triticum aestivum
  unsure (1)..(131): unsure at all Xaa locations
  Clone ID: PAT_TA_50189.pep
SWTRVLSLGSDPYFVFPVIQASVARVLLAGVTTVAVMSMLKEVTPELSCPVVIFFYFNLIARRXTGSFTGVCREAGVRGLIVPDLPYIETGFLRNEAIKNDIELVLFTTPFTKADMINEISIALEGFVYLC

SEQ ID NO: 155772 - protein, 127 aa, Triticum aestivum
  Clone ID: PAT_TA_50190.pep
MSMAAVTKKKKVIIDTDPGIDDAMAIFVALRSPELEVVGLTTIFGNVYTALATRNALHLLETAGRTDIPVAEGSHVTIKKATKLRIASFVHGSDGLGNQNFPPPAGKALDQSAAAFLVEQANLYPGQ

SEQ ID NO: 155773 - protein, 132 aa, Triticum aestivum
  Clone ID: PAT_TA_50191.pep
MLSASKPLFALTSLTAMAIRLPPHTPTHYAPPHRRTPPFRSITRAALSPSTTAMAVSLPPSPKKVLVPIAMGTEEMEAVILAGVLRRAGADVTLASGEDGLQGEASYGTRINRNKSIAACADQVFDLVALPG

SEQ ID NO: 155774 - protein, 98 aa, Triticum aestivum
  Clone ID: PAT_TA_50192.pep
VTANMRGNSAEEVAERVLSQTSLCGLQGPTISPVYCTLDGNVAVDYYAINVVVPQKSLYKSIQQLRSIGGSGVLVSKLTYIFDEETPRWRKLLSELGM

SEQ ID NO: 155775 - protein, 75 aa, Triticum aestivum
  Clone ID: PAT_TA_50193.pep
FLFLFVMGRGRRCLIGCIRVCCVIGSMCVSICLVGLLVGVLLHVLFNVLQILLQGLVLQLVVLLAVLEDVVEDVG

SEQ ID NO: 155776 - protein, 78 aa, Triticum aestivum
  Clone ID: PAT_TA_50194.pep
RLINGMLAGASHLISPNPITFRSLPTQSRGTVMQVILQFLSRFLVIIGFLPYTRPPLVKLVYKADRRASSAPTRPETV

SEQ ID NO: 155777 - protein, 131 aa, Triticum aestivum
  Clone ID: PAT_TA_50195.pep
PTRPLRIPPHFGLWLKTFNGKPRVVDGEHAECGNAMVSKLAPYSLAKGLLQWQREGFYITEPRGTKSAATRAFRSGPPLRLASWINKGLDWGPIDEVQTLQSRIRSLLEKDTGLINMIQVMLGCRVLPCQR

SEQ ID NO: 155778 - protein, 112 aa, Triticum aestivum
  Clone ID: PAT_TA_50196.pep
MISEHGGLVEYHFSPQDGWEWVEHGTPHRDVTLVVAPGPCFDGTQLFVIGSDGHVYLRHLDERTWRWTSHGHPSEPSSTTTDVAGGGEQSCATLGAADAHYASSFRGSCDEK

SEQ ID NO: 155779 - protein, 97 aa, Triticum aestivum
  Clone ID: PAT_TA_50197.pep
MAPTAMASWATSVAPLQGLKSTAGLPVSRRSNGASLGSVSNGGRIRCMQAWPIQGIKKFETLAYLPPVSTEALLKQVDYLRRSKWVPSLESSKGALI

SEQ ID NO: 155780 - protein, 52 aa, Triticum aestivum
  Clone ID: PAT_TA_50198.pep
VGGSHLTQHSASSPTAWHKQAQKLPIAHGALEEAYMNTLHMARLPILPMDAP

SEQ ID NO: 155781 - protein, 98 aa, Triticum aestivum
  Clone ID: PAT_TA_50199.pep
MVHQMEGGDLQPAADGGVDTYGHYCATVVTGIGHDGDYERITTEEKHHTHKEHLVRWAQTRSETYALYEKHEANKGPEYAHKHKIEEEVAAVLLGGPG

SEQ ID NO: 155782 - protein, 140 aa, Triticum aestivum
  Clone ID: PAT_TA_50200.pep
KKDLEVASSSCSCSRLNRTSKKMVSESRASGSRGEEELEPDLDGVSSRGEGGFTARGRRWRRSWRRRRVHQEKGGPRCRRRACRARAPPRALRGSDMKKGRGREEHGPMCPPTMVTNGRGAHQRVPAVDGGSSVWQQRRR

SEQ ID NO: 155783 - protein, 152 aa, Triticum aestivum
  Clone ID: PAT_TA_50201.pep
GKLFQDGNYVAISVFNLETRGAPNSFIAECNVLRNVRHRNLVPILTACSSIDSNGNDFKALVYEFMPRGGLHGLLYSTQDYESSFDLMHITVAQRLSIVVDIADALEYLHHNNQGTIVHCDMKPSNILLDDNMTAHVGDFGLARFVVDSTVS

SEQ ID NO: 155784 - protein, 115 aa, Triticum aestivum
  unsure (1)..(115): unsure at all Xaa locations
  Clone ID: PAT_TA_50202.pep
MKTILASETMEIPEEVTVKVSAKMISVTGPRGTLTRNFKHLNLDFQLQEGGRKLKVDAWFGTRKTMAAIRTVIFHVQNLITGVTKGFRYKMRFVYPHFPINAFITGXNKGIENRN

SEQ ID NO: 155785 - protein, 77 aa, Triticum aestivum
  Clone ID: PAT_TA_50203.pep
LKSHREGLTAPQTETKAKVGFKAGDKDYKKTYYTTKDATNGAAILGGYRASAQPGEPPAEAGAALATGSCTATWTTG

SEQ ID NO: 155786 - protein, 81 aa, Triticum aestivum
  Clone ID: PAT_TA_50204.pep
RGEMDSATAASDRMCSRSIECIFMGAGGVHAPISSSSSNPSWSLSAAAIIFRSTLTDEDSAPAHGRIRARICMVDFQSTRP

SEQ ID NO: 155787 - protein, 148 aa, Triticum aestivum
  Clone ID: PAT_TA_50205.pep
QSVPHTTPASSLGAGGGGACRNNGKVGLVPPGTAILWLLAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAI

SEQ ID NO: 155788 - protein, 98 aa, Triticum aestivum
  Clone ID: PAT_TA_50206.pep
FTKSLAPDPTSRRLPSPPPLCRSNPLAPHRYKFTQPMNAFKFTELTSPGSSVERISSEDHRLDPPRAVGSRGRRQFWRCHRPSCLPQAALRRSSRGGH

SEQ ID NO: 155789 - protein, 61 aa, Triticum aestivum
  Clone ID: PAT_TA_50207.pep
AYDSEQVPFLGDINRQRLGGKGIDALGEGEEVEVGGGARSDHMCLDTMTPSRKSTPDWMVG

SEQ ID NO: 155790 - protein, 129 aa, Triticum aestivum
  Clone ID: PAT_TA_50208.pep
VIKDFDGIEQGGGGGLPAFVAPFYDIYTLNDKNVQIVDTTCPWVLKVCNMVEMHMKGDYTSIIYGKFSYEETVATVFFAGKYFIVKNMAVVTYVCDYILGGQLCGFSLTREEFLENFIMGVFAGFVPDF

SEQ ID NO: 155791 - protein, 38 aa, Triticum aestivum
  Clone ID: PAT_TA_50209.pep
LPTCCSLNTRVAGGDRLSIIYRYFCFFLYSLLFFILDR

SEQ ID NO: 155792 - protein, 49 aa, Triticum aestivum
  unsure (1)..(49): unsure at all Xaa locations
  Clone ID: PAT_TA_50210.pep
DHAFEDACVVQVCLHRYTEVSNSILSYLDGFSAQGFPLAVFLAFXMPSE

SEQ ID NO: 155793 - protein, 138 aa, Triticum aestivum
  unsure (1)..(138): unsure at all Xaa locations
  Clone ID: PAT_TA_50211.pep
GTFVAPFQGLKSTAVLPISRRSSSAGLSSVSNGGRIRCMQVSPIEGIKKFETLSYLPPLSTEALLKQDDYLIRSKWVPCLEFSMVGFVFREHNSSPGYYDGRYWTMWKLPMFGCTDAIQVLNEVXEVKMEYPDSYVRL

SEQ ID NO: 155794 - protein, 43 aa, Triticum aestivum
  Clone ID: PAT_TA_50212.pep
LRWLHLVLWLRVGLQSIQYRLFFKLHFSYPNIMLLLIPLCGRS

SEQ ID NO: 155795 - protein, 55 aa, Triticum aestivum
  unsure (1)..(55): unsure at all Xaa locations
  Clone ID: PAT_TA_50213.pep
LPLLYLLRLGGGTEAIPLLLLELLQLFXPDLVYLHGRNPFLSLLNSLCDPTPCIK

SEQ ID NO: 155796 - protein, 123 aa, Triticum aestivum
  unsure (1)..(123): unsure at all Xaa locations
  Clone ID: PAT_TA_50214.pep
KSSSNYRKLTKAHYIPEQGDRLRELYSITALAKNNSSCSNNGIKVELMDXEERLSKVHYADCREEQIKKIXARKHCKPSRRATHLNDVDWESTFYSRYLXVSNLADLPDLDHHYRQEMKEFVA

SEQ ID NO: 155797 - protein, 87 aa, Triticum aestivum
  Clone ID: PAT_TA_50215.pep
MLVYQDKLSGDELMSDSLPYRELENGVLWEVDGHWVAQGAADVDIAANPSAEGGGAGAGVWTDGLTSLDRYKGRCFHIEPCAGEDSQ

SEQ ID NO: 155798 - protein, 145 aa, Triticum aestivum
  Clone ID: PAT_TA_50216.pep
VGNLLKAVLEAAIIGVEGVDPVRVHGAVPRRIIPQVWELFQQTALGLGALVWPVVVTLVGRVRRVHAPGLPCSHRSSRVLALTTTYMSALPCSVRSGYIFPHLQSETQLQLDPQLQDILEICGGKKISRISRSALVSGMMIGGVG

SEQ ID NO: 155799 - protein, 92 aa, Triticum aestivum
  Clone ID: PAT_TA_50217.pep
SRGNEDAENVTRPVTPGRMPALTRVRPECEREGVGRGNAQQERPTALLRRAAAAPRRRCRGGGRWRAAEDADAEHGAPLVFSGFLLVMVGST

SEQ ID NO: 155800 - protein, 91 aa, Triticum aestivum
  unsure (1)..(91): unsure at all Xaa locations
  Clone ID: PAT_TA_50218.pep
AEMVLTFTKLFIRLFAKKEMRILMVGLDAAVKTTILYKLKLGEIVTTIPTIVFNVXSDEYNNTSFTVCDVGGQDKIRPLWRHYFQNTHRFI

SEQ ID NO: 155801 - protein, 114 aa, Triticum aestivum
  unsure (1)..(114): unsure at all Xaa locations
  Clone ID: PAT_TA_50219.pep
RLRGATGTCAWGYQSISIPNLQTLKLHYYASGSPHYEPIRRSKRRCPRIPFPRCMRSNLRTMDMTTMCLRIKLCMPIMIXHKHFQKMPHPEGEYATARXRNVVGTEMTLDQRAT

SEQ ID NO: 155802 - protein, 85 aa, Triticum aestivum
  Clone ID: PAT_TA_50220.pep
PTLPPRVRHASAHSAGRVRQQCSLLFLHISSSPSSASLRHVTMFLCYFTFTYELLYLQSLWSVLPTLLMNPPLTVAYNFVVAYML

SEQ ID NO: 155803 - protein, 76 aa, Triticum aestivum
  unsure (1)..(76): unsure at all Xaa locations
  Clone ID: PAT_TA_50221.pep
YLPSWGEETRGRSGSADLSCSYXLXSTHLTCSHRRRGESKKSKKIKRKTRNKIVVTVLLLGTETVLIVRTLTLILT

SEQ ID NO: 155804 - protein, 31 aa, Triticum aestivum
  Clone ID: PAT_TA_50222.pep
SITGGPAFVQAVGEAILDATFFYNLPILSTY

SEQ ID NO: 155805 - protein, 76 aa, Triticum aestivum
  Clone ID: PAT_TA_50223.pep
PFCFPITINARVAFDATRPCSEQYRLLFSCIPNVRFAWIDKVIGYCQEYSSVGSCFFTRTKHYHKYYLSWSNLLTF

SEQ ID NO: 155806 - protein, 112 aa, Triticum aestivum
  Clone ID: PAT_TA_50224.pep
VKKKRITEKRKITSMHDQSIRPIYMRLPRTLPYKYTPSGSESAYLRSAPAAAPSSSTVTTILLRVFRFIFLLFLLSPLRRSEQLSSAQLRRYEQLSSAQLDLHLASSRQLGR

SEQ ID NO: 155807 - protein, 92 aa, Triticum aestivum
  unsure (1)..(92): unsure at all Xaa locations
  Clone ID: PAT_TA_50225.pep
RPWSALPNTXSLVLLSPHVRCPGFVCFHFAGSVAFIGFCFLIPCLLICLGSPGCQLPGHVFRSEFKRLVYEGINEFMFIPTPPDVFVAGLVL

SEQ ID NO: 155808 - protein, 66 aa, Triticum aestivum
  Clone ID: PAT_TA_50226.pep
IARRRCSLGTEWVLSYHSSFTSIHSYLLLLSLLLDSNSLRLCKSADILASSSPSVWPQLRKFLTIN

SEQ ID NO: 155809 - protein, 64 aa, Triticum aestivum
  Clone ID: PAT_TA_50227.pep
RQGGALRAVDVRQGHLAGPSYRSTPTTSKPPRPRTVMCSEELPVLIQPSQSTLLRTYVRYQSRN

SEQ ID NO: 155810 - protein, 43 aa, Triticum aestivum
  Clone ID: PAT_TA_50228.pep
VASKELEIRFVPSKDQVADGFTKALATRPFEEFKRNLNSRSLD

SEQ ID NO: 155811 - protein, 71 aa, Triticum aestivum
  Clone ID: PAT_TA_50229.pep
NLTLPKQLSKNGLDRLLHPPYEAWHSLLAGRTKARTPLVTARPEVEAPGQRHIGLTRCQLFIQSVSAEVDK

SEQ ID NO: 155812 - protein, 91 aa, Triticum aestivum
  unsure (1)..(91): unsure at all Xaa locations
  Clone ID: PAT_TA_50230.pep
PPFRDLGIHHMVVNDCYICVIPXHNFLLISLPIVLIEGLLPSGMHILHAYTPVTEPFGLWDGLDRKSAAYRSLKEELSEVIWKAVDLALCP

SEQ ID NO: 155813 - protein, 76 aa, Triticum aestivum
  Clone ID: PAT_TA_50231.pep
FLLGSPPAADHHCHQKVLQNHPVVFGVVLPFTDGLLQVDLADTFKYAATCFRGGLFGSLSFLVRLCFLLSNVTTIF

SEQ ID NO: 155814 - protein, 92 aa, Triticum aestivum
  Clone ID: PAT_TA_50232.pep
KSMLPVKNARPSAGRQPPPQNPVREMASMIGSRMSMITGTMTWSPPPPWPWPLALWPAACCCGCGCAGGCLRPSMLQIMDMLPSLMYQILSF

SEQ ID NO: 155815 - protein, 89 aa, Triticum aestivum
  Clone ID: PAT_TA_50233.pep
MAGLGGGGGLSDYLDRPNAIHRRTASLAIARSGDDGPRIMDGVGREGRRARSSRRLSLSSWLGPRSRPLPADDTTSVDSRSRGFEGSGS

SEQ ID NO: 155816 - protein, 84 aa, Triticum aestivum
  unsure (1)..(84): unsure at all Xaa locations
  Clone ID: PAT_TA_50234.pep
DGQGVPVDTHACSWRGKEEDVRLGANRYSEHQPIGTAAQRRXADEKDYKEPPPAPFFEAGELTSWSFYRAGIAEFLATFLWLYM

SEQ ID NO: 155817 - protein, 93 aa, Triticum aestivum
  Clone ID: PAT_TA_50235.pep
DPVRVCYSTKGINSRVRKYLSPLIHPKSTVFFKCKAELGEPMLKGEYSMTPGTAARAEGKNGGERVRNSHGRRGHRCLPPTAGSSAKACTVSA

SEQ ID NO: 155818 - protein, 109 aa, Triticum aestivum
  Clone ID: PAT_TA_50236.pep
SSLLQPGERLHFPAKLTVKHNSHLTRSHGHTSRAPRFYEQRSSTLPVVDGDPSPELSLPIWCAATTRRRGETVAIRIACYNGGGHELERRARDATTARLTSWNLRPPTS

SEQ ID NO: 155819 - protein, 113 aa, Triticum aestivum
  unsure (1)..(113): unsure at all Xaa locations
  Clone ID: PAT_TA_50237.pep
LAFAGRAYLLLNNILYVADIEIHALREVDFANEXVRTLSGNGTKGSDYXGRGRGTRQVLYSPWDVWLAHXEVTALIARTVHHQICYHSTLKXVTELFSAYGSEKHLNGSRPTN

SEQ ID NO: 155820 - protein, 72 aa, Triticum aestivum
  Clone ID: PAT_TA_50238.pep
LEMVLTLLGIFSLWMRIQGLLYFLWRSHSRLGYQERCGTLGIAHIMLLTSLGKTKLLLQAHRTDALHGCMHI

SEQ ID NO: 155821 - protein, 75 aa, Triticum aestivum
  Clone ID: PAT_TA_50239.pep
MSIFRFILLRIERSRGWRCFATGIPSDSIAELNREMESIFGESPSASPLGSNPTQQVVHPTPAARETQPGLTHVD

SEQ ID NO: 155822 - protein, 144 aa, Triticum aestivum
  Clone ID: PAT_TA_50240.pep
EQIVGFLLRQGEAEGGAGVLPVVGPARVGKSTLVEHVCHDDRVRIHFSSILLMSGDDLEDDEKLSDPGDHGLIKHHGRASHPHNKGSLVIVELAGDEVPDEAIWRRLRSSAFCKGGVTKIIVTSRSEAAQRLGTERALRLKVLS

SEQ ID NO: 155823 - protein, 131 aa, Triticum aestivum
  Clone ID: PAT_TA_50241.pep
VRGPWVQSGKTDQSTGKLNLKSWHESGTIECIRSRIKLLVFHDFRGGRGELAFLKFFFESALVLQEAVIVFAAAPSSMEEVQSKLDILGSMKRASETSIVLLTTRSDPQGGYIWSFKIGSDFSPADPFENY

SEQ ID NO: 155824 - protein, 131 aa, Triticum aestivum
  unsure (1)..(131): unsure at all Xaa locations
  Clone ID: PAT_TA_50242.pep
ARSSSRGSTIMTLSSCATFRDDEVASTRPGIRFLQLXWTXDRKAVEQFVRRAEKAGLKAIALTVDTPRLGRAEANINNRFVDSPKYTLKNLQGXDLDKMDQPNDSGLPSYVPSQIDRTMSWKDVKRLESIT

SEQ ID NO: 155825 - protein, 91 aa, Triticum aestivum
  Clone ID: PAT_TA_50243.pep
WLQGLRKELKAEVMVVSFNFLLSNSSRVLPRSEDEGKKKNLTKQLKKIKGRREEWRIKVVGCQLQILVEHFLKNLVEVSVSPLCVMNDCDG

SEQ ID NO: 155826 - protein, 143 aa, Triticum aestivum
  Clone ID: PAT_TA_50244.pep
TWPVPAAAVLLSAAARFKNTGARRVEKAGEPPRGGHKPNQIDQSVSRTRLEIGGAKKKRESGAFSRSASKAPPLPLCIFLSGRGRRESIGARGGWGRGGGGAAECRARRRCCSWLAAASPSGRRAKSWSAPPPTPLTLLPSTR

SEQ ID NO: 155827 - protein, 83 aa, Triticum aestivum
  unsure (1)..(83): unsure at all Xaa locations
  Clone ID: PAT_TA_50245.pep
MDDNDQVVWAGFDKLLLHASYFMHVLLVGFSNEFQVLDDDDAAXFEIWTHXRYGASIFLQMHPTPLYSEQTVGFTASHSILVF

SEQ ID NO: 155828 - protein, 126 aa, Triticum aestivum
  Clone ID: PAT_TA_50246.pep
AHSPSFQHSANFSTQLISKALNIFYNRQNSTHGRVIKRQLPTERGALRDDDDLLPRDPGSRRQVPHRERHVARPRRNHGWMDLKRARGGGEERKSRGRAGGRARGEGELGFWLRALWKLPFRGRVG

SEQ ID NO: 155829 - protein, 93 aa, Triticum aestivum
  Clone ID: PAT_TA_50247.pep
TFGWIILFPDDVDPSEARSKTSSPSIGKFAFTFPGEVLSVRSFVLEGTSLAPPGSMEGAKDIRSALLVLYKALDKETGLSLCLYGPRLLPPSL

SEQ ID NO: 155830 - protein, 72 aa, Triticum aestivum
  Clone ID: PAT_TA_50248.pep
TESSSDLPTCRSSGRGGGCVPCELWRRSPSLPPPTLTRRWSRRPPTLRSSALGCWRAERHTCTTDRGAEDRS

SEQ ID NO: 155831 - protein, 84 aa, Triticum aestivum
  Clone ID: PAT_TA_50249.pep
ASAPTLMVLEVGYKVHGEKYLQELILARISLPPSAFRSAPTLLVAKIGYCDLPRVMVPSMVFVLLLLFSLIFVFILFDFFFWTV

SEQ ID NO: 155832 - protein, 67 aa, Triticum aestivum
  Clone ID: PAT_TA_50250.pep
MEMKLTIKRVPTVLSNYQEEGGGGCGRNCLGDCCLPASKLPLYAFKADPKKPAQDDELPTEFFLNSL

SEQ ID NO: 155833 - protein, 118 aa, Triticum aestivum
  Clone ID: PAT_TA_50251.pep
PISALPPPLPPPTAPPPPAPASTAPPRTARGDGEPRRASGSRRGAAPAPTAAPGRRSGGGPGRRPGRGPPAAAPAPPGGRPARSGGAGARRIRVPGRARRGERDLRRRGGLPGRGERR

SEQ ID NO: 155834 - protein, 61 aa, Triticum aestivum
  Clone ID: PAT_TA_50252.pep
CAIILHLSHLTYLCIVAYTFSLCVVLLSEIMFHPSFFCTKRSEALPCRHGRFRKTQVTTPS

SEQ ID NO: 155835 - protein, 94 aa, Triticum aestivum
  unsure (1)..(94): unsure at all Xaa locations
  Clone ID: PAT_TA_50253.pep
MAAVFSSTVGAPGSTPTNFLGKKLRKQVTLAGNYHGTSCKGNRFTDMAGENIDXKRNTDKWMGLACDISDDQQDITRGKGIVDSLLQAPTGDRT

SEQ ID NO: 155836 - protein, 51 aa, Triticum aestivum
  Clone ID: PAT_TA_50254.pep
VCHVKSGGVGGRRHSERRDRARRGAAVGRPSPGRARLSSFRYTGRSEWFVT

SEQ ID NO: 155837 - protein, 53 aa, Triticum aestivum
  Clone ID: PAT_TA_50255.pep
LAYGRSLATMRRLVTCACSRLTSPVSLCAPREEARQTYSHPRLYYRCRATCCP

SEQ ID NO: 155838 - protein, 154 aa, Triticum aestivum
  Clone ID: PAT_TA_50256.pep
MPGLLLNTAAPLANPSSLRPSFASSRHRHRCRAAASSSSSSSSSGGGRGSSWATDYDLYELLGVEPSSPQADIKAAYRALQKRCHPDVAAGNGDASAGPSSHDMAVVLNEVYALLSDPAQRQAYDREHARRSEFQGYTGRPLYSSWRGRDAQTR

SEQ ID NO: 155839 - protein, 99 aa, Triticum aestivum
  Clone ID: PAT_TA_50257.pep
GMPELAGTSCPSADIGPVIRTPAVQAPLDLESPPTQSRQCVRFIRNFSGHGSVFRHKADASQRASPGRGLNRPSGANKPPYGSSRRGKHARLSTHHTES

SEQ ID NO: 155840 - protein, 132 aa, Triticum aestivum
  Clone ID: PAT_TA_50258.pep
PLTPNPKPPRPPSGGPQNPSPPPPPPIPPPWMTASTTSSATTSARSSPTPTPMTRTPPSPRPPRSPAPPPRSAPRPAPPTAVDPSALWMSTTTTTPTPSRTPSYSPRTRSTTPRARRSTARALRRSSWTRTS

SEQ ID NO: 155841 - protein, 149 aa, Triticum aestivum
  Clone ID: PAT_TA_50259.pep
LSSPARTWTGVSASTTVMARGPGWEQEPEEPSQSARRPSQSLSLSSSSDRDRVGGRGKSRRSLRRRRRRREAWIGEDWRGRRGSALVANAASRGREGGLRGGYRRGRRTSLIHTMAAPTASPAPPPRPLPGKAGSDQITHPNLHSKSPP

SEQ ID NO: 155842 - protein, 85 aa, Triticum aestivum
  unsure (1)..(85): unsure at all Xaa locations
  Clone ID: PAT_TA_50260.pep
HTSHYAVPGCRTTIIASDTLYSCCTKDRYCGTEDNYWRQQCLISPSTASGYMRGYPDESXVMETLINRVKAQNTNGGGGKSVYSL

SEQ ID NO: 155843 - protein, 122 aa, Triticum aestivum
  Clone ID: PAT_TA_50261.pep
FKSYREGLMSPQTETKAGVGFKAGVKDYKLTYYTPEYETKDTDILAAFRVSPQPGVPPEEAGAAVAAESSTGTWTTVWTDGLTRLDRYIGRCYYIEPVAGEDSQLISYVAYAFYLFYEGSVS

SEQ ID NO: 155844 - protein, 145 aa, Triticum aestivum
  Clone ID: PAT_TA_50262.pep
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYV

SEQ ID NO: 155845 - protein, 57 aa, Triticum aestivum
  Clone ID: PAT_TA_50263.pep
NAPYFFTMKLDHLLQRDFIFLNIFELHIFSVFKMHHSKTHHQFSTLSDFICYFSWIY

SEQ ID NO: 155846 - protein, 94 aa, Triticum aestivum
  Clone ID: PAT_TA_50264.pep
QGFFSSLRADRGRTRTFNSSLNHNSNNYWPDHYLTKTTLVSQDSRALPPSKRMLLFLRMNHTDRALSERSCSLDMAHFLELRLNFFGIGKLIFR

SEQ ID NO: 155847 - protein, 139 aa, Triticum aestivum
  unsure (1)..(139): unsure at all Xaa locations
  Clone ID: PAT_TA_50265.pep
MSPQRETKAGVGYRGADKDYQLTYYTPEAETLDTDLSAAMASSAHPEDAAEEXGACVAGGYSTATWTTGWTDGLTRLDRSTRRCYHINPAAGEDTQWICYVXAYPLYLYGEGSVNNMWTCTECGVISVAALRAVRLEDL

SEQ ID NO: 155848 - protein, 49 aa, Triticum aestivum
  unsure (1)..(49): unsure at all Xaa locations
  Clone ID: PAT_TA_50266.pep
APGSTHPSRTTXAXAVYTQLTYRAWALCSYYMLSYHLILATDFSLLICA

SEQ ID NO: 155849 - protein, 39 aa, Triticum aestivum
  Clone ID: PAT_TA_50267.pep
MNNSCVIQILITGPNIFVENYSLTLAYRRTTGRLPTHAS

SEQ ID NO: 155850 - protein, 98 aa, Triticum aestivum
  Clone ID: PAT_TA_50268.pep
ADVLIIEVIGGVGVSFLVAHTHTHTELCAKGRRFMTCLRPSIPTFYPEGRHAEGLARRNRRRTAQETERRGKQVAARFPPWHAYWTVHRLLFPNQITD

SEQ ID NO: 155851 - protein, 111 aa, Triticum aestivum
  Clone ID: PAT_TA_50269.pep
MLGDTNTQRICLRSILPVNTRPISSRQTYVTKVERGNRLSSLIYPFHIALHNDPLEYVRKAKRSMHRKKSSLEVKFIQVVVQFLVKYFGAKVNSYIYFMFFCTLYALLKTV

SEQ ID NO: 155852 - protein, 56 aa, Triticum aestivum
  Clone ID: PAT_TA_50270.pep
PHPSFFRNKPPPPGPHRPTAWAGAGIEPYRISHLGPSGLHRPARRVHYESGVLLTA

SEQ ID NO: 155853 - protein, 85 aa, Triticum aestivum
  Clone ID: PAT_TA_50271.pep
RKLTRPTQLQSKSSRRSWRRIGEGLDGSWKADGGEDETEVERGTAGAEVSSSTPPTARSSLAHHTPAPRVAQAMNPGPGLLELRT

SEQ ID NO: 155854 - protein, 117 aa, Triticum aestivum
  unsure (1)..(117): unsure at all Xaa locations
  Clone ID: PAT_TA_50272.pep
FFFNGPPNPLKIVESIMSSSTASAPTEAPKKAETSDVVLVTGATGGVGRRVVDVLRKNGVPVRVLVRNXSXARTLLGPDVDLIIGDVTKGDTLDPMYFKWIKNVINAGVVIFCLKEC

SEQ ID NO: 155855 - protein, 79 aa, Triticum aestivum
  Clone ID: PAT_TA_50273.pep
GASCGPDEVLADVGVEEVHHVLETGLVYHLHARRRVVPVPPAHHGHPLVKDVHWPKHDHLVSDRAIHVVDHAFSHHYAW

SEQ ID NO: 155856 - protein, 136 aa, Triticum aestivum
  unsure (1)..(136): unsure at all Xaa locations
  Clone ID: PAT_TA_50274.pep
EQLIVKGAIERGTKRIRLHILTDGRDVSYGTSVGLAETIAKDLXRYREHGVDARIASGGGRMYFTMDRYKNDWSVFKRGWDAHCLGEAXYKFPSALEAEKTLKAQPKAHDHYLSPLVIADERGKNFGPIINGDAFL

SEQ ID NO: 155857 - protein, 71 aa, Triticum aestivum
  Clone ID: PAT_TA_50275.pep
GPGRNSGWTKPSGLILQSKKLKHASQGPNGKGQLGNFEGSFPGAKGQHVGFPWSPRSNDVGLGKVTNGERT

SEQ ID NO: 155858 - protein, 118 aa, Triticum aestivum
  Clone ID: PAT_TA_50276.pep
MGQVWASLQEKLQGRHWKERQVRKITDRVFDRLTEDTQKPEKDALKFEEVYIAVLCVYNDINKYLPGPHYDPPSKERLKELMKEFDIDMNGLLDREEFAEFIRKLTAESLCAISPKLI

SEQ ID NO: 155859 - protein, 99 aa, Triticum aestivum
  unsure (1)..(99): unsure at all Xaa locations
  Clone ID: PAT_TA_50277.pep
MMQKVLTKFCCFTIPRKAKQELSVIDQRHLSXISSTAKDKAKWMFEKLKGKPDKALFDLLSEYNLSTGLFPRNIIXYEYKQTTLELVVHLANPCEVSLK

SEQ ID NO: 155860 - protein, 84 aa, Triticum aestivum
  Clone ID: PAT_TA_50278.pep
MEPGGPWRDPRQGYIYGLGSPMQMPAQQRSDPAAAGGVLKRSLGELERWQHQRQFAMQQELYLRAVRQRTDATSPAVFPVTLAD

SEQ ID NO: 155861 - protein, 131 aa, Triticum aestivum
  Clone ID: PAT_TA_50279.pep
MASSASLLHPSTLAPAFSPPAPRRGLPPSQLDLRPSRRHHGVSVSLAASSSAASPEVEKKPSSPSTPPPGESSALSAVAESVKVLKEAAKTRKVPAPEVLAALAKIKKAKLDTSRFFETLRGTESPGRTWK

SEQ ID NO: 155862 - protein, 79 aa, Triticum aestivum
  Clone ID: PAT_TA_50280.pep
IIGIYQVMESFVKHSVSFFFLFVQNISAEILALEPSLHLSSHLKTPKYDLSRRLRLHFERSFSSPAMVGQPTMWCFWLT

SEQ ID NO: 155863 - protein, 72 aa, Triticum aestivum
  Clone ID: PAT_TA_50281.pep
NYSFDSSFEELISLDTGPNAGVYIKDRVQDYKWAFYTSFYKTRVTDIWIATRGCAQHGGYHKKSGATLYGES

SEQ ID NO: 155864 - protein, 124 aa, Triticum aestivum
  Clone ID: PAT_TA_50282.pep
MAAEPEICVLSNGRITANIASWGATITSLLVPDAQGDLADVVLGFDTLEPYLKGMAPYFGCIVGRVANRIKNGKFDLNGVEYSLPINNGPNSLHGGLKGFDKVVWDVVKRKEGEYPSITFQYES

SEQ ID NO: 155865 - protein, 90 aa, Triticum aestivum
  Clone ID: PAT_TA_50283.pep
PFSGVRGGSERGISAAYALRNLALTPWIPAYSSPPADFLLPHPHKNGFFASSEPPLGAQPIFLPVPSVSPTLLRRKRHAPAALRLRLVGW

SEQ ID NO: 155866 - protein, 143 aa, Triticum aestivum
  Clone ID: PAT_TA_50284.pep
KPPTILSKTKNTPVIPIPHLPRPQPAPPSPPRPQPAPPPSPRPQRMSPPPRPPDPPLPAVANSPARDPLGSTAADPVPQPATSHFAHHCGSRRRPSICAVAAPAWIRPLTAAPGASLAWVRPPRRPAPGFDRCAAPAPRSGHH

SEQ ID NO: 155867 - protein, 65 aa, Triticum aestivum
  Clone ID: PAT_TA_50285.pep
NQGVALRTAPLELRQAPVSGQRQILRLRGGFSRLLSWTSTSTCFTSTSTPLVFTSTSTAPCSIFR

SEQ ID NO: 155868 - protein, 123 aa, Triticum aestivum
  unsure (1)..(123): unsure at all Xaa locations
  Clone ID: PAT_TA_50286.pep
MAFAAPPPPCAKALFSRETSGRDTCHYARHTLCFPHLLLCFAVDHGVVLLRPTPHQRRLAALSYYIXDYKYTMDNAEDMSIVYWLLDEVYTDEAQTEALAPFFTGMVLNHEVSYLLLAEPTLE

SEQ ID NO: 155869 - protein, 65 aa, Triticum aestivum
  Clone ID: PAT_TA_50287.pep
AKDWCVSKGDIPYFETSAKDDYNVDPAFLCIAKLALEHEHDQDIYFNSVAEQGPKTEGQTSGCAC

SEQ ID NO: 155870 - protein, 96 aa, Triticum aestivum
  Clone ID: PAT_TA_50288.pep
MASQGVASMFALALLLGAFASIPQSVESIGVCYGMSANNLPAASTVVSMFKSNGINSMRLYAPDQAALQAVGRTGVNVVVGAPNDVLFNLPGRPGG

SEQ ID NO: 155871 - protein, 53 aa, Triticum aestivum
  Clone ID: PAT_TA_50289.pep
MMHFIVQKNKTWNLLPLPAVKKATGCKWVFTVNHTPQGNMDSHCCYLDGMTKV

SEQ ID NO: 155872 - protein, 91 aa, Triticum aestivum
  Clone ID: PAT_TA_50290.pep
GRTKRRYHNHVLTHHWLGRSNPGACLDERAFQAPAANQGHDLRDAGRVQRYRRSEYMMRQEGPCYEGTAHTAIRMIVRTTILMFLPETYGQ

SEQ ID NO: 155873 - protein, 130 aa, Triticum aestivum
  Clone ID: PAT_TA_50291.pep
RPDHRRHFPLLPSGQIEQSNERLLIKEDVCILFTGGNGDLLEPLNLLFLAHERQRRMGILRRAPSLMAGAGGAWMVEVGVAAAAAMTTLAAKRKRKGEASGDDRVSLHHLYIFFFYPFFSAQSMRWTWHA

SEQ ID NO: 155874 - protein, 57 aa, Triticum aestivum
  Clone ID: PAT_TA_50292.pep
RHSSPTACPSQPRLCTGRLVQLIRVFVDKSRHRTPSHVSHIVLEDGSCHIRALGCLA

SEQ ID NO: 155875 - protein, 38 aa, Triticum aestivum
  Clone ID: PAT_TA_50293.pep
ASHTMSIATCLFQVLLILTALPFICIDNGYMGMCPGYV

SEQ ID NO: 155876 - protein, 69 aa, Triticum aestivum
  Clone ID: PAT_TA_50294.pep
VANATPVRGSDDLLKAHNLDVDVRIQYNDQSDFERVARQFGVFEEWKVPLLTQFNSFIFRSQVWQVINL

SEQ ID NO: 155877 - protein, 59 aa, Triticum aestivum
  Clone ID: PAT_TA_50295.pep
MRCVLIRPSSSAHAEPKSGGGDGDGGHEPYEEYEVEILKPYCLKFAKGRDGGTYIKVIF

SEQ ID NO: 155878 - protein, 131 aa, Triticum aestivum
  unsure (1)..(131): unsure at all Xaa locations
  Clone ID: PAT_TA_50296.pep
MAMEGYDRXFWQFCYHLRLQTVSFSGLSLGDSIWSPDDSGHRARDANLFSPSSAPDNNNAVKMNGNGLNGPGLIVFGKLDFGATTTSKADRYNNVSLPVVDDANSKPYGNANGLYGAKPNNATNNGFGLNK

SEQ ID NO: 155879 - protein, 150 aa, Triticum aestivum
  Clone ID: PAT_TA_50297.pep
AFLFSSMKSKFVAIGCPDLAYFVDDGGYYVTGCMSVCRPSERALPGSCRGDDGCCQSNIPLGLASYRPHLRSFGRRQQQQGGTFLANSTGCAYAFMVDAWWFWYAGSHFNRTGDFAVPVVLDWAIRGAGAGASCAALRENATAYACRSAH

SEQ ID NO: 155880 - protein, 102 aa, Triticum aestivum
  Clone ID: PAT_TA_50298.pep
KRVILRQESEITMWINPKQITICQRVTVNLSQERYPSLEQQAATPKYQQEKARICSCRNTRSRNGPSGTHAPGFWKLGEKGKRRPAAAPGNLHGGSVGEPNA

SEQ ID NO: 155881 - protein, 42 aa, Triticum aestivum
  Clone ID: PAT_TA_50299.pep
LEARRALYIILQPYSFKLSSSYVHAPYTAITLYPQHDAQIMM

SEQ ID NO: 155882 - protein, 48 aa, Triticum aestivum
  Clone ID: PAT_TA_50300.pep
KHRTHVIGLRSRNVRMARDALHMVHRLRVEQAARPKLGSRDTSRFLVA

SEQ ID NO: 155883 - protein, 136 aa, Triticum aestivum
  Clone ID: PAT_TA_50301.pep
RNQETEWSNSLPPSSSSSPQGRFLPPSSPLRSTFPSPPWLLLPRACLLPRPAGLELLGALCSGRLVAAGSPAASPSRTAGRLALTLPPRAMGNCASAMDGLIPWGWGAKPAAANPAGMFASKRTTSSSTTATTGKL

SEQ ID NO: 155884 - protein, 134 aa, Triticum aestivum
  Clone ID: PAT_TA_50302.pep
MAQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESGQDILNLKPLIDKKQ

SEQ ID NO: 155885 - protein, 145 aa, Triticum aestivum
  Clone ID: PAT_TA_50303.pep
VTATHPPACSSSHPLWLHHLHASPPPLVAVVRSDHRVPCPCSKKSCRFQQFFLPVPAKTNSTPSGSSTCQKWLQLFCRLVPAIKISSCSIGARRLHRRPCWLQHAWSRGLWFQHIQSPPSPPPVSPASSYWLRQTMAAGEGSLCW

SEQ ID NO: 155886 - protein, 148 aa, Triticum aestivum
  Clone ID: PAT_TA_50304.pep
QRRVPQPSPEPEDYVGHASSIVRTAEAFDRLSIDAPSYVVTIVAPSKSKPVSASSLYSSETGAWNETTSLHHPEANAHFAASVHVGDALYFRGIGNYTIEYQLTTARLSVLEALAKCNGRLVTMEDGGLGFAAVDNTIITLWARETGP

SEQ ID NO: 155887 - protein, 115 aa, Triticum aestivum
  Clone ID: PAT_TA_50305.pep
MPQQQPGASAHVLDSVPLFVVILGADYTLEYETKDTDILAAFRVSPQPEVPTEEAGAAVAAESSTGTWTTVWTDGLTSLDRYKGRCYHIEPVAGEDSQWICYVAYPLDLFEEGPF

SEQ ID NO: 155888 - protein, 70 aa, Triticum aestivum
  Clone ID: PAT_TA_50306.pep
LLITRRHHIYRLIYGDDNDFVEDEDHDEYDVGGGHYDNTTTTACMTISTTTILTILCLTYTTEMVLRNTL

SEQ ID NO: 155889 - protein, 76 aa, Triticum aestivum
  Clone ID: PAT_TA_50307.pep
QLYLHDQSKFTTSVNDISNSQSPLPPPPTHLEFQTLTGALVFHSSLIFTRCNATSRTSSRLINSTTHTRPGGRRRE

SEQ ID NO: 155890 - protein, 68 aa, Triticum aestivum
  Clone ID: PAT_TA_50308.pep
KHSNLLLYNTAAKKLHSHTQVAHPIVKPMNKKPPYIHPMLSKRHRVHSHQHGLAHRLPMFAAVKFTSP

SEQ ID NO: 155891 - protein, 128 aa, Triticum aestivum
  Clone ID: PAT_TA_50309.pep
MSSLALFLPSSSSSLFLTKQVHPTKGRAPAVVRCSGGPTLSGSHEEEEREGVMVALVGRRNALASAAAACGVSVLGFAGNGLAAAKQGPLAGRIPGLSGPDQNGWKTYRRPDEKSGGHGVGWSPIIPY

SEQ ID NO: 155892 - protein, 131 aa, Triticum aestivum
  Clone ID: PAT_TA_50310.pep
MAAAAAAAAMARRLLSPSASTSARFLLSRHLSSAPSSFPRGGAPAALMDMLRPAAVAPQSFHQLIRNAGISTTRSLLADDDAMVPVSSPLSSPLGAAEGTDNKGAVVKRTKVQAIKKDIKQSPKKVNLVAK

SEQ ID NO: 155893 - protein, 131 aa, Triticum aestivum
  Clone ID: PAT_TA_50311.pep
MAATSASAGASLSVTAAAHRLRHRQLCACARGPATRPHPLLKLNRRSYAVAASSAAAMSPLSLWEGQGIRAELDAPGGVASGDVMGLLLRERIIFLGNEIEDFLADAVVSQLLLLDAMDSESDIRLFVNSP

SEQ ID NO: 155894 - protein, 135 aa, Triticum aestivum
  unsure (1)..(135): unsure at all Xaa locations
  Clone ID: PAT_TA_50312.pep
MALVLGILLVVVLLLAALAMTSAQKAKAPAKPAPAGDDAPEVVEAPAKPFPGVADAPGAAVADGKPPTDVTVMLEKYGKYSKFVQLLKETRVETHINAQLTDSYNGLTIFAXPTDAVMDGLKAGTLNGLSCQEQI

SEQ ID NO: 155895 - protein, 139 aa, Triticum aestivum
  Clone ID: PAT_TA_50313.pep
MPKHYRPAGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVH

SEQ ID NO: 155896 - protein, 49 aa, Triticum aestivum
  Clone ID: PAT_TA_50314.pep
DACVERCRRSFYRSFPHREAIVWHVDLSLQLLSCQPSDNYSTMSSRSIV

SEQ ID NO: 155897 - protein, 129 aa, Triticum aestivum
  unsure (1)..(129): unsure at all Xaa locations
  Clone ID: PAT_TA_50315.pep
MALPANAAASLSFPVIHVEKLETGERGATMGVIRDACENWGFFELLNHGISAELMDEVERVSKAHYAACREEQFKEFAAKTLEAGXEKVLDLLCENLGLEQGYLKRAFAGSRGPTFGTKVSKYPPCPRP

SEQ ID NO: 155898 - protein, 51 aa, Triticum aestivum
  Clone ID: PAT_TA_50316.pep
VCKALGIPTEQFELSMGMSGDFEQAIELGSTNVRVGSTIFGPREYPNQKQN

SEQ ID NO: 155899 - protein, 115 aa, Triticum aestivum
  unsure (1)..(115): unsure at all Xaa locations
  Clone ID: PAT_TA_50317.pep
VDKAEFKGIVLTVVTTGLDRKGADINNRYDVPPNLTLRNSEGADLDKMDHVIDSRLEXYMKAGXYQRTLSWKDEMRVKGITTMPILVIRVITSKDSWLNVQNGAIGMILCNHRGR

SEQ ID NO: 155900 - protein, 46 aa, Triticum aestivum
  Clone ID: PAT_TA_50318.pep
MTVLRIFDTLFLNWRNPFGGIMGTTGFRLTDSWMASNTTRFADPYM

SEQ ID NO: 155901 - protein, 32 aa, Triticum aestivum
  Clone ID: PAT_TA_50319.pep
SSCRILRNSMSDIHTSVVFMFTLGVNVNRYDP

SEQ ID NO: 155902 - protein, 51 aa, Triticum aestivum
  Clone ID: PAT_TA_50320.pep
GYSQIASTCPITQKFRRGGTTMPSGRIKEYIHYWIILFWNHRFQIDDLDLG

SEQ ID NO: 155903 - protein, 96 aa, Triticum aestivum
  Clone ID: PAT_TA_50321.pep
YVSSKKQSGVCFVRSWSEVTKVHGNDGMEPWLAVEFEQSCLAPVFNLMVIVIHDHERGWCLNFCVADLSSPETPWALERAEAMVRDSFAFRNRCHP

SEQ ID NO: 155904 - protein, 91 aa, Triticum aestivum
  Clone ID: PAT_TA_50322.pep
AGDRAVEFGVPLQAWHHRKASALARVRSCIAQVPEQLVQERRLPVLTDRNGVPQRVDPCPRVRGIELQPLQTGRPVYQVLISRGRSVGARA

SEQ ID NO: 155905 - protein, 73 aa, Triticum aestivum
  unsure (1)..(73): unsure at all Xaa locations
  Clone ID: PAT_TA_50323.pep
VLLTWVPTSTLLGLIQLYFDRGNFYXDFTSLAPELDVPGEISERKTYPFELSTDEMPYESYNGTKAQNDVHPY

SEQ ID NO: 155906 - protein, 104 aa, Triticum aestivum
  Clone ID: PAT_TA_50324.pep
MDPKLVEVTQLFDRFKASNFDVCATLLSQLKVLLTKFPSLPPLFQQTPNAVEELKLAREIYEQAAILSVKMEDHDASERDLSSLKPYYMYTCVIISPLFGGVPY

SEQ ID NO: 155907 - protein, 114 aa, Triticum aestivum
  Clone ID: PAT_TA_50325.pep
NSRADNFIEYTSDFCGALSTVVYNYHVHKSATANDNDKIGKMLVKSRYGCMNFEQVMMTVEKVLKYWHMPDDHHDSVKRMHHADTYMINAFLGDANQDSMKADSFHSIHILHTL

SEQ ID NO: 155908 - protein, 149 aa, Triticum aestivum
  Clone ID: PAT_TA_50326.pep
YRSRIPGPTDDGSEILSHSCILGIRSPVLRSMLEEARVEDGLRNILISGVPSQAVRVFIRFLYSSRFEQDEMKKYALHLLVLSHVYSVQSLKIVCTDQLERFFLAPDNAVDVLQLARLCDAPRLSLICTRMITGDFKTISLSEGWKVMR

SEQ ID NO: 155909 - protein, 71 aa, Triticum aestivum
  Clone ID: PAT_TA_50327.pep
ALAENLLLTLLDRRFIVTEILIYTFRIYYDLLHCVHTYINSQELGLWHIQRCLHSETRPCVTRGCCVDRCE

SEQ ID NO: 155910 - protein, 60 aa, Triticum aestivum
  Clone ID: PAT_TA_50328.pep
GTDQEFPGRPTEEVPHFTNPHQSNTHSSRLPQMALLAVKGMAISTAAFPGNNNGALPSPP

SEQ ID NO: 155911 - protein, 75 aa, Triticum aestivum
  Clone ID: PAT_TA_50329.pep
MEGRMSPYLYAMARVGYIAGVTRKSVTDDTPSYGAIETEISAVFLLAPQPEVPPVEVSAVLASESSTGTWTCCLV

SEQ ID NO: 155912 - protein, 82 aa, Triticum aestivum
  unsure (1)..(82): unsure at all Xaa locations
  Clone ID: PAT_TA_50330.pep
NSRADHILKKGNHILVTRATPILNDDVVKQCVDTRLGRDYPHKAVAQXAAVTALYVQYEADXLPNMSIILNRAPATAEPSST

SEQ ID NO: 155913 - protein, 89 aa, Triticum aestivum
  Clone ID: PAT_TA_50331.pep
MSDTDEHHVESKAESGASNTYPQQAGAIRKGGHIVINARPCKVVEVTTSMTGKHGHAKCHFVANEIFNGKRLDDIVPSSYNCDVPHVDC

SEQ ID NO: 155914 - protein, 93 aa, Triticum aestivum
  Clone ID: PAT_TA_50332.pep
LFSFFFFFFFFLFFFFFFFFFFFFFFFFFLFFFWKGAETNNLQGKACPFKIKSMGAPQNKCFPGPLLGLKPKPQKKGKIYYINPGGQSKRVTP

SEQ ID NO: 155915 - protein, 88 aa, Triticum aestivum
  Clone ID: PAT_TA_50333.pep
QIDGEWRYDSRDSVLEWSVMLIDQSNRSGSMEFSVPAADPSTFFPISVGFSASNTFSSMKVTAILPLQGGSSKYSQQVRLVTANYQVV

SEQ ID NO: 155916 - protein, 180 aa, Triticum aestivum
  Clone ID: PAT_TA_50334.pep
HVADYLDKNGRSVLVSNVPMKSKVSAKEQIKHLVYLLEHFATNSADEQDDFVVWLTDFRGWSISSSPLSITRESIHIIQNYYPGVIGVAIPFDPPRIFESFWKIAKNFVQPDMKEKVKFVYANKPESIKIMADIFDLDTLESSFGGRSTGTAFDINKYAERMRRADKMRGASKDSNGHNH

SEQ ID NO: 155917 - protein, 104 aa, Triticum aestivum
  unsure (1)..(104): unsure at all Xaa locations
  Clone ID: PAT_TA_50335.pep
RLGVEVTIYSGQLDLICATKGNTXWVQKLKWEGLKNFTGSPRKPLYCKGGEGEGEGEAAGTQAFLKSYKNLKFYWILGAGHMIPIDNPCPALNMLGDITQSPAR

SEQ ID NO: 155918 - protein, 153 aa, Triticum aestivum
  unsure (1)..(153): unsure at all Xaa locations
  Clone ID: PAT_TA_50336.pep
MANPRVIFDMTVGGAPAGRIEMELNKDAVPRTEENFRALRTGEKGGGKSGKPVNYKGSAYHRESPELMCQGGDYTRGNGTGGEAIYGXEKGDDERGGHKDTKPGXLSMGQRGGPTANGARERHPGPGPTARGGGTGAGPGGGGGGGGEGGGGG

SEQ ID NO: 155919 - protein, 115 aa, Triticum aestivum
  unsure (1)..(115): unsure at all Xaa locations
  Clone ID: PAT_TA_50337.pep
KSXXNXEKXGKRQXXXRXXXKGXTKXPNXXQKHXNXGEXEXXEDHRXGKNXXEXXGRXNKRXXNRXRXEEXAKENEGXTARRRPXRQGGNRERTTAXGTKDXEEARRKKEAAKRK

SEQ ID NO: 155920 - protein, 76 aa, Triticum aestivum
  Clone ID: PAT_TA_50338.pep
FYCLTNSTSVGTSAKATSSSSRNFPCIDRFRDALGGYNIDSFEKAKPYVPLLCCINESSIGLDDIRKVNRYADELN

SEQ ID NO: 155921 - protein, 92 aa, Triticum aestivum
  Clone ID: PAT_TA_50339.pep
MGAVAALLLAGLLAALTYVLRLVHSILWVPHRLERRLRRQGIRGPPRSLLSGNAAEYVAMTKAGQSAPLASFHHGFIGRAAPQYREWGGAER

SEQ ID NO: 155922 - protein, 132 aa, Triticum aestivum
  unsure (1)..(132): unsure at all Xaa locations
  Clone ID: PAT_TA_50340.pep
LVLDRERPLASPEEAEAEGGDPXXPGALGGPCLHVLAGVSEQXNNKRIVLALQSGLKSEILWGLNALTGLCFKEKDELARGYNXPLAKGPGRWDALLQGIDDWGERGGGRGHTEPPRVGTLGGSTAIAGLRP

SEQ ID NO: 155923 - protein, 190 aa, Triticum aestivum
  unsure (1)..(190): unsure at all Xaa locations
  Clone ID: PAT_TA_50341.pep
RRGRTRGRDPSTAWVGSDGMWRILVAAQVGSNNTGIASTLVYRSKDFRHWERNASPLYTSRAAGMVECPDLFPVAEPGMDEGRLDYAAGTASGAMRHVLKLSVMNTTEDYYAVGQYDNVADTFTPEVDGERIIEDCRTWRRFDYGHVYASKSFFDARKNRRVLWAWVNESDSEDDDIARGXWSGLQDCFQ

SEQ ID NO: 155924 - protein, 100 aa, Triticum aestivum
  Clone ID: PAT_TA_50342.pep
LSKKKSKDPTGGSKKQNDGSKILGWLQQKHHSKNLDPSKNCGSWMQQIQAPVVAFSVPIAAKSHHRWPPPPASPVAKRPTSSRGRTRRWTAMASPGCISP

SEQ ID NO: 155925 - protein, 155 aa, Triticum aestivum
  unsure (1)..(155): unsure at all Xaa locations
  Clone ID: PAT_TA_50343.pep
MRPAWFSCIKSRSERYVREQKMPDRAIAVGEXREGTQACDLKAVLYEYINTLNCPFADQGSSVEHPEADPLKRGDTPSXLISAGIAHAYAPXMALSKGANICRGNGNPAVTFHASRGGNMTLFTGPLYWIAHLLRFTAVCFLLRLSTGGVPTGTF

SEQ ID NO: 155926 - protein, 132 aa, Triticum aestivum
  Clone ID: PAT_TA_50344.pep
FLAMLLRAAIYLATSLACRLDLETRMAAQLGQAELDDLLIPSSSPEGAGTAYDVDAAHRILAGYLENEGETTRLDYNTDDDFASAAAPPNDVGPGGKLMESYLAEISSDANLPGDKGTGLAELIPERARGNE

SEQ ID NO: 155927 - protein, 114 aa, Triticum aestivum
  Clone ID: PAT_TA_50345.pep
VGAGKVISVHTLEQWTMQIEEANAAKKLVVVDFTASWCGPCRIMAPVFADLAKKFPNAVFLKVDVDELKPIAEQFSVEAMPTFLFIKEGDVKDRVVGAIKEELTNKVGLHAAAQ

SEQ ID NO: 155928 - protein, 53 aa, Triticum aestivum
  Clone ID: PAT_TA_50346.pep
REYKETNCCSSSLPYRKKRPQRSRDGPNTHSETTKRRKEGNQQLEARPTGPQS

SEQ ID NO: 155929 - protein, 58 aa, Triticum aestivum
  Clone ID: PAT_TA_50347.pep
ADGMDSYGDGYQVIFAEAPASTTGVITSESRKLKMLGKAFARAERAKRDGSGKIPGGN

SEQ ID NO: 155930 - protein, 112 aa, Triticum aestivum
  Clone ID: PAT_TA_50348.pep
YLPPLSTEAFLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 155931 - protein, 78 aa, Triticum aestivum
  Clone ID: PAT_TA_50349.pep
ESLGKSISYKEHRAICKAHLKLRLSHNCCQTWRAPSSNLFCLPLDYRKIKRILSLENSGLTDVFTVAYAKRSWHLTKA

SEQ ID NO: 155932 - protein, 55 aa, Triticum aestivum
  Clone ID: PAT_TA_50350.pep
PAPPPWCYRIEGVNPPQKGRPLVDQYLGSPPGFGWGKDPPPGALPEPKKVVGVED

SEQ ID NO: 155933 - protein, 77 aa, Triticum aestivum
  Clone ID: PAT_TA_50351.pep
KRAATHVCGVDLTDKVVDVIFHVFEANCDGNLSSEEFLRALQRREINIRQPTTPGLMGVFSCWLNCTKCSFQQMLLQ

SEQ ID NO: 155934 - protein, 167 aa, Triticum aestivum
  Clone ID: PAT_TA_50352.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIPSCKEKFEPSIG

SEQ ID NO: 155935 - protein, 42 aa, Triticum aestivum
  unsure (1)..(42): unsure at all Xaa locations
  Clone ID: PAT_TA_50353.pep
ECCDACETYIXGKCVKITPAKAEHIKHYKCPNCSGSGKRARA

SEQ ID NO: 155936 - protein, 97 aa, Triticum aestivum
  unsure (1)..(97): unsure at all Xaa locations
  Clone ID: PAT_TA_50354.pep
RTLAGYNIQXESSLHLELRLRGGMQIFDKTLTGKTITLEVESYDTIDNGKAKIQNKEGIPPDQQRLSYAGKQLEDGRTLTDNNNQKESTLHLGLRLR

SEQ ID NO: 155937 - protein, 105 aa, Triticum aestivum
  unsure (1)..(105): unsure at all Xaa locations
  Clone ID: PAT_TA_50355.pep
KXGQTXEHAXXXXXXGXKXENXXXNKKXATXPKXPKXXXEEXGKEGXXXXKKXGXNXDKGPXGPNXGXEXDNXXERXTNXDXXKGPTXXEARDQSNEPKRPTDKP

SEQ ID NO: 155938 - protein, 117 aa, Triticum aestivum
  unsure (1)..(117): unsure at all Xaa locations
  Clone ID: PAT_TA_50356.pep
CSAGWLPGAFLLGFAAAVGGGPGFVAGVPAGGGLAVRAGSPCPSARGRRPWSFARRRCXCWCCWGCRWWRRGCPAPSRSRRPPPPLLGLRGRAGARAGAXXLVLXDVAPFFRXLGGR

SEQ ID NO: 155939 - protein, 110 aa, Triticum aestivum
  unsure (1)..(110): unsure at all Xaa locations
  Clone ID: PAT_TA_50357.pep
PATAQPPRGRSIKRNPLGKEPXLETPDGAGFESNAIARYVARSKGDSLLWGXSLIEYARGEQGMDYGATEEEPKSARGLDPRLXYMPYNAQAEECGIAGXKRALEAWNTH

SEQ ID NO: 155940 - protein, 161 aa, Triticum aestivum; identical to SEQ ID NO: 129051
  Clone ID: PAT_TA_50358.pep

SEQ ID NO: 155941 - protein, 130 aa, Triticum aestivum
  unsure (1)..(130): unsure at all Xaa locations
  Clone ID: PAT_TA_50359.pep
RTESPGRPSGRRRRRRRPXRGGGGGRRRRSEGDGGGAERAGGTXHRQPAPAQGAGRPGPGPRGETPEEARGKSSADKEHRARRKARRKGRPAHNGXQTRESTQRKARGAAARGRREQRRTEPGEARGERR

SEQ ID NO: 155942 - protein, 101 aa, Triticum aestivum
  unsure (1)..(101): unsure at all Xaa locations
  Clone ID: PAT_TA_50360.pep
PSRHAPPAGARREEDGGERTAPAAEDQTRAAXXKAEPEXXGQRRGGGXRXQKRXDTSRTAPXAXNGRADXAAHGAAXDADEHXANTPASRHRREPEGAEAP

SEQ ID NO: 155943 - protein, 175 aa, Triticum aestivum
  Clone ID: PAT_TA_50361.pep
GIWLLPPSPQPLADSGQGGFAVADAGFGDVGTAEEPEEEKRRFLFRDSYRRRVFFNYEKRIRTRSPPEKIFEYFASIRNPEGEVYMLPADLMRAIVPVFPPSESNVVREGRLRGERNPGELQCAPSEFFMLFDTNGDGLISFAEYIFFVTLLNIPESSFNIAFKMFDLDHNGGNR

SEQ ID NO: 155944 - protein, 50 aa, Triticum aestivum
  Clone ID: PAT_TA_50362.pep
PYAAKAEKLKAEYAKKIDAYNNPQAGEASGDSDKSKSEVNDEDDGSEGDE

SEQ ID NO: 155945 - protein, 62 aa, Triticum aestivum
  Clone ID: PAT_TA_50363.pep
RILVKQLGKIQRGSPTRAKEDDPTQDPTRKPKATSFSREDGGSVTSPRTCYTFLLLLAQVNQ

SEQ ID NO: 155946 - protein, 111 aa, Triticum aestivum
  Clone ID: PAT_TA_50364.pep
DRGGFGHTSIVKQGRGARHGPRNCSRGFMNTEEESPSPPVHTKAQHAAASLDLGHTGLVRWMTHGLRVYTTTQQHGGTLDPKFARHPPAGDLGRPENTISFHGPPPIVCYE

SEQ ID NO: 155947 - protein, 56 aa, Triticum aestivum
  Clone ID: PAT_TA_50365.pep
GKPGKVSGQYGALCLENQGYPYAVNPPNFPSSILRPGPVYKPHMVFRFSSRAPYEG

SEQ ID NO: 155948 - protein, 83 aa, Triticum aestivum
  Clone ID: PAT_TA_50366.pep
LGRPFHIEIISRFYSCRHAPQTVSTDRPIADPNTDRFKADEESFAYMHHGMREPREKLKQPVTAKKGDTKHYTGGWTWTPILS

SEQ ID NO: 155949 - protein, 87 aa, Triticum aestivum
  Clone ID: PAT_TA_50367.pep
PPVPFGHPFCGGLGRGPSHASPVNPFRGLAPCQTQKGNGCAPLTGTPVPPLGGPTSGPLLRGGPFRFWPPFPLKLVPPGKPGGPVFF

SEQ ID NO: 155950 - protein, 65 aa, Triticum aestivum
  Clone ID: PAT_TA_50368.pep
RDAVLLVFATKQDFPNALNVAGIPDKFGLPSLRQGHWYFQGPCVPPGEGLYKGLDWLSTNFASKP

SEQ ID NO: 155951 - protein, 104 aa, Triticum aestivum
  Clone ID: PAT_TA_50369.pep
MCTDLTRSTRRDKVYKLAYGGFVDMDMEEQGSTISLRTLVDYSVVESFGGGGRTCMTARVYPEHAEKSNSHVFVFNNGTGGVKVTRLDAWRLKTATVNVVPLRG

SEQ ID NO: 155952 - protein, 59 aa, Triticum aestivum
  Clone ID: PAT_TA_50370.pep
INYEESRDRFTTHRVTCGCYSPGINEACVDAAVIADWHHKITSDKPPPPPKKKGDAKGP

SEQ ID NO: 155953 - protein, 172 aa, Triticum aestivum
  Clone ID: PAT_TA_50371.pep
FIIGNKASATVQPFLLLHLDIFPDAVQTLDDALHLFSTPESLEGYRTTAGKAGVVTARKSFKIHELSKIMILHLKRFSYGNRGCTKLYKPLHFPLELVLNRDLLSSPSSEGRRYELVATITHHGSGPSRGHYTADAKRDGGQWLRFDDGHVMPINVNKVLHNPAYILFYEQV

SEQ ID NO: 155954 - protein, 57 aa, Triticum aestivum
  Clone ID: PAT_TA_50372.pep
RYIVIYAKEFIYLESEERQYYLLSGSFFRYQKFCAIHSGLPLPFSIGEAEQSKPLKR

SEQ ID NO: 155955 - protein, 73 aa, Triticum aestivum
  Clone ID: PAT_TA_50373.pep
FGYKFKLNTITVLCLILGFKDTLQPGYIHTLESFRGALSCGVFRYIHLRLNANEGLFGRTTKAHQPKYLQDTS

SEQ ID NO: 155956 - protein, 119 aa, Triticum aestivum
  Clone ID: PAT_TA_50374.pep
FINGSSSTYANFCFGWINVKDVALAHILAYEVPSANGRYCMVERVIHHSDLVKIIHEMYPEFPVPDKCADDAPFATIYQVSKNKIRSLGMELTPLETSLKETIESLREKGFVTSESSHL

SEQ ID NO: 155957 - protein, 60 aa, Triticum aestivum
  Clone ID: PAT_TA_50375.pep
LNIKPLIWFKPYVLTYPATEDPYTHESEDLLQHNPHNMQKNAEMVMIQGYVHNTHHPRCK

SEQ ID NO: 155958 - protein, 56 aa, Triticum aestivum
  Clone ID: PAT_TA_50376.pep
SCSPFREGGSKVGSSHNVVLQRALFKVLMGVQCVSVYIVSLFLSIPVNLGISYSAI

SEQ ID NO: 155959 - protein, 73 aa, Triticum aestivum
  Clone ID: PAT_TA_50377.pep
KINQRGFFTRGKKGVFLHLGPKGDPSLKLTPKKTFERADLKKKKPTIIPFTDPWPGKLCPKTLQFWTGVHCTH

SEQ ID NO: 155960 - protein, 132 aa, Triticum aestivum
  Clone ID: PAT_TA_50378.pep
RIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 155961 - protein, 97 aa, Triticum aestivum
  Clone ID: PAT_TA_50379.pep
PRRQYWSWRAAPASPGFSTRHSLPVGSGLRSDQGRARRRFASGCVPRARLPRRATLRRRTHAFGYSKWWWLWLLCPDPFPFFYVQALLSCFVLRISM

SEQ ID NO: 155962 - protein, 81 aa, Triticum aestivum
  Clone ID: PAT_TA_50380.pep
VYTTGNPYGIAADIVFSMPCRSKGDGDYELVKDVAMDDFLWGRIKKSEAELIAEKRCVAHLTGEGNAFCDLPGDTMLPGEM

SEQ ID NO: 155963 - protein, 100 aa, Triticum aestivum
  Clone ID: PAT_TA_50381.pep
VHGHRRRAPKAAQGTGTEAEEQADTAATEGRRRIRHRRRRRRRRSGGLELVIVSCVHAGKHVCVNLVGTAARRPAPPPVILPSGGCTWTNRLTNVPHPLI

SEQ ID NO: 155964 - protein, 74 aa, Triticum aestivum
  Clone ID: PAT_TA_50382.pep
ANSLHGVGDSFSTHLTLSESLDAIKRIHPKRALLIGMRHFFEHERENQMLAEWSIREEIPTQLAHDGLRVFIDI

SEQ ID NO: 155965 - protein, 85 aa, Triticum aestivum
  Clone ID: PAT_TA_50383.pep
GVFSRYYNKLSRKYIFFMHMVELYAPYGLFKGCFDDTNLERLRMAMNTDQNNNGSYYFDFDPKSVDWDDYFYRVHIPGVVKYTCH

SEQ ID NO: 155966 - protein, 143 aa, Triticum aestivum
  unsure (1)..(143): unsure at all Xaa locations
  Clone ID: PAT_TA_50384.pep
MACNVVVFCYSLEYVVGANGAEQTVVSGSMEVLIPCWTVATSGVPVPEQLFNVSICHYNHLNLFHHGDFSRSFGRTFDPSXRELEVAAPILLERDDGHIHRSGSHGDIVFLTSQGXVTLYXPGLLGHDATWRWQLSTDATWTN

SEQ ID NO: 155967 - protein, 90 aa, Triticum aestivum
  Clone ID: PAT_TA_50385.pep
IMNPCLSYGASRRSSRVAFMMARYVEAYVNMRHFISMVQVNRPVGPATCMLLACDRPPYRSRKCQTSAQCEVMRAAYPDNVSIILVCVKE

SEQ ID NO: 155968 - protein, 92 aa, Triticum aestivum
  unsure (1)..(92): unsure at all Xaa locations
  Clone ID: PAT_TA_50386.pep
NERIALQIPAHLSTNDPSLLQSLDVHDSKAIDSXPDAVVRLHAVPLRDLLVTXSPNRSSQIAPPITIITLPLLRTXGRTKGKVLIRGIIRER

SEQ ID NO: 155969 - protein, 88 aa, Triticum aestivum
  unsure (1)..(88): unsure at all Xaa locations
  Clone ID: PAT_TA_50387.pep
LWDVLMXAVQRSGKNQQHNCNAALRQVKAWTELLNAXFTKSKLKQNVGGKLXTQCYEDAKPMKLFPXFIRTLYDQDELAXDTMILWPP

SEQ ID NO: 155970 - protein, 102 aa, Triticum aestivum
  Clone ID: PAT_TA_50388.pep
APRRPRVHHRADVHPEGASCIGRTGSPIPSGEVVKYRRTKVSWFNHAAEQGSCARCVPVPAGDRVRPVPGGTYIEVTGRCVAFGETQGRMARRALFRISVHR

SEQ ID NO: 155971 - protein, 190 aa, Triticum aestivum
  Clone ID: PAT_TA_50389.pep
MACSRGIFLSATFAVLSILSLPRATHGWANGGATWYGGPNGDGSEGGACGYKSDVGQDPFSSLIAAGGVGIFKNGKGCGSCYQVRCKENPECSGKHVTVVITDQCPDAQCQKRPHFDMSGTAFGAMAKPGMADKLRNAGVLNIEFERVPCKYHGKKISFKMDSGANPFYLAMLVEYEAGDGDLNSVEVME

SEQ ID NO: 155972 - protein, 134 aa, Triticum aestivum
  Clone ID: PAT_TA_50390.pep
VATTRTVGHLSKSTEVMKLVNNLMKAPEIAVTMQEFSKEMTKAGVMEEMVNDAMDSALDDEGMEEEIEEEVDKVLSAIAGETASQLPDAVRKQKEKVTQPSTSEPAQRTAVAESVDDDDDDLEKIRERLAKVRS

SEQ ID NO: 155973 - protein, 198 aa, Triticum aestivum
  unsure (1)..(198): unsure at all Xaa locations
  Clone ID: PAT_TA_50391.pep
GPENRRTPMMASNPGEIPEYELNPGELQFRKGDEVLKGTYQVAKWNGTKVSVKIVDRETYSDQEAINSFRHELTVFEKVRHPNVVQFIGAVTQNIPMMIVSEYHANADLGSLIQRKGRLNGHKVLRYALDIARGMTYLHQCKPDPIIHCDLKPKCXNIFLDNGGLTKVGGFGLMRLSKMAPDKVKLMNHEAIVDTFSY

SEQ ID NO: 155974 - protein, 100 aa, Triticum aestivum
  Clone ID: PAT_TA_50392.pep
PPFKTLRGKPANVGKKERKKTKRTGARGLANVTVPLGGTPPPPGVKGPVKGGFPLPIRVGKCLERRSVGAFLVLTQLGKRGFFSKGFNWGTPGFFPSPRC

SEQ ID NO: 155975 - protein, 200 aa, Triticum aestivum
  Clone ID: PAT_TA_50393.pep
YSVKWVQTNVAFARRFEVYLDYPFFEHQIHWFSIFNSFMMVIFLTGLVSMILMRTLRNDYAKYAREDDDLESLERDVSEESGWKLVHGDVFRPPCNLMFLSAVVGIGTQMAALILLVIVLAIVGMLYVGRGAIITTFIVCYALTSFISGYVSGGLYSRNGGKNWIKSMVLTASLFPFLCFSIGLVLNTIAIFYHSLAAIP

SEQ ID NO: 155976 - protein, 75 aa, Triticum aestivum; identical to SEQ ID NO: 106874
  Clone ID: PAT_TA_50394.pep

SEQ ID NO: 155977 - protein, 73 aa, Triticum aestivum
  Clone ID: PAT_TA_50395.pep
NSRADVVTGTRVKTHFARPNWRKVYKDIALKHAGQRVGVFYCGAPVLIKELRQLAQDFSRKTSTKFEFHKENF

SEQ ID NO: 155978 - protein, 33 aa, Triticum aestivum
  unsure (1)..(33): unsure at all Xaa locations
  Clone ID: PAT_TA_50396.pep
QKYQGAGADMPXGMDEDAPAASGGAGPKIEEVD

SEQ ID NO: 155979 - protein, 208 aa, Triticum aestivum
  Clone ID: PAT_TA_50397.pep
NDRQQPYLPLSSCSWDSSSSLEAMSGNRDASGHVMAKGGTKSDIFAPRHDYLTSCPTTGPHMRRSYTEAAKVDCSFDCHPEHHYKGLDRLTPFASCNGQSIECRSEIVDMPRGGRCVDEATSFSSRWCFENGGRGSSLPGGLTYGDEIPSLSSRRCNGSGVLSRSSQWHYGAEISSLSSRQGYGDEIPSLSNQKFNGISRSNHWNYSA

SEQ ID NO: 155980 - protein, 168 aa, Triticum aestivum
  Clone ID: PAT_TA_50398.pep
AAWAGAFYRTRALPRPVWNAASQVLMCAGYVVMAFGMPGSLFVGSVVVGVCYGVRLAVTVPTASELFGLKYYGLIYNILILNLPLGSFLFSGLLAGLLYDAEATKVPGGGNTCSGAHCYRLVFVVMAAACVVGFGLDVLLSLRTRRVYAKIHQAKRAKRSAAAAQRVS

SEQ ID NO: 155981 - protein, 101 aa, Triticum aestivum
  unsure (1)..(101): unsure at all Xaa locations
  Clone ID: PAT_TA_50399.pep
NRXMIXKXGEHQQKSTGGDGRDEGMEIVVWCQRAFGVDCWLADYGVLPAMRSRRRWRLTGRREPFCLHSRVFWQGENYHLEGKRQMKTCMIVYAIDIPFSS

SEQ ID NO: 155982 - protein, 88 aa, Triticum aestivum
  Clone ID: PAT_TA_50400.pep
GSTCLYEHMGISPDGKVLAVTSGSTLQWLCAETGAVLDTAEKAHEGAISGIAWAPRTIPNGGAPAFILASCGDDKKVKLWLAPEVSST

SEQ ID NO: 155983 - protein, 57 aa, Triticum aestivum
  Clone ID: PAT_TA_50401.pep
GKNPILFFDTCTKAQFLVVNLHARQKGGLFHDGVPVNKRYIPPFPPGFFTQGKPRPR

SEQ ID NO: 155984 - protein, 106 aa, Triticum aestivum
  unsure (1)..(106): unsure at all Xaa locations
  Clone ID: PAT_TA_50402.pep
RLFPKKFQKPFPTAGISHIIDITGTPIGKRYARTNEIGVPLAITVDSTTSVTVRDRDSKDQIRVEVDXVALVVKEVTDGQSTWADIMWRYPAHTALATDEEEASET

SEQ ID NO: 155985 - protein, 132 aa, Triticum aestivum
  Clone ID: PAT_TA_50403.pep
MQEFPRGYHEETGITFSSFYPGCIATRGLFGEHIPLFRTLFPRFQKFITKGFVSEAESGKRLAQVVGEPSLTKSGVYWSWNKDWGSFENQLSQGARDPEKARKVWELSEKLVGFACFPTPLGLGPGPGKACI

SEQ ID NO: 155986 - protein, 83 aa, Triticum aestivum
  Clone ID: PAT_TA_50404.pep
TMNFPGSTQSVCFQRMKELPPASASTYCTAIVAYISSTSSIPIESAYILSIFAQKNQGMYCMYVSPSLLRKTLQGRRCCSSSV

SEQ ID NO: 155987 - protein, 44 aa, Triticum aestivum
  Clone ID: PAT_TA_50405.pep
EAPCAGKHLFWFHFNSTYLKKKSYKLQSGNNRVHLFALAISLQG

SEQ ID NO: 155988 - protein, 38 aa, Triticum aestivum
  unsure (1)..(38): unsure at all Xaa locations
  Clone ID: PAT_TA_50406.pep
EQICSGFHFNLRRHSEQKRGTXNKVTRERXGRGHNLNG

SEQ ID NO: 155989 - protein, 61 aa, Triticum aestivum
  Clone ID: PAT_TA_50407.pep
EITGVTFRGPHESPLDSLVGQGFLGTGGPPAILTSEDPLEGKELEFYMRKVQKKKGKGAPA

SEQ ID NO: 155990 - protein, 48 aa, Triticum aestivum
  Clone ID: PAT_TA_50408.pep
YSVHVPFLKELEIGDEAPPLAGHTEEWTDASELSPGSLFSNLGAGQAR

SEQ ID NO: 155991 - protein, 173 aa, Triticum aestivum
  unsure (1)..(173): unsure at all Xaa locations
  Clone ID: PAT_TA_50409.pep
SLIHSCHSRPAAAACIRPGRKRAERGWSAVGADKDSCMHSIXLPYNYILRITLKNTILLGLVKTLMANGDKLSIPNDVAAKFPIAANPKTTNMENRMLXDMLTSNNACVITLTERXTDGRLFKGYRSAPVCIYLTPNIGRCYSCIDPKTHVTSDTRHPCTSCVLYIRYARTSD

SEQ ID NO: 155992 - protein, 147 aa, Triticum aestivum
  unsure (1)..(147): unsure at all Xaa locations
  Clone ID: PAT_TA_50410.pep
LIPPQSMNSSMYMHQAMLETSSLSFIESRSKHGRKRGADGGSDLRLGVAGTLDRKPRRSPATRSPKTPPPHRRRRRGAARTGGLAPRGGRIRRRRRSGARVGAKGRASSSPPFFRVAAVSGGAVIGRGEQGERRGGARXRRRCTPLP

SEQ ID NO: 155993 - protein, 163 aa, Triticum aestivum
  Clone ID: PAT_TA_50411.pep
MADTPTSRMIHPFSNMQRQNPKQFQFQYSDNPQHPCRPYQPSPDTHVVPQHLYSLKSSSDASYENQVAQMKHTLDSSAAAGCMRHDSPSSHSFTPPSIRSGSGSPSSHDDSRSDSTNGSPVSASCVTVTTEDPNDLKQKLKDLEAEMLGPDAEIVNSLESSVA

SEQ ID NO: 155994 - protein, 122 aa, Triticum aestivum
  unsure (1)..(122): unsure at all Xaa locations
  Clone ID: PAT_TA_50412.pep
APVLPHYGAXTEEAPSLANSLGTLCKACRPEVEVEALVIQGPKLGTILSQVKKLEASVLVLSQTKPSTFCWLNCLARSSGEELVEQCINQAECLTLAVRKQSKGVGGYLVSTRWQKNFWLLA

SEQ ID NO: 155995 - protein, 81 aa, Triticum aestivum
  unsure (1)..(81): unsure at all Xaa locations
  Clone ID: PAT_TA_50413.pep
QLPADDXXXIEDAVDAAIQWLDANQLGEVDEFEDKMKELEGLCNPIIAKMYQGAGADMPGGMDEDAPAASGGAGPKIEEVD

SEQ ID NO: 155996 - protein, 45 aa, Triticum aestivum
  Clone ID: PAT_TA_50414.pep
GRVGKKKGYKVAKLHKTPQSDPPPKKNSAPPDKKGTWWFKSLFGK

SEQ ID NO: 155997 - protein, 125 aa, Triticum aestivum
  unsure (1)..(125): unsure at all Xaa locations
  Clone ID: PAT_TA_50415.pep
HRLPSPKLHGSTQGPPVKLHYRAPSGLAVLHRSTTAMRLMRRSTRRRRADAMTQHDADGKWGDAARGGDDGXDAEXGXXVVHPPSPPPPCPAQVGASPMVDVDLAGVGSSLQQQVEEKKKKKGRD

SEQ ID NO: 155998 - protein, 55 aa, Triticum aestivum
  Clone ID: PAT_TA_50416.pep
GGYPAKGYAPGGYPGKPGPHPGGQMGLYPPGHGGGHGHGYSGGKQMGGGKHGGRK

SEQ ID NO: 155999 - protein, 93 aa, Triticum aestivum
  Clone ID: PAT_TA_50417.pep
EVAAAASVLARLSRMGGSSNGAAAKARLVAGGSASHAGLLAGSIRCKAAHRKHLMLLTATGRRGDGGCWCCEDDEYPSQVVCISFSSQRCISC

SEQ ID NO: 156000 - protein, 148 aa, Triticum aestivum
  Clone ID: PAT_TA_50418.pep
EGGSFFLPTRRFFFSQVNPPTRPDQTRPGNKRISSLLFSLSFYNHDRQKGEGRGKEATEINKRTGPLFITKKASNSIWINNNNISLPSSWLLFLAFKLPFFFQPVRLPLLIPPVALFLAGALVKIIIPATARIRIVVVVTKASSILVA

SEQ ID NO: 156001 - protein, 155 aa, Triticum aestivum
  Clone ID: PAT_TA_50419.pep
AFVLVQLYYVKRYNVYAWWYLGLLLLLCMAAGITLPGGLVVLLWHLSEKRRMQDDRWDVNARAGADAEQTTNAAGGADASGASLAAMRTTRYGCRPKFHAEFAAFAERAGGAAADVGVLVCGPAGLQASVARECRSQNLRRGGAVFHFNSHSFDL

SEQ ID NO: 156002 - protein, 75 aa, Triticum aestivum
  Clone ID: PAT_TA_50420.pep
LGKGLFFNRSRKHYLNPVGVKLGTHCGSGLNGWGAWVIRHLFGNPWFPVGWFLGPMPVLGTIIQTIIVVLKYAQR

SEQ ID NO: 156003 - protein, 123 aa, Triticum aestivum
  Clone ID: PAT_TA_50421.pep
KTGFFPSPFFPLGLLNLFQKGWESFTPWPGTLKGGPPLGVFFISIFPINGGGGKKYHFFFWSFSPGNFFWPLFSPPNENPAPPLIFPVFFGVFQKQNPFFIFFGSPLLEAGKKFLPPLLHGPF

SEQ ID NO: 156004 - protein, 70 aa, Triticum aestivum
  Clone ID: PAT_TA_50422.pep
VLSSELDILEKFGNLELYFGWCPCTFLCVIFRAEHFRELIDITKEYCDHAFRNKSFGIKLLRKQRSMRNY

SEQ ID NO: 156005 - protein, 87 aa, Triticum aestivum
  Clone ID: PAT_TA_50423.pep
GNVTSPVAPCMSYARGQGSAPSGGCCSGVRPLNAKGSPPADRKGGCNCLKNLGGWGISMGNPPNIPGKWGVSVFFPINPKTNCTTLH

SEQ ID NO: 156006 - protein, 165 aa, Triticum aestivum
  unsure (1)..(165): unsure at all Xaa locations
  Clone ID: PAT_TA_50424.pep
GGHIHSGPVVRDTLQGEREXMTIGCVRLXRDDFIENYRAPGIFLTXRHWLSMPCVIPAASRGIXHGRHMPTDDXIFGDDSGLQLGGXTLGHTCXNAPAALANRAGLEACAQALNEGRDLASDCNEIIRTACRWRTVLSPGCDIWNVIKCEYEPRDTIDLLYNTKD

SEQ ID NO: 156007 - protein, 95 aa, Triticum aestivum
  Clone ID: PAT_TA_50425.pep
PLVTIKTYIVDILYNIMRPCIYIATDSIHIRACFLEPCSYMNMDIHIFLGTNKKDKWRRKTQSNVRVDKTAMALYIWPVVSELFRPCRTPRSPVA

SEQ ID NO: 156008 - protein, 145 aa, Triticum aestivum
  unsure (1)..(145): unsure at all Xaa locations
  Clone ID: PAT_TA_50426.pep
MAVRYEIAAAAXKLAECQETMLILGRQLQAMRPPAESMGASPTRQRMEDFLQDAAGTTERGEYAQKPSGQHDIDQEMLESGNVSPLNGYKTHMTPSDVDGSPSLSTNSSKRPKHRSRSSSSSSFANQLPEKQSRGFSQFFAKGKK

SEQ ID NO: 156009 - protein, 83 aa, Triticum aestivum
  unsure (1)..(83): unsure at all Xaa locations
  Clone ID: PAT_TA_50427.pep
MGEPFLREHNRSRGYYDCXYWTMWKLPMFGRTDATQVLNEVEEVKKEYPDAYVRVIGFDNLRQVQCVSFIAFRPPGCEESWQA

SEQ ID NO: 156010 - protein, 95 aa, Triticum aestivum
  unsure (1)..(95): unsure at all Xaa locations
  Clone ID: PAT_TA_50428.pep
MGMGDYTSVWACPAACYLKMFPFHMXFLTTLEDLKYAETHEWVKGDGDYRIEGITDHTKNHAWDVAQXRSQKTGSVHSQGTKFVAGESFNATIIH

SEQ ID NO: 156011 - protein, 121 aa, Triticum aestivum
  unsure (1)..(121): unsure at all Xaa locations
  Clone ID: PAT_TA_50429.pep
RPRSELATRRPRNSAPVHTEAWNKSHAVATWGPWHPARADAQVTMKDTELFIQRVRLQGLAWXIAQELKTELTLQSCALSGLKEAADAHMARVLPDTNVCAIHAKRIIILTNDLYLARIIH

SEQ ID NO: 156012 - protein, 51 aa, Triticum aestivum
  Clone ID: PAT_TA_50430.pep
MKGSLFYTCKHPEKCDILSHTASVGVPQQLAGKSMSLMPKSVAYISSTSMV

SEQ ID NO: 156013 - protein, 50 aa, Triticum aestivum
  Clone ID: PAT_TA_50431.pep
VHNNFTILRFVLDASKQCYSRTVLHFLTVVAKYLFCGILGLNGIMLTTSP

SEQ ID NO: 156014 - protein, 152 aa, Triticum aestivum
  Clone ID: PAT_TA_50432.pep
MGRPAMESSSEEELEDDFPGHEWITPQSSIRAAYQSQTEKGIRKTCSELLELKDAIENLCGNMQSKYHAFLRISEEVVEAEQELIELQKHVSAQGMLVQDLMSGVCRELEMWQKHSKEEHAVEKDFQSELNEILSVDTQYPKVIFLDEIDIF

SEQ ID NO: 156015 - protein, 161 aa, Triticum aestivum
  Clone ID: PAT_TA_50433.pep
MIQLAIMSIARRRRLLNDDVLVSLVDSSWKILDISGSEVTDVGLATVARTCSNLWAVDISRCEKITPAAVSEIICHCPSLEILRCGGCSRSEFTARGCVNLLKPKLNTLEEDSWEELEAVDFGSGAQSLRWLVWPKIDDNSKEILALECPRVIVNPKAGTS

SEQ ID NO: 156016 - protein, 79 aa, Triticum aestivum
  Clone ID: PAT_TA_50434.pep
KGYTGLNVRNRRKNKRAHVRASAHVPFYIENKNNNFETIISRKAHKNLAGLFYGLSLTKLNRDLTKTGRTSFLPERKLL

SEQ ID NO: 156017 - protein, 70 aa, Triticum aestivum
  Clone ID: PAT_TA_50435.pep
GQSLKMDNALSEIAPPNYQTPLLAFWGPIHDHHHYCVLDVVQALMLPALDLKNGRSEQKNDLGYTCHCTL

SEQ ID NO: 156018 - protein, 57 aa, Triticum aestivum
  Clone ID: PAT_TA_50436.pep
GWDATLAHAPLRPAKGGVYSHTDRCNSQRPRTQSFRYHKLAPVGIIILFTSWVQPWL

SEQ ID NO: 156019 - protein, 133 aa, Triticum aestivum
  Clone ID: PAT_TA_50437.pep
MGLLDKLWDDTVAGPQPDTGLGRLRKLAVRPAAVKINDVAPGAAMVIPPTTPAGGEDAPMKVTRSIMIKRPAGYPSSPRSAASTPPASPLGSTPPISPFAGGGGRFRRKSSSDAYQRATTGASTSHPPPPFEV

SEQ ID NO: 156020 - protein, 130 aa, Triticum aestivum
  Clone ID: PAT_TA_50438.pep
TLAPAPADVHAAETAAAAVDAVESVRRCLSRGLRWTAVDIVKPAVDQPGDIGGSCRAGRCRSPRSRERGRLMHRTVSYLQTSLRQIHLRPVMPSPRYYSRTLPVWRPLLHRLRSIPYSPKLSLPMEQRPE

SEQ ID NO: 156021 - protein, 88 aa, Triticum aestivum
  unsure (1)..(88): unsure at all Xaa locations
  Clone ID: PAT_TA_50439.pep
AIQGGSSMYVPLVLYLRASRWFDGSYCEGQRVLCNLLLHAVVMLPHYFVIATLIPCRLSALNCPRAKFVCACLERDGPDGQGXSLRPQ

SEQ ID NO: 156022 - protein, 54 aa, Triticum aestivum
  Clone ID: PAT_TA_50440.pep
LLYLTSRSGTVPHARIGHVRHLATSFLLAQVNQLPPTDRPFTTVLTLKTLASPK

SEQ ID NO: 156023 - protein, 54 aa, Triticum aestivum
  unsure (1)..(54): unsure at all Xaa locations
  Clone ID: PAT_TA_50441.pep
DSPGRSAKLARYNKKPTITCREIQTWVRLFLPGEXLAKHTAFEGTKAVTKLTSY

SEQ ID NO: 156024 - protein, 98 aa, Triticum aestivum
  Clone ID: PAT_TA_50442.pep
APFCLYRCHKNSLRRELNLENIAHWSKAYFYLWDEPLNMEQYEVIRNISNELRTYTPDVRILTTYYAGPSGSELTPSTFDAFTKDPNVLRADTQIFCT

SEQ ID NO: 156025 - protein, 74 aa, Triticum aestivum
  unsure (1)..(74): unsure at all Xaa locations
  Clone ID: PAT_TA_50443.pep
CCGGNCGCXESVCTCGNGCGGCKMYPEMDEGVNTTCQTLIMGVAPSKGTPXFEADTDNXGCKCGPNCSCNPCTC

SEQ ID NO: 156026 - protein, 208 aa, Triticum aestivum
  unsure (1)..(208): unsure at all Xaa locations
  Clone ID: PAT_TA_50444.pep
DGIKIRRRPVTGPSVHHVGPFQFRLENEGNTPRNILEKIVWNKDVEIWQMKEKMPLYRLKGPLDNAPPARDFVAALKASYDRTALPALIAEVKKGSPSRGVLRENFEPVEIAQAYEKNGAACLSVLTDSKFFQGSFDYLEAIRNAGVKCPLLCKEFIIDAWQXYYARSKGADAVLLIAAILPDRDISYMLKICKILGMGALVEVHDER

SEQ ID NO: 156027 - protein, 140 aa, Triticum aestivum
  Clone ID: PAT_TA_50445.pep
MSPAVAALLALAVLAASANVCAAQLRRDHYAGVCPDVEAIVRGAVAKKFQQTFITVGATVHLFFHDCFVEGCDASVLIAFTANNTAEKDSTANLSLAGDGFDTVIKAKAGVDAVPRCRKRVFCADILVMGTRDPIALAGG

SEQ ID NO: 156028 - protein, 60 aa, Triticum aestivum
  Clone ID: PAT_TA_50446.pep
HMRRKAQHAKQVCDQSAEAKHTHSKHHHTVTTPISRLGSKPLLRRVSSATQDFIFNRPIV

SEQ ID NO: 156029 - protein, 55 aa, Triticum aestivum
  Clone ID: PAT_TA_50447.pep
RPFFRSSPVRPWGCSPLLRLRVAVGLFVSRCRWLSCPCRSVCLLGRLVVLVPRSV

SEQ ID NO: 156030 - protein, 121 aa, Triticum aestivum
  unsure (1)..(121): unsure at all Xaa locations
  Clone ID: PAT_TA_50448.pep
FFFFFFFFFFFFFLFFFFFHYFSMFSSSRRVLYRSDXRLFLARLNRNQTSVAPASAAAEAFLRLQRSRSATAPPPTMALMGLFVPAAPYGHRSRVFTVWPQLSQKCTRLLSSIGLCGDCGA

SEQ ID NO: 156031 - protein, 60 aa, Triticum aestivum
  Clone ID: PAT_TA_50449.pep
SNGTIISSFIVHLVLYPITIRAISFVYILYSKYGIIKILSYVMDGLRLGCNRHSSVYWRE

SEQ ID NO: 156032 - protein, 42 aa, Triticum aestivum
  Clone ID: PAT_TA_50450.pep
RTAGRIKCMQGRPIKGIKKMETLPYWTPMNAEASLKQGRLPD

SEQ ID NO: 156033 - protein, 109 aa, Triticum aestivum
  Clone ID: PAT_TA_50451.pep
QPNGKSFSRMRWPPDGIPAIRIKASQKRKSSSMFFPVHLRYGCLFSKSPIQVEELVLLGINAHRAADSTTLSMGKALGTGSAKGLLQGAVAVGGGHRRRRRKKTLCNLR

SEQ ID NO: 156034 - protein, 121 aa, Triticum aestivum
  Clone ID: PAT_TA_50452.pep
RREEEESGGEEVSLKLQKRLASSVLKCGKGKVWLDPNEVNEISMANSRQNIRKLVKDGFIIRKPQKIHSRSRARRAHEAKQKGRHSGYGKRRGTREARLPTKNLWMREMPLLRRLLRKYRE

SEQ ID NO: 156035 - protein, 148 aa, Triticum aestivum
  unsure (1)..(148): unsure at all Xaa locations
  Clone ID: PAT_TA_50453.pep
RTFQSTSTGRRSVHVGERGDLGELPRIPAKAVILLQGKXTRRKQAVIXRVFDVGYPPTASYSHYLVHSLPNYPXKKVITRDLNKKTVKMLNMMVLVKLDNFTHLMPTRXYTIHVHLMDVASEMIDSLICKYNNVTSNQADIDTLMNRH

SEQ ID NO: 156036 - protein, 115 aa, Triticum aestivum
  unsure (1)..(115): unsure at all Xaa locations
  Clone ID: PAT_TA_50454.pep
SQYTTLMPGLQYVQHGGSPARGCCTGLQNLLAEANNSPDRRTICGCXLNNVTNGASGGPYITRADALPSKCNGALRYKISPKVALELDPLERNCKRLACRVSTYVCRARSTMSGE

SEQ ID NO: 156037 - protein, 97 aa, Triticum aestivum
  Clone ID: PAT_TA_50455.pep
LCMVRSPPARRTLSSNYFEAFYVSRRDLRRDQGPFMNTGAPPTMYPGLPAATNLVRRRQRARGHGYEGSSRSGSPASPSRSMVGAACCDPGRAQEIT

SEQ ID NO: 156038 - protein, 65 aa, Triticum aestivum
  Clone ID: PAT_TA_50456.pep
VFVNIRYISLRPRLYQKLENDSTYLWYECQSASLVIMNVNITGDMYSPTDARKQAGKHIRSFRCV

SEQ ID NO: 156039 - protein, 76 aa, Triticum aestivum
  Clone ID: PAT_TA_50457.pep
SFTFLPLALMSNVKMHPEPYGHYHFIFLTQSSQHGIVAAPEVEAGDVSRRHKGQVIHAGCLCARVSPRSVCLRSRT

SEQ ID NO: 156040 - protein, 121 aa, Triticum aestivum
  unsure (1)..(121): unsure at all Xaa locations
  Clone ID: PAT_TA_50458.pep
MAAATSTVSGLAGAALTRRPAFSTSFTSGARVSARNPLMTRNLXGNGGITCMTFPRXWLRRDLNVIGVRLIGWLAPESIPVINGDSLTGLFFSNVGEELAHFPLPPGLQEQKWVWVVTWHL

SEQ ID NO: 156041 - protein, 62 aa, Triticum aestivum
  unsure (1)..(62): unsure at all Xaa locations
  Clone ID: PAT_TA_50459.pep
RGLTFDEGMEERLCTYSXRAVAHFPTAVKXFKRRNGWFYSLIHNALEGGKPDPCPLPQLASR

SEQ ID NO: 156042 - protein, 206 aa, Triticum aestivum
  unsure (1)..(206): unsure at all Xaa locations
  Clone ID: PAT_TA_50460.pep
MRKAXMESLTSPAAFVEGGVQDACDDACSICLEAFCESDPSALTGCKHEFHLQCILXSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLRILVPRVGDLPPHANPIEEAGNQSPGVLTYDAEQMLV

SEQ ID NO: 156043 - protein, 123 aa, Triticum aestivum
  unsure (1)..(123): unsure at all Xaa locations
  Clone ID: PAT_TA_50461.pep
PTTQISEPSPSPRPWRRSPPSPXPGGPQPLHTGPPPPPXPLGPAPPRHPPSRLPAPPPPPPPTPCPSCPSTYPLSPTPRRPSSPGPSAAPAPPSKTSRRSSRSSASTRVRSGGRRSPCSTRSG

SEQ ID NO: 156044 - protein, 105 aa, Triticum aestivum
  Clone ID: PAT_TA_50462.pep
MASVKLAAALALVAVCAALAATPATAFPPESCATQGSYFINCLRRGFGERCCAMVENPRCFCQVEREAEIRCVPGRSCPSRGIAKVVKVAEMHLSCMRNLKCKRA

SEQ ID NO: 156045 - protein, 53 aa, Triticum aestivum
  Clone ID: PAT_TA_50463.pep
CYSLPTWYLCIVRLSLAWITGIILLVSTLIGIRLLMNMPLTRDTLLYSCVQMD

SEQ ID NO: 156046 - protein, 142 aa, Triticum aestivum
  Clone ID: PAT_TA_50464.pep
MAPAVMASSATTVAPLQGLKSTAGLPVGRRSSGSLGSVSNGGRIRCMQVWPIEGIKKFETLSYLPPLCTEALLKQVDYLIRSKWVQCLEFSKGGFVFREHNSSPGYYDGQYWTMWKLPMFGCTDPTQVLNEVEEVNNEYPDS

SEQ ID NO: 156047 - protein, 109 aa, Triticum aestivum
  Clone ID: PAT_TA_50465.pep
GRGGQQATTSLRLYWPDMACYHHGTLLPRPCREACHDCLLQWVRRGPHYASQGRRPRPSPPVPANKGLRARYAMINYTAITMIRMMSPYLPYRRVLPEDNRWDTVWLIQ

SEQ ID NO: 156048 - protein, 42 aa, Triticum aestivum
  Clone ID: PAT_TA_50466.pep
GTSVGLDINRRRVVDLSTISFKFSRIQARQHITSFVLGDQIL

SEQ ID NO: 156049 - protein, 81 aa, Triticum aestivum
  Clone ID: PAT_TA_50467.pep
GTGLQRTQPCNMPHCRPAWVRALSSTPAAKVMPLEEQGPLVPQGLVLLPCRLQHTVLNEPQTYCSQCSGGEGHVKGYRVPG

SEQ ID NO: 156050 - protein, 161 aa, Triticum aestivum
  unsure (1)..(161): unsure at all Xaa locations
  Clone ID: PAT_TA_50468.pep
RLNCKGPCPHTVLKCGMDTGWLHPCDXHRISMAILPEHMRLMVXDGGFLMKPETITQGLDLRCPIEAMQTGRPSGYGXRRGTTEAKLPTKILCMQMMLVLMLLAGNYREDKNIDKHMYHDMYLKVTANMFNNKTVLMESIHKFKADKATEKTLSDQCEATR

SEQ ID NO: 156051 - protein, 124 aa, Triticum aestivum
  unsure (1)..(124): unsure at all Xaa locations
  Clone ID: PAT_TA_50469.pep
NDQMQQVCIXSLAAGKEGDPLWASPDAFTHYLEKNHVPXELLRPEERKLQGVGSXSCLISADDPFAVEAWAXKTYPDDTHAKVLADGAADYTRALGLELDLAENGLDLLSRRTALLADYLLVTD

SEQ ID NO: 156052 - protein, 91 aa, Triticum aestivum
  Clone ID: PAT_TA_50470.pep
RHVRLDLLYCLAFFVFLSKHIALIILCACAYHIAKGSIAKQQFSRVIVGNHGRYTVFLIFSTDLKQIDCQSHPKSMQYLSQAHMALICGPC

SEQ ID NO: 156053 - protein, 54 aa, Triticum aestivum
  Clone ID: PAT_TA_50471.pep
ARRAAARTLDLPGACTSWGEDCYELWAYQEQAIPHVRGHVEEGLTLGSGSMMSP

SEQ ID NO: 156054 - protein, 124 aa, Triticum aestivum
  unsure (1)..(124): unsure at all Xaa locations
  Clone ID: PAT_TA_50472.pep
KSYITNNEVDMVMVPDATVLMGILPRHVSTXIEELKPGDISVHDGNDVTKYFVSTGFTFLHANSITDVETCVTDAPIDHIDQCLLQKGIAEFTAKLXSTCTDLDKAEAQIGTDVHIALNAALTG

SEQ ID NO: 156055 - protein, 45 aa, Triticum aestivum
  Clone ID: PAT_TA_50473.pep
GFRSSPAAKSLAPLAPSKPPYSPIYLATVFYPDHLGITICSEGPA

SEQ ID NO: 156056 - protein, 179 aa, Triticum aestivum
  unsure (1)..(179): unsure at all Xaa locations
  Clone ID: PAT_TA_50474.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRXPGCEESGRALTSN

SEQ ID NO: 156057 - protein, 88 aa, Triticum aestivum
  Clone ID: PAT_TA_50475.pep
FAHHIVQRRCFYSTISKIGSNLYNLHNRKVSSAKSALNTSYRERTPLHHHSSVLNMTGASYSRKTETDIEGARHNEPTLKLKNSQVYC

SEQ ID NO: 156058 - protein, 60 aa, Triticum aestivum
  Clone ID: PAT_TA_50476.pep
NIYTASTLCSNACHSSPVMSCAHATCTLFFIYYSRAIPFATPKVFRVFHYGFRTDGWQLI

SEQ ID NO: 156059 - protein, 89 aa, Triticum aestivum
  Clone ID: PAT_TA_50477.pep
RAFFVVFRIHTVHYLFKHVFLFIHPINEQYISSLYKSKSHIFYSNVQYPVKYRTVDLVSVVMVLPCLAMGHNQTVVKAKRLIKVCTKST

SEQ ID NO: 156060 - protein, 80 aa, Triticum aestivum
  unsure (1)..(80): unsure at all Xaa locations
  Clone ID: PAT_TA_50478.pep
MCCCGRRLXCGTDCKCDNXIAAGCNMYPEADDAGATLXLVYATATHKASSIGMEMAAENGRCXCTHCKSGTSCGCSCCIC

SEQ ID NO: 156061 - protein, 111 aa, Triticum aestivum
  unsure (1)..(111): unsure at all Xaa locations
  Clone ID: PAT_TA_50479.pep
SSQSLLPRVHTHPCLATQVHVPASMVREQVVTRGDRHEQCVLSPGTWSGGGSCLALPWNLQRFRQLSPALPLEGTGTVCLQEFKKKNRMFGCGTEDALHREXPPSHQCRYA

SEQ ID NO: 156062 - protein, 81 aa, Triticum aestivum
  Clone ID: PAT_TA_50480.pep
LDEDHITDLTSQVCYEIKGRLYMKTLGETARRLKIDYTHMKKVGHDNQDAVPNDCAKWREDPTRASGWCLALNLIQKILCL

SEQ ID NO: 156063 - protein, 48 aa, Triticum aestivum
  Clone ID: PAT_TA_50481.pep
STCYQFCSLLTDPNPDNPVVPQIAHMYKTDQPKVIRQSLAGTHKYAMG

SEQ ID NO: 156064 - protein, 196 aa, Triticum aestivum
  unsure (1)..(196): unsure at all Xaa locations
  Clone ID: PAT_TA_50482.pep
GRXGWSSLGGIVLCITGAEAMFADLGHFSKLSLRLGFTIVVYPCLVLAYMGEAAYLSKHREDLQSSFYKALPDRVFWPVLFIATLATAVGSQAIISATFSIISQCRALGCFPRIKVVHTSSHVHGQIYIPEVNWTLMSLCLAVTIGFRDTEMIGNAYGLAVILVMFATTCLMFLVITTVWNRSVLWAALFAAGFGS

SEQ ID NO: 156065 - protein, 133 aa, Triticum aestivum
  Clone ID: PAT_TA_50483.pep
MAAAAPTQAPAMTLPAAMAAKVAPSPKPAPAGDRKVVPVMTDADEVVVQVQVQAELHVLAVDDSVVDRAVIAKILRSSKYRVTTVDSATRALELLGLGLITDVNMIITDYWMPGMTGYELLKRVKESSELREI

SEQ ID NO: 156066 - protein, 54 aa, Triticum aestivum
  Clone ID: PAT_TA_50484.pep
ARTVSLLLISADVGFLQYSAVMQEQYNAGTESGESTNTTYILILLLCCYFYFYN

SEQ ID NO: 156067 - protein, 57 aa, Triticum aestivum
  Clone ID: PAT_TA_50485.pep
AYYADHTGSLCKQTKFHPPKLYRSYTQQSNIVHCDINAEHDPRKAKINECAQPRLQN

SEQ ID NO: 156068 - protein, 176 aa, Triticum aestivum
  unsure (1)..(176): unsure at all Xaa locations
  Clone ID: PAT_TA_50486.pep
RRRGRLQPQERGEAPAVAHVNFYRNYGXKTFQETKRAYQKERLDAQLTLVRQSGLLCKRELWRVQYALRMIRNAARHWLTLEXTKNPRRILEGPALLRYMNRYGLLAXGANKLDYILALTALNFLARGLHTLVFKAGMANFIRHALVLVRQRHITVGKQIKNPPSVMERDESAQLI

SEQ ID NO: 156069 - protein, 127 aa, Triticum aestivum
  unsure (1)..(127): unsure at all Xaa locations
  Clone ID: PAT_TA_50487.pep
VGARPAHDLETSKSMDTALHERIMRKELYTDRITLXDMSYGRLSHTKTTERERCMHCRMLHEGQAFSSEIHSERQVVMKAKLEDENGEDDGVEWEEEQPAGNTLGEPYKFVDLNAEAPESADDEEDE

SEQ ID NO: 156070 - protein, 91 aa, Triticum aestivum
  Clone ID: PAT_TA_50488.pep
ATYKTLFALAYSSPSVYRLDRRPTGLTSDARGGGARYYVRACADHGGREAVHVPFLSCPRSGLTASFRAAAHLHLWSWVRALHLLREAQAS

SEQ ID NO: 156071 - protein, 51 aa, Triticum aestivum
  Clone ID: PAT_TA_50489.pep
GAQALFLYTASVGSWLCAHTKGHTSVALILHVSCSSWIEQLSWSTRTTVLF

SEQ ID NO: 156072 - protein, 79 aa, Triticum aestivum
  Clone ID: PAT_TA_50490.pep
SARWGVMFLHAAQPAGRYKAAHASPDDMSLCQTQSWFGYHKADCACVVLWIAATTAVVNILPGFATARGERNELHVCVH

SEQ ID NO: 156073 - protein, 153 aa, Triticum aestivum
  unsure (1)..(153): unsure at all Xaa locations
  Clone ID: PAT_TA_50491.pep
LRGANHGVHDRPVAGVRLPGPTGRRASRFTVRASSAEAEAAGRRAVLGLMASGVVGSAFAQVVHAGTVAAIKVGPPPPLSGGLPGTDNSDEARDFDLPLKNRFYLQPLPPAEAAVRAKXSAQDILNLKPLIDKKQWPYVMNDLRLEASYLRYD

SEQ ID NO: 156074 - protein, 116 aa, Triticum aestivum
  Clone ID: PAT_TA_50492.pep
CNFPQRRARLPLELVALVVGLMLAGNRLWQMNLWAVSASLRYHAHGEGAVADASVAAPTLVLGIVFTGNRRLPPHLGRPCLLDHVGLWWRWSQHAVLSWPRTSPSICWSQQNNHGS

SEQ ID NO: 156075 - protein, 96 aa, Triticum aestivum
  Clone ID: PAT_TA_50493.pep
ALLVSGWEWFAVLGGILFPDLFAYFSGGAYNSLMSLLGALSGKIGSAPAALAALGLWTFGVCSLCQRVRPGFLCFLFRVRGSCHLKRWCKQSPCSL

SEQ ID NO: 156076 - protein, 98 aa, Triticum aestivum
  Clone ID: PAT_TA_50494.pep
DYLIRSKWVPALEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 156077 - protein, 102 aa, Triticum aestivum
  Clone ID: PAT_TA_50495.pep
MSPVIDEEAAARQRAKEAAALPKQQQHAAPIPENPPAVNSSTARTTAKPKAKAGATVATVSSQATAPVYQGVFCRDLAVVGTLLSRSGFDRSLPVKCEAMSC

SEQ ID NO: 156078 - protein, 88 aa, Triticum aestivum
  unsure (1)..(88): unsure at all Xaa locations
  Clone ID: PAT_TA_50496.pep
GGFGGPPGRAQXLPAPPPKGGQFCLXGLYKRAPVGPVNPARPGGLFYMAGKAKWDAWKAVEAKSKGGAMVDYIPKVKPLLGGAPPAFV

SEQ ID NO: 156079 - protein, 91 aa, Triticum aestivum
  unsure (1)..(91): unsure at all Xaa locations
  Clone ID: PAT_TA_50497.pep
HPVVVSRPEKLGKTPAQVALRWGIQAGXSVLPKSTHEERIRANFDVFDWSIPSDLFAGFSEIEQTRLIRGKFWTHPEGVFKSEEEIWDGEI

SEQ ID NO: 156080 - protein, 132 aa, Triticum aestivum
  unsure (1)..(132): unsure at all Xaa locations
  Clone ID: PAT_TA_50498.pep
ACGVDTVLGDIQCVGIAQMLTHENALIVVARRDNTDETGAPMPVHHTHDMICSWGGYTLIGLXDILLPLLLLAFALTYDRPVLKTLQAGYFLWYMXAYGSGLMITYPHLNLMDGHGQPGLLYIVPFTLGTFI

SEQ ID NO: 156081 - protein, 75 aa, Triticum aestivum
  Clone ID: PAT_TA_50499.pep
LDSLLSCNLVGDLVKECQKQAHQVDVLSHVQFLPILHLLRVACYSCSKSCSRPIGCMGFTISLTSTFSASKVLLK

SEQ ID NO: 156082 - protein, 114 aa, Triticum aestivum
  unsure (1)..(114): unsure at all Xaa locations
  Clone ID: PAT_TA_50500.pep
QNIGAQVTGGNAPXEQLATQAARKFAPVTVGVKNFHRCPPGEHDGDFGEIRNVPASSRFCSSAXLLFQRLIREILQDLKTDLRLQWYIGFTLHEARDVYLXVLFYDTNLCSLHT

SEQ ID NO: 156083 - protein, 127 aa, Triticum aestivum
  unsure (1)..(127): unsure at all Xaa locations
  Clone ID: PAT_TA_50501.pep
MVGGVTFHVTNKCXFPVWPAVAPNAGHPVLAAGGFFLPPGQSERVGAPATWNGRFWGRTGCTFAGNAARCLTGDCDGRLACNGSVGTPPATLVEVSLPEDQSMGSSYDVSVVDGYNPSVAVWSWPAN

SEQ ID NO: 156084 - protein, 192 aa, Triticum aestivum
  Clone ID: PAT_TA_50502.pep
MPPMQDKHSSQELLQAQVNLWHHALGFVKSMALKCAMELQIPNTIQHHGGLMTPSELATKIGLHLSKLPRLRRLMRVLTISGIFAVHEAASPSKEVVYGLTPTTRLLVGGEVKSNLFPILSLMLDSTVIAPFFGMHSWFLDEHSASLFKKAHSLNFWEMAEQDDAYNQILNNAMVSVSNFLTDIILRECGDV

SEQ ID NO: 156085 - protein, 198 aa, Triticum aestivum
  Clone ID: PAT_TA_50503.pep
SFPGLKSHTYVHVLRFRSAVYLVRCSPRIVAVALAAQIYCFDAVTLENKLSVLSYPLQGAPGVNIGYGPMAVGPRWLAYATNTPLLSNTGRLSPQNLTPSPGVSPSTSPSSGSLVARYAMESSKQLASGIIDMGYKTFSKYRQELLPDGSNSPLSSSPGRRSGKIPSSVHPLEADNAGMVVIKDFTSKAVVSQFRAHT

SEQ ID NO: 156086 - protein, 72 aa, Triticum aestivum
  unsure (1)..(72): unsure at all Xaa locations
  Clone ID: PAT_TA_50504.pep
PGLHGTDKFHKARDSDLPLKNHFYLXTLPPREAAVLANEWDQDILNLKPVIYKKQCPNFMNDLRLRAFYLRY

SEQ ID NO: 156087 - protein, 103 aa, Triticum aestivum
  Clone ID: PAT_TA_50505.pep
RGRKKGSKAKKSVETYKIYIFKVLKQVPPDIGISSKAMSIMNSFINDIFEKLAAEAAKLARYNKKPPIPSREIQTSVRLVLPGELAKHAVSEGTKAVTKFPSS

SEQ ID NO: 156088 - protein, 109 aa, Triticum aestivum
  Clone ID: PAT_TA_50506.pep
YVHLLPKVLQTMSQGGQLQNKPCNTFPLRVKRVDITFNVHLFPGIHCGGSSYQHLNVLVHADSFKDHMNCHFCLLMQYLSPLELVNCTPLDSGSVFSFFSDPRSASSFF

SEQ ID NO: 156089 - protein, 95 aa, Triticum aestivum
  Clone ID: PAT_TA_50507.pep
LPILALGQYFNFKVYQLLGESGTYYGVRFGKKIPWVTEFPFGYIKDPQYVGSILSLVALLCWVPFQYIVLWCLGYVFMILVEDKEDPATRAKLLS

SEQ ID NO: 156090 - protein, 142 aa, Triticum aestivum
  unsure (1)..(142): unsure at all Xaa locations
  Clone ID: PAT_TA_50508.pep
SCSTVEDPIAVQDRKYHGRAQPAIHGDRDDIYQLGXFFLIVITGKPTESRSELEPLRAQLSGALAEDPHMLKDMADPTIRGTFAVEXSLSKVTEVALNCTAGDPSDRPSVDHVLWNLQYSMHVQDRWAINESLSLSVKSQAW

SEQ ID NO: 156091 - protein, 65 aa, Triticum aestivum
  Clone ID: PAT_TA_50509.pep
LPQEITPAFLFWYRTGALEHRALQAIGYDPEGICKDGAPSPGRSWRERSRGEFRNFSWLKSKSVT

SEQ ID NO: 156092 - protein, 66 aa, Triticum aestivum
  Clone ID: PAT_TA_50510.pep
YHWECYSLDVAAMQTWFRYWDQLNPRAVPTSQQKPSVFLEANTHYFPDDTETHPNYYLTFTLHTML

SEQ ID NO: 156093 - protein, 145 aa, Triticum aestivum
  Clone ID: PAT_TA_50511.pep
ILITVETRDRLRAVVIIKMAAVFLSPDGSFRVYTANACLIFLLRSASPRYDHGPIKGIPGCRTRGTGNECSVHQPRLQPQVTGQCAQALGMVRRRPSVTSGTSPDTLVIELDTFAEGERLSGSRKRGGSYVMADGSVGGYDGVRI

SEQ ID NO: 156094 - protein, 129 aa, Triticum aestivum
  unsure (1)..(129): unsure at all Xaa locations
  Clone ID: PAT_TA_50512.pep
MGLLTIEDPNTRLKPDKWSSYTCAVLDHKAHTPITTPTVTNRPEPFESDVVMGMGGYSASLXTTLPYVHLIYNPYAXTGETYTDTLLTGFPRGFVIKALDDLQXSPPNPNIAFKLLHCSHIDGPFKGHP

SEQ ID NO: 156095 - protein, 92 aa, Triticum aestivum
  unsure (1)..(92): unsure at all Xaa locations
  Clone ID: PAT_TA_50513.pep
MLRRIAATAAGGTERTRGLGMTQLAYIFAGAQRMAPEHGFTRYDGYLRGLDGEGHDDPLCEEVAKSYSSLCPSEWTVRXNQQRENGTFPEPL

SEQ ID NO: 156096 - protein, 193 aa, Triticum aestivum
  unsure (1)..(193): unsure at all Xaa locations
  Clone ID: PAT_TA_50514.pep
XLVVGPXKMLLSPSSEQKVVAELKIELEAQGLPTDGTRQVLYQRVQKARRINRSRGIPLWVPPVEDDEVVDEELDEMISRIKLEDGNTEFWKRRFLGETRNHLCEEDSKEDPDFDDELDEDDDDDDDDDSAKEADEDEIDDEVIDRTENQAGDDETKDKPAKGPNQHLQMIGVQLLKDLEKTSGSTKKLKKIP

SEQ ID NO: 156097 - protein, 153 aa, Triticum aestivum
  Clone ID: PAT_TA_50515.pep
SSAATWPFSSLAVNNVRGQFKEHPTTSVQSGRSCHRPRARCKPSGGHPARSHVLWAPTAQGESPWPSSGCCAVLRLPRTAPAPYSAAATAGGRCCLCSLSRAGAPDRRHPPPPALAPAVAASLSIPVRSILECGYASACIPGTAHTRHSPCGR

SEQ ID NO: 156098 - protein, 137 aa, Triticum aestivum
  unsure (1)..(137): unsure at all Xaa locations
  Clone ID: PAT_TA_50516.pep
QKPLQACSLLPWPPPTRKRRCLAAAATAGAAPDARAGTDADPCKIASSTCRPXPAPAPWSCXPPTPTRGATGASRRTTRPAAAXPAPTASAVPHAAVAATPSTEPAPMKPGATCKHEDDEDKQASTKTTNEPPPNVS

SEQ ID NO: 156099 - protein, 148 aa, Triticum aestivum
  Clone ID: PAT_TA_50517.pep
HSKTASIIHKYKETCSDMMDVANSSCSGDGGQSITQRKGLREALLRHNSCEELDEICRGGNWIFPRYTVVPSVSDGMFHASVRLTCPEFEMSITGGPRLTAHEARCSTAANMILELHKKADEEEQYGTWCKITTPKSRYCRWLERVVI

SEQ ID NO: 156100 - protein, 95 aa, Triticum aestivum
  unsure (1)..(95): unsure at all Xaa locations
  Clone ID: PAT_TA_50518.pep
GATQGSASEKIGRVVKAAGIKVQASWTGLFXARSGXKRSVHALILSLGSGAGGAHIXASASSPSGGRAAGRQKRAXIKVEAKEYINDDLGFSLFV

SEQ ID NO: 156101 - protein, 69 aa, Triticum aestivum
  Clone ID: PAT_TA_50519.pep
GKLRPINGMELSDFRVINQIAKSRLQRAPEFKLKTKLLLGWGLECKFPVPDLFGCKNPVQGLIQDLNSI

SEQ ID NO: 156102 - protein, 40 aa, Triticum aestivum
  Clone ID: PAT_TA_50520.pep
FGCLMFSCLFRAYFPWPGAPAFLFLEGINHPFQLMVINAK

SEQ ID NO: 156103 - protein, 176 aa, Triticum aestivum
  unsure (1)..(176): unsure at all Xaa locations
  Clone ID: PAT_TA_50521.pep
MLGCLGALFSVHRDRTHARDVRILIPNCSLLNPTPHLASMIIQHFKMREDVKSFNLSSVGCTARLIGIDLAKXMLQANHNSYAGGLKTEXITLNWYFGNDRSMLXLSNCXFRMVGAAALLSNRGADAGRAKYRLLHTVRTHKGATDECFKCVYQREDDVGKGVVSLARELMTVAGD

SEQ ID NO: 156104 - protein, 92 aa, Triticum aestivum
  Clone ID: PAT_TA_50522.pep
QETGVQASDQQGPSLPGSASSSVAVQSAARTAPVLCMAGATGEIMVPLLTYCEYPRPQPRAVSAVHTVKNHRLVIEGPWWRWLRSPSPRPGR

SEQ ID NO: 156105 - protein, 178 aa, Triticum aestivum
  Clone ID: PAT_TA_50523.pep
LQHHGPPVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 156106 - protein, 133 aa, Triticum aestivum
  Clone ID: PAT_TA_50524.pep
MDISQEQQQDFGVLLKQGAEGRVFVSTFVGRKCVIKERFSKKYRHPLLDSKLTLKRLNAEARCMTKARRLGVPTPVLYAVDPLQHTLTFEYVDGLCVKDILLGFGSNGINEERLNDIATQIGNAVGKLHDGGL

SEQ ID NO: 156107 - protein, 152 aa, Triticum aestivum; identical to SEQ ID NO: 126264
  Clone ID: PAT_TA_50525.pep

SEQ ID NO: 156108 - protein, 63 aa, Triticum aestivum
  Clone ID: PAT_TA_50526.pep
CKTGMRYKIVLQGNASNTIYCMIFCMRTFSTFQLITSFMKFDNQTVNVSNRILVKHENPMRRC

SEQ ID NO: 156109 - protein, 176 aa, Triticum aestivum
  Clone ID: PAT_TA_50527.pep
HHGPPVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 156110 - protein, 182 aa, Triticum aestivum
  Clone ID: PAT_TA_50528.pep
ASPIMPDTIISGLKKYNWGALSFDIKLCKTNNTSKSVMRAPGDAQGSFIAEAIIEHVASVLSLDANSVRQKNFHTYDSLVLFYPESTDEASTYTLHSIFDRLLTTSSYLHRAESSRQFNSCSKWRKRGISCVPLVFKVAPRPAPGRVSVLNDGFIVVEVGGIEIGQGLWTKVQQMTAFALGQ

SEQ ID NO: 156111 - protein, 175 aa, Triticum aestivum
  unsure (1)..(175): unsure at all Xaa locations
  Clone ID: PAT_TA_50529.pep
MAPAVMASSATTVAPFQGXKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 156112 - protein, 139 aa, Triticum aestivum
  unsure (1)..(139): unsure at all Xaa locations
  Clone ID: PAT_TA_50530.pep
MARYQAVRRGKSTGGKAPRQAXLATKAARKSAPATGGVKKPHRFRPGTVALREIRKYHKSTXELLILKLPFQRLVREIAQDFKTDLRLQSSGISVLQEVTNAYLVGLFEDTNLCAIHAKRVTIMRNDMHLDRRIRGERA

SEQ ID NO: 156113 - protein, 80 aa, Triticum aestivum
  Clone ID: PAT_TA_50531.pep
GTTKGIMYRPFSGVRYQSWRSPPSALTGRHPQERRPRDVAQALGLKAAHHRDAPYLNWRTPGPQRPSKLAPRRRSAGASP

SEQ ID NO: 156114 - protein, 129 aa, Triticum aestivum
  unsure (1)..(129): unsure at all Xaa locations
  Clone ID: PAT_TA_50532.pep
HGTSQPRAGAKPRRSRRAQGRRPQEEVGVEVRQGRAPVPGWASGGTLKRRYAQRVGTGAPVYLAAVLEYLAAELLELAGNAAKDNKKSRIHPEGHLLLAVRNDEELGKLLXGVTIAHGGVVPKITRCCS

SEQ ID NO: 156115 - protein, 90 aa, Triticum aestivum
  Clone ID: PAT_TA_50533.pep
AYIKPWMDPVSRFGSCTRRPHIFGWQHRVPFIQIASQSLLVQWIPSLQTPLACTPIDGLLCNHHPSLRSTDKCSHDSSVCPASVMFIKQS

SEQ ID NO: 156116 - protein, 75 aa, Triticum aestivum
  Clone ID: PAT_TA_50534.pep
RRSSRPTPGASTSNVPIGLHPTRQLLRQERPLRLTGPPLEAEDPIDPSNTAGIHYTYVRACMRSPTCLHDLRPIH

SEQ ID NO: 156117 - protein, 80 aa, Triticum aestivum
  Clone ID: PAT_TA_50535.pep
QCRGVTNYRTGNTLTLPTYNWLTAHSTFFLWRISYLRRCQPPLTTVAQPDWGMVLPLHMHFKACKSGVYAHTDRCTLPNP

SEQ ID NO: 156118 - protein, 81 aa, Triticum aestivum
  Clone ID: PAT_TA_50536.pep
AHDRRERRALRERVAAASSLCRRRKATSLCRGSRSPAGQRLYYISHDLASNQLYHDYVAGDQQHSTAGHNGPLKPNARRHE

SEQ ID NO: 156119 - protein, 99 aa, Triticum aestivum
  unsure (1)..(99): unsure at all Xaa locations
  Clone ID: PAT_TA_50537.pep
RSLXLEAKDMEPSRCALHRFGNTSSSSLWYELAYAEAKGRVKRGNRVWQIGFGSGFKCNSAVWRALRDVPAVSAPGPEEKACNPWVDCVAKYPPKEYVL

SEQ ID NO: 156120 - protein, 127 aa, Triticum aestivum
  unsure (1)..(127): unsure at all Xaa locations
  Clone ID: PAT_TA_50538.pep
PRARAPSKQLATKSARNSAPATVGVKKPHRFRPGTVALREIRKYQKSTELLIRKLPFQRLVREIAQDFKPDLRFPELMPSRAMQEAAXAYLVGLFEDTSLCSIHXAKRVTIMPKDIQFAHGIRGERA

SEQ ID NO: 156121 - protein, 86 aa, Triticum aestivum
  Clone ID: PAT_TA_50539.pep
EFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 156122 - protein, 83 aa, Triticum aestivum
  Clone ID: PAT_TA_50540.pep
VGICSHHRYHHLYVMVEECLCSKMMINGPQAMSCAVFRICPMCTSKTFLCGLGRPQATHRVGSLEYSNRVGSKPGGHEVGFLG

SEQ ID NO: 156123 - protein, 93 aa, Triticum aestivum
  Clone ID: PAT_TA_50541.pep
GVHLAINHFRSAALGDVVLARAVPVHLGRSTQVWEVKLWKMDPSEEGKKGPQISESRVTLLCNLPVPDNLHHAGDALKKYAAAATTTTPTSKL

SEQ ID NO: 156124 - protein, 75 aa, Triticum aestivum
  Clone ID: PAT_TA_50542.pep
HGAQGQHPGHQPQRAHRPQPPRQLLRQERPLRLPVPPLEEKTREIHRPQQASTIRTYVHACVHQLACMIYDPSID

SEQ ID NO: 156125 - protein, 179 aa, Triticum aestivum
  unsure (1)..(179): unsure at all Xaa locations
  Clone ID: PAT_TA_50543.pep
MAAATARQLLVHRITSSCSSXTLPKHTSSCFQAGGWNKAAKLPSFRARVTVKPPCAVPGKGGIVPADDDGVSLGTVKLPANIDVARFEGLLFQWGNSLCQGAMLPLPVPIKVDKVEGGIRLGFIGIDDGATSLLAYIDCLVSPATDGSGFVFRAITNGAMKDMXPPGEPRIMRSLLMAL

SEQ ID NO: 156126 - protein, 151 aa, Triticum aestivum
  Clone ID: PAT_TA_50544.pep
LWGFWTIIGVDLIWASSNRVDSAIACAPDCSRFRDGPFTHALEYRCMMFGVPAGVANVCRVPGGGEVHCGVKVGSQLLAELFSSAVRSESRGSAAPAVAVGVRQSLAPRPSRSPCIVASCPRYVGSSDWSLGVRLPAGRTGVHKSGVAVSG

SEQ ID NO: 156127 - protein, 165 aa, Triticum aestivum
  Clone ID: PAT_TA_50545.pep
QPHRIHLSPESQQERASQEEDASKLKKVAGKKFGGPRKKSVTRSVKAGLQFPVGRIGRLLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKTAAKSPKKATKSP

SEQ ID NO: 156128 - protein, 69 aa, Triticum aestivum
  Clone ID: PAT_TA_50546.pep
LRNVPHVPSPSQSCIQHHAQAMGLVHHGTVSALGSTNNIMQVERRVHIAKTQSSASSGVWVWHFYSGNL

SEQ ID NO: 156129 - protein, 132 aa, Triticum aestivum
  Clone ID: PAT_TA_50547.pep
CGTRAGVGMLQPASRGAGTVDMKSCNRQSSMLEDQCAARCWDATTGTPWCWNRRHGKLQPAISDAGRGRQQSELFLLESFVSFAGTSIVFARTVCMFCCNRHFFGWNHRDFLLESLGGDMFFAGTGDLFCWN

SEQ ID NO: 156130 - protein, 133 aa, Triticum aestivum
  unsure (1)..(133): unsure at all Xaa locations
  Clone ID: PAT_TA_50548.pep
GRYRCMQVWPIEGIKKFETVSYLPPISTEALLKQVDYLIRSKXVPCLEFSKVGFIFREHNASPGYYDGRYWTMXKLPMFGCTDATQVINEVEEVKKEYPDAYVRIIGFDNMRQVQCVSFIAFKPPGCEESGKA

SEQ ID NO: 156131 - protein, 86 aa, Triticum aestivum
  Clone ID: PAT_TA_50549.pep
RNNICTTCLWVHKQYLILMDGYAYAYLHAPDPTGSYHYRLTGTYIPGMVYYRLHSYCQVSAFIPCNATNTERLQFARTLMFDLIDG

SEQ ID NO: 156132 - protein, 192 aa, Triticum aestivum
  Clone ID: PAT_TA_50550.pep
MATGVTVCVTGAAGYCASWLVKLLLSRGYAVHGTVRDLCDNKTAHLRRLDNAASNLKLFKADLLDYDAMASAISGCQGVFHVATPVPSGELTDPELQMLGPAVTGTTNVLKAASAANVRRVVVVSSMVAVEINPKDWPQGKIRDESCWSDTEFCRSNESWYPVAKIAAEAAALEYGRETGLDVVTLNPALVF

SEQ ID NO: 156133 - protein, 73 aa, Triticum aestivum
  Clone ID: PAT_TA_50551.pep
SGPFFIASAWLSACRPSTAPSCSAGCPLIMSWCCRLQIGPPAGPGSLVLRSWAVTAPSPCVFLVGRKPPVPGG

SEQ ID NO: 156134 - protein, 78 aa, Triticum aestivum
  Clone ID: PAT_TA_50552.pep
EASAGGALSLGRVRFMRRAGVADDGRSALYTACFTCYRCMAEALDQLVHYLSPCNRGPSLWLSGARFISPVHLAYVGY

SEQ ID NO: 156135 - protein, 87 aa, Triticum aestivum
  Clone ID: PAT_TA_50553.pep
GLSSQPSEAWWMKLGAPHVPQAAGLLGGILNLPTLLRDATLSARRLQAHPLGHHVNLACLLRQLVRSLAQDRRLLLLGHWGRDPMLR

SEQ ID NO: 156136 - protein, 112 aa, Triticum aestivum
  Clone ID: PAT_TA_50554.pep
TTMYRMDDALWNYPCSHGLTPLLVLTTLTMTRCIYQLTLACYFDYPARLSSAICLLYSTWFVLIARSGRPIQRIRCADHLASRGHYGTCIDHLTKEWWRRLAVSYRILNKGH

SEQ ID NO: 156137 - protein, 154 aa, Triticum aestivum
  unsure (1)..(154): unsure at all Xaa locations
  Clone ID: PAT_TA_50555.pep
LITIKTVMGFRVLNGVYIGLLNLSLYFHTVGFYHMTKLAIIPCSDIIDSLXRTQSNLAIHIFLTRLLLGDPAPTLIEFQLNAPGGILSFFPIITTSMDQIMTKHYSEEMKGFXKHLLYQAYAYQSXHCDLIRLFLQRLLTNQNLFAFNYTSNGA

SEQ ID NO: 156138 - protein, 110 aa, Triticum aestivum
  unsure (1)..(110): unsure at all Xaa locations
  Clone ID: PAT_TA_50556.pep
AMGIALLRMMPNRPLLSCFAYAFPFAVSSPIGVAVGIAIHPTTQGAVADWMFRXSPMGLATGIFXXCSVSHLLSKGYKPQRPVAADTPLGRWLAVVLGVGVIPVVMIWDT

SEQ ID NO: 156139 - protein, 108 aa, Triticum aestivum
  Clone ID: PAT_TA_50557.pep
KNQNTLQNPSNLLLPLFSGHLRDSCLPAAPVTMPASAQPLAVVDEIAAQVSAGSQLRLQLSNGRFQLVMIVVATSLSSPAPARVVVLHHHVRAKPKSATKNPKKVDSS

SEQ ID NO: 156140 - protein, 95 aa, Triticum aestivum
  Clone ID: PAT_TA_50558.pep
AYATLLLNYSVLSIESKDEQSQAQILSAALEIAEDDAQDADSKYRALVAIGSLMLNGLVKSIALDLDVKSVASSAKASMDLKIAEVGADIELLTR

SEQ ID NO: 156141 - protein, 80 aa, Triticum aestivum
  Clone ID: PAT_TA_50559.pep
LLGGTMLAADHFELQVWCVALTRVRCCSNCNISKRSGLKRQWGSSYFHTCGMCSALVLWHFSQGPQVSQSIPMQFVSRGS

SEQ ID NO: 156142 - protein, 89 aa, Triticum aestivum
  Clone ID: PAT_TA_50560.pep
QGGFDLRLGSRWCPRLVLRVGLAFARGRSVRAPRPMIGTLVVTSWVPPVLPPCSIWLNASPLKDLKLPPPVSFLCVTPPALLAHGPVWF

SEQ ID NO: 156143 - protein, 105 aa, Triticum aestivum
  Clone ID: PAT_TA_50561.pep
PYFHCAQNRMLRHRLSMSVYEPTPLCPQNIRPFLHMMLVLNTLLYFGTEGVHVYFSSSQEAKTVERQWNVVLTNSYRRLSNEVNIVNMAPISGFSHAHLRACPQE

SEQ ID NO: 156144 - protein, 51 aa, Triticum aestivum
  Clone ID: PAT_TA_50562.pep
VTVDCLVRTHTRRARLDPKGVATRVNLSSIGADVLPQVTEVVPHVTCPAGR

SEQ ID NO: 156145 - protein, 161 aa, Triticum aestivum
  unsure (1)..(161): unsure at all Xaa locations
  Clone ID: PAT_TA_50563.pep
ALIEQVTARCGRQLSAEAEQLQHEXSELEXALLNKHEHVQAVYHLVMRVEQETDIXKKHAMCAQQDAADQRYXAHVLHEKYDEPMASLAQXDNRAGMAETMVKATLQYQSIQKKTLSPYSSPRASAQNDSFHECXLKIINLLEPFSLSWPDNNTGKHNYAS

SEQ ID NO: 156146 - protein, 50 aa, Triticum aestivum
  unsure (1)..(50): unsure at all Xaa locations
  Clone ID: PAT_TA_50564.pep
YVHLYMVLAQDLATAVHKXAIRRRLSASSGSGSAGAPHRRQTRSLFSSGR

SEQ ID NO: 156147 - protein, 84 aa, Triticum aestivum
  Clone ID: PAT_TA_50565.pep
SLLLISDQPCSVRLVTCPPFRSMLVGAVVHLGPISNRQQGSLGLWPHNTSVETQHHAPGPLVALLRTFPVLCDRVRARRSRRLR

SEQ ID NO: 156148 - protein, 149 aa, Triticum aestivum
  Clone ID: PAT_TA_50566.pep
SSHLHTRRHRQSASTQTSELCQQIWYSPTSRRRVAVQPAGNAGCCESPNAQYVIAMILRKAKRVRHMPMRLHTEWTDLPVCEQLTALHRQSTVAFFTWRRSLSVYEQKEPERHSKRSKIMNASVNITIYYIMETNYIMKGRSMPNEIGG

SEQ ID NO: 156149 - protein, 125 aa, Triticum aestivum
  Clone ID: PAT_TA_50567.pep
MAAMKVVLKLDVHDDRQKQKAIKLVSALHGIDQIAVDMKDQKMTVVGTVDPVAVVARLRSKPFTTAQIFSVGPAKEEKKDGDKKEGEKNDAGKQVEYLQYWYPPPPYHPHLCHLAEEDPNSCVIC

SEQ ID NO: 156150 - protein, 53 aa, Triticum aestivum
  unsure (1)..(53): unsure at all Xaa locations
  Clone ID: PAT_TA_50568.pep
QPGCKMMLPLFXRRYLDRCSFLRRXLLEPLIXLFXPLASSRRRLRPRFPVRGG

SEQ ID NO: 156151 - protein, 146 aa, Triticum aestivum
  Clone ID: PAT_TA_50569.pep
RYARTTLRADGITMVVADLGCSSGPNTLSFISEVIGAVRSCTRKSEEERRAVEVQFFLNDLPGNDFNLVFRSLEQFENLSRKDTPPYYVVGLPRSYYRKLFPSRSVHFFHSSYSLMWRSKVPEELSSCTHLSEGNIYIGKNNFTYG

SEQ ID NO: 156152 - protein, 122 aa, Triticum aestivum
  unsure (1)..(122): unsure at all Xaa locations
  Clone ID: PAT_TA_50570.pep
GRADHGGEAARQPPHLALMGNGVHRSVGGEVVHARTVMSIKVGPTXPPVSGGLPGADSSVKARDFDLPLYNRFYLGTLAPGEAAVRAKESCXYMLNLKPVMDMKEWLFVLNELRLRVFYVRF

SEQ ID NO: 156153 - protein, 161 aa, Triticum aestivum
  unsure (1)..(161): unsure at all Xaa locations
  Clone ID: PAT_TA_50571.pep
KKKTALLCAIWWPLRLSLKVPFLYRRLSRHNSHLQLFPQEQDRLIVAVHNLPHFKVPEWVLIKMKVYCDGRSCQAFANAWDFKLTEXTLERLNKSISEPSVVCRHYCGVLVTCHYTXTTGRRGQDTFVFNKRLSVLQRLLIALLLLCGSIFIILKGVFLSI

SEQ ID NO: 156154 - protein, 52 aa, Triticum aestivum
  Clone ID: PAT_TA_50572.pep
PQLTYTPSPKPPTPKPTPPTYTPTPKPPATKPPTYTPTPPVSHTPSPPPPYY

SEQ ID NO: 156155 - protein, 88 aa, Triticum aestivum
  Clone ID: PAT_TA_50573.pep
LYNSQIIGKTLQNFRIPGELGRNHYTGRTIRGTRGANTRRGHTFTVDICLALNRGAWGHHRANFGSHTTRKAGNYQWAMVRGERGLSQ

SEQ ID NO: 156156 - protein, 109 aa, Triticum aestivum
  Clone ID: PAT_TA_50574.pep
FTLRATSERSYNSLDHGTNKHTECVQRLPPLRGDGGGDDNRELGYRGTNLSPFNRQRGRLGTPLRHSIGPTGRCLRRFPVGRLRFLIQSKCGEGRAFEQIKCPQRIQQQ

SEQ ID NO: 156157 - protein, 86 aa, Triticum aestivum; identical to SEQ ID NO: 156121
  Clone ID: PAT_TA_50575.pep

SEQ ID NO: 156158 - protein, 74 aa, Triticum aestivum
  unsure (1)..(74): unsure at all Xaa locations
  Clone ID: PAT_TA_50576.pep
MQKRDQEGVYHFPNKCWANMYGYSXPMLHYSEKWAESGDRYPNITTLLLIWAVTLHRLLIGGVLIVYNTSALDL

SEQ ID NO: 156159 - protein, 84 aa, Triticum aestivum
  unsure (1)..(84): unsure at all Xaa locations
  Clone ID: PAT_TA_50577.pep
GIPRVGPTGPGTFFXIWSARPSSHIDVAVRPFFSAQGVFGIKVKIMLAWAPKGKLGPTPPVPALVPIPPPKEEAELXPPALVEV

SEQ ID NO: 156160 - protein, 107 aa, Triticum aestivum
  Clone ID: PAT_TA_50578.pep
AAPPRSPPPRRTCPRTRPRPARIPCRPPSPSRGAPSPAPAPDSMRGLTGGPVGPHLYTRGACLHVGTWCVIWVAPPAPMRMCFPCFFHPRTCWGRVAFVFLLCRSRP

SEQ ID NO: 156161 - protein, 80 aa, Triticum aestivum
  unsure (1)..(80): unsure at all Xaa locations
  Clone ID: PAT_TA_50579.pep
TAKGARTQGKQVPQPSEKKPQEKPNPARTPRGRAPRNQKKAPPPFKGPPWSAAPSLRAPPXPPHPLLFPPGPKRGGGGAP

SEQ ID NO: 156162 - protein, 52 aa, Triticum aestivum
  unsure (1)..(52): unsure at all Xaa locations
  Clone ID: PAT_TA_50580.pep
KKPPGGPLPRNLNPESPPPQTTPIGGGKGXKNPRGKPLATKPNPRKPPRPPP

SEQ ID NO: 156163 - protein, 87 aa, Triticum aestivum
  Clone ID: PAT_TA_50581.pep
CGTRLCWQRGKCPQSHKGSAGPPNRTPLGEHITHALFVVFAPLVATPLENAKAKPPLLRVVTEEAHVMHIVYLVVYAGIVRYCKWDA

SEQ ID NO: 156164 - protein, 67 aa, Triticum aestivum
  unsure (1)..(67): unsure at all Xaa locations
  Clone ID: PAT_TA_50582.pep
RLAGRGGVKRSPGLIYEEPRGVLKPLLENVIRDAVPHTEHAPRKTVPPMDVVYALKRQXRPPYGFGG

SEQ ID NO: 156165 - protein, 80 aa, Triticum aestivum
  Clone ID: PAT_TA_50583.pep
FMHSGCIHESLVIKTRKNMQLCLSSTMVVAHETVNRSHYGASTRLILLADNPVAAVSAAVRRACATVAAGWRRQRHGGGV

SEQ ID NO: 156166 - protein, 71 aa, Triticum aestivum
  Clone ID: PAT_TA_50584.pep
LYGPTVFVMVIVPGGLQLGAQVMGLGRPKGRFCTHKGYLSSLKTILLQQMPQIGHVCFETIVMLIKQATHL

SEQ ID NO: 156167 - protein, 122 aa, Triticum aestivum
  unsure (1)..(122): unsure at all Xaa locations
  Clone ID: PAT_TA_50585.pep
EKDRAPGXFFPQGWVPMPGVIPVASGGIHVWHTPALPEIFGADSVLQFGGGPLGXPWGNAPGAAANRVALDACAQPRNEGRDLAREGNEITPPPRQWTPALPAACEVWKALKXEFAPVDPIV

SEQ ID NO: 156168 - protein, 39 aa, Triticum aestivum
  Clone ID: PAT_TA_50586.pep
VVFRVRGSVFSLGAYMVCNPYACAPVEFSRDVSILDLSR

SEQ ID NO: 156169 - protein, 105 aa, Triticum aestivum
  unsure (1)..(105): unsure at all Xaa locations
  Clone ID: PAT_TA_50587.pep
PDISRSSRGSNMCGGGCRGSLIFIDLGKDMLQAKQNKTQLXLNITNNDLEWHFGNNKCILVSNCIMQMGWVGPVLYHIGDLSVRTKYLFTHKRRTHKGYTCDDIK

SEQ ID NO: 156170 - protein, 106 aa, Triticum aestivum
  Clone ID: PAT_TA_50588.pep
VALGHVSSWLPDIYGWPGTSSVKPIAFRRSRSATWLGLCTGLAVSPSSYKIRWGRPIISFLKRTAKRSLTGSCLCSRAAPGTAPSWTWTALAATVRLVASRSLSTP

SEQ ID NO: 156171 - protein, 195 aa, Triticum aestivum
  unsure (1)..(195): unsure at all Xaa locations
  Clone ID: PAT_TA_50589.pep
RPPLHNVKAKYQDKQGIPPAQQRLIFAGKQLEDGRTLADYNIQNESTLHLVLRLTGGMQIFCKTLTGKTITLEGESSDTIDNVKAKXIQDKEGIPPDQQRLIFAGKQLEDGRTLADYNIQKESTLHLVLRLRGSMQIFVKTLTGKTMTLEVESSDTIDNVNAKIQDKEGIPPDQQRLIFAGKQLEDGRTLADYNI

SEQ ID NO: 156172 - protein, 124 aa, Triticum aestivum
  unsure (1)..(124): unsure at all Xaa locations
  Clone ID: PAT_TA_50590.pep
MITSPFEGPTSVPCLSIRGCSFSAGCSGGKNIKGNKPLQLXGGLTVNIYANGRKVGKKGVYHFVDKDGANVHGYRPIYTPEEWAESGDRYAGGTTGLFIWADTLAGLLGGGVLLVXYNTSAIDG

SEQ ID NO: 156173 - protein, 159 aa, Triticum aestivum
  unsure (1)..(159): unsure at all Xaa locations
  Clone ID: PAT_TA_50591.pep
HQRPDCRLATGPGRREEGAVGRKAGGPRKKSVTRSVKAGLQFPVGRIGRYLKNGRYAKRVCTGAPVYLAAVLEYLAAELLELAGNAGNDNKKSRIVPRHLLLAVRNDQXLGRLLAGVTIAHGGVLPNINPVLLPKKTAEKEPKSPMKTAKSPKKADKKA

SEQ ID NO: 156174 - protein, 31 aa, Triticum aestivum
  unsure (1)..(31): unsure at all Xaa locations
  Clone ID: PAT_TA_50592.pep
LPTXLXXFLKKVTGTMFYVPYERSXRGKVPG

SEQ ID NO: 156175 - protein, 116 aa, Triticum aestivum
  unsure (1)..(116): unsure at all Xaa locations
  Clone ID: PAT_TA_50593.pep
MARVALVAVFAVLAALAAADMASGAATCCYVTFDDAPCMSYARGQAWAPXAACCSXGERPCNAKACTPADRKAACNCLNNLAVSGINMGNAANIPGKCWVSVSFPINTKTNCNNLH

SEQ ID NO: 156176 - protein, 66 aa, Triticum aestivum
  Clone ID: PAT_TA_50594.pep
SKSQEEPKRATCLLVFFLMKNQNLVLGIVIHFVGSPCNTCLASYLYGPLELEVPFPLMLVARVFVL

SEQ ID NO: 156177 - protein, 109 aa, Triticum aestivum
  unsure (1)..(109): unsure at all Xaa locations
  Clone ID: PAT_TA_50595.pep
VRSRPSGDGSNHLVRERAPATSCTCKHLIWIYCIMLSTTAVKLALWVYWRSLGNSIVRTNTKEPXFNVITNVDDLMAAVLGDRAVWWIYPVGAVLLAVYTIANWFGNVR

SEQ ID NO: 156178 - protein, 116 aa, Triticum aestivum
  Clone ID: PAT_TA_50596.pep
PYTHTLIHMYVFIRASMTTAFSGERRKHTRRDTWDNCCFSWSAGMYSPPALFNSVELIIFGTNLLCREHERSLFIAGPPGRAVVGREHRRIWNVFVGLYEHHLQFTKQSSSVGPQS

SEQ ID NO: 156179 - protein, 91 aa, Triticum aestivum
  Clone ID: PAT_TA_50597.pep
TAINQNSIVMPFIYVYSSHYKLQQAISINPQRTLRIHRHDQFVYLWTNLQVAGKKTMTSGVILPPINMIISNLYKGVAQYIRPDISYSVQL

SEQ ID NO: 156180 - protein, 97 aa, Triticum aestivum
  Clone ID: PAT_TA_50598.pep
GRVGLACGNEPIHLPRHSCLCATANSSSTYEYGRMMTSFELLYTLQEEHPPFYKIEPASPIDLKVPCGTYNKYVVSRMTKSTLLNNLMNSNMLPLFL

SEQ ID NO: 156181 - protein, 186 aa, Triticum aestivum
  Clone ID: PAT_TA_50599.pep
MAPTVMASSATSVAPFQGLKSTAGLPVSRRSNGASLGSVSNGGRIRCVQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIVFKPTGLRGIRQGPKQFTHHGPTY

SEQ ID NO: 156182 - protein, 91 aa, Triticum aestivum
  Clone ID: PAT_TA_50600.pep
LVVFRILVPALGVRLMFTPPLHIYTVKSHVLFSPQFSLARWEDYILLVAFCCTSFPRSLLYFRSHVPCFSAFLFPVFILNINIHLCFSSEL
